United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 34

SEQ ID NO: 146019 - protein, 323 aa, Glycine max
  Coding DNA Sequence Number=SeqID_29241
  Gene Ontology: Mol. function=protein serine/threonine kinase activity
  Homolog annotation: Hit_ID=Q9FH45; Match level="QueryCoverage=99%, HitCoverage=38%, E-value=2e-99, Identity=59%"; Hit description =Arabidopsis thaliana genomic DNA, chromosome 5, TAC clone:K2N11
MSSKVVYEGWMVRYGRRKIGRSFIHMRYFVLESRLLAYYKRKPQDNQVPIKTLLIDGNCRVDDRGLKTHHGHVGSAIKYARVNTYTHIFVLSVAMLVVFNPIRKLDVWNGGSTLIQIKIKPYKLTRMRGMHAHLVQGRPMVYVLSVYNKKEKNHRIMMAAFNIQEALIWKEKIEYVIDQHQGAQPSNGNKYISFEYKSGMDNGKTASSSDRESQFSAQEDEDEPHPNLLRRTTIGNGPPESVFDWTREIDSDLSNQNINNQAFSRKHWRLLQCQDGLRTFEELGEVDYLPRSCSKAMKAVGVVEATCEEIFKLVMSMDGTRFE

SEQ ID NO: 146020 - protein, 674 aa, Glycine max
  Coding DNA Sequence Number=SeqID_29242
  Gene Ontology: Mol. function=binding; Cellular component=nucleus; Biological process=metabolic process
  Homolog annotation: Hit_ID=Q2QTL4; Match level="QueryCoverage=88%, HitCoverage=80%, E-value=1e-102, Identity=30%"; Hit description =Pentatricopeptide, putative, expressed
  Pfam annotation: Domain name=PPR; Domain location=115-149; Score =12.5; E_value=0.25; Accession=PF01535.11; Description=PPR repeat
  Pfam annotation: Domain name=PPR; Domain location=177-211; Score =32.8; E_value=1.2e-06; Accession=PF01535.11; Description=PPR repeat
  Pfam annotation: Domain name=PPR; Domain location=239-273; Score =41.2; E_value=3.5e-09; Accession=PF01535.11; Description=PPR repeat
  Pfam annotation: Domain name=PPR; Domain location=301-335; Score =27.4; E_value=5e-05; Accession=PF01535.11; Description=PPR repeat
  Pfam annotation: Domain name=PPR; Domain location=407-441; Score =24.0; E_value=0.00052; Accession=PF01535.11; Description=PPR repeat
  Pfam annotation: Domain name=PPR; Domain location=469-503; Score =30.8; E_value=4.7e-06; Accession=PF01535.11; Description=PPR repeat
  Pfam annotation: Domain name=PPR; Domain location=570-604; Score =43.0; E_value=1e-09; Accession=PF01535.11; Description=PPR repeat
  Pfam annotation: Domain name=PPR; Domain location=605-639; Score=3.7; E_value=2.7; Accession=PF01535.11; Description=PPR repeat
  Pfam module annotation: Pfam domain module=PPR::PPR::PPR::PPR::PPR::PP R::PPR::PPR; Domain location=115-149::177-211::239-273::301-335::407 -441::469-503::570-604::605-639
MNSWRKKGSRWMGTGKSKCFWGETRDRVEMLCLKQLNSHEQGFKFQSIFPRILKSSFHNVYRVNHSRPRKPPFPFPKRTECDESLLLHYLSNGWHDDARNLLQNSSGGDLHSRVVRWTSLLSNFSRHGFVTEARTLFDIMPHRNLVSYNAMLSAYLRSGMLDEASRFFDTMPERNVVSWTALLGGFSDAGRIEDAKKVFDEMPQRNVVSWNAMVVALVRNGDLEEARIVFEETPYKNVVSWNAMIAGYVERGRMDEARELFEKMEFRNVVTWTSMISGYCREGNLEGAYCLFRAMPEKNVVSWTAMIGGFAWNGFYEEALLLFLEMLRVSDAKPNGETFVSLVYACGGLGFSCIGKQLHAQLIVNSWGIDDYDGRLRRGLVRMYSGFGLMDSAHNVFEGNLKDCDDQCFNSMINGYVQAGQLESAQELFDMVPVRNKVASTCMIAGYLSAGQVLKAWNLFNDMPDRDSIAWTEMIYGYVQNELIAEAFCLFVEMMAHGVSPMSSTYAVLFGAMGSVAYLDQGRQLHGMQLKTVYVYDLILENSLIAMYAKCGEIDDAYRIFSNMTYRDKISWNTMIMGLSDHGMANKALKVYETMLEFGIYPDGLTFLGVLTACAHVGLVDKGWELFLAMVNAYAIQPGLEHYVSIINLLGRAGKVKEAEEFVLRLPVEPNHAI

SEQ ID NO: 146021 - protein, 243 aa, Glycine max
  Coding DNA Sequence Number=SeqID_29243
  Gene Ontology: Cellular component=extracellular region; Biological process=sexual reproduction
  Homolog annotation: Hit_ID=Q850K7; Match level="QueryCoverage=88%, HitCoverage=86%, E-value=3e-59, Identity=58%"; Hit description =Expansin-like B1 precursor
  Pfam annotation: Domain name=DPBB_1; Domain location=65-143; Score =59.8; E_value=8.9e-15; Accession=PF03330.8; Description=Rare lipoprotein A (RlpA)-like double
  Pfam annotation: Domain name=Pollen_allerg_1; Domain location=157 -228; Score=-1.2; E_value=0.006; Accession=PF01357.11; Description =Pollen allergen
  Pfam module annotation: Pfam domain module=DPBB_1::Pollen_allerg_1; Domain location=65-143::157-228
MALYLFCLLLAITLIFMQTLADTSCTDCSFILGQHIIQILKNAEQMAIIGACGFGSFGATVNGGDVSAASSLYRNGVGCGACYQVRCTNSVYCSETGVTAVITDQASSDNTDFILGKHAFSRMAQTTDAAASLLALGVAFIFLSVSSVACSYPDKNITIKIDESSNNPYYLAFVIWYQQGRRDITAVQLCEIEAMGQCGLLPLHRVDPLSLRMLFSDEEEGEETWVVPVNNIPGDWKAGETYD

SEQ ID NO: 146022 - protein, 503 aa, Glycine max
  Coding DNA Sequence Number=SeqID_29244
  Gene Ontology: Mol. function=GTP binding; Cellular component =intracellular; Biological process=translation
  Homolog annotation: Hit_ID=UPI0000162CAC; Match level="QueryCoverage =93%, HitCoverage=47%, E-value=1e-128, Identity=52%"; Hit description= GTP binding
  Pfam annotation: Domain name=Arf; Domain location=304-490; Score= -72.6; E_value=0.00036; Accession=PF00025.11; Description=ADP -ribosylation factor family
  Pfam annotation: Domain name=GTP1_OBG; Domain location=49-314; Score =3.1; E_value=4.2e-10; Accession=PF01018.12; Description=GTP1OBG family
  Pfam annotation: Domain name=GTP_EFTU; Domain location=313-493; Score= -72.3; E_value=0.052; Accession=PF00009.17; Description=Elongation factor Tu GTP binding domain
  Pfam annotation: Domain name=MMR_HSR1; Domain location=316-445; Score= 132.0; E_value=1.7e-36; Accession=PF01926.13; Description=GTPase of unknown function
  Pfam module annotation: Pfam domain module=Arf::GTP1_OBG::GTP _EFTU::MMR_HSR1; Domain location=304-490::49-314::313-493::316-445
MLVFQAKCIKHMEAFTQRFISRWSVTLYARYSDTPQKKSKLAPLQERRMMDQCKIFAKAGDGGNGCSSLRKGRPDGGNGGRGGDVILECSHRVWDFSGLQRHLIAEKGGPGSSKKLIGSRGADKVARVPIGSVVHLVNGDIPSVVKTQSATDVDPWDIPGALVDDFPNPGNGSTSSVTSGEVKAMHSTSCSSSQDEETDVKKSEKSRQVALTDVFSQLSTSNGAPEFGTEDIGEKQEILYNVAELTEEGQQIVIARGGEGGLGNVSCVKDSRKPVTMAFSCQHMDNVQDPDSVLSSQQAGSPGSETVLILELKSIADVSFVGMPNAGKSTLLGAISRAKPAVGDYAFTTLRPNLGNLNYDDLSITVADIPGLIKGAHQNRGLGHAFLRHIERTKVLAYVVDLAAALNGRKGIPPWEQLRDLILELEYHQDGLSKRPSLIVANKTDEEGAEEVYKELKRRVQGVPIFPVCAVLGEGIADLKAGLKMLVSSEMSSELCLDQILLA

SEQ ID NO: 146023 - protein, 128 aa, Glycine max
  Coding DNA Sequence Number=SeqID_29245
  Gene Ontology: Mol. function=RNA-directed DNA polymerase activity; Biological process=RNA-dependent DNA replication
MDSNFLAPTFFASTPQLVFEFLWSLEDYSYMMAYLARKLLKRDQFNVLFLFEVVNREAPLWERHPQILATKKKSHLEVVRTQFDLKCETPFESSNPPPTTMLDTDTLQQLQNCIGEMERCNEEELRKL

SEQ ID NO: 146024 - protein, 110 aa, Glycine max
  Coding DNA Sequence Number=SeqID_29246
MAHFIPCKKVDACHVADLYFTEVVCLHGLPRSDEDFNLRWNSLKERGDDENQTRNNDIEEIQGLGGPMTRARAKKTKEALNQMVTTFIEPNSRLERIKPKSVNYIKQLKE

SEQ ID NO: 146025 - protein, 60 aa, Glycine max
  Coding DNA Sequence Number=SeqID_29247
VLGGGDDIIFWSREKSPRSRKWPHEEAQQVHENGVCRCNKEKGMEYSPLGGVGFQKRKHS

SEQ ID NO: 146026 - protein, 206 aa, Glycine max
  Coding DNA Sequence Number=SeqID_29248
  Gene Ontology: Mol. function=RNA-directed DNA polymerase activity; Biological process=RNA-dependent DNA replication
MDKLLKVNFIKKVRYSTRLANVIVDAYPPPNIDKLVDGASGFQVLSFLDAYFGFNQIQMHVPDKKKMTFITQDANFCYREVQKLNGRLASSSKFLPKLAKKAKLPRVPLLLFVVIEAVSSTLVQEEGKHQLPIYLTSCILHDIEKHNQMIEKGGASTYYLGLTSQAILSESSSEFDLQYKPCVFIKTQFMAYFLEEFAGNDQTTLD

SEQ ID NO: 146027 - protein, 77 aa, Glycine max
  Coding DNA Sequence Number=SeqID_29249
MAGEVPTELRALPEFGARLQINEFFNRLWASIRSIVMQIYIEYIVQACLVGNFIFKCSMETMAPRSLSVFLAINAKQ

SEQ ID NO: 146028 - protein, 203 aa, Glycine max
  Coding DNA Sequence Number=SeqID_29250
MPNEEHRTKNNVELDYGTFRYGLSLVFLFFLLLLSDFSPISFNTEGPNPSSASLTPIYRKLGHLVVLQLAQVSCFFTLNPSPWVSSASLTKTSNDFSSCARRIRPEFWQDSPREDLGFDEPVRLTKEGPWVLRAFREKRLTKGGPWPLEKRDSPREDLGFDEPLEKQDLPMGDLGFDKPLEKQPGMHPSRIMVRLTKSRAWVL

SEQ ID NO: 146029 - protein, 404 aa, Glycine max
  Coding DNA Sequence Number=SeqID_29251
  Gene Ontology: Mol. function=sugar porter activity; Cellular component=integral to membrane; Biological process=carbohydrate transport
  Homolog annotation: Hit_ID=Q1S244; Match level="QueryCoverage=99%, HitCoverage=68%, E-value=0.0, Identity=81%"; Hit description=Sugar transporter
  Pfam annotation: Domain name=MFS_1; Domain location=31-390; Score =86.6; E_value=7.5e-23; Accession=PF07690.6; Description=Major Facilitator Superfamily
  Pfam annotation: Domain name=Sugar_tr; Domain location=27-403; Score =253.0; E_value=6e-73; Accession=PF00083.14; Description=Sugar (and other) transporter
  Pfam module annotation: Pfam domain module=MFS_1::Sugar_tr; Domain location=31-390::27-403
MDERVASKTEFTECWRRTTESPYIMRLALSAGIGGLLFGYDTGVISGALLYIRDDFDQVDKKTWLQETIVSMAVAGAIIGAALGGWINDKLGRKRTILVADVVFFIGALVMSLAPSPWVIIVGRVFVGLGVGMASMTAPLYISEASPAKIRGALVSINAFLITGGQFLSYLVNLAFTKAPGTWRWMLGVAGVPAVIQFVLMLSLPESPRWLYRQNKEEEAKHILSKIYRPSEVEEEMRAMQESVEAERAEEGLIGHSLAQKLKNVLANDVVRRALYAGITVQVAQQLVGINTVMYYSPTIVQFAGIASNSTALALSLVTSGLNAVGSILSMLFIDRYGRRKLMLISMIGIIVCLIMLSVTFNQAAHHAPAISNQDTLSFGANSTCQAYTKAPNFSSWNCMHCLQ

SEQ ID NO: 146030 - protein, 42 aa, Glycine max
  Coding DNA Sequence Number=SeqID_29252
MAWSSLVTFVSENPLSELGHTMHGKRQRPRWASSLRAKRADL

SEQ ID NO: 146031 - protein, 299 aa, Glycine max
  Coding DNA Sequence Number=SeqID_29253
  Gene Ontology: Mol. function=kinase activity; Cellular component =nucleus; Biological process=protein amino acid autophosphorylation
  Homolog annotation: Hit_ID=Q9FHI1; Match level="QueryCoverage=68%, HitCoverage=96%, E-value=1e-110, Identity=91%"; Hit description =Arabidopsis thaliana genomic DNA, chromosome 5, P1 clone:MFC19
  Pfam annotation: Domain name=Mob1_phocein; Domain location=114-290; Score=383.8; E_value=2.6e-112; Accession=PF03637.7; Description =Mob1phocein family
ILTFIFWGSHKQQLVARSHTEAEYRSLAQIAAEILWMQTLLTELKVPFSTPIVFCDNQSAVAIAHNPVLHARTKHMELDVFFVLFYLILFCNRNQRTFRPKKSTPSGSKGAQLRKHIDATLGSGNLREAVKLPPGEDLNEWLAVNTVDFFNQVNLLYGTLTEFCTPENCRTMSAGPKYEYRWADGVQIKKPIEVSAPKYVEYLMDWIEAQLDDESIFPQKLGSPFPPNFKEVVKTIFKRLFRVYAHIYHSHFQKIVSLKEEAHLNTCFKHFILFTCEFGLIDKKELAPLQELIETIIPY

SEQ ID NO: 146032 - protein, 226 aa, Glycine max
  Coding DNA Sequence Number=SeqID_29254
  Homolog annotation: Hit_ID=Q1S250; Match level="QueryCoverage=46%, HitCoverage=14%, E-value=4e-09, Identity=42%"; Hit description =Thymidine kinase
  Subcellular localization annotation: CTP_CleavageSite=50; ConfidenceScore=5.87e-01
MKSLLNPKFSALSPKASPFALFSLPSSRFSFRSNPRRIPNRLLRLNPSPCSSNNFCCTIQNRSLQTEPSPPPSGEIHVIVGPMFAGKTTSLLRRIQSETTNGSLSWLDAFTVIVASCLQLLIPKVIIVLYFDLERLFLCNAIFTGLIWSTLRSSLAEDPNRVRSWKLCKGGGLSVLSQLKVIFESWVGEGNWALVPNGIGDASKSLFSDAAGIHILEIYKPHQQAD

SEQ ID NO: 146033 - protein, 574 aa, Glycine max
  Coding DNA Sequence Number=SeqID_29255
  Gene Ontology: Mol. function=protein binding; Cellular component =membrane; Biological process=defense response
  Homolog annotation: Hit_ID=Q1SW19; Match level="QueryCoverage=90%, HitCoverage=60%, E-value=1e-70, Identity=34%"; Hit description =Disease resistance protein
  Pfam annotation: Domain name=NB-ARC; Domain location=134-421; Score =85.0; E_value=2.3e-22; Accession=PF00931.13; Description=NB-ARC domain
MAETVVSLAGQHVLPRFLEVVNMLRGLKKEVEDIKKELESFQHFINDADKVAEAEQDDGKHITNKKKRVKRLREAAFSMENIIDLYDIYEDKQPGDPGCAALPCEAVDYIKTLIFWLQIELKENYGLQSKLPLEQRPISSTGNQNVTRHNLRMAPLYAEEAEEWENWEKQLLPSWFMTTWRFMHASIVEHGSVSKSYTAEGLLREMLDMLCNEKVEDPAPNFETLTRKLRNGLCNKGYVVVFDDVWNKRFWNDIQFALIDNKNGSRILITTQDTQVAQFCMKDSLIQLKLEPLSEEKSLELFCKKAFGYGFDGRYPKEYKDLGLEIIGKGQCLPLAIVAIGGLLYSKCKSAAEWKRFSQNLSLELERNSELSSISQILCLSYDDLPYNLRSCLLYFGMYPEDYDGFVKHVTGETLEEVAQQYLAELINRSLVQVSSFTINGKVRGCCVHDSIHEMILRKIKDTVFCHCIHEHNQLVSSGILRHLTIATGSTDLIGSIERSHVRKFGQFNPLEVFKLEVYTGKHRLVDLVVRNNSFEKTVVVALSGGGIVILDEVFEILPLIQLEPSASKLQFPI

SEQ ID NO: 146034 - protein, 232 aa, Glycine max
  Coding DNA Sequence Number=SeqID_29256
MQEFPERGELKRMQREQERERRRIRDRQRRQSMTQEQRERHLARRRRNYQLRRQRAANAQVPYSPFPQLQTLESSAGEASTSDELQGLTSSTFLDYGVLSQGLNQVQETFNFGSKVLEGSSIPLETLVYKPANSPRRMRLNHIKGLARNLTHSMDDDPAVTHQLVAELIAKEDQDVSAGNFGSTPKSLRLNCVKRLARSKNSPPIETADQKDLKLPSEGIQLLGNESFIGST

SEQ ID NO: 146035 - protein, 83 aa, Glycine max
  Coding DNA Sequence Number=SeqID_29257
MESKFESLPIAQVEALLLAHESRLNKSLKVFLISVADLAATVVLVAVSTIVVASTVAAKAMVVVASQNFSVRLPMKSYSKLVQ

SEQ ID NO: 146036 - protein, 141 aa, Glycine max
  Coding DNA Sequence Number=SeqID_29258
  Gene Ontology: Mol. function=thymidine kinase activity; Cellular component=cytoplasm; Biological process=DNA replication
  Homolog annotation: Hit_ID=Q1S250; Match level="QueryCoverage=99%, HitCoverage=17%, E-value=1e-53, Identity=75%"; Hit description =Thymidine kinase
  Pfam annotation: Domain name=TK; Domain location=1-116; Score=32.6; E_ value=7.6e-10; Accession=PF00265.9; Description=Thymidine kinase
LDVIGIDEAQFFDDLYEFCLQAADHDGKTVIVAGLDGYGWILHYRVHAEGVSTFTGRRSFGSVLDIIPLADSVTKLTARCEICGKRACFTLRKTQDKQIELIGGVDVYMPVCRQHYVSGQVAMEATRHVLESHKVECASHT

SEQ ID NO: 146037 - protein, 356 aa, Glycine max
  Coding DNA Sequence Number=SeqID_29259
  Homolog annotation: Hit_ID=Q6ZIK5; Match level="QueryCoverage=29%, HitCoverage=28%, E-value=2e-37, Identity=67%"; Hit description =Putative growth-regulating factor 1
  Pfam annotation: Domain name=QLQ; Domain location=13-49; Score=74.0; E_value=4.7e-19; Accession=PF08880.1; Description=QLQ
  Pfam annotation: Domain name=WRC; Domain location=67-112; Score=91.1; E_value=3.3e-24; Accession=PF08879.1; Description=WRC
  Pfam module annotation: Pfam domain module=QLQ::WRC; Domain location =13-49::67-112
MSVPPPYAAAMWTPFTAAQWHELEHQALIFKYLKAGLSVPPDLLLPIRKSLQLMSHPSLGFYGKKIDPEPGRCRRTDGKKWRCSRDAHPDSKYCDRHMIRRRYRSRKPVESSQTHSSSSSSSSSSATAASSNSNPVAGGGGGSVANVSGTATAAKTLHTLPLHTNGAREGFTFTLGNNTNTTLPHLHMNPLTLSADNTKKTYSKHGSCDVKLPNMWIIMRVRFWEFGLNSEADEHNVLQKDLGSVRYQGYDFTSDAMWSQMSHIPSNTVSESRSGSTMLGNCFQHQTMRDAELLNLETARTKDLVFSGQLSSAGGLKQEYQSPQSLFSDWDWKKDLSSSALEYKPNKDFNCNPDAN

SEQ ID NO: 146038 - protein, 287 aa, Glycine max
  Coding DNA Sequence Number=SeqID_29260
  Gene Ontology: Mol. function=nucleic acid binding; Biological process= DNA integration
  Homolog annotation: Hit_ID=Q1S7C5; Match level="QueryCoverage=65%, HitCoverage=16%, E-value=2e-18, Identity=32%"; Hit description =Integrase, catalytic region
MIQPFFSGVNKLSQLLNPISFIDLSSIHKFRYNFSLKKIVKQELKIPSMKLGSNKIKFSLHGCNRRFLRQFFLKFSDHLICPKSRSGFTIISISKREPLCVSFELSSERLEASQCMSICRRSKQFSVLLLWSEARSCFRSISIPSFKVSHRIHSIITIMESKFESLPIAQVEALLLAHESRLNKSLKVFLISVADLAATVVLVAVSTTVVVGTVAAKAMVVVASQNFSVRSISIPSFKVSHRIHSIITIMESKFESLPIAQVEALLLAHESRLNKFKQSLSESPSIN

SEQ ID NO: 146039 - protein, 312 aa, Glycine max
  Coding DNA Sequence Number=SeqID_29261
  Gene Ontology: Mol. function=zinc ion binding
  Homolog annotation: Hit_ID=Q17TI5; Match level="QueryCoverage=99%, HitCoverage=88%, E-value=1e-100, Identity=59%"; Hit description =Brevis radix
  Pfam annotation: Domain name=DZC; Domain location=123-158; Score =80.6; E_value=4.9e-21; Accession=PF08381.1; Description=Disease resistancezinc fingerchromo
  Pfam annotation: Domain name=DZC; Domain location=276-311; Score =80.0; E_value=7.4e-21; Accession=PF08381.1; Description=Disease resistancezinc fingerchromo
  Pfam module annotation: Pfam domain module=DZC::DZC; Domain location =123-158::276-311
MLKDMALKFSGAYKQCKPCTGSSTYKKGQRPYPDFDTISEGVPYPYIGGASSTSTPAWDFTSSNFLGARSDQRFMGGFSGDRTPRGPQSAPACDVVVEDEDETKEWMAQVEPGVHITFVSLPNGGNDLKRIRFSREIFDKWQAQKWWGENYDRIMELYNVQRFNRQALNTPSRSEDEQRDSSYSRMTSGHDSPMHSMSLKDWTPRNHYKPSGNNPSEAMDQGGGGQNFHAASSVEASRTTTSSRDERSMSNASDLETEWIEQDEPGVYITIRQLADGTKELRRVRFSRERFGEGHAKKWWEDNRERIQAQYL

SEQ ID NO: 146040 - protein, 252 aa, Glycine max
  Coding DNA Sequence Number=SeqID_29262
  Gene Ontology: Mol. function=protein binding; Cellular component =membrane; Biological process=defense response
  Homolog annotation: Hit_ID=Q1STK6; Match level="QueryCoverage=98%, HitCoverage=39%, E-value=8e-28, Identity=37%"; Hit description =Disease resistance protein
MGTKGATILVTTRLEQVASIMETHPAYRLIKLSQDYSWSLFKHHAFGPNREEREEIVAIGKEIVRKCVGSPLAIKTLGSLLCDEIEVTQWQNIKGRNLEVEDVGNKVRRKLYNRSFFQEAKLDGLGIITSFKMHDLFHDLARSIMGEECVKLQILKLEYFGSHNLLPKDLTPLQDLRHLVIYRCPSIADMPLNIGMLSHLRTLSTFIVDSKSGYGLDAKQSNFIKGTNVNAELVLETLEPPSTLKSFGMRGY

SEQ ID NO: 146041 - protein, 159 aa, Glycine max
  Coding DNA Sequence Number=SeqID_29263
  Homolog annotation: Hit_ID=Q1SN45; Match level="QueryCoverage=46%, HitCoverage=4%, E-value=2e-13, Identity=49%"; Hit description=AAA ATPase
MGSKIYPKVHENPRAFFSSSSPSLLESCIQYPWGWRLQLSFFLLHCAAIDLQEANDFIDEEDPRPISSTWSYITTELNVHEIKHYLDGRLNWVPPSIGELYYLRMMLAVVKGLTTYEQICTVNGQLYSSFREACFAMSFLLNDKEYIKALREAYHWGYG

SEQ ID NO: 146042 - protein, 48 aa, Glycine max
  Coding DNA Sequence Number=SeqID_29264
MESDSKKSLYPRYKRSLTLLSGVLSLVNVKVVQGLSYHLQGLLLLIEG

SEQ ID NO: 146043 - protein, 48 aa, Glycine max
  Coding DNA Sequence Number=SeqID_29265
MEFHKKTFEGQLRDVDEVFEYCLKKRELENTSASEAQMAPKKGGLDRR

SEQ ID NO: 146044 - protein, 71 aa, Glycine max
  Coding DNA Sequence Number=SeqID_29266
MASLLCREGIATGNGDLAMHGEPPVKLASSNRLCRRGAAFAGKVPTYVCPVQNFYFTTFLSYELVNNPPCI

SEQ ID NO: 146045 - protein, 81 aa, Glycine max
  Coding DNA Sequence Number=SeqID_29267
MIVSAISSTHEVSTWMRRGSRSAARGWVNRPRSIDWLAGPAARMGYEPIFLNGPWLCHIFGPAPLNPRTMRVWPVGSAGCP

SEQ ID NO: 146046 - protein, 127 aa, Glycine max
  Coding DNA Sequence Number=SeqID_29268
  Subcellular localization annotation: CTP_CleavageSite=61; ConfidenceScore=5.06e-01
MLGSALSTLVALSLNYSLFFMCLCPCAFVLSSAYTSSHPCIILAFISHPSLPSKLSCKPIRGNAAKRDEDPCVSVGNCDERTKRACCAKPLLCFMEVELSVPCCAKLNSLIVFKLWLSACLSCLAHE

SEQ ID NO: 146047 - protein, 97 aa, Glycine max
  Coding DNA Sequence Number=SeqID_29269
  Gene Ontology: Mol. function=DNA binding; Biological process=DNA integration
MFEKSLGGAYYFISFIDEHSRRVWIYLLNTKDQVIQAFKEYHVMVERETGKKLKCAQANNGGEYHDPFEAYCKTYGIELENMPPKTPQLNGVVKRMN

SEQ ID NO: 146048 - protein, 256 aa, Glycine max
  Coding DNA Sequence Number=SeqID_29270
  Gene Ontology: Mol. function=nucleic acid binding; Cellular component= intracellular; Biological process=DNA integration
MDTITDSLLNEKARRKEQGMVVQSEAIIVENCKRSENRRRSASHKKSKCRYLKRDKKIDIVKPDQIHPKKNEDKSTTTVAADQDDDVFLIGEDNYLNVACDDCSWIVDSGASFHVSPHGGFFSTYQSGDFGTIKMGNYVTRKIVGIGDITFMIDTRHKLMFKEMRHVPDMRLNLISVGKLNDVGLINHFGACKWKLTKHSMIVGRGKKEGSLYVMHGRICKGEANIAYGDSSIELWHRQLGHMSEKRLLGKTMFLM

SEQ ID NO: 146049 - protein, 78 aa, Glycine max
  Coding DNA Sequence Number=SeqID_29271
MSSTINYGILCDTILPPRELDRRLQEDWTRDAREGSRILMSLRGKLPGNHITNETSKKVGLRPQKETTPEKLAFHRFK

SEQ ID NO: 146050 - protein, 101 aa, Glycine max
  Coding DNA Sequence Number=SeqID_29272
SYLAHGLEIYPKAHENPRAFPWISSPIYLDSSSQCPCGIGLHQNSLTLSLLKDLTCLFATTRISNNEGGVGEEGGSARDTVGGDGCDDRDGEWRHLKKNFV

SEQ ID NO: 146051 - protein, 271 aa, Glycine max
  Coding DNA Sequence Number=SeqID_29273
  Homolog annotation: Hit_ID=Q8VWQ0; Match level="QueryCoverage=22%, HitCoverage=11%, E-value=8e-16, Identity=65%"; Hit description =Putative serine carboxypeptidase
MYGGLGEHHTMFYFFFESQSSKNDCVVISLTRGPRCSNELGLFCSNGPFQLTKNLSLEWNDYGWDKTNPLGRVKYHLCLCYLCFLIARLILPSSACWATSLNQTSPRRSSTKSTTLVASCSVACYFVGSPSKQRAGAPTIPTPASTLAPFYLEDHQTQNPYIPFFYQKACLASYLGSIFCRFSLGSRLMFLVLVKEGFQPRIPRQSSFFFKEFQTMQIKHLIQHPMKQTLEQLLENPRTLKSQLNKGSRYHRRINQIHIIGKQKKKSSILR

SEQ ID NO: 146052 - protein, 520 aa, Glycine max
  Coding DNA Sequence Number=SeqID_29274
  Homolog annotation: Hit_ID=Q9AR60; Match level="QueryCoverage=22%, HitCoverage=28%, E-value=3e-15, Identity=38%"; Hit description =Photoperiod responsive protein
GGGNDNDDDDDVNNNDNDRDTNGGRGDGGGIGGGGDADGGGSDNMVVVTMLVVILVAMSMVGDNGGGCGDNDRGDILISDGGSNASGNGDAGGSDDGSGVGGGTKCGGCDDIGGGDDKYGGADSNAGGDGDVVVAIDDGGGGNSVGGYGGGHNDGGGGSGGSKNWTKHASTAKRSFSMLSAIEESGRESISRSCTKREISVLSATAFTQLLHTLEKTQGIEFHSSHNAYFGKRDLEAARGATFVEIPRVPPVALAILADVEGVAFSIGETTTHRVSPLPLARHLHGVVEVVTKFLRACSAATAERCLRMLVVLATCVEGRAAMTEEPWCVAAVVERITKASKAAAADAVAVLWSLCCLCKNVKVKDDVAKRNGVVVVLLVMQRGWEEHVRSMCVDLIKVLKGARKNGGPLKQCIVHNYPCIFSYMKLETREGVSPMGEARPYVWLSRQWRKRLPPRIASATGGTLQPVHCIAVGNGGLCFLAITFGGFHAKTSVDSLVAALVSASSGAESDALSAWFETL

SEQ ID NO: 146053 - protein, 519 aa, Glycine max
  Coding DNA Sequence Number=SeqID_29275
  Gene Ontology: Mol. function=pyridoxal phosphate binding; Cellular component=cytoplasm; Biological process=amino acid metabolic process
  Homolog annotation: Hit_ID=Q58PU0; Match level="QueryCoverage=91%, HitCoverage=66%, E-value=0.0, Identity=73%"; Hit description=SpeC
  Pfam annotation: Domain name=OKR_DC_1; Domain location=146-519; Score= 733.1; E_value=1.8e-217; Accession=PF01276.10; Description=OrnLysArg decarboxylase, major domain
  Pfam annotation: Domain name=OKR_DC_1_N; Domain location=49-140; Score=61.5; E_value=2.8e-15; Accession=PF03709.5; Description =OrnLysArg decarboxylase, N-terminal domain
  Pfam module annotation: Pfam domain module=OKR_DC_1::OKR_DC_1_N; Domain location=146-519::49-140
MPSCRPNLFPIFIAEDAAMPGTMHVCTCRRALHDKRASVICCSHFPLTMRVAVAPSLSLNTARDVVTLDNTDFTDVAAVVVSLADTRSGVLTLLRQTGFNLPVFVANAFDDAVLTLPGVTGEINGAAEEWQALEQAAQAYEAELLPPFFDTLTRYVDMQNSTFACPGHQGGAFFRRHPAGRQFYEFYGENVFRSDMCNADVKLGDLLIHEGSAKDAQKYAARVFNADKTYFVLNGTSSANKVVTNALLTRGDLVLFDRNNHKSNHHGALIQAGATPVYLEAARNPFGFIGGIDAHCFDETYLREQVRQVAPQRADQPRPFRLAIIQLGTYDGTVYNARQVVDRIGHLCDYILFDSAWLGYEQFIPLMAGCSPLTLELNENDPGIFVTQSVHKQLAGFSQTSQIHKKDNHIRGQKRFCPHKRLNNAFMLHASTSPFYPLFAALDINARMHQGEAGRSMWHDCVTLGIEARKAILERCSLIQPFLPEQVHGKPWQAAETATIAADPAYFSFEPGAKWHGFA

SEQ ID NO: 146054 - protein, 129 aa, Glycine max
  Coding DNA Sequence Number=SeqID_29276
MAPNAGAQRGTRWCVFQGRKTCGVVTNVYSRKTSEKPKWKRSKEADDHNLSPRAIGLDCLWIVKEADEHNLSPRAIGLDCLWMAKEADDHNLSLRAIGLDCLWMEKEADDHNFSPHAIRLDCLWMAKGD

SEQ ID NO: 146055 - protein, 519 aa, Glycine max
  Coding DNA Sequence Number=SeqID_29277
  Gene Ontology: Mol. function=transporter activity; Cellular component= outer membrane; Biological process=transport
  Homolog annotation: Hit_ID=Q2WCM6; Match level="QueryCoverage=99%, HitCoverage=64%, E-value=2e-34, Identity=26%"; Hit description=HuvS protein
  Pfam annotation: Domain name=TonB_dep_Rec; Domain location=218-519; Score=114.6; E_value=2.9e-31; Accession=PF00593.14; Description=TonB dependent receptor
PNDQHKLSATFDYYHKTNHTHYDTWDSSSGNTIWGTAQQQSDSRRWGINLADEWTPYNEMIDTLTTRVYWQQTEAHDTTWLPTSASQYGFVYSDYNVDTLGFDTRASKTLGRHELSGGVNARVENSERPFRQEPNPGTFGTITQPQSDSRSWTVAGYLQDKINFDLDSHNFAVIPGVRVIHQSTKPKNLGDLTNGSTVLTAEQVEKLYGKTNSDTEVLPSLTFQYDINPALTTWLQYKRGVEFPTTSQLYGSWNLGSSYAGSAQYALIGNADLKTETSNNFEWGLKGQPTDGITLNTSVFYNTYKNFIAYTRYRRATNPAMFVNVPANIYTSYQAENRDKAYIYGAEISTRVNYGSWFPTVDGLSSTFALGYSEGKAKSRYLGDKYIDLDSVAPLKAIVGVAWDDKARGYGAALTATFVKGKQASATNRESYSNSGAAISDASSEYMRVPGYGLIDATAYWQLTKNVRLSSGVYNITDRKYWDYLSSRTLTSASAQERNDINLAVMPGRTWQLGVNVDF

SEQ ID NO: 146056 - protein, 104 aa, Glycine max
  Coding DNA Sequence Number=SeqID_29278
  Homolog annotation: Hit_ID=Q337A9; Match level="QueryCoverage=77%, HitCoverage=17%, E-value=6e-27, Identity=72%"; Hit description=Major Facilitator Superfamily protein, expressed
  Pfam annotation: Domain name=DUF791; Domain location=1-104; Score= -179.6; E_value=0.014; Accession=PF05631.4; Description=Protein of unknown function (DUF791)
MDVLTFSKAIFHGNGLVAILFGLFGNVLVDTLALGPVAPFDVALCFLAIGMAIILSSWTENFGDPSENKDLLTQFRGATMAIASVSMALHCSKKPGSEKGTIVL

SEQ ID NO: 146057 - protein, 349 aa, Glycine max
  Coding DNA Sequence Number=SeqID_29279
  Gene Ontology: Mol. function=O-methyltransferase activity; Biological process=iron ion transport
  Homolog annotation: Hit_ID=Q5PKX4; Match level="QueryCoverage=71%, HitCoverage=97%, E-value=1e-64, Identity=50%"; Hit description =Hypothetical protein yqjH
  Pfam annotation: Domain name=FAD_binding_9; Domain location=115-228; Score=143.2; E_value=6.8e-40; Accession=PF08021.2; Description =Siderophore-interacting FAD-binding do
  Pfam annotation: Domain name=SIP; Domain location=234-349; Score =64.5; E_value=3.4e-16; Accession=PF04954.4; Description=Siderophore -interacting protein
  Pfam module annotation: Pfam domain module=FAD_binding_9::SIP; Domain location=115-228::234-349
  Subcellular localization annotation: CTP_CleavageSite=52; ConfidenceScore=5.03e-01
SREAESAGRNPDRQAVPHARQRREVGARRCGRRSAVSRGGGNTGQPQRQAKSAAARAGRELRRTHRREKQPAFEKLLRRRKERGTVAAGRETLPNPTHHRAPQRVRNELRFRHITVASKTRVADAFWRIVFSGSDLAGFHSPSFDDHIKVFFPDTPGGALALPHMTDEGIVWPDGVRPAARDYTPLAFNGSDSLTLDFYIHDGGVASSWASAAQPGDRIAMGGPRGSCVVPVDYACQIYVCDETGLPAFKRRYQEMQAQQIHLLACVDEPVGRAYLGDLPDVTVSWLGSGKMQTEALTPLLDPIMLPADDYFIWLTGEGAAVKQLSDYFTQQRAAHSDLVRAVAYWHQK

SEQ ID NO: 146058 - protein, 340 aa, Glycine max
  Coding DNA Sequence Number=SeqID_29280
  Gene Ontology: Mol. function=heat shock protein binding; Cellular component=chloroplast thylakoid membrane; Biological process =response to heat
  Homolog annotation: Hit_ID=Q7N8Y3; Match level="QueryCoverage=99%, HitCoverage=100%, E-value=1e-112, Identity=66%"; Hit description =Chaperone protein dnaJ
  Pfam annotation: Domain name=DnaJ; Domain location=5-67; Score=140.3; E_value=5.2e-39; Accession=PF00226.21; Description=DnaJ domain
  Pfam annotation: Domain name=DnaJ_C; Domain location=188-309; Score =275.9; E_value=8.1e-80; Accession=PF01556.9; Description=DnaJ C terminal region
  Pfam module annotation: Pfam domain module=DnaJ::DnaJ_C; Domain location=5-67::188-309
MAKSDFYEILGVSKSADEREIKKAYKRLAMKYHPDRNPGDKEAETKFKEVKEAYEILTDAQKRAAYDQYGHAAFEQGGGGGFGGGFGGGGADFSDIFGDVFGDIFGGGRRQRASRGADLRYNMELTLEEASVMSATAAAPKRAPSRRPARPVTVRARSVQRPVTATAAFERQKTLSVKIPGGPSIPGDRIRLSGEGEAGEHGAPAGDLYVQVSVKKHPIFEREDNNLYCEVPINFAMAALGGEIEVPTLDGRVKLKVPAETQTGKLFRMRGKGVKSVRGGAVGDLLCRVVVETPVSLNDKQKALLRELEESFGGPTGEKNSPRSKSFFDGVKKFFDDLTR

SEQ ID NO: 146059 - protein, 131 aa, Glycine max
  Coding DNA Sequence Number=SeqID_29281
  Gene Ontology: Mol. function=transporter activity; Cellular component= integral to membrane; Biological process=transport
  Homolog annotation: Hit_ID=Q393U1; Match level="QueryCoverage=85%, HitCoverage=23%, E-value=3e-19, Identity=45%"; Hit description=Major facilitator superfamily (MFS_1) transporter
  Subcellular localization annotation: CTP_CleavageSite=19; ConfidenceScore=5.55e-01
MPASPASSPAPLTPAARRYAMLAVSLSISMATLDTSMTNTALPSMASQLGVGAADVIGVVTVYQLVMVATMLPLAALAGKIGHRRVFLPALWLFLAASVWCGAAQSLWSLEAARAAQGLAAAALMGCNMAL

SEQ ID NO: 146060 - protein, 187 aa, Glycine max
  Coding DNA Sequence Number=SeqID_29282
MAILGLLVAVHVGGSLRNEEFAWNQPSLDTTWSMTWPTNILVFSGLRLCMEGCGVVLTKFRGYSGRVIEVMKKPASGKRKWGWQNSGLISAGLIEVGGWHCHSPSLFNNTIHLALPFQFHGLKLKSHSSMRCSRVVYITFCIGLFIISARGGRKAGYTRGSFYGVPGSCYINFIWVFHHWCLGRPYY

SEQ ID NO: 146061 - protein, 68 aa, Glycine max
  Coding DNA Sequence Number=SeqID_29283
QPQSAEPGFRSFCVPTLDQFRAELAWPGDWPEDQTEEAPAGAPDGAEDTRMDEEMTDLLGFMRGSGAT

SEQ ID NO: 146062 - protein, 68 aa, Glycine max
  Coding DNA Sequence Number=SeqID_29284
  Gene Ontology: Mol. function=nucleotide binding; Cellular component =endoplasmic reticulum; Biological process=response to heat
  Homolog annotation: Hit_ID=P09189; Match level="QueryCoverage=91%, HitCoverage=9%, E-value=2e-13, Identity=61%"; Hit description=Heat shock cognate 70 kDa protein
MTEIAEVYPETTIRNVVVPVPVYLNDPQRQTTKDVSVISGLNMMQTIHVSTTATIFYGLGKKAIRFMG

SEQ ID NO: 146063 - protein, 144 aa, Glycine max
  Coding DNA Sequence Number=SeqID_29285
MVASHGCLYLYSGHAIPYHPLDHFFWLQPLHTAIHPQPPLQEPSLLSQHPHSLYVHPTQSFGIDFESTRIRLLALCGTTTLQTVRTMPTSPSMDFTVTLEHQNTGTSSIVHLLANSKPHTPMPSKEDDPPSSVIVQTTYPSVDI

SEQ ID NO: 146064 - protein, 75 aa, Glycine max; identical to SEQ ID NO: 142399
  Coding DNA Sequence Number=SeqID_29286

SEQ ID NO: 146065 - protein, 191 aa, Glycine max
  Coding DNA Sequence Number=SeqID_29287
  Gene Ontology: Cellular component=clathrin vesicle coat; Biological process=ER to Golgi vesicle-mediated transport
  Homolog annotation: Hit_ID=Q93Y22; Match level="QueryCoverage=73%, HitCoverage=29%, E-value=3e-20, Identity=42%"; Hit description =Coatomer delta subunit
MKRKASEIDKSKIEKSRGDKGGFGPLQLMGSGRIENSFSDLSISSSGTGFESGSGFGLTSDVDSFATKPKGHPTSSATAPPKGLGMKLGEVILEDVQPKHSESWVVAPQLTDPITLTVEEKLNIIARQSWSDSVTDIRRNLEDKWVASALFWAYGCYLHPFVWYCYHYPPLENQPYPQGWAIKTSRYRGWV

SEQ ID NO: 146066 - protein, 69 aa, Glycine max
  Coding DNA Sequence Number=SeqID_29288
MENIFGFKSAYILKQDSLPTSYKSFLNKHGGKDPVILQGVKDIASGKPFTNLGAIEKYYKTMGIDVKLN

SEQ ID NO: 146067 - protein, 115 aa, Glycine max
  Coding DNA Sequence Number=SeqID_29289
MAKIQGPKEEKTYSNIYKEEWTQPWSMGSEIYLEVHENPRAFFSSSSPILLESSIQYPWGLFSDPLHGLPSPAKHFFSDDCNSKDNHFIFVEAKLHDESKMIQRCFDDNNDDNKR

SEQ ID NO: 146068 - protein, 114 aa, Glycine max
  Coding DNA Sequence Number=SeqID_29290
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=77%, HitCoverage=7%, E-value=4e-27, Identity=56%"; Hit description=Chromo
MEPELAMILYTYRTVFDLPSGLPPSRTHNHSIPLVEGAGPEGIIAPSRSPFSPPIILVKKKDGTWIFCTDYRALNAITIKDSFPIPTVENKKEVQSICIEVIELCMVHKRNKQS

SEQ ID NO: 146069 - protein, 126 aa, Glycine max
  Coding DNA Sequence Number=SeqID_29291
MGSSQKPSLKKRFYQVKIKSLEVTSLRKFGQLMGQLQRQAFRKAYAVEVLHLWGLPAITNGIRPPKASRKWGGRNTEKIFGGSPLSKCGWVGGPGSDRRFSRPIITTRESPVVAMLADLYDTFDRR

SEQ ID NO: 146070 - protein, 72 aa, Glycine max
  Coding DNA Sequence Number=SeqID_29292
MYKCVVTRMCWMSLYVDEMAPRKLSSKRSRKDAAAAGTSAAPEFDSHRFRSTEHQQRFEAIKGWSFHRERRV

SEQ ID NO: 146071 - protein, 289 aa, Glycine max
  Coding DNA Sequence Number=SeqID_29293
  Gene Ontology: Mol. function=hydrogen:sugar symporter activity; Cellular component=integral to membrane; Biological process=transport
  Homolog annotation: Hit_ID=Q5I3L7; Match level="QueryCoverage=70%, HitCoverage=49%, E-value=3e-93, Identity=82%"; Hit description=Aec46
  Pfam annotation: Domain name=LacY_symp; Domain location=68-289; Score= -27.0; E_value=3.4e-17; Accession=PF01306.10; Description=LacY protonsugar symporter
  Subcellular localization annotation: CTP_CleavageSite=79; ConfidenceScore=5.49e-01
MASGLSSENMLTTKLFQPWARAVSSIESVISTENGVVTVSSASTPMVLGVARAPRIFFADSARDTVISETLASFATSFRDAMVITPEVGLKAGDTGIIYAVLSVSALFAQICYGFIQDKLGLRKNLLWYITVLLILSGPAYLLFGYLLKINVLLGSIFGGIYIGLTFNGGIGVLESYTERVARQSQFEFGKARMWGSLGWAVATFFAGLLFNINPQLNFAVASCSGLVFFMLLARLKVSSAPHAMQEAVSGGKVTLEDALRLLTLPRFWALVFFVVGTCIYGVYDQQFP

SEQ ID NO: 146072 - protein, 148 aa, Glycine max
  Coding DNA Sequence Number=SeqID_29294
  Homolog annotation: Hit_ID=Q8H612; Match level="QueryCoverage=99%, HitCoverage=25%, E-value=7e-43, Identity=57%"; Hit description =Pentatricopeptide (PPR) repeat-containing protein-like
  Pfam annotation: Domain name=DUF247; Domain location=2-147; Score= -171.1; E_value=0.016; Accession=PF03140.6; Description=Plant protein of unknown function
MINKPPSVEEITIPSVTELLNAGVRFLPTIGSISNISFNAKTCTFYLPAIGLDVNTKVFLKNLVAYEASVALGPLVITRYTELMNGIIDSEEDAKALREKGIILNHLKSDKEVANLWNGMSKSLRLSREPLLDKVIEDVNKYYNGRMK

SEQ ID NO: 146073 - protein, 84 aa, Glycine max
  Coding DNA Sequence Number=SeqID_29295
MLIDVGNALACACCVCSWGALCTDLPGSLALAFGHEHTLYGVYVMGGGLSPGREHLWAPRLITYGRGLLRAHRVVSTNSAQFPK

SEQ ID NO: 146074 - protein, 48 aa, Glycine max
  Coding DNA Sequence Number=SeqID_29296
MVLITPLMCWRIPILSSLVYFLVLVLLLLMSFRPYSFLVVVWSLNKLG

SEQ ID NO: 146075 - protein, 212 aa, Glycine max
  Coding DNA Sequence Number=SeqID_29297
  Gene Ontology: Mol. function=transition metal ion binding; Biological process=DNA integration
  Subcellular localization annotation: CTP_CleavageSite=42; ConfidenceScore=5.24e-01
MKDSPTSPESSTYTLSGTSTLILSTPPIAKCPSYHLYGTRTSGASISSTKTITVVVSIIIVNFMRLEVSPDIVHPYASPLLGFIGERVETRGYVDLMTTFGQGKLSRSFTIRYLLVDATTSYFALIGRKTLKELGAISSMPHLTTKFPTLTWEIVIVKADQKDLSAHEYMCLADMLRKNIDLFASQPSEMSRIHLDIIFHQLAIWPQAKQVS

SEQ ID NO: 146076 - protein, 69 aa, Glycine max
  Coding DNA Sequence Number=SeqID_29298
MAKDLSALHKKGTWDIVPLPPRKRDTQLAWLPREFLNSMIQKQSQKEGQNGLFIKIYDPKFAQTSNQLA

SEQ ID NO: 146077 - protein, 103 aa, Glycine max
  Coding DNA Sequence Number=SeqID_29299
  Gene Ontology: Mol. function=serine carboxypeptidase activity; Biological process=proteolysis
  Homolog annotation: Hit_ID=Q1EP77; Match level="QueryCoverage=61%, HitCoverage=13%, E-value=5e-15, Identity=68%"; Hit description =Serine carboxypeptidase (Carboxypeptidase D), putative
MKLHSLASYLSQEILAEQEVDRVHGLPAQHPVKFNNMVVISLSMKLKEEHCSIGFSRPLTNQNKNAFSYGSMENHKPEGQEVSAAGVNIDNHMNEGSGWINSA

SEQ ID NO: 146078 - protein, 161 aa, Glycine max
  Coding DNA Sequence Number=SeqID_29300
MARYISLGRAHNLHESVILRLVAGDKNTTFTVHIDGLAHHHSNLKPIIYRRRYIFTVDITDDMLQQNLPLTLPAAASKFVYGSKKSITIHHRLSKSTKWPLTIHHDVPAITQPWFNLIHEKNLKAGDEVVFYYRFHDHAWELLIRKAIEWNNSNTDPDSDD

SEQ ID NO: 146079 - protein, 114 aa, Glycine max
  Coding DNA Sequence Number=SeqID_29301
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=77%, HitCoverage=7%, E-value=3e-27, Identity=56%"; Hit description=Chromo
MEPELAMILYTYRTVFDVPSGLPPSRTHNHSIPLVEGAGPEGIIAPSRSPFSPPIILVKKKDGTWIFCTDYRALNAITIKDSFPIPTVENKKEVQSICIEVIELCMVHKRDKQS

SEQ ID NO: 146080 - protein, 78 aa, Glycine max
  Coding DNA Sequence Number=SeqID_29302
ALQEKVDDNPGEAVGDDGVYGIADVGNPGPSQGGEVEVLSGDLDDSRVELLTVEEDRWVVVEEEAGSDAGIEAEEGEG

SEQ ID NO: 146081 - protein, 117 aa, Glycine max
  Coding DNA Sequence Number=SeqID_29303
  Subcellular localization annotation: CTP_CleavageSite=24; ConfidenceScore=5.21e-01
MSLPRAVHVSSTFESGAPRISFPSAVRQFSILHCFRSPMNVIAQQCSCILHLRVWSPVKLLHSAVRKFSILHFFSEPHECHCLALFMCPPPSSLEPRECHCLALFANSPFSTFFGAP

SEQ ID NO: 146082 - protein, 268 aa, Glycine max
  Coding DNA Sequence Number=SeqID_29304
  Gene Ontology: Cellular component=membrane; Biological process =transport
  Homolog annotation: Hit_ID=UPI0000680675; Match level="QueryCoverage =92%, HitCoverage=83%, E-value=4e-70, Identity=58%"; Hit description =integral membrane protein
AFSGAGCPRHLGIARGLCRADPGGHLAALALDAGAASGLGASAFRRGAGRHEPAVLHGAAHHSLRPGRGHRVLGAAGRGHLPLAPARGFCLACAGGGGAGPDPAHRRCQRRRPGTGARGHCLRRGRRHLLGAVHPAGPAAGQHSQRPGRVAGPGVRRHGGGALRRGRGGGQAAAAIHTSFRVDGCGHLQRLALHAGDDGAAPPAARTFGIALATEPAIAALMGMLLLHEQLVGTQWLAIACIMGAAMGSAITRPAAAAKAPAEVASAG

SEQ ID NO: 146083 - protein, 299 aa, Glycine max
  Coding DNA Sequence Number=SeqID_29305
  Gene Ontology: Mol. function=transcription factor activity; Biological process=regulation of transcription, DNA-dependent
  Homolog annotation: Hit_ID=Q0B5J3; Match level="QueryCoverage=99%, HitCoverage=98%, E-value=1e-107, Identity=63%"; Hit description =Transcriptional regulator, LysR family
  Pfam annotation: Domain name=HTH_1; Domain location=8-67; Score=77.4; E_value=4.5e-20; Accession=PF00126.17; Description=Bacterial regulatory helix-turn-helix protein, lysR family
  Pfam annotation: Domain name=LysR_substrate; Domain location=91-297; Score=156.9; E_value=5.2e-44; Accession=PF03466.10; Description=LysR substrate binding domain
  Pfam module annotation: Pfam domain module=HTH_1::LysR_substrate; Domain location=8-67::91-297
  Subcellular localization annotation: CTP_CleavageSite=39; ConfidenceScore=5.09e-01
MSRKFDYLGDVEVFITVVEHGSFTAAAVALSTTPSVLSRAVSRLEMRLGRQLLQRTTRRVGLTEAGRIYLEQARSAFSLLDDAERDGRGQEGDLTGRVRISVPTTYGHYCLPPLLARFSQQFPRVQVELNITNRNVDLIAEGFDLAIRLGQMPDSGFVARKLQDAALLLVASPAYLHRMGMPQTLDELRQHMCLPFIMPCTGRIAPWVFRVDERDVDWQPDSTIEISDDVLGVVSLAEHGIGVCQSYEFIVREKIQRGQLVEILPQLRGRSRPFSLIYAPHRRQSAATRAMIDLLASEQ

SEQ ID NO: 146084 - protein, 87 aa, Glycine max
  Coding DNA Sequence Number=SeqID_29306
MYDTLQTDSKKPLYPTCKNSLTLLSVVFGLFNDNFPLYIKHEDLFEIAHGGQCLSISVIQLWIFALKGLDDTPQSKSKVVAKWIVVK

SEQ ID NO: 146085 - protein, 65 aa, Glycine max
  Coding DNA Sequence Number=SeqID_29307
MLQCEGLFSKLRYDFEIPNGETVWNWVTNMIFKFHDDPTVWWAAGRRKGFERRRGKTKMRPKGGS

SEQ ID NO: 146086 - protein, 50 aa, Glycine max
  Coding DNA Sequence Number=SeqID_29308
MVVLGHAQTPLEKALGFLAVVLGAGNAAGGYVVTARMLEMFKPSAPIGWP

SEQ ID NO: 146087 - protein, 187 aa, Glycine max
  Coding DNA Sequence Number=SeqID_29309
  Gene Ontology: Mol. function=transcription factor activity; Biological process=regulation of transcription, DNA-dependent
  Homolog annotation: Hit_ID=Q4UR96; Match level="QueryCoverage=45%, HitCoverage=37%, E-value=1e-21, Identity=56%"; Hit description=ECF sigma factor
MPWMKLEPDISGVCRITGTREMITWPVMSASMKMYSATNPSLTGNAPALSSSSHHNHGLNPACTRRQPKRRSRVVDGDPERGTVPCAGEQPRPPERRDRCPAGIAGGVPGQRRPASVPLRRGRPAPARRRHGRSAGRTAAHAGLRRQAGGRMGAAVLEHPAPARDRHTAPAPLPPAVLARQPGRGRR

SEQ ID NO: 146088 - protein, 81 aa, Glycine max
  Coding DNA Sequence Number=SeqID_29310
MTTLASACYQTLSLTNSEIVCAGYRIGHLRVPTDSQVTIAKGGVVDKSRAFAPTYPQFVMRNSDLRSSCFCVTKIFSVFLH

SEQ ID NO: 146089 - protein, 256 aa, Glycine max
  Coding DNA Sequence Number=SeqID_29311
  Gene Ontology: Mol. function=acyltransferase activity; Biological process=aromatic compound metabolic process
  Homolog annotation: Hit_ID=UPI00005FA8E6; Match level="QueryCoverage =92%, HitCoverage=88%, E-value=2e-73, Identity=56%"; Hit description =COG0596: Predicted hydrolases or acyltransferases (alpha/beta hydrolase superfamily)
  Pfam annotation: Domain name=Abhydrolase_1; Domain location=41-250; Score=41.8; E_value=2.4e-09; Accession=PF00561.10; Description =alphabeta hydrolase fold
  Pfam annotation: Domain name=Thioesterase; Domain location=16-252; Score=-41.3; E_value=0.025; Accession=PF00975.10; Description =Thioesterase domain
  Pfam module annotation: Pfam domain module=Abhydrolase_1::Thioesterase ; Domain location=41-250::16-252
MMLATRILQQGEAGRPWLVWLHGLLGNNNEWRVIAARSPEWPSLAIDLPGHGDSVAVSCRGFDDISAQIAAALQLRNIERYWLVGYSLGGRIAMYHACHGHHAGLQGVIVEGGNPGLEDEEQRRRRCEQDALWAARFRSEPIAEVLADWYQQPVFKELSHVHRQALIAARSVNSGPAIADMLEATSLGRQPYLAPQLRQLTVSLRVLCGENDPKFQRLARDAGLPLRIVPQAGHNAHLANPQDFVAELQTFLVNPG

SEQ ID NO: 146090 - protein, 55 aa, Glycine max
  Coding DNA Sequence Number=SeqID_29312
MGDQEEFGAEVAWPGDWLDAQAGEEPVGSPGEAEESRIDEDMTDLLGFLGGSGAT

SEQ ID NO: 146091 - protein, 229 aa, Glycine max
  Coding DNA Sequence Number=SeqID_29313
  Gene Ontology: Mol. function=amino acid-polyamine transporter activity; Cellular component=membrane; Biological process=amino acid transport
  Homolog annotation: Hit_ID=Q66D01; Match level="QueryCoverage=99%, HitCoverage=56%, E-value=9e-83, Identity=68%"; Hit description=HAAAP family tyrosine:H+ symporter, tyrP precursor
  Pfam annotation: Domain name=Trp_Tyr_perm; Domain location=1-217; Score=130.9; E_value=3.5e-36; Accession=PF03222.4; Description =Tryptophantyrosine permease family
MTLPLEQGLALSAIPVIFTSFGFHGSVPSIVNYMGGNIRKLRWVFIIGSAIPLMAYIFWQLATLGSISSDTFVGILAQQAGLNGLLQAVRDAVASPHVELAVHLFADLALATSFLGVALGLFDFLADLFKRQDNVRGRLQTGAITFLPPLAFALFYPRGFVLALGFAAIALSVLALLLPSLLVWKTRQKHQAQYRVWGGTPALALVFVCGVTVIAIQLGIASGMLPAVG

SEQ ID NO: 146092 - protein, 85 aa, Glycine max
  Coding DNA Sequence Number=SeqID_29314
  Subcellular localization annotation: CTP_CleavageSite=67; ConfidenceScore=5.20e-01
MASMDTSAKVNSKIFPCNIGMRGSGEFIPFLDTTSRGSKVPQRTFLRRRHGPSVGLFTQGIKTEPICDAYAKDTMRECTQYDDIY

SEQ ID NO: 146093 - protein, 62 aa, Glycine max
  Coding DNA Sequence Number=SeqID_29315
MERCNLHKRLTNLVDGSIDLALVLPTDYREIEAALCIPGRGFILNTEGHPRRILGKDLTTLA

SEQ ID NO: 146094 - protein, 202 aa, Glycine max
  Coding DNA Sequence Number=SeqID_29316
MPISPCRCIVDLCRHDIGKVAPTRRPVDPKKSNRALGFPALVTGLCQSYRVPVPPARSCHRDIGKDRAHKTPSGPKEVQQGPGVSNSDYGPLSVLQGARPPASSCHRDIGKGHARKTLSGLEEVRQVLELPALITGLCQFYGVPVIPSKVISPPTNRAFIKKYCVPKQAQGETPQQPGDGRQRATDASPSPLEFTSAHPQKG

SEQ ID NO: 146095 - protein, 119 aa, Glycine max
  Coding DNA Sequence Number=SeqID_29317
  Gene Ontology: Mol. function=anthranilate synthase activity; Biological process=folic acid and derivative biosynthetic process
  Homolog annotation: Hit_ID=Q6TAS3; Match level="QueryCoverage=83%, HitCoverage=10%, E-value=7e-35, Identity=70%"; Hit description =Aminodeoxychorismate synthase/glutamine amidotransferase
MHSHKEEESNERKRKLQEPVLVPVQKADFVRTLLIDNYDSYTYNVYQELSIINGVPPVVIQNDDWTWEELCHYLYEENAFDNIVISPGPGSPACPEDIGEDLRMPLWIDNFTTFASCFK

SEQ ID NO: 146096 - protein, 190 aa, Glycine max
  Coding DNA Sequence Number=SeqID_29318
  Homolog annotation: Hit_ID=Q00TU5; Match level="QueryCoverage=96%, HitCoverage=19%, E-value=1e-39, Identity=50%"; Hit description=[U] KOG2211 Predicted Golgi transport complex 1 protein
  Subcellular localization annotation: CTP_CleavageSite=13; ConfidenceScore=5.01e-01
MLQLSSNAHGDVFSAARGPLFAARLALAERVLRSFVTHASLIRKMDTGAKMRLVKECDEISHAVATHLRVSGSEADSSAFKSIKAFKSLVLLPTENIEASPLVRDVDPRSLLHHLYSRAPADALSTPAERASLNAAQYASRLLNKMNDAEVWRGVKATLDVYDETAKTGRDGADAVVTLMRAVGERLAKK

SEQ ID NO: 146097 - protein, 161 aa, Glycine max
  Coding DNA Sequence Number=SeqID_29319
  Homolog annotation: Hit_ID=Q01BP9; Match level="QueryCoverage=60%, HitCoverage=60%, E-value=1e-29, Identity=66%"; Hit description =Chromosome 03 contig 1, DNA sequence
MRTVRVVGSDNRKVIGLRYPASLLPYVKETVEMQWAEKFTDPSSLALLDGDGDENLNAILGVTVEAPTAIDPVSFAKCFRKTQTIMDFFGGATKTKHAPVDLTATDDGGRSKKKKKSTNPFTVAASAAKTCCVCGKKFPATMLNAEMNAHLDKCLADGEPL

SEQ ID NO: 146098 - protein, 140 aa, Glycine max
  Coding DNA Sequence Number=SeqID_29320
  Gene Ontology: Mol. function=RNA-directed DNA polymerase activity; Cellular component=signal recognition particle, endoplasmic reticulum targeting; Biological process=RNA-dependent DNA replication
MKVEQLFACHHISEERKVPLATLSFRRYVLYWWTSLVRERRIHGDPLVKYWNDLKSALRKRHFPSYYERELMDKLQMLRQGSMNIGEYREQMELLLLRAGLREEERTSIARFLSWLNMEVRDKVELLPYRDLDELVQLCI

SEQ ID NO: 146099 - protein, 141 aa, Glycine max
  Coding DNA Sequence Number=SeqID_29321
MDMNMGYLISHQISLTAQHDSSRLGFPALITALCKARGVQLDSRSLESLSPTINLAYIKKNRWNLDDPIVTFRGPRKARGKRSEVPTTSAPPETAAPSSSTALVPPIQTLAIPQASTQIPPPAPLSSGPSYFSFTPQIVSA

SEQ ID NO: 146100 - protein, 76 aa, Glycine max
  Coding DNA Sequence Number=SeqID_29322
MGETHEAPRDHNLADFEPYLGYATEGEVVGGVPLPGTLGGPQFRPQPQPLHFTMGEVPPAWGISLVPTYSSIAMRK

SEQ ID NO: 146101 - protein, 113 aa, Glycine max
  Coding DNA Sequence Number=SeqID_29323
MEPTAGKPGSLRNLLIRFLLFGVLVIGVRFAYLIAVAGESCTIDDFCFFSLPDTLSLVIAGTGPLAVESASAAGGLVQPELYTSKDWINGVRFYSSAFQDLIAGGYLSPESKT

SEQ ID NO: 146102 - protein, 128 aa, Glycine max
  Coding DNA Sequence Number=SeqID_29324
MLQSIHQGQIILLQSLQVVAPPGSIPSIEQFLERVRPETATTLERSLEGTSEPLALVVDLSSPQPATDPFTPVVDKLEDQMIGRQRRRGEGRHHPLGNKPWKKELHHQECALDEKLEEDALMEEKKER

SEQ ID NO: 146103 - protein, 77 aa, Glycine max
  Coding DNA Sequence Number=SeqID_29325
MDDINVATLTNYCAHTCYLRHNERKVVLSCTEQPCNYDYSRFIVPLAFDVATHSSYFLQRLLVVEERLNAREKKIAM

SEQ ID NO: 146104 - protein, 63 aa, Glycine max
  Coding DNA Sequence Number=SeqID_29326
MTVNVLVENDDPQPNPIWELTVDGPLSPSSPPIVVGYEWMRDDVLKCLFEVLGLILPLTTFHC

SEQ ID NO: 146105 - protein, 356 aa, Glycine max
  Coding DNA Sequence Number=SeqID_29327
MAGLYQSDIEHQGDLLFEFSFLEMWVAIFGNWVMMEVIWGGVGVSWKCNGEDEVLGQVKELSNVELDKIMSTALVDQDNKAMLGRGGPSVRKGCQNLMQRVRCPHRQLKYAIEVYNDGQESICHPNDNKVPGHAREPFPRKGKLGLGMLGNKAVVGDKSCNGGQEVLFPGAWPGTRLVSMMKVGGPAPPDASAERILVICWAKRDSRASSIPVQDVRKPFLNIHWYQHNIGSRPSKCGTSNFIWGQEGDGEVSIGKEEGKRGLALVQASDRLIQAVNGGLPGIMLWRQHKGRSDQLLRSYTMRSKTTKMGGIVEISSGHNIIDFSACLTASDKIIEVCGFSGIPSGPTVVQFLVAL

SEQ ID NO: 146106 - protein, 187 aa, Glycine max
  Coding DNA Sequence Number=SeqID_29328
  Gene Ontology: Mol. function=RNA-directed DNA polymerase activity; Cellular component=chromatin; Biological process=chromatin assembly or disassembly
MADSDIHKTTFRTHHDHYEFKVMPFGYAHLASLSTPSALRGFLGLTGFYRHFIKSYAALIAPLTSLLRKDNFQWSDEAQTTFEQLKRKMTEALVLVSPDFSAPFTIETDASSRAMGTVLQHNCHPIAYYSKTLCPHLQLASTYVREPHAITVAVRKWRHYLLGHPFTILTDHQSLKELMSQGIQIYE

SEQ ID NO: 146107 - protein, 191 aa, Glycine max
  Coding DNA Sequence Number=SeqID_29329
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=32%, E-value=1e-32, Identity=53%"; Hit description =Integrase, catalytic region
MSTTYHSQVDDQTEVMNRILEQYLRAFVHDRPSQWYHFLLLAEWSYNTSTHSGTCISPFEAIYRKPLLSIPHYILGDMTVEAVDSLLATRTVILAGLRRRLIKAQTNMKTVANTHCRSLEFTVGNWVYGVMIAIQTHKNRKNTRVARNWTTTCLEGIPENPHASMTSFEAIKQALKSILLCPLLISTIPPI

SEQ ID NO: 146108 - protein, 806 aa, Glycine max
  Coding DNA Sequence Number=SeqID_29330
  Gene Ontology: Mol. function=binding; Cellular component=kinesin complex; Biological process=defense response
  Homolog annotation: Hit_ID=Q8S3S1; Match level="QueryCoverage=91%, HitCoverage=98%, E-value=0.0, Identity=57%"; Hit description =Putative kinesin light chain gene
  Pfam annotation: Domain name=TPR_1; Domain location=388-421; Score =16.5; E_value=0.057; Accession=PF00515.18; Description =Tetratricopeptide repeat
  Pfam annotation: Domain name=TPR_1; Domain location=430-463; Score =5.5; E_value=1.2; Accession=PF00515.18; Description=Tetratricopeptide repeat
  Pfam annotation: Domain name=TPR_1; Domain location=512-545; Score =19.9; E_value=0.0088; Accession=PF00515.18; Description =Tetratricopeptide repeat
  Pfam annotation: Domain name=TPR_1; Domain location=554-587; Score =15.9; E_value=0.067; Accession=PF00515.18; Description =Tetratricopeptide repeat
  Pfam annotation: Domain name=TPR_1; Domain location=597-630; Score =21.9; E_value=0.0022; Accession=PF00515.18; Description =Tetratricopeptide repeat
  Pfam annotation: Domain name=TPR_1; Domain location=638-671; Score =4.6; E_value=1.5; Accession=PF00515.18; Description=Tetratricopeptide repeat
  Pfam annotation: Domain name=TPR_1; Domain location=680-713; Score =4.1; E_value=1.8; Accession=PF00515.18; Description=Tetratricopeptide repeat
  Pfam annotation: Domain name=TPR_1; Domain location=722-755; Score =2.5; E_value=2.7; Accession=PF00515.18; Description=Tetratricopeptide repeat
  Pfam annotation: Domain name=TPR_2; Domain location=301-335; Score =7.0; E_value=5.1; Accession=PF07719.7; Description=Tetratricopeptide repeat
  Pfam annotation: Domain name=TPR_2; Domain location=388-421; Score =12.2; E_value=1.3; Accession=PF07719.7; Description=Tetratricopeptide repeat
  Pfam annotation: Domain name=TPR_2; Domain location=430-463; Score =10.9; E_value=1.8; Accession=PF07719.7; Description=Tetratricopeptide repeat
  Pfam annotation: Domain name=TPR_2; Domain location=472-505; Score =2.6; E_value=16; Accession=PF07719.7; Description=Tetratricopeptide repeat
  Pfam annotation: Domain name=TPR_2; Domain location=512-545; Score =13.6; E_value=0.71; Accession=PF07719.7; Description=Tetratricopeptid e repeat
  Pfam annotation: Domain name=TPR_2; Domain location=554-587; Score =13.8; E_value=0.62; Accession=PF07719.7; Description=Tetratricopeptid e repeat
  Pfam annotation: Domain name=TPR_2; Domain location=597-630; Score =21.3; E_value=0.0034; Accession=PF07719.7; Description =Tetratricopeptide repeat
  Pfam annotation: Domain name=TPR_2; Domain location=638-671; Score =6.9; E_value=5.1; Accession=PF07719.7; Description=Tetratricopeptide repeat
  Pfam annotation: Domain name=TPR_2; Domain location=680-713; Score =7.6; E_value=4.3; Accession=PF07719.7; Description=Tetratricopeptide repeat
  Pfam annotation: Domain name=TPR_2; Domain location=722-755; Score =4.2; E_value=11; Accession=PF07719.7; Description=Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_2::TPR_2; Domain location=388-421::430 -463::512-545::554-587:...
  Pfam module annotation: Domain location=:597-630::638-671::680 -713::722-755::301-335::388-421::430-463::472-505::512-545::554 -587::597-630::638-671::680-713::722-755
MNKRSNLSSCLCTFSRGTKVPTKKNLCVLDDVGFLIIVYSLFLNNKTGFLFMKELNMPGIVTNGVQDEGGSNEMNGDQDSPFKEPLNLVKSPRGGSVSPGRGQGDDGANFGGDGVVEPSIEQLYENVCDMQSSDQSPSRQSFGSDGDESRIDSELRHLVGGRMREVEIMEEEVGEGKEPEGSSSSEISSALGGLSHDKKLDQVDEIQEVQPAATSSGSTEKSVKALNSQVESDNTLPKLTSKGRSPLSKAPIPRKNGKPLRKPIGGVTGVKNTKNSPIGKSVSQNRVESMAESALEKPERAPVLLKQARDLISSGDNPQKALDLALQAMELFEKFGNGKPSLELVMCLHVTAAIYCSLGQYAEAIPILERSIEIPVIGESQQHALAKFAGHMQLGDTYAMLGQLENSIMCYTTGLEVQKQILGETDPRVGETCRYVAEANVQALQFDEAERLCQMALDIHKANNSAPSVEEAADRRLMGLICETKGNHETALEHLVLASMAMVNNGQEAEVASVDCSIGDTYLSLSRYDEAAFAYQKALTVFKTSKGENHPAVGLVFVRLADLYNRTGKIRESKSYCENALKIYENPMPGVPLEEIASGLTNISTIYESMNELEQALKLLQKALEIYSDTPGQQSTIAGIEAQMGVMYYMLGNYSESYNTLKDAISKLRAIGEKKSSFFGIALNQMGLACVQRYALSEATELFEEAKSILEQEYGPYHPETLGVYSNLAGTYDAIGRLDDAIQILEYVVNTREEKLGTANPEVDDEKRRLGELLKEAGRVRSRKARSLENLLDGNAHAANNVVIRA

SEQ ID NO: 146109 - protein, 83 aa, Glycine max
  Coding DNA Sequence Number=SeqID_29331
MAITESGPIFLKAVNYSGDIKDKDFIALHIRDAITELYVRHQRFRSLKEGLQKMFITLEWSTYKDHDVGMAKKVKETLLDDIW

SEQ ID NO: 146110 - protein, 84 aa, Glycine max
  Coding DNA Sequence Number=SeqID_29332
MNDYVKIDQEFPHIKMWNLLMKGRNALEDTLMMWIEREDFHDVDSLRDKGELDAKSWWPLSYLGNHTYLLVVKGIGAPTISYIV

SEQ ID NO: 146111 - protein, 78 aa, Glycine max
  Coding DNA Sequence Number=SeqID_29333
MLTAMTVTAITLVSMKLSLCWPWWWWRGWLRWWCKRLKVDDANHSENGRCKKEPNKDRARDRDCERSSSRHRSERERD

SEQ ID NO: 146112 - protein, 85 aa, Glycine max
  Coding DNA Sequence Number=SeqID_29334
  Subcellular localization annotation: CTP_CleavageSite=25; ConfidenceScore=5.11e-01
MNRNRKSKFSSSGIQLNSTKSEPTREMIVAVPTQALLGRLIMQFTFKSRSSSADFWDCYTCKSTCMTIKHVQWLITTKRKNILLT

SEQ ID NO: 146113 - protein, 132 aa, Glycine max
  Coding DNA Sequence Number=SeqID_29335
MKKKQEEEELIRKKKKQKRKRGERESPVSRLDPSYTETLKFLQKLKACHACFSGRYGNTSRRVFRLAVICHRHGKSIDLRNGERKRERRRHFKEKMSLEEAHHHRRPWIRTWRKKEMNEGRGREEHEILCSK

SEQ ID NO: 146114 - protein, 69 aa, Glycine max
  Coding DNA Sequence Number=SeqID_29336
MRCYKRWMMDNPDQPFNYYMLHQLKVVLVVDDVHKLKQLQEPVGRPDWFGPGSIIIITTRDGQLIGTIS

SEQ ID NO: 146115 - protein, 344 aa, Glycine max
  Coding DNA Sequence Number=SeqID_29337
  Gene Ontology: Mol. function=RNA-directed DNA polymerase activity; Cellular component=chromatin; Biological process=chromatin assembly or disassembly
  Pfam annotation: Domain name=rve; Domain location=117-222; Score= -9.3; E_value=0.036; Accession=PF00665.16; Description=Integrase core domain
MEFDFIIEYREGQENVAADALSRLDSHEIMALQVHQPDSSMLSRIQQSWQTDPSLQQLVSDLQSNPSSHKNYTWVQNELRRKGKLVVGLDPQLRQDILSWIHASACGGHSGRDATLQKMKNVVYWRGMSKAVKLSKAAHFMALSHPYTAADVAQCFLDHVFKLHGFPDSITSDRDPIFVSHFWKEFMSLQGIQWFKWLPLAEWWYNSTYHNTIKASPYEIVYGQAPLVHLPYLLGESKIALVDRSLQKHEEMLKLLKFHMKRAQDKMNQLTDKGISDRSFHIVEDKLKLPPGSMVHNVFHVSQLKKFTGTATSGNFSPSPLLDTSQKEPEAIIDRMTVKRGNHA

SEQ ID NO: 146116 - protein, 571 aa, Glycine max
  Coding DNA Sequence Number=SeqID_29338
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=302-471::81-172
STISIGIIEPVLSLVIKQWQRTRAIKLPFVKWKNVLAAKWNRDLSSSLLPCNKQYTKYFNRGNKILQQQAIHLGVRDLAPILVALDWLGKALQWHSAYIKSVGLENLPSWNEYQILLHDRFGDVCEDPMVDFMKLRQTGSIIEYHEEFDSIVSRVDLFDEHQLSCFLGGLKQEIHVLEVEDEEEDSRPQEIDANMVSEHDLEPLISMNALTGVANFRTMRVTGYCGKKPLQILIDNGSTHNFLDLHIAQKMGYQKEAMDIVSVTIIDGNKVQISSKPSSLLPCRIGHDHKIPLTQGANPINKRPYSPVVLVGKKDGAWRLCVDYRDLNKATIKKKFPIPLVEDLLDELYGSTIFSKIDLSAGYNQVRVDATNVHKTTFRTHGGHFEYLVMPFGLTNAPATFQGLMNSVFQHYLRRFLLVFFDDILIYSRSMEEHLSHLHQVLLIMRTHSLYAKKSKCYFGVDKVEYLGHFITKEGVSTYPSKIVAVQDWPLPQNLKQLRSFLGLVGYCRRFVSRYGAIEKPLTDMLKKDNFSWSSTTKETFQELKQSGGGCFWPGLKCYVNAESPPNCLHQ

SEQ ID NO: 146117 - protein, 172 aa, Glycine max
  Coding DNA Sequence Number=SeqID_29339
  Gene Ontology: Mol. function=two-component response regulator activity; Cellular component=nucleus; Biological process=two -component signal transduction system (phosphorelay)
  Homolog annotation: Hit_ID=Q1RU46; Match level="QueryCoverage=97%, HitCoverage=94%, E-value=4e-56, Identity=68%"; Hit description =Response regulator receiver
  Pfam annotation: Domain name=Response_reg; Domain location=9-142; Score=69.7; E_value=9.4e-18; Accession=PF00072.14; Description =Response regulator receiver domain
MGMAAEAQFHVLAVDDSLIDRMLIERLLKTSSFHVTALDSGSKALKFLGLVEDEQRNKEPPSIALESHQDVEVNLIITDYCMPEMTGYDLLKKIKESKSLKDIPVVIMSSENVPARINRCLEDGADEFFLKPVQQSDVNKLRPHLLKSKVKDEEVQQINKKKEGNRRKPFTR

SEQ ID NO: 146118 - protein, 307 aa, Glycine max
  Coding DNA Sequence Number=SeqID_29340
  Gene Ontology: Mol. function=DNA-directed DNA polymerase activity; Cellular component=intracellular; Biological process=DNA replication
  Homolog annotation: Hit_ID=Q1H191; Match level="QueryCoverage=56%, HitCoverage=75%, E-value=3e-68, Identity=72%"; Hit description=DNA polymerase III, epsilon subunit
  Pfam annotation: Domain name=Exonuc_X-T; Domain location=134-287; Score=124.7; E_value=2.6e-34; Accession=PF00929.14; Description =Exonuclease
  Pfam annotation: Domain name=RnaseH; Domain location=1-136; Score =177.6; E_value=3.1e-50; Accession=PF00075.14; Description=RNase H
  Pfam module annotation: Pfam domain module=Exonuc_X-T::RnaseH; Domain location=134-287::1-136
MYADGACKGNPGVGGWGVWLKAGPHEKSLYGGEALTTNNRMELTAVIQGLQALKKPSHIKIYTDSSYVQKGMTEWLPGWKQKQWRTADKKPVKNADLWQTLEALAQPHQIEWIWVRGHAGNEGNERADALANQGLYPDQGHRIIEIAAVEIFNRRPTQRHFHIYINPEREIDPGAQEVHGISLEFLQDKPLFANIAEEFIEFIRGAELIIHNAPFDVGFLNMELARLNLDKLESYISGIIDTLKMAKEMRPGQRNNLDALCRHYGIDNSQRTLHGALLDAELLAEVYKAMTRGQESLLMELSSPVEQ

SEQ ID NO: 146119 - protein, 144 aa, Glycine max
  Coding DNA Sequence Number=SeqID_29341
MYCYEEDLPSFLFLADFMVLDLTRADNLWHCYGRRLRRNPRSLDWLLTGCSRCSIILNSIIDLFDSDILCLPPGYWVVTIILDLAIYLIWKDLVLDHASSATFIGSSLVGIGIKLKEVRDLVAVLREVCGRKITYLTLSPSPYP

SEQ ID NO: 146120 - protein, 227 aa, Glycine max
  Coding DNA Sequence Number=SeqID_29342
SKSLAFVDCTAFCYHDPRAGSPRRHLTVIRTSSVIDKQRPIWSSAPFPEMSKSLAFVGRPIICHTDPEAAGPMTSRDQVWSFCTLVSSRGGGPDDTRRYLTVIRTLLSSRGGGPDDTRRYLTVIRTLLSSRGGGPDDKQRPKTKFGHSAPLYHAEAAGPMIRGDTLRLSAPFCHPEAAGPMTRRDQVWSFCTLVSSRGGGPDDTRRYLMVIRTLLSSRGGPDDKQRP

SEQ ID NO: 146121 - protein, 136 aa, Glycine max
  Coding DNA Sequence Number=SeqID_29343
  Homolog annotation: Hit_ID=Q1SKD7; Match level="QueryCoverage=58%, HitCoverage=20%, E-value=2e-07, Identity=32%"; Hit description =Ankyrin
MAPRKLASKRSRKDAAAAGTSAAPEFDSHRFRSAEHQQRFEAIKGWSFHRERRVQLRDDEYTDFQEEIARRCWTSLVTPMAKFDPDTILEFYANAWPTEEGVRDLRRPQLVPGISASIGGGPGVRIRSEEEPGRWI

SEQ ID NO: 146122 - protein, 110 aa, Glycine max
  Coding DNA Sequence Number=SeqID_29344
MTLTYDALLYYNGRWNMPRQHDFVGYAFTGKNPKRFDIPSGCTINVLKDLIKQVAPQDIPPYDIHESQTVRRLFCLQPGHYKYSDKVIKFEIIELKTDDDVLKVLVQSDY

SEQ ID NO: 146123 - protein, 233 aa, Glycine max
  Coding DNA Sequence Number=SeqID_29345
MTLSRCWWNYSRSALLRRELRRFSVMALMLDVYQTKIGACHWIVAAHLRWGPLTAIHRSERVVRQFGYIQTILSHPAASSLSVEEIDDRWMQFSEYIAHVGKMCAVPGQCSPDYMDWFYMISHPFMSLAQPRDPPRVLPIQQYDTFVELDLYQQPMVAAAPDEVDVDVYHLRHAVDGYVAIADKLERLLNLSILTEGTKAYTVDEECLGIARSYISQPTIGHRSRCRRRMDGH

SEQ ID NO: 146124 - protein, 470 aa, Glycine max
  Coding DNA Sequence Number=SeqID_29346
MKTIASKVWGVKVVQSGDTTVKATRGVYVKAIPIRKDGRRTMIPMLQGHFARKMVYHVFNKMDEDSKHTLIAKAKAIADEDQGLKNFGISKKIQKIMTKQQKRKKTRKQSQKEEEEEELLAKEHRTKKRHETTVSTLVHPPAATSIPRRLKDLSETNEEDEGLVQVSLQKRKEAALVAPAPKRAKKFQLVSQPRVFVISFAIPRRIKTRVTKANPKIDGKEWAISFNGNNQDSALSSSSSSSLSYSESINNTSISPFRNHDYSTQSHIPPSPIHLDKFKRSTPREPLRYAQIFPLAFFNSNPISETPYFEFLYFKLVERETIHVQEPTWTKHECEHTSSEAFKALPTYDIVHLPLTQWTYPAKEEEIFVAAMKQDIALVQAKASTKAMDDTIVCGVIIDLTNIGVMGKTSEASNVAIAAEVEHNILEPISKQSTNSNEATSRDKGEPDVVSSTPPIHPYSFKLCTTCHCY

SEQ ID NO: 146125 - protein, 74 aa, Glycine max
  Coding DNA Sequence Number=SeqID_29347
MNIIVSLEQVMVVEVERVVVKIEEVMVLGLRFMVAGQETHVQMVVEVQQQLQAFTSEPVECFGGERHQDWRTEW

SEQ ID NO: 146126 - protein, 63 aa, Glycine max
  Coding DNA Sequence Number=SeqID_29348
MGDWGNFLHRILEEDSEDSAPIKMFLLVGGSTASNDGSWRPPVVVGGGEGGVRVWVAFGEEER

SEQ ID NO: 146127 - protein, 128 aa, Glycine max
  Coding DNA Sequence Number=SeqID_29349
MQRRSNAGDLISIDLEINATCRRRNIERIINFLQDLEAAATPKEEPRSSEASSSFPIPVKSHTDLIEEVIMAEEPRRVTLEDYSSSSVPQFFTSIAQPEVQAQTITYPPSLIQLVQNNLFHGLPNEDP

SEQ ID NO: 146128 - protein, 79 aa, Glycine max
  Coding DNA Sequence Number=SeqID_29350
RACVTNLAGSTGETAYVEHLAVSTGEIALVVYVVVIAGNINAYSASIAKKNGGISAYVEHLTCAAGGIAFSLLLLAASP

SEQ ID NO: 146129 - protein, 134 aa, Glycine max
  Coding DNA Sequence Number=SeqID_29351
  Gene Ontology: Mol. function=binding; Cellular component =intracellular; Biological process=protein kinase C activation
  Homolog annotation: Hit_ID=Q9LWW0; Match level="QueryCoverage=97%, HitCoverage=44%, E-value=7e-33, Identity=38%"; Hit description =Pentatricopeptide (PPR) repeat-containing protein-like
  Pfam annotation: Domain name=PPR; Domain location=12-46; Score=40.3; E_value=6.8e-09; Accession=PF01535.11; Description=PPR repeat
  Pfam annotation: Domain name=PPR; Domain location=83-117; Score=10.8; E_value=0.4; Accession=PF01535.11; Description=PPR repeat
  Pfam module annotation: Pfam domain module=PPR::PPR; Domain location =12-46::83-117
MWNIFGPEKDVMAWSAMITAFAMHGLSEECLELFARMVNDGVRPNAVTFVGVLCACVHGGLVSEGNEYFKKRMKEYGVSPTIQHYGCIVDLYSRAGRIEDAWSVVKSMPVEPDVMIWGALLSGLGCMGTLKLVR

SEQ ID NO: 146130 - protein, 140 aa, Glycine max
  Coding DNA Sequence Number=SeqID_29352
  Gene Ontology: Mol. function=binding
  Homolog annotation: Hit_ID=Q9FG16; Match level="QueryCoverage=65%, HitCoverage=19%, E-value=2e-10, Identity=31%"; Hit description =Selenium-binding protein-like
MNHAAPRYDVPMRHLIEQFPRNVNHARFGICVDDGVPRGGLNKRVVGKTKEEDLSVKLATWMRGVDGLKKEWEGMKIGKHGMVAHAKVERQCWRKRFRLCFWKDKDLGACTISPSRKHALVVTAKANHETPDVQGRRTMK

SEQ ID NO: 146131 - protein, 105 aa, Glycine max
  Coding DNA Sequence Number=SeqID_29353
  Gene Ontology: Mol. function=binding; Biological process=thiamin biosynthetic process
  Homolog annotation: Hit_ID=Q1SD65; Match level="QueryCoverage=99%, HitCoverage=21%, E-value=1e-33, Identity=63%"; Hit description =Tetratricopeptide-like helical
MLDEIVKRLEKHGYERNTGEVLLDLDEEGKEFALSLHSEKLAIAYCFLRTSPGTTIRIVKNLRICSDCHVAIKMISREFNWEIIVRDCNRFHHFKNGLCSYKDYW

SEQ ID NO: 146132 - protein, 63 aa, Glycine max
  Coding DNA Sequence Number=SeqID_29354
  Homolog annotation: Hit_ID=Q1RUS5; Match level="QueryCoverage=78%, HitCoverage=9%, E-value=6e-14, Identity=72%"; Hit description =Sodium/calcium exchanger membrane region
MLDAVLSVRDERPEDWVPEETPYFQHEAHEKVDFSDIKHVNEENRDTVDIFYIHSENPTGIKN

SEQ ID NO: 146133 - protein, 261 aa, Glycine max
  Coding DNA Sequence Number=SeqID_29355
  Gene Ontology: Mol. function=transferase activity, transferring glycosyl groups; Cellular component=nucleus; Biological process =protein amino acid ADP-ribosylation
  Homolog annotation: Hit_ID=Q5Z8Q9; Match level="QueryCoverage=98%, HitCoverage=56%, E-value=7e-57, Identity=55%"; Hit description=Poly [ADP-ribose] polymerase 2-A (EC 2.4.2.30) (PARP-2-A) (ADPRT 2-A) (NAD(+) ADP-ribosyltransferase 2-A)
  Pfam annotation: Domain name=PARP; Domain location=131-255; Score =60.6; E_value=5e-15; Accession=PF00644.10; Description=Poly(ADP -ribose) polymerase catalytic domain
  Pfam annotation: Domain name=PARP_reg; Domain location=26-129; Score =115.8; E_value=1.2e-31; Accession=PF02877.5; Description=Poly(ADP -ribose) polymerase, regulatory domain
  Pfam module annotation: Pfam domain module=PARP::PARP_reg; Domain location=131-255::26-129
MDYSGKENESTVTENPDHALGKQPQESKLEPRVAKFISLVCNGYEVLKRLANVIDKGDRKVLKQLSGEFYTVIPHDFGFKKVREFVIDTPQKLKRKLEMVEALAEIEVATKLLKDDAEMQGDPLYTHYQRLHCELAPVEFGCVEFSMIEEYTKNTHAETHSNYTVDIVQIFRTSREGEAERFRKFICFAISYCSTKGLGGTALDPSKAQELEDGLVVPLGKPKTESGKKGDLLYNEYIVYNVEQIRMRYIVHLNFNFKTTS

SEQ ID NO: 146134 - protein, 33 aa, Glycine max
  Coding DNA Sequence Number=SeqID_29356
MAQQGDLGANYIGYSHSESRAHGSCLSPKGTFY

SEQ ID NO: 146135 - protein, 196 aa, Glycine max
  Coding DNA Sequence Number=SeqID_29357
  Homolog annotation: Hit_ID=Q53M14; Match level="QueryCoverage=60%, HitCoverage=70%, E-value=8e-20, Identity=44%"; Hit description =Expressed protein
MVKIKRLIEEYNLGCGNPTQASPFLVAVEKYNHTGGFSVSQFEFPNSKTIAIQAATALRGDEEVIEGKGSGGDADGEIEIIAETNDVENAEPEEEDLHANPPEFGEPAVGYVDGDDFLVTQLVRTFEGETARTVQIGVEFSAGRVQLVAGHSFRENACRKVKALQHLVRRRGAGGGDRRRRRKAVSDVVPLLLELN

SEQ ID NO: 146136 - protein, 79 aa, Glycine max
  Coding DNA Sequence Number=SeqID_29358
  Homolog annotation: Hit_ID=Q53M14; Match level="QueryCoverage=81%, HitCoverage=36%, E-value=2e-11, Identity=49%"; Hit description =Expressed protein
MDLGKTIIEYCQIQRFAIEATTTLGALEEVLDAEISGSDADREVNIVALTRDLDDVEPQEQDFDGDTFEIVEPALGDHT

SEQ ID NO: 146137 - protein, 69 aa, Glycine max
  Coding DNA Sequence Number=SeqID_29359
  Gene Ontology: Mol. function=transition metal ion binding
MELLQIYQRKSEIIDSHTNIVINPLTLENTDNEFYIIKLPNFFNDSKVRHGSYMGIVIMYSSKVLRFNP

SEQ ID NO: 146138 - protein, 479 aa, Glycine max
  Coding DNA Sequence Number=SeqID_29360
  Gene Ontology: Mol. function=carbohydrate binding; Cellular component= outer membrane; Biological process=outer membrane biogenesis (sensu ProteoBacteria)
  Homolog annotation: Hit_ID=P31554; Match level="QueryCoverage=99%, HitCoverage=62%, E-value=0.0, Identity=64%"; Hit description=Organic solvent tolerance protein precursor
  Pfam annotation: Domain name=OstA_C; Domain location=96-469; Score =388.1; E_value=1.4e-113; Accession=PF04453.5; Description=Organic solvent tolerance protein
LPIGDRRRSGFLIPNAKYGSNNGFEFMLPYYWNIAPQVDATITPHYMSKRGLQLQNEFRYLTQFVAGLLELDYLPSDNQYNKDKAARPSVQNDSNDDRWLFYWRHSGVYDQHWRFNADYTKVSDPYYFNDLDSKYYSSTDGYATQKFSVGYADTNWDATLSSKDFQNDIGPFDGRIYAQAVKFTNVSNRMPEATRLHIEPTLNLPLSNGWASLDTEAKLLATHYQQDNVNYYNENIDTTRTNQLKESVNRTLPQFKVDGRLVFDRNMDWAEGYTQTLEPRVQYLYIPYRNQSNIYPYDSTLLQTDYTGLFRDRTYSGLDRIASSNEVATGVTTRIYDNDLVERFNVSVGQIYSFTPSRTGVNQTNKEDDTGSLVWAGDTYWKVSDRWGVRGGLQYDTRLDNVSQGNAIVEYRRDADRMVQLSYRYSSPEYVAQALSGSGLIDNPSYQKIYKNGISQVGATASWPIADAWSLVGGYYYDT

SEQ ID NO: 146139 - protein, 72 aa, Glycine max
  Coding DNA Sequence Number=SeqID_29361
  Subcellular localization annotation: CTP_CleavageSite=58; ConfidenceScore=5.19e-01
MGARDKSIMHKRFMQKPLLNVSHSLTIKDHTLTGLRLMRSFTVNLTNQLTFPVMILIPCSFSSNDYMLTQGI

SEQ ID NO: 146140 - protein, 194 aa, Glycine max
  Coding DNA Sequence Number=SeqID_29362
  Gene Ontology: Mol. function=protein binding; Cellular component =membrane; Biological process=defense response
  Homolog annotation: Hit_ID=Q1SGS4; Match level="QueryCoverage=95%, HitCoverage=44%, E-value=2e-25, Identity=36%"; Hit description =Leucine-rich repeat
MELIYRMVFSWMTQIFEVHWQSSLSFNRLDIVIPGTEIPRWFSKQNEGDSISMDPSPLMEDPNWIGVACCALLVAHHDPSNIGNRSTHLDHYPSIGYSFQNKQNDLVTGELDHLLILFASREEFLLFPRHETDMHGLDTRGFTTWIRDHPKGLRLQVKSCGYRWVFKEDLQQLNPNMMFRGNSSSRKCKLLSSD

SEQ ID NO: 146141 - protein, 138 aa, Glycine max
  Coding DNA Sequence Number=SeqID_29363
MVKSSATISVISLVDFLLEQARHEFLVLTVTQDRQKASTSNQPLQEEDFCGEKEILANNAELKKTRINVYRTHRLTPHSWTFSIKSSHGEASTDCNLIGGLSSIKNGNAVSSRVKTNPGNWWSDWWLWYYTPGNRKGS

SEQ ID NO: 146142 - protein, 59 aa, Glycine max
  Coding DNA Sequence Number=SeqID_29364
MNHKGIPSFVFSDYIQEVMPTSCNEPKSVINQEANPASWYEPKERWSLVFSVQPRKTFS

SEQ ID NO: 146143 - protein, 532 aa, Glycine max
  Coding DNA Sequence Number=SeqID_29365
  Gene Ontology: Mol. function=transmembrane receptor activity; Cellular component=membrane; Biological process=defense response
  Homolog annotation: Hit_ID=Q1SGR7; Match level="QueryCoverage=100%, HitCoverage=45%, E-value=1e-147, Identity=51%"; Hit description=TIR; Disease resistance protein; AAA ATPase
  Pfam annotation: Domain name=ABC_tran; Domain location=210-328; Score= -60.9; E_value=0.042; Accession=PF00005.17; Description=ABC transporter
  Pfam annotation: Domain name=NB-ARC; Domain location=170-473; Score =72.4; E_value=1.4e-18; Accession=PF00931.13; Description=NB-ARC domain
  Pfam annotation: Domain name=TIR; Domain location=13-146; Score =174.4; E_value=2.9e-49; Accession=PF01582.10; Description=TIR domain
  Pfam module annotation: Pfam domain module=ABC_tran::NB-ARC::TIR; Domain location=210-328::170-473::13-146
MACSSSHAKNFDVFVSFRGLDTRNSFTDHLFAALQRKGIVAFRDNQNINKGELLEPELLQAIEGSHVFIVVFSKDYASSTWCLKELRKIFDRVEETGRSVLPIFYDVTPSEVRKQSGKFGKAFAEYEERFKDDLEMVNKWRKALKAIGNRSGWDVQNKPEHEEIEKIVEEVMNLLGHNQIWSFSGDLVDMDSRVKQLEELLDLSANDVVRVVGIWGMSGVGKTTLVTALFGKISPQYDARCFIDDLNKYCGDFGATSAQKQLLCQALNQGNMEIHNLSHGTMLVRTRLRRLKTLIVLDNVDQVEQLENLALHPEYLGEGSRIIIISKNMHILKNYGVYKVYNVQLLKKDKALQLLCKKAFKSDDIEKGYEEVTYDVLKYVNGLPLAIKVLGSFLFDRDVFEWRSALTRMKENPSKDIMDVLRISFDGLETMEKEIFLDIVCFFSSDQFQDYDRRSIPPEKILGYRGFYPKIGMKVLVEKSLISFDRYSNIQMHDLLKELGKIIIREKAPKQPRKWSRLWDYKDLQKVMIENK

SEQ ID NO: 146144 - protein, 76 aa, Glycine max
  Coding DNA Sequence Number=SeqID_29366
MAGASRYEKNLHLYLARVAAAKRRSNHLYQLLYKFSPQFESKDQLLARKALPWENQKIEANNFLDLRSKKRIHVNN

SEQ ID NO: 146145 - protein, 64 aa, Glycine max
  Coding DNA Sequence Number=SeqID_29367
MCGITVEVVEEGFQNREKCQNEETQKGSGFIIVEVVEATLFRRQEMGPARREDVRKEKVKISDP

SEQ ID NO: 146146 - protein, 149 aa, Glycine max
  Coding DNA Sequence Number=SeqID_29368
MTDLVSAEDDVNLRVSTGLSAAIDEGRRRRCQSSRAIRLFVLQTAKKNVYTDNHSGISARQRDSNVSMTDLVSAEDDVNLRVSMGLSAAIDEGRRRRCFSSYRQQKECYTDNHSGISARQRDSNVSMTDLVSAEDDVKSPRVNGLVGRY

SEQ ID NO: 146147 - protein, 94 aa, Glycine max
  Coding DNA Sequence Number=SeqID_29369
TSFGYRKDRNDQWLKKDALLPQDERTPSPPPQRDVSALMNEVLSELRGLRSYVGDRFDSLDTRFASMDIRLTQLEEDVGYIRQSFDLPPPPPPS

SEQ ID NO: 146148 - protein, 90 aa, Glycine max
  Coding DNA Sequence Number=SeqID_29370
MFWLKFKEELSDVWKLIDNYRNVQEVNVVKTKIETLILQNGWGQVTVNNEVNEDKEVYFRYLEPPERFCCIYSSEEDHRTTPDKWLWNGA

SEQ ID NO: 146149 - protein, 115 aa, Glycine max
  Coding DNA Sequence Number=SeqID_29371
  Gene Ontology: Mol. function=DNA binding; Biological process=DNA integration
KTCNFSIDQAGEERKLQLSELDEICLEAYENSKLYKEKTKKFHDSLIAKKDFVVGQKVLLYNSRLRLMSVEIKSESTNKSFKVNEHRLKPFLINPSLVDVVVEETSLLHPTSLPP

SEQ ID NO: 146150 - protein, 97 aa, Glycine max
  Coding DNA Sequence Number=SeqID_29372
  Homolog annotation: Hit_ID=Q1SM20; Match level="QueryCoverage=81%, HitCoverage=20%, E-value=2e-07, Identity=35%"; Hit description =Nucleic acid-binding, OB-fold
FSFAEFDREKLRVCDYKVMARVADKIKLIDGSREALKLSVRITDLWFIGIPGKTKQAKMVVVDSDGDEIHVVCKQDQLKSRKADLKENLTYVMHNFK

SEQ ID NO: 146151 - protein, 144 aa, Glycine max
  Coding DNA Sequence Number=SeqID_29373
MGERPTSSFGANTEKNPKEECKAVLTRSQRRAQGEQRDERDQFEEGRINKEGEKEEEKKEEEKEVPSKKNKERYFKRFLEIFKGLEITIPFGEALQQMPLYTKFMKDILTKKGKYIDNESIVVGGNCSAVIQRKLSKKFKIPRA

SEQ ID NO: 146152 - protein, 106 aa, Glycine max
  Coding DNA Sequence Number=SeqID_29374
  Gene Ontology: Mol. function=RNA-directed DNA polymerase activity; Biological process=RNA-dependent DNA replication
  Homolog annotation: Hit_ID=Q1T5Q8; Match level="QueryCoverage=71%, HitCoverage=10%, E-value=2e-16, Identity=52%"; Hit description=RNA -directed DNA polymerase
MLANSLKWVMDDVISTTQSTFISGRKMLDGVLIAIELVHEANGKKNKLLCFKLDFEKAYDSVSWEFLDFMIQGIGFSAFGGAEGLSMMFIEVVRKRLFGGFELEGL

SEQ ID NO: 146153 - protein, 73 aa, Glycine max
  Coding DNA Sequence Number=SeqID_29375
MALLGKWWWKLRVDSKSLWSSVLKVKYKGVGCVKVRRIGGMGLVLSGRLVLTFHHTCVMHWVNGSMFIRLVYA

SEQ ID NO: 146154 - protein, 326 aa, Glycine max
  Coding DNA Sequence Number=SeqID_29376
  Gene Ontology: Mol. function=2-deoxy-D-gluconate 3-dehydrogenase activity; Cellular component=chloroplast; Biological process =metabolic process
  Homolog annotation: Hit_ID=P37769; Match level="QueryCoverage=74%, HitCoverage=96%, E-value=1e-131, Identity=95%"; Hit description=2 -deoxy-D-gluconate 3-dehydrogenase
  Pfam annotation: Domain name=KR; Domain location=85-267; Score=-96.9; E_value=0.097; Accession=PF08659.1; Description=KR domain
  Pfam annotation: Domain name=adh_short; Domain location=84-250; Score= 96.7; E_value=6.9e-26; Accession=PF00106.15; Description=short chain dehydrogenase
  Pfam module annotation: Pfam domain module=KR::adh_short; Domain location=85-267::84-250
ARDAVYRRRSGRCAGGGARIIRSRAVFGAMSNFLADLLFFVFLSDFLSSRGLLCDHQQNGTLFYFYDGDAPGVLLSLRTLPVGKVAVVTGCDTGLGQGMAVGLAEAGCDIVGINIVEPTETIERVTALGRRFLSLTADLRQIDGIPQLLERAVAEFGHIDILVNNAGLIRRQDAIEFSEKDWDDVMNLNIKSVFFMSQAAAKHFIAQGNGGKIINIASMLSFQGGIRVPSYTASKSGVMGVTRLLANEWAKHNINVNAIAPGYMATNNTQQLRADEQRSAEILDRIPAGRWGLPSDLMGPVVFLASSASDYINGYTVAVDGGWLAR

SEQ ID NO: 146155 - protein, 179 aa, Glycine max
  Coding DNA Sequence Number=SeqID_29377
  Gene Ontology: Mol. function=GTP binding; Cellular component =intracellular
  Homolog annotation: Hit_ID=Q10C01; Match level="QueryCoverage=91%, HitCoverage=47%, E-value=2e-39, Identity=48%"; Hit description =GTP1/OBG family protein, expressed
  Pfam annotation: Domain name=GTP1_OBG; Domain location=31-176; Score=- 53.3; E_value=6.6e-06; Accession=PF01018.12; Description=GTP1OBG family
MKEPIYVHCAVTSANASPPPSMSLAKEPHKYFDHVIITVRTGDGGHGAVLNQQQQQEQGKMKLKKGKGSLKRDFDGSLILPIGGHGGDVVLYADESKDTLLEFHNTGRYHTKRSGNVDAMGILTLMLRDGLTAPTLCIVVPVGTVVKSKRGKMLADLAQPWDEVLVARGGQEEVLYIHH

SEQ ID NO: 146156 - protein, 60 aa, Glycine max
  Coding DNA Sequence Number=SeqID_29378
MGSFLNTQTASTTGEFGLREGIAPCNGDMHLQAEQIASVTGDIRASGNRQSNGRVPGAVS

SEQ ID NO: 146157 - protein, 36 aa, Glycine max
  Coding DNA Sequence Number=SeqID_29379
MAVSAISTMKRSPNPKGEEVNVAVEAEIYPTGTTVR

SEQ ID NO: 146158 - protein, 69 aa, Glycine max
  Coding DNA Sequence Number=SeqID_29380
MCSKETQRVTTELTVTHDSDNVTMANTNNKHTRIDEDEPPINEDQTQIEEKKMRGEIQRNGVGCWKKIP

SEQ ID NO: 146159 - protein, 467 aa, Glycine max
  Coding DNA Sequence Number=SeqID_29381
  Gene Ontology: Mol. function=nucleic acid binding; Cellular component= intracellular; Biological process=chromatin modification
  Homolog annotation: Hit_ID=Q5Z8K9; Match level="QueryCoverage=94%, HitCoverage=99%, E-value=1e-122, Identity=52%"; Hit description=Zinc finger protein-like
  Pfam annotation: Domain name=zf-C2H2; Domain location=106-130; Score =15.1; E_value=0.24; Accession=PF00096.16; Description=Zinc finger, C2H2 type
  Pfam annotation: Domain name=zf-C2H2; Domain location=270-297; Score =10.6; E_value=0.74; Accession=PF00096.16; Description=Zinc finger, C2H2 type
  Pfam annotation: Domain name=zf-C2H2; Domain location=4-28; Score =9.6; E_value=0.95; Accession=PF00096.16; Description=Zinc finger, C2H2 type
  Pfam module annotation: Pfam domain module=zf-C2H2::zf-C2H2::zf-C2H2; Domain location=106-130::270-297::4-28
MPGLTCNACNTEFKDDTEQKLHYKSEWHRYNLKRKNRNNCKSIVLRTFHRVIVEVSYNIRTWEEDVVTKEAYQVAGVPGVTEALFLARQSVLAQEKNKLGETPMLYTCGLCGKDYKSSKAHAEHLKSRGHMMRASEGTSHADEKAIVKPLPQRVVNRPPPRREVDNSENEESEDEWEEVDPEEDLVDGAAKSLTDLNVNEHGENVDMEVDDDFEELDPSCCFMCDQEHKTIENCMVHMHKHHGFFIPDVEYLKDPKGLLTYLGLKVKRDYMCLYCNDRCYPFSSLEAVRKHMEAKSHCKVHYGDGVDDEEVELEEFYDYSSSYVDDQGKQLVASCDASNNVELVGGSELIISRKSGDRSSTKTLGSREFLRYYRQKPRPSLANMAITAALASRYRSMGLTTIQSREKIVRMKVLKEMNRSGVDNMRTKMAMKSNVIRNLPKNGYHQHLDDKDTFLIGAFFGGSAAWS

SEQ ID NO: 146160 - protein, 55 aa, Glycine max
  Coding DNA Sequence Number=SeqID_29382
MGRSMLHVHTDMTGEAWTARHVGEATRELSEIRWGVRNPPIRESHVTGAIGKKSI

SEQ ID NO: 146161 - protein, 168 aa, Glycine max
  Coding DNA Sequence Number=SeqID_29383
  Subcellular localization annotation: CTP_CleavageSite=68; ConfidenceScore=5.26e-01
MHKALRSNAPLPYPHLITLFLQHFNVPLNSEPFVKVKRSFSIGVNVVSSFGYRKKRDGSWVKKDAPVQAAEDRSPSPPLQRDDSSSLMHNILDRLDGLHTFVSERFDSLDNRIDAMDARFARMDTRITKLEEDIVIIKKGEIVEAMSSKIILIMPKNQESSKFHRIKI

SEQ ID NO: 146162 - protein, 71 aa, Glycine max
  Coding DNA Sequence Number=SeqID_29384
MIDPPSPIRRHMKWKMTRTKKTGQMMSQTAKEIANKIDQTSQGSFVTHGRQDVLTAVIGQPEHPGHVRAAR

SEQ ID NO: 146163 - protein, 103 aa, Glycine max
  Coding DNA Sequence Number=SeqID_29385
MYKCYVRRFDVPRGKCGWIPKDLIVEINPIGPNLNWVCLKEKDSLWYMDSGYSRHMTGDKSRLTDFVLKEGGYATFGDNNKKRIMGEGNIGNQHKTHKKCFVC

SEQ ID NO: 146164 - protein, 135 aa, Glycine max
  Coding DNA Sequence Number=SeqID_29386
RVLGRALGREVSGDEEEAPLRQRLTPLAHRQWATVAVVEDIEHVDDVAGKAHEDSHDLVMEDECTELKLASHERKVEKLGMSTPKIEGLVVGAFHTYDAIDVDQAAKFLVELLGVTTQEVIDKTKQCRGAYVCLI

SEQ ID NO: 146165 - protein, 169 aa, Glycine max
  Coding DNA Sequence Number=SeqID_29387
MVRIRELHRDLGRVLGKTLGEEVSGDEEEAPQHQRPKASACRQWAATTIVEDIEHVDDAADEAHEEPHDPVTKDVDVDSQSFPSEPQDISVLTSYVDHVVAKVYLQDCTELKLASHGRTVEKLGRPAPEIEGLVAGTSHTYDAIDVDQVAQLLVDLLGVTTQEVVDETK

SEQ ID NO: 146166 - protein, 78 aa, Glycine max
  Coding DNA Sequence Number=SeqID_29388
MVSLDLLKESYDEVLQPGHRGLAVVALYPHSTYTVTCPLLRFSTQGLFANLTRVGKTYSVSRIICTYLPPKVLRLYLI

SEQ ID NO: 146167 - protein, 143 aa, Glycine max
  Coding DNA Sequence Number=SeqID_29389
MGLGMEKSANMRTSKPSRKGIDRKKRKGNKIARTHRRLGLGGIKVLVMPVTGGRNHLTGDRRKGMYVLKTVMYSLDRVFSKAVPKTLFELWTNRTPSIRHLIRIVKSGNVRFIENGEISGSIVPREVKIKEVRVQIPLVCTSS

SEQ ID NO: 146168 - protein, 273 aa, Glycine max
  Coding DNA Sequence Number=SeqID_29390
  Gene Ontology: Mol. function=nucleic acid binding; Cellular component= proton-transporting two-sector ATPase complex; Biological process=DNA integration
  Homolog annotation: Hit_ID=Q1S4N1; Match level="QueryCoverage=95%, HitCoverage=22%, E-value=2e-87, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVSLYVDDLGSHNELIGKFKERIKDAFEITDLGKMTFFLSMQVQQKHNEIFVYRQKYAKKVLRKFNMEECKPTATPMNQKEIFCKEDEAERVDERLYKSLIGCLMYLTTTRPDIMYVVSLLSRYMHCASKIHFQAAKKILRYVKGTIDYGIRFSQVKSFNPLGYYDSDWAGCVDDMRSTSGYCFTLGSEYIDVAVVVNQALWIRKLMIDLHTEPTESTQIFFDNQIVISIAYDPMFHGKTKHFKIKFFFLREVQKDGGVQLVTTRKYAFNIGY

SEQ ID NO: 146169 - protein, 112 aa, Glycine max
  Coding DNA Sequence Number=SeqID_29391
MYRGLGCISELEPHKTLLVEYKDHFSGQTQVAFAEAPNEALPLYCRPNFGAAWSMRVMIAGTHLAIPKFIYIKIIFLAVMPTSSLLLRRVDSILPSSITEFSNSPSYLVAAQ

SEQ ID NO: 146170 - protein, 54 aa, Glycine max
  Coding DNA Sequence Number=SeqID_29392
MDEHQQNWKEMANIMMKINKESDEMFNIVHVIDQLYDEVSRSFAIRWKDELDPM

SEQ ID NO: 146171 - protein, 84 aa, Glycine max
  Coding DNA Sequence Number=SeqID_29393
  Subcellular localization annotation: CTP_CleavageSite=63; ConfidenceScore=5.43e-01
MTAHVSDFAIARLLSTINGSTSKQTSTLGIKGLLAMLLKALGSVASAMACQASMGQLSTSNAVASKGTKGAKKRGIEEVGVEHK

SEQ ID NO: 146172 - protein, 221 aa, Glycine max
  Coding DNA Sequence Number=SeqID_29394
MHGSRRRESGTSAPGCGANESPLMKMPLIYSWGICWSWRRANAVNSFKEGARPRGSMRRPSVSSYVFQGKTSPEAWQGDGDHAFQTPSGPGEVQQGTRVSSLDHGPLPVLWGVGRHNSKVMQQGEDQQQPAVDAPPPPLLQPPSLKSIFAHLRRIELHMHAYMKHVTDQQAANHRGQFRATIAWLGDKPNFQAGEGPATALGDEDRAQEDDGTTNVMEYFL

SEQ ID NO: 146173 - protein, 175 aa, Glycine max
  Coding DNA Sequence Number=SeqID_29395
MKDKRDEEEKLENQKKKKDSKALSTKAKGKEKEEKDSSKKIVKKENHFATKCDIKRALLLKKSFYLLLSRETSFSISIPLELEVIPQVKELLDEGLVRKSLNPCALLVPKIGIMRHQILMIGGIINLKIKKKVVATNSSAGGRRVTRGCVFQERNTRGVAINVYLRKTSKKSEKT

SEQ ID NO: 146174 - protein, 68 aa, Glycine max
  Coding DNA Sequence Number=SeqID_29396
MAGPSDMALVLVTRMEKEKSIKAKGIDEEKTLHQSNQRSPFSLHTHQSHSFEVIIIQETMKRIRNHFI

SEQ ID NO: 146175 - protein, 379 aa, Glycine max
  Coding DNA Sequence Number=SeqID_29397
MEGRGFSGLYKNSSEELFLKTVMESPIGMPVPTMEMLGFKNVSQSFRTDSEELFKRWLTNGEASHYMIMISTELANNVSNQQHVGVASEGRNNDKLYMQNNLLANDVSGDINFPIRDPVNRELQSSSDLFLAKAWFLSDQRVTRSRSSELRRRYTEMQNSQTKQGMESMSMTPQHVVDTTKQEIAHFNGFDYITMTELPSQKGSFLSPSNSSSSTFHTHQLVDADKVSSCVSMLKGTLQRKRLGNQVEIEREAASDSLNGLFGPQEPIFQNGFHEGLENWSHQKPINVQGACTARVKDPGVYILSDGFANQTNQAYVDASREPSQSESSAAAPVISSGLDACEGPSNSNQNLCESSWKPVGVNRSSENTQNRVKGMDFT

SEQ ID NO: 146176 - protein, 72 aa, Glycine max
  Coding DNA Sequence Number=SeqID_29398
VKDQKGVPQPTVLETNFACGGVAGTMTRESAMSLRVYKNLKRRRVGAELLTYENPKLTTLSATLPCSSSAFV

SEQ ID NO: 146177 - protein, 671 aa, Glycine max
  Coding DNA Sequence Number=SeqID_29399
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q9C9W6; Match level="QueryCoverage=99%, HitCoverage=78%, E-value=0.0, Identity=77%"; Hit description =Putative trehalose-6-phosphate synthase; 46897-44149
  Pfam annotation: Domain name=Glyco_transf_20; Domain location=60-552; Score=891.3; E_value=4.3e-265; Accession=PF00982.11; Description =Glycosyltransferase family 20
MVSKSYSNLLELASGEAPSFGYMNRRIPRIMTVAGLISDVDDDPVESVCSDPSSSTAHRDRIIMVANQLPIRAQRRPNGNNRSCWSFEWDENALLQLKDGLGDDDIEVIYVGCLKEEVHPSEQDEVSQTLLETFKCIPTFLPADQFTKYYHGFCKQQLWPLFHYMLPLSPELGGRFNRSLWQAYVSVNKIFADRIMEVINPEDDYVWIHDYHLMVLPTFLRKRFNRVKLGFFLHSPFPSSEIYKTLPVREEILRALLNSDLIGFHTFDYARHFLSCCSRMLGLTYESKRGYIGIEYYGRTVSIKILPVGIHLGQLQSVLRMPQTEEKVCELIRQFSDKGRTLLLGVDDMDIFKGISLKLLAMEQLLIQHPEYREKVVLVQIANPARGRGKDVKEVQAETKATVKRINETFGKPGYDPVILIEEPLKFYERVAYYVVAECCLVTAVRDGMNLIPYEYIISRQGNETLDKVLGLASSPKKKSMLVVSEFIGCSPSLSGAIRVNPWNIDAVADAMDSALEMADLEKELRHEKHYRYVSTHDVGYWARSFLQDLERTCSDHVRRRWWGIGFGLSFRVVALDPNFKKLSMEHIISAYKRTATRAILLDYDGTLMPQSSTIDKSPSSKSIEILSSLCRDKNNMVFLVSARSRKMLSEWFCPCENLGVAAEHGYFLRQ

SEQ ID NO: 146178 - protein, 97 aa, Glycine max
  Coding DNA Sequence Number=SeqID_29400
MNDLVYVMYNLKLKSRQTRKNIALPFEDMKSDDEWITKEGDDIFDEDNLQVEQEQPLGESGSGSSIDLVGGSLTDPTLDAFDIDNLVLNDNVKDHFN

SEQ ID NO: 146179 - protein, 80 aa, Glycine max
  Coding DNA Sequence Number=SeqID_29401
  Gene Ontology: Mol. function=serine carboxypeptidase activity; Biological process=proteolysis
  Homolog annotation: Hit_ID=Q5W727; Match level="QueryCoverage=79%, HitCoverage=13%, E-value=2e-19, Identity=60%"; Hit description =Putative serine carboxypeptidase II
MISLPSKWICSHLQVGNPKTDDYYDYKGLLEYAWSHAVISDQQYDKAKQLCDFKQFEWSNECNKAMNEVFQDYSKIDIVE

SEQ ID NO: 146180 - protein, 187 aa, Glycine max
  Coding DNA Sequence Number=SeqID_29402
  Gene Ontology: Mol. function=protein serine/threonine kinase activity; Cellular component=cytoplasm; Biological process=protein amino acid phosphorylation
  Homolog annotation: Hit_ID=Q56YK2; Match level="QueryCoverage=55%, HitCoverage=30%, E-value=2e-28, Identity=54%"; Hit description =Protein kinase-like protein
ILCKSYPVEFASYFHYCRSLTFDQRPDYGLLKRLFRNLFTRAGYDSDYLFDWTILKYQQMQQEKTQSQPPAPLAVPTSLEPVDEDNHKGVNDSIKIAVATPKVNVDHQRVFKTTASNVQNLNAKIPEKHIVNNGSSVPTAMPRVSIENATKQVRPAGTSNVGHGLGNKTGASGCIVPSLRRTSSTRQ

SEQ ID NO: 146181 - protein, 234 aa, Glycine max
  Coding DNA Sequence Number=SeqID_29403
  Gene Ontology: Mol. function=protein serine/threonine kinase activity; Cellular component=plasmodesma; Biological process=protein amino acid phosphorylation
  Homolog annotation: Hit_ID=Q5NB70; Match level="QueryCoverage=91%, HitCoverage=46%, E-value=6e-90, Identity=73%"; Hit description =Putative dual specificity kinase 1
  Pfam annotation: Domain name=Pkinase; Domain location=2-232; Score =14.2; E_value=2.1e-09; Accession=PF00069.15; Description=Protein kinase domain
MYDLENRKTNQPQLQFEAKLYSTLQGGSGIPRMKWCGTDGDSNVLVIELLGPSLEDLFFFCGNKFSLKTVLMLADQLLTRIEYLHSKGFLHRDIKPDNFLMGLGKKANQVYMIDFGLAKEYRDPFTNKHIPYRENKGLTGTARYASYNAHSGIEQSRRDDLESLGYVLMYFLRGSYEGLDFLVLAFFSLPWQGLQAVTKRQKYDKICKKKLSTPIEFLFFCHKSEITDVPQSTR

SEQ ID NO: 146182 - protein, 38 aa, Glycine max
  Coding DNA Sequence Number=SeqID_29404
MATIMAIEFDASNNRSKLWLETNSQLLVHAFTHPTIEF

SEQ ID NO: 146183 - protein, 377 aa, Glycine max
  Coding DNA Sequence Number=SeqID_29405
  Homolog annotation: Hit_ID=Q1SS26; Match level="QueryCoverage=70%, HitCoverage=31%, E-value=7e-09, Identity=20%"; Hit description =Unnamed protein product; no similarity, hypothetical start
  Subcellular localization annotation: CTP_CleavageSite=73; ConfidenceScore=5.75e-01
MAESSKKRKGSSASASASRAHRSGATSASTAPIPPSLSSSPMFSSDEQQKRYSNLFSSRSIIDPKFIDMEFFSAETFDCIQAFQNLGLLPFMSLQLPIYPELVKAFYCNLEIQDITLISEIFGIKMVIDQSLFYDLTKLPSDGVPFEGTLNDDWKFDFSAHDARQLVCTNNADMTGRLLAGSLAFERCILHYLIVRILLPQSSNLAQVSEEDLIIMWAFHTGRQLDWAHLVRYRMHKALRLNAPLPYPQLVTLFFRHFQIPPDSEPYVPIKRSFLIGAAVIASFGYRKEHDGSWVKKGAPPADDEGNQPVEDNSSLLRKLLEKFDGLQTFVGDKFDNMELQVNMRFDAMESRITKVEEDVSFIRTCFDPPPPPPSSS

SEQ ID NO: 146184 - protein, 115 aa, Glycine max
  Coding DNA Sequence Number=SeqID_29406
  Subcellular localization annotation: CTP_CleavageSite=74; ConfidenceScore=5.63e-01
MLVRMIRTRLFAAARVKSCPSMHSSSVIASLSGCARTVGRPPISGGGPRTVKRKLLVRMWSTLKMRTRSPLKVRACNPLKARMYSPLEVRACSPLKVRACSPLTVRVTSTQGEDV

SEQ ID NO: 146185 - protein, 54 aa, Glycine max
  Coding DNA Sequence Number=SeqID_29407
VLICITSFLLRLSKKGGDSAQEEILIVKPEGGIDHVAHPHAITDTIMNDFNVSV

SEQ ID NO: 146186 - protein, 161 aa, Glycine max
  Coding DNA Sequence Number=SeqID_29408
  Gene Ontology: Mol. function=RNA-directed DNA polymerase activity; Biological process=RNA-dependent DNA replication
MGAYSRDEKLLMHFFQESLAGVAVIWYTNLETSRMRSWKDLITAFIRQYQYNTAPDTTQLQNMSKDFAAQVAPPMVEREIITMIVDTLPVFYYEKLVSYMPSSFADLVFAGERIEVGLERGKFDYIASASMSNRRFRATGEKKKKGDAHAVTSAPTWPKPQ

SEQ ID NO: 146187 - protein, 87 aa, Glycine max
  Coding DNA Sequence Number=SeqID_29409
MYIRLSNGVLLGECWLTFQEDGPNIKTNSLASHGGPAVNAVEECRPQRPKQMKDVETSRRFVLKALHEVGIVGFDGGYLLSTLGGSA

SEQ ID NO: 146188 - protein, 118 aa, Glycine max
  Coding DNA Sequence Number=SeqID_29410
MTFPEFKTQLDLLRECRQIVAIVSEVAKQSFKKKGMHAPAEKEKQPPSSSVQVVVTVAVPETVSYGDAMSMESNSNELELSFSEKMSSQPESDEVKAVATTSVWQSQVKPKSVERARD

SEQ ID NO: 146189 - protein, 182 aa, Glycine max
  Coding DNA Sequence Number=SeqID_29411
  Gene Ontology: Mol. function=voltage-gated chloride channel activity; Cellular component=membrane; Biological process=chloride transport
  Homolog annotation: Hit_ID=Q0IJ86; Match level="QueryCoverage=92%, HitCoverage=21%, E-value=1e-92, Identity=100%"; Hit description =Chloride channel
EERDPESNPLNEPLLKRNRTLSSNPLALVGAKVSYIESLDYEINENDLFKQDWRSRSRTQVLQYIFWKWTLAFLVGLLTGVIATLINLAVENIAGYKFLAVVNFIQKERYLRGFLYFTGINFLLTFVASILCVCFAPTAAGPGIPEIKAYLNGVDTPNMYGATTLFVKISIYGIQTLTFALV

SEQ ID NO: 146190 - protein, 42 aa, Glycine max
  Coding DNA Sequence Number=SeqID_29412
MLHKAMIVGAEFRKRFIGCFKRTMNDMSDTGNLSQQLQAKGK

SEQ ID NO: 146191 - protein, 605 aa, Glycine max
  Coding DNA Sequence Number=SeqID_29413
  Gene Ontology: Mol. function=binding; Cellular component=thylakoid; Biological process=photosynthesis
  Homolog annotation: Hit_ID=Q8GZN1; Match level="QueryCoverage=95%, HitCoverage=82%, E-value=0.0, Identity=73%"; Hit description=Pollen -specific calmodulin-binding protein
  Pfam annotation: Domain name=TPR_1; Domain location=110-143; Score =3.9; E_value=1.9; Accession=PF00515.18; Description=Tetratricopeptide repeat
  Pfam annotation: Domain name=TPR_1; Domain location=294-327; Score =14.4; E_value=0.1; Accession=PF00515.18; Description=Tetratricopeptid e repeat
  Pfam annotation: Domain name=TPR_1; Domain location=540-573; Score =16.7; E_value=0.055; Accession=PF00515.18; Description =Tetratricopeptide repeat
  Pfam annotation: Domain name=TPR_2; Domain location=110-143; Score =12.3; E_value=1.2; Accession=PF07719.7; Description=Tetratricopeptide repeat
  Pfam annotation: Domain name=TPR_2; Domain location=294-327; Score =15.2; E_value=0.24; Accession=PF07719.7; Description=Tetratricopeptid e repeat
  Pfam annotation: Domain name=TPR_2; Domain location=381-414; Score =0.6; E_value=28; Accession=PF07719.7; Description=Tetratricopeptide repeat
  Pfam annotation: Domain name=TPR_2; Domain location=450-483; Score =12.4; E_value=1.2; Accession=PF07719.7; Description=Tetratricopeptide repeat
  Pfam annotation: Domain name=TPR_2; Domain location=540-573; Score =16.2; E_value=0.12; Accession=PF07719.7; Description=Tetratricopeptid e repeat
  Pfam module annotation: Pfam domain module=TPR_1::TPR_1::TPR_1::TPR _2::TPR_2::TPR_2::TPR_2::TPR_2; Domain location=110-143::294-327::540- 573::110-143::294-327::381-414::450-483::540-573
MSFREFHANGSRMVTSEVEAKLDQGNIQEAEEALREGLSLNFEEARALLGKLEYQRGNVEGALRVFDGIDLQAAIQRLQPSFSEKTPVKKGRTRTESPSSVSQHAASLVLEAIYLKSKSLQKLGKFTEAANDCRRILDAVEKIFYLDNPDIQVDNRLQGIVSHAVELLPELWKQAGCYDEAISAYRRALLGQWNLHNDFCARIQKSFVIFLLYSGVEASPPSLAVQIDGSYVPKNNLEEAILLLMNFLKDFCLGKMKWDPSVMEHLTFALSICGGTSILAKQLEELRPGVYHRIDCWNTLALCYSGAGQNDSALNLLRKSLHKHERPNDLTSLLLAAKICSEDPYLAAEGVNHAQRAISNAHGPNEHLKGVALRMLGLCLGKQAKVASSDFERSHLQSKALESLVAAIRLEPNNSDLIFELAVQYAEHRNLPAALRSARHFFNKTGGSVSKSWRLLALILSAQQRFSEAEVVTDAALDQTARWEQGPLLRLKAKLMISQSRPMDAIETYRYLLALVQAQKKSFGPLQISSKVEEDKVNEFDTWHGLANLYASLSHWKDAEICLQKVRELKEYSAALMHTEGKTKTFLLFEVFYSSMLNLTPPLLI

SEQ ID NO: 146192 - protein, 230 aa, Glycine max
  Coding DNA Sequence Number=SeqID_29414
  Gene Ontology: Mol. function=protein binding; Cellular component =cytoskeleton; Biological process=synapse organization and biogenesis
  Homolog annotation: Hit_ID=O49673; Match level="QueryCoverage=88%, HitCoverage=77%, E-value=2e-51, Identity=56%"; Hit description =Ankyrin-like protein
  Pfam annotation: Domain name=Ank; Domain location=21-53; Score=21.1; E_value=0.004; Accession=PF00023.20; Description=Ankyrin repeat
  Pfam annotation: Domain name=Ank; Domain location=54-86; Score=33.4; E_value=8e-07; Accession=PF00023.20; Description=Ankyrin repeat
  Pfam annotation: Domain name=Ank; Domain location=87-119; Score=35.4; E_value=2e-07; Accession=PF00023.20; Description=Ankyrin repeat
  Pfam module annotation: Pfam domain module=Ank::Ank::Ank; Domain location=21-53::54-86::87-119
MGNPRKPSTADELHTAARSATLDNSLHLAAFSGQAEVVTYLCKQKADVGASAMDDMAAIHFASQKGHLEVVRALLSAGASLKATTRKGMTSLHYAVQGSHMELVKYLAKKGANLGAKTKAGKTPLDLATNEEIRSFLEEYEKSAKNGELGKKDKDKAEESDPKTSTLGSEGDLSSEPAAAAIDEEDNVGEKRKKGNEDGTREEESSQPKKARVNLSHLQSSDDTQEEENL

SEQ ID NO: 146193 - protein, 80 aa, Glycine max
  Coding DNA Sequence Number=SeqID_29415
  Gene Ontology: Mol. function=methyltransferase activity; Biological process=metabolic process
RFVSEIERTLKPEGVCVLHVALSRRADKYSANDLYSVQPLVELFKRSALVHVRSVDGFGLDTEVAFRKKGEPPPAAHHRL

SEQ ID NO: 146194 - protein, 77 aa, Glycine max
  Coding DNA Sequence Number=SeqID_29416
  Homolog annotation: Hit_ID=Q7XA24; Match level="QueryCoverage=94%, HitCoverage=36%, E-value=5e-21, Identity=67%"; Hit description =Putative kinesin-like protein, identical
MQNQAYQQVMDEAEKEYKKVSERITESRDAMKASYEEFMAEAQASASRACKTSIVELSQSFEKAIDSLRNRYGIPSN

SEQ ID NO: 146195 - protein, 109 aa, Glycine max
  Coding DNA Sequence Number=SeqID_29417
  Homolog annotation: Hit_ID=Q6Z9U4; Match level="QueryCoverage=98%, HitCoverage=52%, E-value=2e-08, Identity=38%"; Hit description =Kinesin-like
  Subcellular localization annotation: CTP_CleavageSite=49; ConfidenceScore=5.87e-01
MKKTGKKTKPTVADLLKSPSPVASPTANSPAIFKRAVSSSSKGAKRGSRVALATSTSPPRGHRAPSNISDLRNFASSGVDDLKRRIDRSHSEILKDLEASNSRLHKRFK

SEQ ID NO: 146196 - protein, 250 aa, Glycine max
  Coding DNA Sequence Number=SeqID_29418
  Gene Ontology: Mol. function=zinc ion binding; Biological process =intracellular signaling cascade
  Homolog annotation: Hit_ID=Q2QMP6; Match level="QueryCoverage=42%, HitCoverage=45%, E-value=2e-22, Identity=41%"; Hit description=DC1 domain-containing protein, putative, expressed
  Pfam annotation: Domain name=C1_1; Domain location=10-63; Score=-1.5; E_value=0.039; Accession=PF00130.12; Description=Phorbol estersdiacylglycerol binding
  Pfam annotation: Domain name=C1_2; Domain location=24-53; Score=26.1; E_value=0.00012; Accession=PF03107.7; Description=C1 domain
  Pfam annotation: Domain name=C1_2; Domain location=82-109; Score =29.5; E_value=1.2e-05; Accession=PF03107.7; Description=C1 domain
  Pfam annotation: Domain name=C1_3; Domain location=23-53; Score=33.4; E_value=7.7e-07; Accession=PF07649.3; Description=C1-like domain
  Pfam annotation: Domain name=C1_3; Domain location=81-109; Score =15.8; E_value=0.0071; Accession=PF07649.3; Description=C1-like domain
  Pfam module annotation: Pfam domain module=C1_1::C1_2::C1_2::C1_3::C1_ 3; Domain location=10-63::24-53::82-109::23-53::81-109
MSTKKGCPSHAEAMQLKQPGAPFKCSGCKQMGFGPSYHCESSNCSYVLHEECANAVSIAFHPFFSKSNFEFHEKAPGKRTRYCDGCGKDVLGFVYHCSTTGYDLHPCCLKLKHNISDQEGRVTLELCQKVPSKCVKCKHRNVVERVKGWSYVSSGGDCCYHVSCVKELILENWKKGYFSQETNNSIGMSSDRENTQVALRSMEIVPSGRRSRRINKYTKIAVLVFKLVVSAIFGNPISAIAALVEALVTD

SEQ ID NO: 146197 - protein, 103 aa, Glycine max
  Coding DNA Sequence Number=SeqID_29419
  Gene Ontology: Mol. function=hydrolase activity; Cellular component =microtubule; Biological process=cell division
  Homolog annotation: Hit_ID=Q8LF21; Match level="QueryCoverage=97%, HitCoverage=16%, E-value=2e-38, Identity=79%"; Hit description =Dynamin-related protein 1C
  Pfam annotation: Domain name=Dynamin_N; Domain location=38-101; Score= -31.1; E_value=0.0056; Accession=PF00350.13; Description=Dynamin family
MATMTSLIGLINKIQRACTVLGDHGGEGMSLWEALPTVAVVGGQSSGKSSVLESVVGRDFLPRGSGIVTRRPLVLQLHKTDDGQQEYAEFLHASRKRFTDFGK

SEQ ID NO: 146198 - protein, 633 aa, Glycine max
  Coding DNA Sequence Number=SeqID_29420
  Gene Ontology: Mol. function=two-component response regulator activity; Cellular component=nucleus; Biological process=two -component signal transduction system (phosphorelay)
  Homolog annotation: Hit_ID=Q8H7S7; Match level="QueryCoverage=71%, HitCoverage=63%, E-value=1e-119, Identity=52%"; Hit description =Putative response regulator 10
  Pfam annotation: Domain name=Myb_DNA-binding; Domain location=200 -250; Score=49.1; E_value=1.5e-11; Accession=PF00249.21; Description =Myb-like DNA-binding domain
  Pfam annotation: Domain name=Response_reg; Domain location=14-127; Score=93.8; E_value=5.3e-25; Accession=PF00072.14; Description =Response regulator receiver domain
  Pfam module annotation: Pfam domain module=Myb_DNA-binding::Response _reg; Domain location=200-250::14-127
MAPCAAAAEFPVGLRVLVVDDDATTLKIIEQMSIRCRYRVTTCTEATVALNLLRERKGCFDVVLSDVHMPDMDGYKLLEHVGLEMDLPVIMMSGDSTTSAVMKGIRHGACDYLIKPVREEELRNIWQHVVRKFWNDNKELDNSGSMEDSDRNKWGNDDAEYTSSVADAAEVVKAPKKRSSLKEEDIELESDDPATSKKPRVVWSVELHQQFVSAVNQLGLDKAVPKRILELMNVPGLTRENVASHLQKFRLYLKRLSGVAQQQNGMLNAIPGTIESKLGATGRFDIQALAAAGHVPPETLAALHAELLGHPATHMMSTVDQTTLLQASIQGLKHSHAEHAVAYGQPLVKCHSNIGKNFSPSILTVNDTSSGYGTWPSSNNTIGLVRPNSSVERVGIQNNNMLMDILEHQQSQQHQQKQQLQQQSLIHDQSCSINVQPSCMVVPSQSSDTFQAVNSPASVNQDFSFARNAIIDYSLLSQKSKNSFSASQFPGGDTKARGVLYGYSTPSTCSTSSSNGNRQQLQNSTLTFGAARPLPSLLPMSDRKDPYGFKSGDLLDQVCFRNLGFVGKGTCIPSRFVENEIESSVSDFSQMKVNVDSSGNTRNQEPNFINIPKVSHPIIERYPSRDHSRVFTE

SEQ ID NO: 146199 - protein, 123 aa, Glycine max
  Coding DNA Sequence Number=SeqID_29421
  Homolog annotation: Hit_ID=Q5Z7Y6; Match level="QueryCoverage=99%, HitCoverage=36%, E-value=5e-17, Identity=34%"; Hit description=F-box family protein-like
  Subcellular localization annotation: CTP_CleavageSite=22; ConfidenceScore=5.00e-01
MASLLNLPSLSSVFFSQTAEPRAHQRRGVERVGPKDQVLVRGWKIKGRGRAGERLWVVAARRTRRLAAETDWTERLRERKEGWRRRRRWWRGGWGGRGSHVAEMGSKVWNWMTAEEWEWERMA

SEQ ID NO: 146200 - protein, 194 aa, Glycine max
  Coding DNA Sequence Number=SeqID_29422
  Homolog annotation: Hit_ID=UPI000038D1B9; Match level="QueryCoverage =51%, HitCoverage=88%, E-value=1e-08, Identity=34%"; Hit description =COG0722: 3-deoxy-D-arabino-heptulosonate 7-phosphate (DAHP) synthase
  Subcellular localization annotation: CTP_CleavageSite=61; ConfidenceScore=5.31e-01
MYHTTHPMKSVAKSWTMMMPSPMQHIPLPSSLMNNISTHNSILCCDFNYVNLSNQRGTRLLCSARRQIRYQDDGDDKDSDEEYGHNEEIAKLESYSQSAKGEVLLVHALVDQEEVDVLIFKKDVSQQKFDCNTFQGFSSCLSYSTSPDPTRSILPARAVIVSIDRIKGPFNPANIEYLQKGVTWEEFKTNLLSN

SEQ ID NO: 146201 - protein, 478 aa, Glycine max
  Coding DNA Sequence Number=SeqID_29423
  Gene Ontology: Mol. function=GTPase activity; Cellular component =microtubule; Biological process=cell division
  Homolog annotation: Hit_ID=Q1SLG1; Match level="QueryCoverage=97%, HitCoverage=77%, E-value=0.0, Identity=83%"; Hit description=Dynamin central region; Dynamin; Dynamin GTPase effector
  Pfam annotation: Domain name=Dynamin_M; Domain location=132-409; Score=227.7; E_value=2.5e-65; Accession=PF01031.10; Description =Dynamin central region
  Pfam annotation: Domain name=Dynamin_N; Domain location=2-123; Score =91.2; E_value=3.1e-24; Accession=PF00350.13; Description=Dynamin family
  Pfam annotation: Domain name=GED; Domain location=422-478; Score=7.7; E_value=0.00059; Accession=PF02212.8; Description=Dynamin GTPase effector domain
  Pfam module annotation: Pfam domain module=Dynamin_M::Dynamin_N::GED; Domain location=132-409::2-123::422-478
MDVNNIKSHNSAVRQEISDETDRITGKTKAISNVPIQLSIYSPNVVNLTLIDLPGLTKVAVEGQSDTIVQDIENMVRSYVEKPNCIILAISPANQDIATSDAIKIAREVDPSGERTFGVVTKLDLMDKGTNAVEVLEGRQYKLQHPWVGIVNRSQADINKNVDMIVARKKEREYFETSPEYGHLAHKMGAEYLAKLLSEHLEYVIRMKIPSIIALINKAIDELNAELDRIGRPIAVDSGMCRAFDKVFKEHLDGGRPGGDRIYGVFDHQLPAALKKLPFNRHLSSKNVEKVVMEADGYQPHLIAPEQGYRRLIEGSIGYFKGPAEASVDAVHLILKELVRKSIAATEELKRFPTLQADIAAAANDALERFRDESRRTVTRMVDMESAYLTVEFFRKMHLEPEKNADQKNPSRNNPNPPVDSYTDTHLSKIGSNVNGYINMVLDTLKNSIPKAVVHCQVREAKRSLLNHFYVQVGRREV

SEQ ID NO: 146202 - protein, 270 aa, Glycine max
  Coding DNA Sequence Number=SeqID_29424
  Gene Ontology: Mol. function=hydrolase activity; Cellular component =nucleus; Biological process=snRNA processing
  Homolog annotation: Hit_ID=Q8GUU3; Match level="QueryCoverage=55%, HitCoverage=24%, E-value=4e-66, Identity=77%"; Hit description=FEG protein
  Pfam annotation: Domain name=Lactamase_B; Domain location=23-164; Score=43.6; E_value=6.7e-10; Accession=PF00753.17; Description =Metallo-beta-lactamase superfamily
MVLAHSAISHLLGLFAGAGQEVGKSCVVVTINAKRIMFDCGMHMGYLDHRRYPDFTRISPSRDLNSALSCIIITHFHLDHVGALAYFTEVLGYNGPVYMTYPTKALAPLMLEDYRKVMVDRRGEEELFSSDQIAECMKKVIAVDLRQTVQVEKDLQIRAYYAGHQNHLIQQVGVHTDSGWEWDFRWRRSLFDSEVINADSFLNDIEGKTVHPCRRDEWVWKAEPSGIYSTQSAYNLLQGEIIEASDDGVFAELWKLKVPKKISVFAWRLI

SEQ ID NO: 146203 - protein, 132 aa, Glycine max
  Coding DNA Sequence Number=SeqID_29425
  Homolog annotation: Hit_ID=Q5Z7Y6; Match level="QueryCoverage=96%, HitCoverage=34%, E-value=2e-17, Identity=34%"; Hit description=F-box family protein-like
MVNVKGDAAKEGVVYDVAEDAWKEMPEGMLHGWRGPVAAMEEEVMYVVDEAKGVLRRYVEEEDSWEEILENERLKGAEKIVAWRGKLCVVSASSGISVVDVAAPSPRIWSVRLPEGFEPVTVHILPRIPAGV

SEQ ID NO: 146204 - protein, 620 aa, Glycine max
  Coding DNA Sequence Number=SeqID_29426
  Gene Ontology: Mol. function=ATP binding; Cellular component =chloroplast; Biological process=response to heat
  Homolog annotation: Hit_ID=Q1SEZ3; Match level="QueryCoverage=98%, HitCoverage=98%, E-value=0.0, Identity=70%"; Hit description=Heat shock protein Hsp70
  Pfam annotation: Domain name=HSP70; Domain location=9-618; Score =1085.1; E_value=0; Accession=PF00012.10; Description=Hsp70 protein
  Pfam annotation: Domain name=MreB_Mbl; Domain location=7-393; Score= -241.0; E_value=0.0081; Accession=PF06723.3; Description=MreBMbl protein
  Pfam module annotation: Pfam domain module=HSP70::MreB_Mbl; Domain location=9-618::7-393
MAKKYEGCAVGIDLGTTYSCVAVWLEQHCRVEIIHNDQGNNTTPSCVAFTDQQRLIGEAAKNQAATNPENTVFDAKRLIGRKFSDPVIQKDKMLWPFKVVAGINDKPMISLNYKGQEKHLLAEEVSSMVLIKMREIAEAYLETPVENAVVTVPAYFNDSQRKATIDAGAIAGLNVMRIINEPTAAAIAYGLDKRTDCVEERNIFIFDLGGGTFDVSLLTIKDKVFQVKATAGNTHLGGEDFDNRMVNYFVQEFKRKNKVDISGNPRALRRLRSACERAKRILSYAVTTNIEVDALFQGVDFCSSITRAKFEEINMELFEECMETVDRCLSDANMDKSSVHDVVLVGGSSRIPKVQELLQGFFDGKVLCKSINPDEAVAYGAAVQAALLSKGIVNVPNLVLLDITPLSLGVSVQGDLMSVVIPRNTTIPVRRTKTYVTTEDNQSAVMIEVYEGERTRASDNNLLGFFTLSGIPPAPRGHPLYETFDIDENGILSVSAEEESTGNKNEITITNEKERLSTKEIKRMIQEAEYYKAEDKKFLRKAKAMNDLDYYVYKIKNALKKKDISSKLCSKEKENVSSAIARATDLLEDNNQQDDIVVFEDNLKELESIIERMKAMGKIG

SEQ ID NO: 146205 - protein, 600 aa, Glycine max
  Coding DNA Sequence Number=SeqID_29427
  Gene Ontology: Mol. function=microtubule binding; Cellular component =cortical microtubule, transverse to long axis; Biological process =cytoskeleton organization and biogenesis
  Homolog annotation: Hit_ID=Q1SLE1; Match level="QueryCoverage=99%, HitCoverage=95%, E-value=0.0, Identity=67%"; Hit description=Myosin II heavy chain-like
  Pfam annotation: Domain name=Myosin_HC-like; Domain location=213-565; Score=849.4; E_value=1.8e-252; Accession=PF07058.2; Description =Myosin II heavy chain-like
MAEVSGDGGGAALSVSGSFKEGRGSARRRGGGGGVRPPSMDADEFMNLLHGSDPVKVELNRLENEVRDKDRELSEAQAEIKALRLSERLREKAVEELTEELSKVDEKLKLTESLLESKNLEIKKINDEKKASMAAQFAAEATLRRVHAAQKDDDMPPIEAILAPLEAELKLARQEIAKLQDDNKALDRLTKSKEAALLEAERTVQVALAKASMVDDLQNKNQELIKQIEICQEENKILDKMHRQKVAEVEKLTQTVRELEEAVLAGGAAANAVRDYQRKVQEMNEERKTLDRELARAKVTANRVAVVVANEWKDANDKVMPVKQWLEERRFLQGEMQQLRDKLAIVERAAKYEAQLKEKYHLRLKVLEESLRGNSNSSNRGTPEGRSMSNGPSRRQSLGGADNFSKLTSNGFLSKRSPSSQLRSSLSSSTVLKHAKGTSKSFDGGTRSLERSKMLLNGTPPSYSFNQSMEETKEREASDNWKGNSDDKPNDFPTVDSVDSVPSVLYDFLQKEVIALRKAGHEKDQSLKDKDDAIEMLAKKVDTLTKAMEVEAKKMRREVAAMEKEVAAMRVEKEHENRAKRFSNIKGPVNIAQQQLISGR

SEQ ID NO: 146206 - protein, 80 aa, Glycine max
  Coding DNA Sequence Number=SeqID_29428
MNVNRKDFGGGEKVPVNFTSRLKVEAQPHKCISEVQNESQKDEASGPKGVGSKGKQRQLNSSCISEDSSRLSKCFEGKRF

SEQ ID NO: 146207 - protein, 343 aa, Glycine max
  Coding DNA Sequence Number=SeqID_29429
  Gene Ontology: Mol. function=binding; Cellular component=membrane of vacuole with cell cycle-correlated morphology; Biological process =phospholipid metabolic process
  Homolog annotation: Hit_ID=Q10PS3; Match level="QueryCoverage=97%, HitCoverage=48%, E-value=1e-149, Identity=77%"; Hit description=HEAT repeat family protein, expressed
  Pfam annotation: Domain name=HEAT; Domain location=127-162; Score =8.5; E_value=3.9; Accession=PF02985.12; Description=HEAT repeat
  Pfam annotation: Domain name=HEAT; Domain location=183-219; Score =3.3; E_value=17; Accession=PF02985.12; Description=HEAT repeat
  Pfam annotation: Domain name=HEAT; Domain location=2-38; Score=1.7; E_ value=26; Accession=PF02985.12; Description=HEAT repeat
  Pfam annotation: Domain name=HEAT; Domain location=238-274; Score =5.8; E_value=8.5; Accession=PF02985.12; Description=HEAT repeat
  Pfam annotation: Domain name=HEAT; Domain location=86-122; Score =38.4; E_value=2.5e-08; Accession=PF02985.12; Description=HEAT repeat
  Pfam module annotation: Pfam domain module=HEAT::HEAT::HEAT::HEAT::HEA T; Domain location=127-162::183-219::2-38::238-274::86-122
MADALSVIPAAVLRNLADKLYEKRKNAALEVEGIVKQLAGAGDHDRITAVITLLTTEFTYSPQANHRKGGLISLAAATVGLTTEAAQHLEQIVPPVLNSFADQDSRVRYYACEALYNIAKVVRGDFIIFFNQIFDALCKLSADSDANVQSAAHLLDRLVKDIVTESDQFRCPFLLLCYTFLCILFIEEFIPLLRERMNVLNPYVRQFLVGWITVLDSVPDIDMLGFLPDFLDVLLLKSVDYGRMAEILVQRAGSPDEFTRLTAITWINEFVKLGGDQLVPYYADILGAVLPCISDKEEKIRVVARETNEELRAIKADPAEAFDVGAILSIARSALGIQEYKGK

SEQ ID NO: 146208 - protein, 297 aa, Glycine max
  Coding DNA Sequence Number=SeqID_29430
  Gene Ontology: Mol. function=structural constituent of ribosome; Cellular component=small ribosomal subunit; Biological process =translation
  Homolog annotation: Hit_ID=Q1SLE0; Match level="QueryCoverage=77%, HitCoverage=82%, E-value=1e-126, Identity=97%"; Hit description =Ribosomal protein S5, bacterial and organelle form
  Pfam annotation: Domain name=Ribosomal_S5; Domain location=86-152; Score=140.1; E_value=6.1e-39; Accession=PF00333.10; Description =Ribosomal protein S5, N-terminal domain
  Pfam annotation: Domain name=Ribosomal_S5_C; Domain location=169-242; Score=131.6; E_value=2.2e-36; Accession=PF03719.5; Description =Ribosomal protein S5, C-terminal domain
  Pfam module annotation: Pfam domain module=Ribosomal_S5::Ribosomal_S5_ C; Domain location=86-152::169-242
MAERGGGERGGDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLMKTYGFLTPEFWKETRFSKSPFQEYTDLLAKPTGKTLILEEERLSDRLQRGANEFLRCPFKLFSRNTV

SEQ ID NO: 146209 - protein, 652 aa, Glycine max
  Coding DNA Sequence Number=SeqID_29431
  Homolog annotation: Hit_ID=Q10PS1; Match level="QueryCoverage=41%, HitCoverage=88%, E-value=6e-81, Identity=61%"; Hit description=UDP-3- 0-acyl N-acetylglucosamine deacetylase family protein, expressed
  Pfam annotation: Domain name=LpxC; Domain location=29-309; Score =147.8; E_value=2.8e-41; Accession=PF03331.4; Description=UDP-3-O -acyl N-acetylglycosamine deacetylase
  Pfam annotation: Domain name=zf-C3HC4; Domain location=601-641; Score= 44.5; E_value=3.5e-10; Accession=PF00097.15; Description=Zinc finger, C3HC4 type (RING finger)
  Pfam module annotation: Pfam domain module=LpxC::zf-C3HC4; Domain location=29-309::601-641
MVSDARFLPPAAALCSLLSVARLMHNVFLQRSQIIKTDWEAAANPSGLRGAARQGVAFGKGFDGETVSRTRFPRQVSPLCTTLYKGGFRIRTVEHLLSALEASGVDNCRIEIEDSDTQGHDAEIPIFDGSAREWVAAVEEVGLTVATDLDGKSVEKMAPHVNEPVYAWRNDSFVAAFPSEVVRITYGINFSQAPVIGCQWFSTPPLDNLVYSMQIALSRTFCIYEEVEQMRNAGLIKGGSLENAIVCSASKGWLNPPLHFSDEPCRHKILDLIGDLSLFAQFGNQGLPVAHIVAYKACDFVGVVVQPDASELLFMCSQGGRRNAEIPKHLRPRPAMSSQTAPTEAPEPYTPLLRSRTDAGRGPAPALALLLGRAGRRGPSMLVRETAARELEERRADWGYSKPVVALDMSWNMAFVVVSAAMLACTTSEHPTTPIRVWIVGYALQCLVHVLLVWLEYRRRSRRDSRSGSQRARDVESDAGSGDDDDYSDDGDGSSGNTSRSRLAVVFLAFDVFFAIFCVVLACLIGIALCCCLPCIIAILYAVAGQEGASEADLSMLPKYKFRILSDVDKPSGGAGSMVPIETSSAYLENERTLLLEDAECCICLCSYEDGAELHALPCNHHFHSSCIVKWLKMNATCPLCKYNILKGNEQV

SEQ ID NO: 146210 - protein, 115 aa, Glycine max
  Coding DNA Sequence Number=SeqID_29432
  Homolog annotation: Hit_ID=Q8GUU2; Match level="QueryCoverage=35%, HitCoverage=11%, E-value=6e-18, Identity=90%"; Hit description=RES protein
MKQSSFRQKRNEQPTNWTSLNLTKDEIILSRLQLLTYSSINALYIFSLQKQLNETTIKTQRVGKEDKLHSSSAISQCTTNGNDGCREEHAALLHPRMNRGIYNIPEKQQQQIIIK

SEQ ID NO: 146211 - protein, 203 aa, Glycine max
  Coding DNA Sequence Number=SeqID_29433
  Gene Ontology: Mol. function=hydrolase activity
  Homolog annotation: Hit_ID=Q8GUU3; Match level="QueryCoverage=87%, HitCoverage=26%, E-value=1e-49, Identity=56%"; Hit description=FEG protein
  Pfam annotation: Domain name=RMMBL; Domain location=47-89; Score =60.4; E_value=6e-15; Accession=PF07521.2; Description=RNA -metabolising metallo-beta-lactamase
MVAAHNAAIKNMEDDGYQLQVKYCVPGTIGHKLMSDKHDKVDLDPNTKIDVRCQIHQLAFSPHTDSKGIMDLVNFLSPKHVILVHGEKHKMASLKEKIHSELGIQCYDPANNETVTIPSANYVYAETSDTFIRSCLSPNFTFQKCSSVDLCNSTTVDRNLMPELQVEDERVAEGVLVLEKGKKAKIVHQDELLLMLEEQKHDA

SEQ ID NO: 146212 - protein, 47 aa, Glycine max; identical to SEQ ID NO: 134338
  Coding DNA Sequence Number=SeqID_29434

SEQ ID NO: 146213 - protein, 552 aa, Glycine max
  Coding DNA Sequence Number=SeqID_29435
  Gene Ontology: Mol. function=transporter activity; Cellular component= integral to membrane; Biological process=transport
  Homolog annotation: Hit_ID=Q9ZU96; Match level="QueryCoverage=98%, HitCoverage=99%, E-value=0.0, Identity=63%"; Hit description =Expressed protein
  Pfam annotation: Domain name=Ank; Domain location=119-149; Score=5.4; E_value=5.3; Accession=PF00023.20; Description=Ankyrin repeat
  Pfam annotation: Domain name=Ank; Domain location=153-186; Score =19.2; E_value=0.015; Accession=PF00023.20; Description=Ankyrin repeat
  Pfam annotation: Domain name=Ank; Domain location=187-217; Score =25.1; E_value=0.00026; Accession=PF00023.20; Description=Ankyrin repeat
  Pfam annotation: Domain name=Ank; Domain location=221-281; Score =10.7; E_value=0.89; Accession=PF00023.20; Description=Ankyrin repeat
  Pfam annotation: Domain name=Ank; Domain location=85-117; Score=12.5; E_value=0.49; Accession=PF00023.20; Description=Ankyrin repeat
  Pfam module annotation: Pfam domain module=Ank::Ank::Ank::Ank::Ank; Domain location=119-149::153-186::187-217::221-281::85-117
MDSNSKAVCFITHQAIFNAVRCGDLEGLKEQLKNKGEEGVSEVMSMQNDAGETMFYIAAEIGLREVFSFLFGLCDMEVLKIRAKSDLNPFHVAAKGGHLDIVREILSTWPEVCTLCDSSNTSPLYFAAIGDHLDVVNAILDVDVSSMMIVRKNGKTALHNAARYGILRIVKALIARDPGIVCIKDRKGQTALHMAVKGQSTSVVDEILQADLTILNERDKKGNTALHMATRKCRPQVIDSVVVPSPPPTGFKGAGFYFYCKSMVVSILLTYTALNVNAINNQKETALDLADKLRYGDSALEIKEALAECGAKHARHIGKVNEAMELKRAVSDIKHEVQSQLIQNEKTRKRVSGIAKELKKIHREAVQNTINSVTVVAVLFGSIAFMALFSLPGQYRKKQPEAGKANIADDAAFSAFCLLNATALFLSLAVVVAQITLVAWDTRSQRQVVSVINKLMWAACACTCGAFLAISFVVVGDETWLAISVTVLGAPILLGTLAYLCYFVFRRRFGLRSDSQGLVKRPSGSKSFSWSYSVNISDVDDYDSDHVKIYAL

SEQ ID NO: 146214 - protein, 75 aa, Glycine max
  Coding DNA Sequence Number=SeqID_29436
MWLKGVKTPVVLSGNYEECAKCASLSLACQAKRHFASVKRTLCAKSECHYDEAELSAPCCAKLRLSFVLKIVDLG

SEQ ID NO: 146215 - protein, 125 aa, Glycine max
  Coding DNA Sequence Number=SeqID_29437
  Gene Ontology: Mol. function=DNA binding; Cellular component=nucleus; Biological process=regulation of transcription
  Homolog annotation: Hit_ID=Q84QS1; Match level="QueryCoverage=53%, HitCoverage=23%, E-value=7e-20, Identity=64%"; Hit description =Transcription factor GT-3b
  Pfam annotation: Domain name=Myb_DNA-binding; Domain location=47-106; Score=22.5; E_value=0.0015; Accession=PF00249.21; Description=Myb -like DNA-binding domain
MFGGGGEDALAARLGMMPPSLLNPASVMSGEMSPAVPAAREERGPAQPQWSQQETREFIAIRAELERDFTASKRNKTLWEVVSAKMRERGFRRSPEQCKCKWKNLVNRYKHFVWSIVAFSVVDEF

SEQ ID NO: 146216 - protein, 191 aa, Glycine max
  Coding DNA Sequence Number=SeqID_29438
  Subcellular localization annotation: CTP_CleavageSite=36; ConfidenceScore=5.44e-01
MKRGPTPIIGSKSRSQAPPGRALPEQNNRLNQRNAKTTTKKSKTTTRNRSKVTPKKIDRIKDGVLRIYMFGETEKEKLERKKKGNCNLARGKGKEKGVIGDAIRCEGIQAGTEDAKGNRNQMKPGFIATEVEDAETLAQQKRTFGIDARWMMTTTKNAMATTSLQSSSKPQNNHQSTTKTLVDNGAIMANQ

SEQ ID NO: 146217 - protein, 90 aa, Glycine max
  Coding DNA Sequence Number=SeqID_29439
MNERLGVMWRPRKGVLQGNKTEGVFFSMLLCDRLQQDTARRDLVVRQPQIGVTVPKDQWQQNGDGRKMIRDATSRRRRVKKKLTTIGSHG

SEQ ID NO: 146218 - protein, 181 aa, Glycine max
  Coding DNA Sequence Number=SeqID_29440
MTNNLLDISHYYRAIIAEDYHERNTRAYRWTSTKTLPVSMYWKRLDRVTSDDFGNVQMIPPHSPCSRLCLEDIDDRWMHFSDYLAPPGDPIRHPPIVPDDTYVEPNMPQYPMAAVAIEEAPVHAFSHAEQPRHAVLLNLRIVAEATETYDVMQDCLRIARGVTVNCNVYVRSRQRRHMEDA

SEQ ID NO: 146219 - protein, 58 aa, Glycine max
  Coding DNA Sequence Number=SeqID_29441
MTEVSKGVQEHHMYSLEAMEGACDGQMKQRGHIIEGDGDLSYWKMETASFLMPHLHKN

SEQ ID NO: 146220 - protein, 262 aa, Glycine max
  Coding DNA Sequence Number=SeqID_29442
MKIFEWMQNRINGSNGKKKQSGSISTTSNYNMRHEPCKQEFSDWPQALLAIGTFGGNNLKEDSGGRSNNTAEDSSSFQDCTQEITLEDVGNLQNEFSIFFKGPNLAGEQEEHTNDLIKENESPCDGSNVSRGNFCPSNSIIFSRGKDCSLDHSSKKGVGKKSLSFLLKKMLACKSGFQPTPLFKDLLSTESRMEKILRAILHKKIYPQGSCSTTPFVKKYLEATPISDDGEDDDDEEELAAAAAENGCKWVKTDSEYIVLEI

SEQ ID NO: 146221 - protein, 113 aa, Glycine max
  Coding DNA Sequence Number=SeqID_29443
  Pfam annotation: Domain name=DUF1909; Domain location=2-73; Score= -4.0; E_value=0.021; Accession=PF08927.1; Description=Domain of unknown function (DUF1909)
MTRGKQKIEAQKRNAERNQKGKGSQLEARAVGLKVICPICKLFQQLLKVNGFVDDAKGLDYLLVSFLCIDCFTFKLHSLSDEKINPAQLANQNQLVDHYASKHPKEKPPAESS

SEQ ID NO: 146222 - protein, 108 aa, Glycine max
  Coding DNA Sequence Number=SeqID_29444
  Gene Ontology: Mol. function=cobyrinic acid a,c-diamide synthase activity; Biological process=selection of site for barrier septum formation
  Homolog annotation: Hit_ID=Q45RR8; Match level="QueryCoverage=51%, HitCoverage=17%, E-value=3e-09, Identity=60%"; Hit description =Plastid division regulator MinD
CVTIDMVLKAEKEVEVAKAKVSIDGDDGEAEADEGEANVGSGGGLGHVALAGGDDDNKGVEPEREDGRMRAEEECRVAGDGGVGEKVERGHWEGERGGGRRRRNTMVK

SEQ ID NO: 146223 - protein, 61 aa, Glycine max
  Coding DNA Sequence Number=SeqID_29445
MNTTRLTPRYTIHISSNMISLALQSEGIGKLRKGLGLLIKLASPHIKKVWNLRRKGSVCCI

SEQ ID NO: 146224 - protein, 123 aa, Glycine max
  Coding DNA Sequence Number=SeqID_29446
MASNHFSNFEGTYKNLRPPALIIAGCSVLVALVLSILLILQHLRSYTNPAELGITSANPKLVYIQEQKWIVAVISMVPIYAIESAGRIWLCFCINHDHYPYKAVLRVEPEVALAEEIVNRCME

SEQ ID NO: 146225 - protein, 72 aa, Glycine max
  Coding DNA Sequence Number=SeqID_29447
MHETQCGPPWVHRMNRKAWFKKNRGGGCRPARPGELSSPRRARLLPPEATAFWRNILEGPSEPGCYLHPHFY

SEQ ID NO: 146226 - protein, 101 aa, Glycine max
  Coding DNA Sequence Number=SeqID_29448
  Gene Ontology: Mol. function=protein serine/threonine kinase activity; Cellular component=cytoplasm; Biological process=protein amino acid phosphorylation
  Homolog annotation: Hit_ID=Q75GE8; Match level="QueryCoverage=85%, HitCoverage=16%, E-value=4e-23, Identity=63%"; Hit description =Putative calmodulin-domain protein kinase
MAVRKLRTAIDVEDVWQEVAIMLMLPEHANKVKLKATYKDEENVHLVMDLYTGGEPFDWIVTQGHCSERATANVARTIVEVVKMCHANRVKNAVCGCIAMC

SEQ ID NO: 146227 - protein, 52 aa, Glycine max
  Coding DNA Sequence Number=SeqID_29449
MAVPIASGCSSTCLLTFAPNRCFASLDDSSKQGKIDENIPMYLNEEHDQHGL

SEQ ID NO: 146228 - protein, 75 aa, Glycine max
  Coding DNA Sequence Number=SeqID_29450
  Subcellular localization annotation: CTP_CleavageSite=39; ConfidenceScore=5.57e-01
MTKEVIHSHNSVAPRLHFSSSPSSSKFFSQLSEKAILCRGNMPRRAACLGLKVSTRLGELELAQFLDALSGALLG

SEQ ID NO: 146229 - protein, 114 aa, Glycine max
  Coding DNA Sequence Number=SeqID_29451
MVPILHPTKKEKMSSINALSMKLLIFTLNLSLTCTSLGRVAELQRKQDKLNRQLIPQVDAVEPPLAEVASQPQPIVEDALATINTSYTPREVTPLTTFAPTGVPKERIQELLHL

SEQ ID NO: 146230 - protein, 61 aa, Glycine max
  Coding DNA Sequence Number=SeqID_29452
  Subcellular localization annotation: CTP_CleavageSite=47; ConfidenceScore=5.65e-01
MIAGHAQQPAGTVDLLRQHRQLTSRTSGSCRSGACSATSTSRVSGVSVTAISPCSTRGRRS

SEQ ID NO: 146231 - protein, 146 aa, Glycine max
  Coding DNA Sequence Number=SeqID_29453
  Gene Ontology: Mol. function=N-acetyltransferase activity; Biological process=N-terminal protein amino acid acetylation
  Homolog annotation: Hit_ID=Q5PK14; Match level="QueryCoverage=99%, HitCoverage=98%, E-value=4e-41, Identity=59%"; Hit description =Ribosomal-protein-alanine acetyltransferase
  Pfam annotation: Domain name=Acetyltransf_1; Domain location=43-121; Score=79.4; E_value=1.1e-20; Accession=PF00583.14; Description =Acetyltransferase (GNAT) family
  Pfam annotation: Domain name=FR47; Domain location=40-131; Score =28.4; E_value=2.5e-05; Accession=PF08445.1; Description=FR47-like protein
  Pfam module annotation: Pfam domain module=Acetyltransf_1::FR47; Domain location=43-121::40-131
MTAISFITPDLQPRLLEIERRAHAFPWSEQTFASNQGERYVNLCLHADGQLAGFAITQVVLDEASLFNIAVDPAFQRRGYARQLLQQLIAELEQRAVMTLWLEVRASNQPAIALYQQLDFHQVSVRPNYYPTASGREDAIIMALTL

SEQ ID NO: 146232 - protein, 206 aa, Glycine max
  Coding DNA Sequence Number=SeqID_29454
  Homolog annotation: Hit_ID=Q67YT8; Match level="QueryCoverage=97%, HitCoverage=38%, E-value=4e-52, Identity=51%"; Hit description=MRNA, complete cds, clone: RAFL24-09-C04
MDLFGIYQGLKTVHLQTLTKDRLEIILSTWIECGYVPSPAEVSEKEGINFLGVKGGKCLWPIRIGCLNPKDQIPKWSMKTIQCITDEDYYFVCVEIFEGLKRIGKPSILLSIREGAEAVHIIMGMLQACYIRRALLMNNTRWEIIIEESHASDSTMEDWFVIVEDAKKSAERDTSNLIEQMVGKGWMAKNILLSTQEQTRYSFICD

SEQ ID NO: 146233 - protein, 108 aa, Glycine max
  Coding DNA Sequence Number=SeqID_29455
SIGAAIALERPLAATETSVVGRIEVAAVASAIAPEQDGAIAGSTAVFNCYLDFKRKLANTLMPPLCRIVFDFPCAVVADLPYAIVSLPLPFECHDFQFFTMAEQTEHG

SEQ ID NO: 146234 - protein, 126 aa, Glycine max
  Coding DNA Sequence Number=SeqID_29456
  Gene Ontology: Mol. function=single-stranded DNA binding
  Homolog annotation: Hit_ID=Q58J68; Match level="QueryCoverage=73%, HitCoverage=24%, E-value=6e-22, Identity=53%"; Hit description =Mitochondrial SBP40
MVGHIGWGRTQVKPKHPDFKRKDRNSLWLGKDEKWVLPKLEGLQFDVPTAISKKGDGGEPCNDLVQNYANWWDNRLNKRNAKAPDFKHKETGKGLWLDSSSEWVLEKLPPPLKPKQSVDTERTLVS

SEQ ID NO: 146235 - protein, 159 aa, Glycine max
  Coding DNA Sequence Number=SeqID_29457
MGQCSRPTCFLLLSRVEVGGLTAQHHSTATASPVTPQSLENDNDKDDNEDLALYGGLFDNEQKRRFWRLKRNSKSLSKYCSVEDSKSGKGNSAICEAISLIFEMMVEGVEETTEGDEEIGCVLRKGGSVIKRMAAKIGEQLWILPKDKIPVFVHQLLMR

SEQ ID NO: 146236 - protein, 245 aa, Glycine max
  Coding DNA Sequence Number=SeqID_29458
  Gene Ontology: Mol. function=protein serine/threonine kinase activity; Cellular component=integral to membrane; Biological process=protein amino acid phosphorylation
  Homolog annotation: Hit_ID=Q9C867; Match level="QueryCoverage=97%, HitCoverage=36%, E-value=3e-90, Identity=80%"; Hit description =Protein kinase, putative
MYQPIFWSDLYLLMVSLPTLLEAREHSLGYYKFELLLGSVNSFVGNRGLCGVKINSTCRDDGLPDTNGQSTNSDQNQIGKKKYSGRLLISASATVGALLLVALMCFWGCFLYKKFGKNDRISLAMDVGAGASIVMFHGDLPYSSKDIIKKLETLNEEHIIGIGGFGTVYKLAMDDGNVFALKRIVKLNEGFDRFFERELEILGSIKHRYLVNLRGYCNSPTSKLLIYDYLPGGSLDEALHGKIPI

SEQ ID NO: 146237 - protein, 803 aa, Glycine max
  Coding DNA Sequence Number=SeqID_29459
  Gene Ontology: Mol. function=protein serine/threonine kinase activity; Cellular component=cell surface; Biological process =protein amino acid phosphorylation
  Homolog annotation: Hit_ID=Q5QLR7; Match level="QueryCoverage=96%, HitCoverage=96%, E-value=1e-167, Identity=42%"; Hit description=S -receptor kinase-like
  Pfam annotation: Domain name=B_lectin; Domain location=77-191; Score =115.1; E_value=2e-31; Accession=PF01453.15; Description=D-mannose binding lectin
  Pfam annotation: Domain name=PAN_1; Domain location=340-419; Score =1.9; E_value=0.1; Accession=PF00024.16; Description=PAN domain
  Pfam annotation: Domain name=PAN_2; Domain location=340-401; Score =7.3; E_value=0.00024; Accession=PF08276.2; Description=PAN-like domain
  Pfam annotation: Domain name=Pkinase; Domain location=520-793; Score =201.9; E_value=1.5e-57; Accession=PF00069.15; Description=Protein kinase domain
  Pfam annotation: Domain name=Pkinase_Tyr; Domain location=520-793; Score=98.4; E_value=2.2e-26; Accession=PF07714.7; Description =Protein tyrosine kinase
  Pfam annotation: Domain name=S_locus_glycop; Domain location=214-328; Score=3.2; E_value=2.2e-05; Accession=PF00954.11; Description=S-locus glycoprotein family
  Pfam module annotation: Pfam domain module=B_lectin::PAN_1::PAN _2::Pkinase::Pkinase_Tyr::S_locus_glycop; Domain location=77-191::340- 419::340-401::520-793::520-793::214-328
MAAIYTFSLILLSLVMCLQLSYSAVDTMHQGSSLSVEEPKDVMLSPNAMFSAGFYAVGENAYSFAVWYSEPNGRPPNPTFVWMANRDQPVNGKRSKFSLLGNGNLVLNDADGSVVWSTDIVSSSSAVHLSLDNTGNLVLREANDRRDVVLWQSFDSPTDTLLPQQVFTRHSKLVSSRSETNMSSGFYTLFFDNDNVLRLLYDGPDVSGPYWPDPWLAPWDAGRSSYNNSRVAVMDTLGSFNSSDDFHFMTSDYGKVVQRRLIMDHDGNIRVYSRRHGGEKWSVTWQAKSTPCSIHGICGPNSLCSYHQNSGLKCSCLPGYKRKNDSDWSYGCEPKVHPSCKKTESRFLYVPNVKLFGFDYGVKENYTLKECKELCLQLCNCKGIQYTFYDTKGTYTCYPKLQLRHASSIQYFTDDLYLKLPASSSYSNEGSTDEQGLNCSSRTIKIERTYDKGHENRYVKFLVWFATGVGGLELLCAFVVWFFLVRTTGKQDSGADGRVYALAGFRKFSYSELKQATKGFSQEIGRGAAGVVYKGVLLDQRVAAVKRLKDANQGEEEFLAEVSCIGRLNHMNLIEMWGYCAEGKHRLLVYEYMEHGSLAKNIESNALDWTKRFDIALGTARCLAYLHEECLEWILHCDVKPQNILLDSNYHPKVADFGLSKLRNRNETTYSSFSTIRGTRGYMAPEWIFNLPITSKVDVYSYGIVVLEMVTGRSITKDIEATDNGVVNQHLSMVTWLKERQKNGFTCVSEILDPTVEGVYDEGKMETLARVALQCIEEEKDKRPTMSQVVEMLQESSRETHNR

SEQ ID NO: 146238 - protein, 160 aa, Glycine max
  Coding DNA Sequence Number=SeqID_29460
  Gene Ontology: Mol. function=protein serine/threonine kinase activity; Biological process=protein amino acid phosphorylation
  Homolog annotation: Hit_ID=Q5VRR9; Match level="QueryCoverage=81%, HitCoverage=17%, E-value=1e-27, Identity=54%"; Hit description =Putative S-domain receptor-like protein kinase
MVRCASRGNEARLLRDCLESKKGVRWGIEALPNDGGIGGFGSEENEERVAVAQMMVPPASVKTTLPSFQRERCEPLPLTGLSRLAIHKTVGRSDLVNHTEKQKALSPTWKNPAEKSPLDETMVSFCFSTESEEPSGSLSIVPKEVGTKRRRRKSRTMRIA

SEQ ID NO: 146239 - protein, 96 aa, Glycine max
  Coding DNA Sequence Number=SeqID_29461
MKCYLNYIVIEVITGDQGVVSDNNMSVKGGWRDLPQWHSTMLSGIVVGPMTTTSQTTFSYVKLSFRYPIMSSTTILASKTKKEKKKKENGKRRRRS

SEQ ID NO: 146240 - protein, 396 aa, Glycine max
  Coding DNA Sequence Number=SeqID_29462
  Gene Ontology: Mol. function=protein serine/threonine kinase activity; Cellular component=membrane; Biological process=protein amino acid phosphorylation
  Homolog annotation: Hit_ID=Q10KZ7; Match level="QueryCoverage=90%, HitCoverage=91%, E-value=1e-102, Identity=50%"; Hit description =Protein kinase APK1A, chloroplast, putative, expressed
  Pfam annotation: Domain name=Pkinase; Domain location=90-342; Score =54.5; E_value=3.6e-13; Accession=PF00069.15; Description=Protein kinase domain
  Pfam annotation: Domain name=Pkinase_Tyr; Domain location=90-342; Score=43.4; E_value=3.9e-15; Accession=PF07714.7; Description =Protein tyrosine kinase
  Pfam module annotation: Pfam domain module=Pkinase::Pkinase_Tyr; Domain location=90-342::90-342
  Subcellular localization annotation: CTP_CleavageSite=16; ConfidenceScore=5.63e-01
MKQPSKPWRPFTANCCSTEDQTIFKNFSRCKPSRSDLSKNIAPLPSFRRLSFSDLSRSSSTRINEDLAQSFGSDLFDFQLSELRAITQNFSSNFLLGEGGFGTVHKGYIDDNLRLGLKAQPVAVKLLDIEGLQGHREWLAEVIFLGQLRHPNLVKLIGYCCEDEERLLVYEFMPRGSLENHLFRRLTSLPWGTRLKIATGAAKGLSFLHGAEKPVIYRDFKTSNVLLDSEFTAKLSDFGLAKMGPEGSNTHVSTRVMGTYGYAAPEYISTGKINKSVICTYFLAICFITSIMRTKEVEVHYGSKAFRPIFCEGCKGDGTFGIAMHKLNPKDRPRMPTIVETLEGLQQYKDMAVTSGHWPVSPKSTKNRVSNNNKVNVKARAGANHKQPSPVPSRKT

SEQ ID NO: 146241 - protein, 384 aa, Glycine max
  Coding DNA Sequence Number=SeqID_29463
  Homolog annotation: Hit_ID=Q10NK5; Match level="QueryCoverage=99%, HitCoverage=98%, E-value=3e-93, Identity=45%"; Hit description =Variant SH3 domain containing protein, expressed
  Pfam annotation: Domain name=BAR; Domain location=47-278; Score= -52.3; E_value=0.081; Accession=PF03114.8; Description=BAR domain
  Pfam annotation: Domain name=SH3_1; Domain location=320-374; Score =51.4; E_value=3e-12; Accession=PF00018.18; Description=SH3 domain
  Pfam annotation: Domain name=SH3_2; Domain location=321-374; Score =35.8; E_value=1.5e-07; Accession=PF07653.7; Description=Variant SH3 domain
  Pfam module annotation: Pfam domain module=BAR::SH3_1::SH3_2; Domain location=47-278::320-374::321-374
MDAIRKQASKLREQVARQQQAILRQLGQISNEPLMTDESEIECLQQLQKLYTSTKTAKEALLGYVYNQCVAQCSQHFQRHIVRAIEGFISVSSKQMEIVRRMARDCCKYGTENLGSSYPLARASLQFGNTYDTMENERETLLGILGDQISEPLRAQITGAPLEDARHLTHRYDKLHQEVEAQLSSHQAAEVLRRRSKLRNSSVSAESAVRLQNAETRLKELKSALAALGREATAAMLSVEEQQQQMTLQSLRTMVDAERSYHQHVLVILEKLYTEIIEERQPKEATSFPLPKDGYNQPADENANSNGIDYKHNSQTGTYFFAKVIHPFDAQAEGELSLSVDDFVVVRQVGPNGWSEGECKGNAGWFPSAYVQRQDMIPASKITE

SEQ ID NO: 146242 - protein, 394 aa, Glycine max
  Coding DNA Sequence Number=SeqID_29464
  Gene Ontology: Mol. function=transferase activity; Biological process= biosynthetic process
  Homolog annotation: Hit_ID=Q5VPB6; Match level="QueryCoverage=99%, HitCoverage=76%, E-value=1e-145, Identity=62%"; Hit description =Glycosyl transferase family 1 protein-like
  Pfam annotation: Domain name=Glycos_transf_1; Domain location=199 -364; Score=62.6; E_value=1.2e-15; Accession=PF00534.10; Description =Glycosyl transferases group 1
MERHAYTLHTALAQRGHKVHIFTSPPQEETTSTFSSDTTKEADANAPSSPYIHCHEGEPGKWRYNKAWEQFLEQNQKEPFDVVHSESVALPHWLARELPNLAVSWHGIALESLQSSIFQDLARTQDEPRSPNFDKGLQGVLPKILNEIRFFRKYAHHVAISDSCGEMLRDVYQIPNKRVHVILNGVDKDEFREDVELGKEFRIKIGIPSNASLVLGVAGRLVKDKGHPLLHEAYSMLITKYPNVYLIVAGSGPWENRYRDLGSHVLVLGSMSPSMLRAFYNAIDIFVNPTLRPQGLDLTMMEAMMSGKPLLASRFPSIKGSVVVDDAFGFMFSPNVESLLEALEAVVKEGKERLARRGKACREYAISMFTATKMALAYERLFLCIKEDRFCNYP

SEQ ID NO: 146243 - protein, 256 aa, Glycine max
  Coding DNA Sequence Number=SeqID_29465
MVGFYDLSDTDNDSAVEEIISQAQDAVVLDQVSAINCSAFTDDSLLPSHLETRFRNLKSFPPTKPKPNTIAKARTFSSNLSSANPQSPNFSPPKQNPDSGYTSSHEKKSFREKTKDGSLSVSASSPPSASASASSPCSDESSMSSLFKPKQKEEGSKQDSSVRSSNSPSPPRRRGCLWFFPKKKKEEEKEKKKKKSKQNWGDDLLSELGSFSRKEQQKMLKKAMKEEEKVSREAEKIVQWAKQASARFNLEDELSD

SEQ ID NO: 146244 - protein, 159 aa, Glycine max
  Coding DNA Sequence Number=SeqID_29466
  Homolog annotation: Hit_ID=Q2QYU1; Match level="QueryCoverage=60%, HitCoverage=16%, E-value=5e-30, Identity=68%"; Hit description =Nodulin-like family protein, expressed
  Subcellular localization annotation: CTP_CleavageSite=50; ConfidenceScore=5.04e-01
KFYFARTGWLAIGLVPTPVAFILLAVSDSAAALKTGTALIGLSSGFIFAAAVAVTSELFGPNSVSVNHNILITNIPIGSLLFGFLAALIYDENAYKIPGELMADTLILAQAMELLILEGGCIGVMILEAELKQGRVKILFLSPAMHQTGKTWKLWKHEV

SEQ ID NO: 146245 - protein, 41 aa, Glycine max
  Coding DNA Sequence Number=SeqID_29467
MEMAFQPLDKMKVIGIEWSMETRSYRSHLLEECTTLVECKD

SEQ ID NO: 146246 - protein, 109 aa, Glycine max
  Coding DNA Sequence Number=SeqID_29468
MEPEYTGESACCFCFPSTKKSVARNGKRSSGVLLSSEHVEWGKNDEILSDTSTFSVKEQERRLKKALEEEERASKEAERIVKWVKQESARIDVSAIKSILSDEKEANVK

SEQ ID NO: 146247 - protein, 137 aa, Glycine max
  Coding DNA Sequence Number=SeqID_29469
  Gene Ontology: Mol. function=protein serine/threonine kinase activity; Cellular component=cell surface; Biological process =protein amino acid phosphorylation
  Homolog annotation: Hit_ID=Q5VRR9; Match level="QueryCoverage=93%, HitCoverage=15%, E-value=1e-26, Identity=48%"; Hit description =Putative S-domain receptor-like protein kinase
  Pfam annotation: Domain name=B_lectin; Domain location=38-137; Score =73.4; E_value=7.1e-19; Accession=PF01453.15; Description=D-mannose binding lectin
  Subcellular localization annotation: CTP_CleavageSite=42; ConfidenceScore=5.07e-01
MSCSHKKNGMFSAGFYAVGQNAYSFAVWFSEPYGQTRNATVVWMANRDQPVNGKDSKISLLRNGNLALNDVDESLVWYTNTASLSSSVRLFFDNTGNLLLHETQATGVVLWQSFDFPTDTLLPQQVFTRHSKLVSSR

SEQ ID NO: 146248 - protein, 177 aa, Glycine max
  Coding DNA Sequence Number=SeqID_29470
  Gene Ontology: Mol. function=protein serine/threonine kinase activity; Cellular component=integral to membrane; Biological process=protein amino acid phosphorylation
  Homolog annotation: Hit_ID=Q9C867; Match level="QueryCoverage=99%, HitCoverage=33%, E-value=2e-85, Identity=80%"; Hit description =Protein kinase, putative
  Pfam annotation: Domain name=Pkinase; Domain location=3-159; Score= -28.2; E_value=7e-07; Accession=PF00069.15; Description=Protein kinase domain
  Pfam annotation: Domain name=Pkinase_Tyr; Domain location=1-159; Score=-79.8; E_value=1.4e-07; Accession=PF07714.7; Description =Protein tyrosine kinase
  Pfam module annotation: Pfam domain module=Pkinase::Pkinase_Tyr; Domain location=3-159::1-159
RAEQLDWDSRLNIIMGAAKGLAYLHHDCSPRIIHRDIKSSNILLDGNLDARVSDFGLAKLLEDEESHITTIVAGTFGYLAPEYMQSGRATEKSDVYSFGVLTLEVLSGKRPTDAAFIEKGLNIVGVQMESLDALLSVAIQCVSSSPEDRPTMHRVVQLLESEVVTPCPSDFYDSNSD

SEQ ID NO: 146249 - protein, 416 aa, Glycine max
  Coding DNA Sequence Number=SeqID_29471
  Homolog annotation: Hit_ID=Q2QYU1; Match level="QueryCoverage=98%, HitCoverage=66%, E-value=8e-86, Identity=44%"; Hit description =Nodulin-like family protein, expressed
  Pfam annotation: Domain name=DUF1218; Domain location=160-259; Score=- 14.1; E_value=0.037; Accession=PF06749.3; Description=Protein of unknown function (DUF1218)
  Pfam annotation: Domain name=Nodulin-like; Domain location=7-255; Score=360.3; E_value=3.1e-105; Accession=PF06813.4; Description =Nodulin-like
  Pfam module annotation: Pfam domain module=DUF1218::Nodulin-like; Domain location=160-259::7-255
MAGQSRKWMILVATIWIQAFTGTNFDFSEYSSSLKSHLNISQLQLNYLATASDMGKVFGWSSGLALMYLPLSLVLFIASSIGFIAYGLQWLAIKNLITLPYYLFFLLCLLSGCSICWFNTVCFVLCIRNFPVNRPLALSLTVSFNGVSAALYTLAANSIDPSSDALYLLLNALVPLLTSLAALVPILLQPPLDSLNRSPEASRRNSVIFLVLNFLAIFTGIYLLLFGSSTSDESTSRLYFGGAILFLISPLCIPGTIYARDWFHHAIHSSFRMEGSGFILVHVDDLELHKELLTRQNSTLSLSNGDGHGLLSENGSKYRSQSAKSSDVCCGKMFGQDQLAMLGEEHTAAVVVQRLDFWLYYVTYFCGGTIGLVYSNNLGQIAQSLGLSSSISTLVTLYSAFSFFGRLLSAVPDYIR

SEQ ID NO: 146250 - protein, 243 aa, Glycine max
  Coding DNA Sequence Number=SeqID_29472
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=95%, HitCoverage=18%, E-value=3e-73, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKNCNTAPVSVMPNLKLTEELYEKLVNATLFKQIIGSLRFLCNNRPDISYGVGLLSRFMGNPRALHMTAAKHILRSCIEAYSDSDWCGDKVERKSTFGYLFKYLDAPISWCSKKQSVVALSSCEAEYIGSAEAACQSLWLEALLEEMKLQYERLVQMYVDNKSTISLSKNPIYHGKSKHIKNKYHFLRGQVSKGRLELVYCSTNDQVAYVFTKPLKYERFEKLKTLLNLESAECFGLSGNVGV

SEQ ID NO: 146251 - protein, 240 aa, Glycine max
  Coding DNA Sequence Number=SeqID_29473
  Gene Ontology: Mol. function=chromatin binding; Cellular component =chromatin; Biological process=chromatin assembly or disassembly
  Homolog annotation: Hit_ID=Q2R2X7; Match level="QueryCoverage=86%, HitCoverage=81%, E-value=1e-54, Identity=54%"; Hit description=MRG family protein, putative, expressed
  Pfam annotation: Domain name=MRG; Domain location=23-240; Score=90.5; E_value=5e-24; Accession=PF05712.4; Description=MRG
VRQVEYRNTKGWQFLVHYLGWKKRWDEWLDLDRLMKHTEENMRKKHDLDEKLGNDKNAKVPRGSLAKSKPTNVSRGRKRRNESVIKGKPAVDPDKLVNIQIPPTLKKQLVDDCEFITHLGKLVKLPRTPNVKGILKNYFDYRLKKCGSVGDSVEEIMKGLSCYFDKALPVMLLYKNERQQYQEACPANVFPSAIYGAEHLLRLFGSCKKTRAHSSFLLIMLQKVLRTAPTNKVTRLVNNN

SEQ ID NO: 146252 - protein, 235 aa, Glycine max
  Coding DNA Sequence Number=SeqID_29474
  Gene Ontology: Mol. function=RNA-directed DNA polymerase activity; Cellular component=exocyst; Biological process=RNA-dependent DNA replication
MLVGIRVDELSLARFAGVLNCKCGRLPFVYLGIPIRANPRNEVMWEPVIRKLKSKLAVWKQKSPSIGGRLTLTNSVLASLPLYYASFFKIPPCVIKKIFRIQRGFLWGGEEDGGKVACVKWDDVCVAKGDGWLGIKNIKTFNVALFGKWRDFGEVYGQNGGGDEPSRFDRNLLWEVGNGKKIDVWVDGGWVRKLGWRRNWFTWEEPIVDDLNQILQRVMLSQEREDRLIWKAASS

SEQ ID NO: 146253 - protein, 251 aa, Glycine max
  Coding DNA Sequence Number=SeqID_29475
  Homolog annotation: Hit_ID=Q9STX3; Match level="QueryCoverage=40%, HitCoverage=62%, E-value=8e-35, Identity=69%"; Hit description=F-box protein GID2
  Pfam annotation: Domain name=F-box; Domain location=37-84; Score =26.7; E_value=8e-05; Accession=PF00646.23; Description=F-box domain
MKRPLSPSASGVNVEDRKMKKKAKAVENEDDNGERVEGLAHFDDNLLFEVLKHVDARTLAMSGCVNKQWHKTAQDERLWELICTKQWANTGCGEQQLRSVVLALGGFRRLHALYLFPLSKPQQTPSSSSSSTSSSSSSAWGPTIPQNRLGFGSEGIRECKGELAKGVIGGAGSVFFFFPKVNKETEAEACMSKSNTSISCLSTSLQIFSFMIVDWIRRNEELASSQMAGMSPSQPQGHPTPWFKNNPVCIV

SEQ ID NO: 146254 - protein, 67 aa, Glycine max
  Coding DNA Sequence Number=SeqID_29476
MGGLVGKQGWMMGNGAGEVKVKVRVVHLLLMVFEDDKERNECVSILWPSLHVPIRLLFILTTGESIN

SEQ ID NO: 146255 - protein, 754 aa, Glycine max
  Coding DNA Sequence Number=SeqID_29477
  Gene Ontology: Cellular component=cell surface
  Homolog annotation: Hit_ID=Q1RTL8; Match level="QueryCoverage=99%, HitCoverage=100%, E-value=0.0, Identity=66%"; Hit description=IMP dehydrogenase/GMP reductase
  Pfam annotation: Domain name=DUF1106; Domain location=314-398; Score=- 5.4; E_value=0.079; Accession=PF06523.2; Description=Protein of unknown function (DUF1106)
  Pfam annotation: Domain name=VWA; Domain location=330-497; Score =54.2; E_value=4.4e-13; Accession=PF00092.18; Description=von Willebrand factor type A domain
  Pfam module annotation: Pfam domain module=DUF1106::VWA; Domain location=314-398::330-497
MAEEFSKSVEEGLRLSKRIYFGNDRAVSPPKPPPSMSKSHTACLPTAPMLYAVIHDPAIVDNPDVPSYQPYVHGQCDPPALIPLHMIGNVHLQAHCYVNAVAFVTVSGSWRLHCVSGSRTCDCIVALPVPPQGSILGVEVSVHRKSYSTQLVDMKDNNGKENMIRAQDGGFVGLNLFTLRIPQIDGGSNLSVKISWYQKILYSNDVFCLNVPFNFPDFVNPVGKKMEKKEKIEIIMNAITGSEILCKTMSHPLKKVRHNAGSMGFSYESDVLSWSKTDFSFSYAVPDSSSHISGGVLLESPSVDDFDQREMFCMYLSPGNLQGRKIFRKDIVFVIDISGSMRGKLIDHTKNALSAALSKLNPHDSFSIIAFNGEIYQFSKSMELASKDAVERAIEWINMNFIAGGDTNILHPLNTAIEMLSDAQSSVPIIFLVTDGTVEDERQICDMMKNHMTNGESISPRIYTFGIDLIEPQMLKLFDKASSLVLANITMDIFNDVDEVEVCPSHIPDLSSDGPLLLCGRYKGSFPKDLEIKGVLPDFSNFVIDLKIQEAKGIPVQRICARDQIEYLTAQAWLSKDEKLEQMVAKLSLQTGFTSEYTSMTILEIDLRKKAKESDGKKLHSSIKIDKISHFLSSKSWQKVSKKSNPQSGAKEQEQRVILLPPLGIGFGNLTATAENIQPGSEETKGPDGAEIFVKAATNCCGTCCNYCCCMCCIQAFTRINNQCAIAFTQLCVGLGCFSCINCCADICCSGNEN

SEQ ID NO: 146256 - protein, 330 aa, Glycine max
  Coding DNA Sequence Number=SeqID_29478
  Gene Ontology: Mol. function=kinase activity
  Homolog annotation: Hit_ID=Q10JV0; Match level="QueryCoverage=83%, HitCoverage=60%, E-value=4e-77, Identity=53%"; Hit description=MAP kinase-activating protein C22orf5, putative, expressed
  Pfam annotation: Domain name=DUF300; Domain location=1-200; Score =187.9; E_value=2.4e-53; Accession=PF03619.7; Description=Domain of unknown function
GEGKVVEVLEDESAEQLSKSLLDGSDENHGIENRSFWNFFWYPSKLGKDLLTTEKFGLVQYTVCALLAFILELAGVYGDGEFKWYYGYPYIAVVLNFSQMWALYCLVQFYNVTHERLQPIKPLAKFISFKAIVFATWWQGVGIAVLCTFGVLPNEGKFQTGLQDFLISIEMAIAGVAHVFVFSAKPYHFLPPPAYGKVSKETIEAALEIDEGNKQKSAVLKEKITQVEAPTTSVTESVQDIVVEGGQRVVKDVVLTINQAIGPVEKGVTRIQETFHHKTVVSSDDDDDDDDDDDDDDDDDDDDDDDDDEEEEEEEEEEEDIQVEKDVAKS

SEQ ID NO: 146257 - protein, 498 aa, Glycine max
  Coding DNA Sequence Number=SeqID_29479
  Gene Ontology: Mol. function=structural constituent of ribosome; Cellular component=intracellular; Biological process=translation
  Homolog annotation: Hit_ID=Q9FN19; Match level="QueryCoverage=88%, HitCoverage=87%, E-value=1e-137, Identity=45%"; Hit description =Arabidopsis thaliana genomic DNA, chromosome 5, TAC clone:K8K14
  Pfam annotation: Domain name=WD40; Domain location=161-199; Score =46.9; E_value=6.9e-11; Accession=PF00400.22; Description=WD domain, G-beta repeat
  Pfam annotation: Domain name=WD40; Domain location=220-270; Score =17.9; E_value=0.037; Accession=PF00400.22; Description=WD domain, G -beta repeat
  Pfam annotation: Domain name=WD40; Domain location=273-311; Score =37.2; E_value=5.8e-08; Accession=PF00400.22; Description=WD domain, G-beta repeat
  Pfam annotation: Domain name=WD40; Domain location=315-352; Score =14.4; E_value=0.41; Accession=PF00400.22; Description=WD domain, G -beta repeat
  Pfam annotation: Domain name=WD40; Domain location=356-394; Score =54.8; E_value=2.9e-13; Accession=PF00400.22; Description=WD domain, G-beta repeat
  Pfam annotation: Domain name=WD40; Domain location=398-445; Score =40.6; E_value=5.4e-09; Accession=PF00400.22; Description=WD domain, G-beta repeat
  Pfam module annotation: Pfam domain module=WD40::WD40::WD40::WD40::WD4 0::WD40; Domain location=161-199::220-270::273-311::315-352::356 -394::398-445
MPTLWTREVSVLHRFLYCLQSDADMDEDFSFLQPLDLITKGPTELHNIVKAKKENLRQHKFESNKIMNDLSQDDSRRERVQETDKEMKEKENEHRLEKIRLEKEKEQPKLEYKETQHIDQNHTEKQEDKITVENLENRAQGGAEPMEISQSSMLSPDDTPCSDVKLLKGHTSEVFACAWNPSAPLLASGSGDSTARIWKIADGTCDSSVQNEPVNVVVLQHFKESTNEKSKDVTTLDWNLISFAMLFITTKGDGTLLATGSYDGQARIWSIDGELNCTLNKHRGPIFSLKWNKKGDYLLSGSVDKTAIVWNIKTGEWKQLFEFHTGPTLDVDWRNNVSFATCSTDKMIHVCKIGENRPIKTFSGHQDEVNAIKWDPSGSLLASCSDDHTAKIWSLKQDNFLHNLKEHVKGIYTIRWSPTGPGTNSPNQQLVLASASFDSTIKLWDVELGSVLYTLNGHSWTVWMKISRNPILDISSLNKLLSRAFEDICLLVLGFNVK

SEQ ID NO: 146258 - protein, 198 aa, Glycine max
  Coding DNA Sequence Number=SeqID_29480
  Gene Ontology: Mol. function=ATP-dependent helicase activity; Cellular component=intracellular; Biological process=DNA recombination
  Homolog annotation: Hit_ID=Q1RTN3; Match level="QueryCoverage=57%, HitCoverage=31%, E-value=2e-40, Identity=75%"; Hit description=ATP -requiring DNA helicase RecQ
  Subcellular localization annotation: CTP_CleavageSite=48; ConfidenceScore=5.10e-01
MGVDGFCWEGKRSRAFGRAMAMVPLDGSLSCVSTKISFKSFVRMNMLSLEMRVQKDVVESLQMQNPLMLKSSFNRPNIYYEVRYKDLLDDAYADLSNTLKSLGDVCAIVYCLERSMCDDLSTNLSQNGISCAAYHAGLNNKMRTSVLDDWISSKIKVVVATVAFGMQLHVALWWWWGWGEVSFLAPVHSSGHNSYELQ

SEQ ID NO: 146259 - protein, 221 aa, Glycine max
  Coding DNA Sequence Number=SeqID_29481
  Gene Ontology: Mol. function=ATP-dependent helicase activity; Cellular component=intracellular; Biological process=DNA recombination
  Homolog annotation: Hit_ID=Q1RTN3; Match level="QueryCoverage=99%, HitCoverage=56%, E-value=4e-76, Identity=66%"; Hit description=ATP -requiring DNA helicase RecQ
  Pfam annotation: Domain name=DEAD; Domain location=40-219; Score =54.8; E_value=2.9e-13; Accession=PF00270.19; Description=DEADDEAH box helicase
  Pfam annotation: Domain name=ResIII; Domain location=36-220; Score= -36.0; E_value=0.049; Accession=PF04851.6; Description=Type III restriction enzyme, res subunit
  Pfam module annotation: Pfam domain module=DEAD::ResIII; Domain location=40-219::36-220
MQKSALPLSDANANKKREELRRKETLVKLLRWHFGYPDFRDMQLDAIQAVLSGKDCFCLMPTGGGKSMCYQIPALAKAGIVLVVCPLIGKPSNGTKGERHSGRISLLNENNRCKSKGNLMHETPCSYLVGSGVDIHEDLDSGKPSTRLLYVTPELITTPGFMTKLTKIYTRGLLNLIAIDEAHCISSWGHDFRPSYRKLSSLRSHLPDVPILALTATAVPK

SEQ ID NO: 146260 - protein, 41 aa, Glycine max
  Coding DNA Sequence Number=SeqID_29482
MVVAVLTRHWLTAGQAYDKIHGGKNGKREGECMDISQWWLC

SEQ ID NO: 146261 - protein, 392 aa, Glycine max
  Coding DNA Sequence Number=SeqID_29483
  Gene Ontology: Mol. function=translation initiation factor activity; Cellular component=eukaryotic translation initiation factor 2B complex; Biological process=cellular biosynthetic process
  Homolog annotation: Hit_ID=Q1RTN1; Match level="QueryCoverage=81%, HitCoverage=86%, E-value=1e-136, Identity=80%"; Hit description =Initiation factor 2B related
  Pfam annotation: Domain name=ACP_syn_III; Domain location=127-204; Score=-20.8; E_value=0.087; Accession=PF08545.1; Description=3 -Oxoacyl-[acyl-carrier-protein (ACP)
  Pfam annotation: Domain name=IF-2B; Domain location=2-303; Score =373.7; E_value=2.9e-109; Accession=PF01008.8; Description=Initiation factor 2 subunit family
  Pfam module annotation: Pfam domain module=ACP_syn_III::IF-2B; Domain location=127-204::2-303
MVVRGAPAIAIAAALSLAVEVFNLDFNGSATDAVSLLQKKLEYLVTSRPTAVNLSDAATKLKEVISNAAATTSEGRSVFQVYIDAAEVMLEDDVASNRAIGSYGASIIQQQTEKQKLSVLTHCNTGSLATAGYGTALGVIRALHSAGVLKRAYCTETRPFNQGSRLTAFELVHEKIPGTLIADSAAAALMKAGHVDAVVVGADRVASNGDTANKIGTYSVALSAKFHNVPFYVAAPLTSIDLSLSSGQEIVIEERSPKELLNTHGGLGEQIAASGISVWNPAFDVTPANLISGIITEKGVITKTSAGDAFDIKAFVQKTGLKSIGVVGFFKSLFVITTLTSDDNNVMAMIKVLVMIDVTTMVMITSRDENRPDQPTGAYGLTYIKSGLNWPI

SEQ ID NO: 146262 - protein, 84 aa, Glycine max
  Coding DNA Sequence Number=SeqID_29484
  Homolog annotation: Hit_ID=Q1S1X7; Match level="QueryCoverage=67%, HitCoverage=4%, E-value=1e-08, Identity=52%"; Hit description =Integrase, catalytic region; Zinc finger, CCHC-type; Peptidase aspartic, catalytic
MDLIQAVNVVSEYMGNPRKEHWQPVKCIFKYLKGTTNIGLVYHDGASCALAGYSISNYAHIWMQGDMLLDVEYMALAKVTNEGM

SEQ ID NO: 146263 - protein, 351 aa, Glycine max
  Coding DNA Sequence Number=SeqID_29485
  Gene Ontology: Mol. function=kinase activity; Cellular component =nucleus; Biological process=regulation of progression through cell cycle
  Homolog annotation: Hit_ID=Q39877; Match level="QueryCoverage=84%, HitCoverage=90%, E-value=1e-157, Identity=88%"; Hit description =Mitotic cyclin a1-type
  Pfam annotation: Domain name=Cyclin_C; Domain location=190-326; Score= 126.2; E_value=9.4e-35; Accession=PF02984.9; Description=Cyclin, C -terminal domain
  Pfam annotation: Domain name=Cyclin_N; Domain location=83-188; Score =119.2; E_value=1.1e-32; Accession=PF00134.13; Description=Cyclin, N -terminal domain
  Pfam module annotation: Pfam domain module=Cyclin_C::Cyclin_N; Domain location=190-326::83-188
METRAAAKRKANAAIVVVVEKQHPKRQRVVLGELPNLQNLIVSKIQNPRKEKLQCRKNPNANKPSPTNNTLSSPQLDGSYVSDIHEYLREMEMQKKRRPMVNYIEKFQKIVTPTMRGILVDWLVEVAEEYKLLSDTLHLSVSYIDRKYEETDPPSVDEFCSITDNTYDKAEVVKMEADILKSLKFEMGNPTVSTFLRRYANVASDVQKTPNSQIEHLGSYIGELSLLDYDCLRFLPSIVAASVIFLAKFIIWPEVHPWALKVENLLQTSSLCECSGYKPAELKECVLILHDLYLSRKAASFKAVREKYKHQKVCVVELQGQQDHIRYESSIAFPDELSGTRPLKKDQLTRS

SEQ ID NO: 146264 - protein, 178 aa, Glycine max
  Coding DNA Sequence Number=SeqID_29486
  Gene Ontology: Mol. function=magnesium ion binding; Cellular component=cytosol; Biological process=regulation of transcription, DNA-dependent
  Homolog annotation: Hit_ID=Q24DC8; Match level="QueryCoverage=90%, HitCoverage=48%, E-value=2e-13, Identity=32%"; Hit description =Endonuclease/Exonuclease/phosphatase family protein
  Pfam annotation: Domain name=Exo_endo_phos; Domain location=1-173; Score=-11.3; E_value=0.063; Accession=PF03372.13; Description =EndonucleaseExonucleasephosphatase family
MAAFKLKDRSHHIVIVANTYLLAMKDPDWADVKLAQAKYLLSRIAKFKTLISDRYECIPEVILAGDFNSTPGDMVYQYLVSGNPSSNLTPDCLEESPSPIPLCSVYASTRGEPPFTNYTPGFTGTLDYILFSPSDNIKPISFLELLDSDAADIVGGLPNFSYPSDHLPIGAEFEIIKE

SEQ ID NO: 146265 - protein, 563 aa, Glycine max
  Coding DNA Sequence Number=SeqID_29487
  Gene Ontology: Mol. function=transition metal ion binding; Cellular component=nucleus; Biological process=regulation of transcription, DNA-dependent
  Pfam annotation: Domain name=Transposase_21; Domain location=50-230; Score=-135.4; E_value=0.0047; Accession=PF02992.5; Description =Transposase family tnp2
MIHDVGQKSFQQAHAPLYDTLQSDLKKPLYLGCTNFTRLSAVLDLVNLKARYEWSDKSFTKLFDVLEKMLPNQNTLPKNHYDAKKIICPPGPRQPRNNIDDYLSPLVEDLRKLREDKVGVLDGYHQQTIKLHAMKNVCDSLINTLLNIKGKTNDGLNARQDLVDIGICEQFHPITTEEEAIEFCSEYMKKEKSIWFLESRHDNRWGGKGSRGFKIVTMGRLEFNQVHLYILNNTKEVVPYIASHKGFFKVLQEHNKTFINQFKDTIFHDDNASETLRALADGPKRNVLTSKGYDINNYSFYTKSQDEKSTVQNSRVSIDAHAKHYCSASDNPIMVSIPYFGVIQQIWEVDYSHLRVPIFKYLYNVAYKDKPFIMSEQAKQVFYVQHLCSSKLSMVLQGRIRGVTHENQDSTLDFCDTPFSTHMSSIQAKHEVHMVTPPSSPPQDFSSPLESTSRRRRTRQCTQLKRLVAKHLDPSRPVVHVNLPLGKLHTHIWEQFSANRKTPSQQKAQECQKHNMWQHVLSRGGYDLLEKKLMAKKMKKRQEESIAIGSSGVVNPPSPIKGM

SEQ ID NO: 146266 - protein, 109 aa, Glycine max
  Coding DNA Sequence Number=SeqID_29488
  Gene Ontology: Mol. function=kinase activity; Cellular component =nucleus; Biological process=regulation of progression through cell cycle
  Homolog annotation: Hit_ID=Q39877; Match level="QueryCoverage=85%, HitCoverage=22%, E-value=6e-30, Identity=71%"; Hit description =Mitotic cyclin a1-type
  Pfam annotation: Domain name=Cyclin_C; Domain location=1-108; Score =7.9; E_value=0.0093; Accession=PF02984.9; Description=Cyclin, C -terminal domain
MDYDCIRFLPSTVAASVIFLARFIISPEVHPWNKLLPDFKALKVENLLQTSSLCECSGYKPIELKECVLILHDLYFSRKAESFKAVREKYKQPKGSQITDAFCELLVRR

SEQ ID NO: 146267 - protein, 183 aa, Glycine max
  Coding DNA Sequence Number=SeqID_29489
  Gene Ontology: Mol. function=ATP-dependent helicase activity; Cellular component=nucleoplasm; Biological process=DNA recombination
  Homolog annotation: Hit_ID=Q1RTN4; Match level="QueryCoverage=89%, HitCoverage=40%, E-value=3e-66, Identity=76%"; Hit description=ATP -dependent DNA helicase RecQ
MGIDRKDVRIVCHFNIPKSMEAFYQESGRAGRDQLPSRSLLYYGVDDRKRMEFILRKSVSKKSQSSSSQEESSKMSLIAFNLMVEYCEGSGCRRKRVLESFGEQVTASLCGKTCDGCRHPNLVARYLEDLTTACALRQKNGSSRVFMTSSTDAINGEQLSEFWNQDEEASGSEEDISDSDGST

SEQ ID NO: 146268 - protein, 152 aa, Glycine max
  Coding DNA Sequence Number=SeqID_29490
  Gene Ontology: Mol. function=ATP-dependent helicase activity; Biological process=DNA recombination
  Homolog annotation: Hit_ID=Q1RTN4; Match level="QueryCoverage=98%, HitCoverage=44%, E-value=2e-40, Identity=55%"; Hit description=ATP -dependent DNA helicase RecQ
SNKVDKNAISDPMRGSSRQRLQNALKQVQQRLDNFKIEMETSASFLEEECYKKYGKLKTSSSQLISPSHQLNSPSHRQPALDPYARDTSNEHSGTARSETSACVLPMEGSFSTNLPQIPSFSEFVNSRKAKGDQLHDTKRHSSRVEKKMRIQ

SEQ ID NO: 146269 - protein, 290 aa, Glycine max
  Coding DNA Sequence Number=SeqID_29491
  Gene Ontology: Mol. function=strictosidine synthase activity; Cellular component=membrane; Biological process=biosynthetic process
  Homolog annotation: Hit_ID=Q1RTN5; Match level="QueryCoverage=92%, HitCoverage=54%, E-value=2e-44, Identity=62%"; Hit description =Soluble quinoprotein glucose dehydrogenase
  Pfam annotation: Domain name=Str_synth; Domain location=214-290; Score=46.7; E_value=7.7e-11; Accession=PF03088.7; Description =Strictosidine synthase
MASNLIRVSTSLVLVVLVALTVQIFYISPIDPVLLDIKPAPSTKDNQLQNIIKLGEGLLKEPEDVVVDKEGTLYTATRDGWIKRLRRNNGKWENWKHIDSHTLLGIATAKEGGLIVCDTSKGLLKVTEEDGFSVLVSHVNGSQLSTFLFLSQNHLHMAELHVRPASQYNPSRKRVVIGTIDFITIRYTLDKNGIVFRWTSRITGTTTTLIRFADDVIEGSNGNVYFSVVSTKFDLQDWYLDVLEARPRGQVLKYNPTSNETVIVLDNVAFANGVALSKDEDYLVVCETWK

SEQ ID NO: 146270 - protein, 222 aa, Glycine max
  Coding DNA Sequence Number=SeqID_29492
  Gene Ontology: Mol. function=strictosidine synthase activity; Cellular component=membrane; Biological process=biosynthetic process
  Homolog annotation: Hit_ID=Q1RTN5; Match level="QueryCoverage=99%, HitCoverage=77%, E-value=7e-72, Identity=51%"; Hit description =Soluble quinoprotein glucose dehydrogenase
  Pfam annotation: Domain name=Str_synth; Domain location=36-117; Score= 8.4; E_value=0.00021; Accession=PF03088.7; Description=Strictosidine synthase
ESEDVCVDKEGTLYTATRDGWIKRLRRNKGNWENWKHMDSDTLIGITTAKEVGIIVCDVTKASSHGQVLKYNPTSNETVIFLNNVVAFANGVALSKDEDYLVACEIWKCIRHWLKGANKGITDVLIENLPGAPDNINLAPDGSFWIPLILLTSKGLEFVHKYKTTKHLVDSFPRLIVVNVATDGKIIREFDDADWKVITFVTSALEFEDHLYLGNLNCNFLG

SEQ ID NO: 146271 - protein, 251 aa, Glycine max
  Coding DNA Sequence Number=SeqID_29493
  Gene Ontology: Mol. function=aldehyde dehydrogenase (NAD) activity; Cellular component=cellular_component; Biological process=metabolic process
  Homolog annotation: Hit_ID=Q84P31; Match level="QueryCoverage=99%, HitCoverage=60%, E-value=3e-66, Identity=89%"; Hit description =Aldehyde dehydrogenase family 7 member A1
  Pfam annotation: Domain name=Aldedh; Domain location=1-234; Score= -53.0; E_value=2e-13; Accession=PF00171.12; Description=Aldehyde dehydrogenase family
LVAEVLERNKLPGAIFTSFCGGADIGQAIAKDTRIPLVSFTGSSKVGLMVQQTVNERFGKCLLELSGNNAIIVMDDADIKLAVRSILFAAVGTTGQRCTTCRRLGGKILTGGSVLESGGNFVQPTIVEISPDAPVVKEELFGPVLYVMKFQTLEEAIALNNSVPQGLSSSIFTQRPGTIFKWIGPRGSDCGIVNANIPTNGAEIGGAFGGEKATGGGREAGSDSWKQYMRRSTCTINYGSELPLAQGINFG

SEQ ID NO: 146272 - protein, 104 aa, Glycine max
  Coding DNA Sequence Number=SeqID_29494
  Gene Ontology: Mol. function=aldehyde dehydrogenase (NAD) activity; Cellular component=cellular_component; Biological process=metabolic process
  Homolog annotation: Hit_ID=Q84P31; Match level="QueryCoverage=92%, HitCoverage=19%, E-value=3e-48, Identity=97%"; Hit description =Aldehyde dehydrogenase family 7 member A1
IPAPKRGEIVRQIGEALRAKLDPLGRLVSLEMGKILPEGIGEVQEIIDMCDYCVGLSRQLNGSIIPSERPDHMMFEVWNPLGIVGVISAFNFPCAVLAALQSFI

SEQ ID NO: 146273 - protein, 61 aa, Glycine max
  Coding DNA Sequence Number=SeqID_29495
MAQIVMSFVVSCDDAWTKLKKAYANRSLAKILSFKLKEQLATISKGSPFVHDYLHQCNFAL

SEQ ID NO: 146274 - protein, 104 aa, Glycine max
  Coding DNA Sequence Number=SeqID_29496
MLFSKRSYETIMLRPLLERIAVPAAILIAEGGAHPGAGELGGAGMGGCSGGEGGSLMGVVEDLEEVLGDGGANVVVCRGVHDGLHLGSREEKVNSYDFSLLKFF

SEQ ID NO: 146275 - protein, 166 aa, Glycine max
  Coding DNA Sequence Number=SeqID_29497
TGCTLSALACDSLLPRWLLEVSGLLGLSGPDVLSEVNMPPRNRHASDSISDETSTQPQNVAPRDHGRGGSHGQGRHGRGGGMPNVEVPRATRGNPTLAQLTANMKNMHETLRQLAHADPQAFIDEESWIFRGLGSSPTQMSYLFRVIARQGDMTYGQALNRAITAE

SEQ ID NO: 146276 - protein, 309 aa, Glycine max
  Coding DNA Sequence Number=SeqID_29498
  Gene Ontology: Mol. function=DNA binding
  Homolog annotation: Hit_ID=Q1RTB4; Match level="QueryCoverage=90%, HitCoverage=62%, E-value=2e-30, Identity=30%"; Hit description=IMP dehydrogenase/GMP reductase
MVEVSVEAIASLTQYYDQPLRCFTFRDFQLVPIVEEFEEIMGCPLGGRKPYLFSRFYPSMEKVVKVVKISIQELDHVKQNRNGVVEIPRKHLEEKAKALADQGEWASFIDILTLLIFGFVLFPNVDGLVDLEAIDAFLAYHHSKESPIIAILADVYDMFDRRCEKSGPRIVCYTLALYEGITGVFSSCEGFPNVPLLGTRGCIIYNPVLAIRQLGYPMRGAPSEENITPFIAWDFSDPNARVLQGVCKAWDAVQRKDKKLWGSSNGIIDDSHKWLRAQTKELDWLPKLMVAREEETETLEESEEVQGGT

SEQ ID NO: 146277 - protein, 204 aa, Glycine max
  Coding DNA Sequence Number=SeqID_29499
MVEEWGLEEWWLAEVPEEPPKQHDLESFWSPVKPKKDLLGSCSFPYIRQVNDRAQRLEDEIMLARSMSIFMIILYIIWALSMLRLEVQEVGENAPCLSQSSHILPQDLPWPLDVQNEMASEQAELGFNGLVVWVSMEELGEAILWVVDVGIEFLHQGHDVREMNVVLVFVLGNLKCEPGGIPDWFHFLRVALTYGGLALLRGHL

SEQ ID NO: 146278 - protein, 77 aa, Glycine max
  Coding DNA Sequence Number=SeqID_29500
  Subcellular localization annotation: CTP_CleavageSite=45; ConfidenceScore=5.37e-01
QSSNMKIVLNQSLILASPPSVIYQPSSFSALAVDLASTVVVNMPRTMEEDDALRDPSLPEVECMRVRLQGNKEGANH

SEQ ID NO: 146279 - protein, 191 aa, Glycine max
  Coding DNA Sequence Number=SeqID_29501
  Gene Ontology: Mol. function=RNA-directed DNA polymerase activity; Biological process=RNA-dependent DNA replication
VIIFTDHATIKYLPTKVDAKPRLIKWVLLLQEFDIEIKDKKGCEILVVGHLSRMPMSICYTVISVRELELFRGEMRCPYRISLRALINDGGSTSVMHNCRKSWDTTMSDIRSLLPTILKQMVRLRTAFKTPIGLSPFQIVYRKTCHLLVEMEHKAYSALKFLNFDESLSREKWKLQLLELEKMRLNAYDSS

SEQ ID NO: 146280 - protein, 109 aa, Glycine max
  Coding DNA Sequence Number=SeqID_29502
  Subcellular localization annotation: CTP_CleavageSite=48; ConfidenceScore=5.18e-01
MAPPLTSSPWWKSPLKDLIEAQRSILHRSFSSKLPPMVPLSFVLQFFVAETYMSQHALLWASEARLTGALSKGGKMRGVATNVFLWKTSEKPKETGQNENSKFGSCIYV

SEQ ID NO: 146281 - protein, 76 aa, Glycine max
  Coding DNA Sequence Number=SeqID_29503
MTSHGSRLIGGGCMNDNQFMGLQIKVENGELANSARQSIRGAPNKSGEWRILEIGELENSARQSIRGAPESLVEDA

SEQ ID NO: 146282 - protein, 117 aa, Glycine max
  Coding DNA Sequence Number=SeqID_29504
MESPLHLALLLWSLEEVFVDGGRQRGRCKGICVQSDYFGCKKKKGCKKTMRRGTLTEKGLSKGYVDDKDEVEDDTLIFDTQKLMKSLLEVCCLVKNHVDEGEKEEEEEDKEKKGYIL

SEQ ID NO: 146283 - protein, 327 aa, Glycine max
  Coding DNA Sequence Number=SeqID_29505
  Gene Ontology: Mol. function=phospholipase A2 activity; Cellular component=kinesin complex; Biological process=lipid metabolic process
  Homolog annotation: Hit_ID=Q9FZ09; Match level="QueryCoverage=100%, HitCoverage=76%, E-value=1e-129, Identity=71%"; Hit description =Patatin-like protein 1
  Pfam annotation: Domain name=Patatin; Domain location=23-231; Score =284.0; E_value=2.9e-82; Accession=PF01734.12; Description=Patatin -like phospholipase
MERAKSSIEQIQPPTYGNLVTILSIDGGGIRGIIPATIIDFLESQLQELDGPDARLADYFDVISGTSTGGLVTAMITAPDNNNRPLFAAKDIKPFYMDHSPKIFPQHSGLGGTILAKVVKSLLGGPKYDGKYLHGVVREKLGDIRLHETLTNVVIPTFDIKSLQPIIFSSYQIKNSPSLDAKLSDICISTSAAPTYLPAHNFNNQDSNGKVHEFNLIDGGVCANNPTLVAMNEVTKQIIKQNSDLFPIKPLEYGRFLIISIGTGTAKNEEKFNAQMAAKWGLLDWLTQSGSTPLIDVFTQSSADMVDFHLSAVTQALHSQDNYLRIQ

SEQ ID NO: 146284 - protein, 669 aa, Glycine max
  Coding DNA Sequence Number=SeqID_29506
  Gene Ontology: Mol. function=nucleic acid binding
  Homolog annotation: Hit_ID=Q06AW3; Match level="QueryCoverage=17%, HitCoverage=87%, E-value=2e-08, Identity=33%"; Hit description=RNA -binding protein
  Pfam annotation: Domain name=RRM_1; Domain location=3-66; Score=59.2; E_value=1.4e-14; Accession=PF00076.12; Description=RNA recognition motif. (a.k.a. RRM, R
  Pfam annotation: Domain name=zf-CCHC; Domain location=236-253; Score =28.8; E_value=1.8e-05; Accession=PF00098.13; Description=Zinc knuckle
  Pfam module annotation: Pfam domain module=RRM_1::zf-CCHC; Domain location=3-66::236-253
MSLYIGNLSEHSQRDDLERVFRRFGHCNVQLKRDGYGFVVFDFPPDAEKALRALKGRNICGEPLTLTWSNKQPSTHFSRIPSGGRRNVYELQHARNPERVGYVRRRSGFSGWSNQKMGRGKSVEMPSEERGYRHDDFKDYVGEEKKFGGDFPYEGGGVVPNKEDEPVHDPLVDNGNGNAIEFDRYEPYQGNDRKHDNEDYHVGYSGGSPAAHSLENVSRAIGEDTSNRPNGSKFQQICFRCGDPGHKIRNCPKEHTSQRKYNRLDVWQNNRIDKKHKSEDVNKFESDSLAKLQSNLEPLSLRHQRDGRRLSGSRHHHAPWRNESFPGARETDRHKKKEYVGKKRSRNDIELPKQSNAKISKRSVSSSLLSDYSASHFLSNSQSSKSLRRSSSHSRSRSVSSRSHSSSSKSQYCKGKSLNSRRSSSPMSLCLSLNQTLSSSPNKIQLNSKASSINGTALESVEHLVAQGQQIGSKMELDNLQSKGTGVAVNGKAAVYTTVVDGVEKGQFVQEDNHENHFILKSSDRVTDLNEPLVGNLSPPIEKETKDIEHSGAMMLDDISTEIQKSASETNVNLHSNLSTIVSTEEICMVLNTYGLELPKDDENNLTIDALFGCARLWPWHVVYYRRLKKGPISTENYARRVAQNQEFGIVDKYVRSSSGWGEFSLENA

SEQ ID NO: 146285 - protein, 366 aa, Glycine max
  Coding DNA Sequence Number=SeqID_29507
  Gene Ontology: Mol. function=protein binding; Cellular component =protein complex; Biological process=protein catabolic process
  Homolog annotation: Hit_ID=Q9LT08; Match level="QueryCoverage=99%, HitCoverage=100%, E-value=1e-131, Identity=69%"; Hit description=26S proteasome non-ATPase regulatory subunit 14
  Pfam annotation: Domain name=Mov34; Domain location=26-139; Score =161.2; E_value=2.6e-45; Accession=PF01398.11; Description =Mov34MPNPAD-1 family
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQRPPNLDNAAGIVVAELFKTLDSSLKYYCRLKEGERTRGGRLGSAKVEGDGLPGVGLSSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDSHSKTNEQTVQEMLSLAAKYNKAVQEEDELPPEKLAIANVGRQDAKKHLEEHVSNLMSSNIVQTLGMMLDTVVF

SEQ ID NO: 146286 - protein, 235 aa, Glycine max
  Coding DNA Sequence Number=SeqID_29508
  Gene Ontology: Mol. function=phospholipase A2 activity; Biological process=lipid metabolic process
  Homolog annotation: Hit_ID=Q9FZ09; Match level="QueryCoverage=97%, HitCoverage=54%, E-value=4e-90, Identity=70%"; Hit description =Patatin-like protein 1
MWPCMDAKLSDICISTSAAPTYLPAHNFNNHDSKGNVHEFNLIDGGVCANNPTLVAMNEVTKQIIKQNSDFFPIKPMEYGRFLIISIGTGTSKTEEKFNAQMAAKWGLLDWLTQSGSNPLIDVFSQSSADMVDFHLSAVTQALNSQDNYLRIQDDTLTGTDSSVDIATKENLEKLYQIGENLLKKPVSRVNLENGLFQPLKNGETNEHALKRFAKILSQERRLREMRSPNTKKTF

SEQ ID NO: 146287 - protein, 134 aa, Glycine max
  Coding DNA Sequence Number=SeqID_29509
  Gene Ontology: Mol. function=phospholipase A2 activity; Biological process=lipid metabolic process
  Homolog annotation: Hit_ID=Q9FZ09; Match level="QueryCoverage=99%, HitCoverage=30%, E-value=4e-46, Identity=79%"; Hit description =Patatin-like protein 1
  Pfam annotation: Domain name=Patatin; Domain location=23-134; Score =47.5; E_value=4.5e-11; Accession=PF01734.12; Description=Patatin -like phospholipase
MERAKSSIEQIQPPTYGNLVTILSIDGGGIRGIIPATIIDFLESQLQELDGPEARLADYFDVISGTSTGGLVTAMITAPDNNNRPLFAAKDIKPFYMDHCPKIFPQHSGLGGTILAKIIYKISGRTQIRREIPA

SEQ ID NO: 146288 - protein, 135 aa, Glycine max
  Coding DNA Sequence Number=SeqID_29510
  Subcellular localization annotation: CTP_CleavageSite=80; ConfidenceScore=5.39e-01
MKSKTWLGSWKKPPNSKQQGNTIQKFNHVSFNPTSSCGESKAKPEKIPKRKSLVPTRKGNSWSQIQNVILFFLFKYTHSRSSKAFKTQGPSLVSRPSNTKSPVRATTRINEALGLNLELGLGLNPALALDLKRAD

SEQ ID NO: 146289 - protein, 211 aa, Glycine max
  Coding DNA Sequence Number=SeqID_29511
MGGVFYHEEEPINHTKRCKFLAGTLKEVFSHCQTLSCRRLSTASLEEECPIIDDVDEVVVSAVRSRVMEKQKHKPSPLREGFSMAYSPATRELYVTHSHTMAPQAKVVVGDEEHNEREEFFSVKSCLSCCSSSSAVSDQAFYSVKTNLSRCSSMNEVDISECWRRSIIQEFCHCEGWPFGLCRKAVLLPPLPKSPSESWLSRKIQRSTKVT

SEQ ID NO: 146290 - protein, 459 aa, Glycine max
  Coding DNA Sequence Number=SeqID_29512
  Gene Ontology: Mol. function=DNA binding; Biological process =regulation of transcription, DNA-dependent
  Homolog annotation: Hit_ID=Q1SCZ2; Match level="QueryCoverage=98%, HitCoverage=86%, E-value=7e-65, Identity=35%"; Hit description =Transcriptional factor B3
  Pfam annotation: Domain name=B3; Domain location=1-67; Score=20.0; E _value=0.00039; Accession=PF02362.12; Description=B3 DNA binding domain
  Pfam annotation: Domain name=B3; Domain location=188-282; Score=70.4; E_value=5.7e-18; Accession=PF02362.12; Description=B3 DNA binding domain
  Pfam annotation: Domain name=B3; Domain location=356-456; Score=27.7; E_value=4.1e-05; Accession=PF02362.12; Description=B3 DNA binding domain
  Pfam module annotation: Pfam domain module=B3::B3::B3; Domain location=1-67::188-282::356-456
MSNPVFLKPADGTEWKIHYTKHGGEIWFQKGWKEFATYYSLDHGHLLFFEYEGTSHFDVHIFDSSALEIDYPSHGTHEGKDNLVEISDDSVEILGEQFSCQNTRGSSPQPCKKMKNSITTNVERSPNVVNLHQHVPTISNSSQKATFMKQMLDEDDGIGIFNTEYPKVEQSTSTALKKASTFRSEHPFFRLVMKPSFINGYYLEIPPQFAERYLKKTHAIVILEILDGRTWSVICSATRLTEGWQKFASENNLNVGDVCVFELIQKIQGLCFKVSIYQGAEEPICPISQARTELSENANIVLLKCCIVHPSTNWTGGTSSQRSSQVKSRSKLKILTIRYIALKRASKFTSENPFFMVTLTTKLKSIITRDVHVPMDFVRKHLVNVKQKLMMIHFRKKLWPVRFVVRESSTVSGNLSTGWAWFVRENELQRGDVCIFELFNREDATFDAHVFRGHREVMH

SEQ ID NO: 146291 - protein, 104 aa, Glycine max
  Coding DNA Sequence Number=SeqID_29513
MSELSLERAAVLSGGHFERERFRDRRASSSLPAARAAQPALFEIAESISAMSASGVAVIIFTPSNTFQWTEPEPMSVVTLVHEILLIGKSDLSRKEVNDECVAV

SEQ ID NO: 146292 - protein, 70 aa, Glycine max
  Coding DNA Sequence Number=SeqID_29514
MAECFILSDGVGRGATRGRDLASNSHIRCGYKVEATKRMGNWAGSNEGWAQNSASSLLKRIYWPKDHKRS

SEQ ID NO: 146293 - protein, 281 aa, Glycine max
  Coding DNA Sequence Number=SeqID_29515
MAREEWRLQLHQRANSICSYKKITLLICFLNIVVALYSLRSLYASLSIYSGSVARNIVVYRPDQIRKMEESNRIRKAYKPVELMKLVKEFEGEFSRENVVVELPRHLKQKISDEVSQRLGSLNESSKNIFHPQVMAKERGMLVRALESDWDVLSEEIGLWIPIQVANEEHNDKPESTTEIEEEVLPGRPLQPECNPELHTDYDGTAVRWGLTHHKDSAADCCQACLDQAKHAKEECLIAFDSIFPAEKSKLNFKDRYPEWYRNSHPSAPVIVPWASGVVSA

SEQ ID NO: 146294 - protein, 289 aa, Glycine max
  Coding DNA Sequence Number=SeqID_29516
  Gene Ontology: Mol. function=glutamate 5-kinase activity; Cellular component=origin recognition complex; Biological process=DNA replication
  Homolog annotation: Hit_ID=Q38899; Match level="QueryCoverage=99%, HitCoverage=80%, E-value=1e-107, Identity=64%"; Hit description =Origin recognition complex subunit 2
  Pfam annotation: Domain name=ORC2; Domain location=1-288; Score =321.8; E_value=1.2e-93; Accession=PF04084.4; Description=Origin recognition complex subunit 2
MYPEWFFALRNGFGLLMYGFGSKKVLIEDFASTALTEYSVVVINGYLQTINLKQVVIALAEILWEQVKTKQRVSYRDLPKSQQSFNSKSMEDLLTFLDQAEIEAGAFFVCVVIHNIDGSGLRDSETQQYLARLAACAQIRVVASIDHVNAPLFWDKNMAHTQFNWCWYHVPTFAPYKVEGMFYPMILAHGSASQTVKTATIVLSSLTRNAQSVFKVLAEHQLSHPDEGNDLYSVCRERFLVSSQITLNSHLTEFKDHELVKIKKHSDGQDCLHIPLTAEALQKVVLEII

SEQ ID NO: 146295 - protein, 136 aa, Glycine max
  Coding DNA Sequence Number=SeqID_29517
  Homolog annotation: Hit_ID=Q9FM71; Match level="QueryCoverage=24%, HitCoverage=5%, E-value=1e-07, Identity=71%"; Hit description =Arabidopsis thaliana genomic DNA, chromosome 5, P1 clone:MDF20
MSLGFRFQVSMAVERVVVVEEAGLWNLGFQNQGFRGNKGLVRQGQGSVGGGGRGGNVNRVGGNGVGNSVSAISSVNIGGVRGGGGGGGTTVGFGGTILFVGDSHWWTTDVELSKYGPVKVVKFFNEKTSGKSKGYY

SEQ ID NO: 146296 - protein, 120 aa, Glycine max
  Coding DNA Sequence Number=SeqID_29518
MAWCQSGPARISGDAFLAAWRAYREKEREVVMVGHLGNRIMCISANGASGTFWSVYVDLYGQIWILLVIESRFGFLCGLSFTCKNIEIFDQRIFSGRGIGCITFSQNGLTWWEGDYLGVK

SEQ ID NO: 146297 - protein, 262 aa, Glycine max
  Coding DNA Sequence Number=SeqID_29519
  Gene Ontology: Mol. function=nucleic acid binding; Biological process= DNA integration
MSLSNLITHIIIEDTNRKEYATARANALFVKANMVQGKPAQRRYGQCCDQYEQMSVYPGDSKTTPILGKGKVLLKLTFGKTLALSDVLHVPTIKANSVSVALLRKDIFPLRSNASSSTNTSHEQPIETCSEPMCEDLRRCKRQRVEKYFGEDFYTYLVEDDPLSFSEAISSSYANLWEQVIKIEIDSIKKNNIWTLVGLPRGARPTRCKWIFKRKYNPDGSIDKYKARLVAKAATDMLVIHQMDVKTTFLNDDFNLKGVKFP

SEQ ID NO: 146298 - protein, 90 aa, Glycine max
  Coding DNA Sequence Number=SeqID_29520
MVVADGMCHDTDKDACRTPDTTRDWDRMVLWSYPPTARQMAVTGGVFVVGGLLFGVGAYFSFVNVAPQQERLKSRREAMRNYIKKRFGDS

SEQ ID NO: 146299 - protein, 113 aa, Glycine max
  Coding DNA Sequence Number=SeqID_29521
MALIISMHTIAINAQEIQSKSTLKTILNECNVKSKSKKAWLPPCKHFFNFTSLTFGVALRIFELDDYGVLWDFSAKSLDDSYALRRISSSSYGCTFLFSLDVVELKLRNFMTQ

SEQ ID NO: 146300 - protein, 76 aa, Glycine max
  Coding DNA Sequence Number=SeqID_29522
  Gene Ontology: Mol. function=protein-tyrosine kinase activity; Biological process=protein amino acid phosphorylation
  Homolog annotation: Hit_ID=Q1T6P5; Match level="QueryCoverage=98%, HitCoverage=9%, E-value=2e-15, Identity=53%"; Hit description=EGF -like, subtype 2; S-locus glycoprotein; Curculin-like (Mannose- binding) lectin; ...
  Homolog annotation: Hit description=Apple-like; Serine/threonine protein kinase, active site
MPPKYATRGHFSVKSDVFSYGVIVLDIISGKKNMEISNSDNFNNLLGHAWRLWIEERELELLDEVLGEQCTTFEVI

SEQ ID NO: 146301 - protein, 344 aa, Glycine max
  Coding DNA Sequence Number=SeqID_29523
  Gene Ontology: Mol. function=DNA binding; Biological process =regulation of transcription, DNA-dependent
  Homolog annotation: Hit_ID=Q8GYJ2; Match level="QueryCoverage=77%, HitCoverage=82%, E-value=1e-49, Identity=46%"; Hit description =Putative RAV2-like DNA binding protein
  Pfam annotation: Domain name=B3; Domain location=74-184; Score=121.0; E_value=3.4e-33; Accession=PF02362.12; Description=B3 DNA binding domain
MSTNHYTMDLPEPTLWWPHPHQQQLTLIDPDPLPLNLNNDDNDNGDDNDNDENQTVTTTTTGGEEEIINNKEPMFEKPLTPSDVGKLNRLVIPKQHAEKYFPLSGGDSGSSECKGLLLSFEDESGKCWRFRYSYWNSSQSYVLTKGWSRYVKDKRLDAGDVVLFQRHRADAQRLFIGWRRRRQSDALPPPAHVSSRKSGGDGNSSKNEGDVGVGWTRGFYPAHHPYPTHHHHPSPYHHQQDDSLHAVRGSQGQNQRTRPVGNSSSSSSSSSRVLRLFGVNMECQPEHDDSGPSTPQCSYNTNNILPSTQGTDIHSHLNFYQQQQTSNSKPPPHHMMIRHQPYYY

SEQ ID NO: 146302 - protein, 870 aa, Glycine max
  Coding DNA Sequence Number=SeqID_29524
  Gene Ontology: Mol. function=RNA-directed DNA polymerase activity; Cellular component=chromatin; Biological process=chromatin assembly or disassembly
  Pfam annotation: Domain name=rve; Domain location=498-654; Score =100.6; E_value=4.8e-27; Accession=PF00665.16; Description=Integrase core domain
  Pfam annotation: Domain name=zf-H2C2; Domain location=443-480; Score =9.8; E_value=0.018; Accession=PF09337.1; Description=His(2)-Cys(2) zinc finger
  Pfam module annotation: Pfam domain module=RVT_1::rve::zf-H2C2; Domain location=1-156::498-654::443-480
  Subcellular localization annotation: CTP_CleavageSite=29; ConfidenceScore=5.29e-01
MGHGVVVLIIGHSTLSPSKTNSPCQPSMSYSMISGKPQFSKLDLRQGFHQIRMADFDLSKTAFRTHQGHYEFRVMPFGLCNAPSTFQSAMNDTLKPYLGKFVVVFFDDIMVYSQDLLSHITHLESVLSTLLTHQFYLRESKCVFAQSRLNYLGHIISAEGIAPDPEKIQAMVDWPIPTSTTNLRGFLGLTGFYRKFIKGYASIAAPITALLRKDQFIWSPEATSAFDHLKTQMTRAPVLSTPDFNIPFVLETDASAVAIRAVLIQQQHHIAYYSKVLCPRLRRASAYVRELHAITSAVRKWRHYLLGTSFTILTDHKSLKDLMSQVIQTPKQQTYLVKLLGYDYEIRYKPGVSNVVADALSRLPSGEFLSFTVPHFDFLDTFRRSLTADNQYCDLLTAIQTRPADHPSLSVHRGLIFKDHRIWLPFPTPFTSSLLEEFHTSPLGDHSGVAKTLHRLQQSFDWPNIRADVRHFISHCLICQQTKYETKKPSGLLQPLPISARIWEDLSLDFITGLPPSHSHTVILVVVDRYSKGAHFGAFPAQHTAHQVAVRFMDMVCKHHGFPRSLVSDMDALFLSHFWRELFRLNGTQLRMSTAYHPQSDGQTEVVNCTLEQYLRAYVHHKPNQWFRYLSLAEWSYNTTVHSSTGFTPFEIIYGRPPPNIVDYVMGSSPIDAVDSFLTDRTELHVVLQRRLLKAQFVMKVNDDKHRHDVHYVVGDWVFLRLRPYRQKSMTPTYSKLAKRFFGPYQVTERIGPVAYKLALPTDSRIHNVFHVSLLKAHHGPPPSNDNPLPSLAVDHHPVVKPLTILDWKWDLSVTPPQRMQSYNLEDEVVFGGVGVDSNTQNREPNNNINGDTSRPKRVTRKPTYLEDFK

SEQ ID NO: 146303 - protein, 50 aa, Glycine max
  Coding DNA Sequence Number=SeqID_29525
MAPMLHSKSSKPPALNNYSFISVISLSSVDAHTLHMTELRQPPRLVASSF

SEQ ID NO: 146304 - protein, 438 aa, Glycine max
  Coding DNA Sequence Number=SeqID_29526
  Gene Ontology: Mol. function=transferase activity; Cellular component= nucleus; Biological process=paclitaxel biosynthetic process
  Homolog annotation: Hit_ID=Q3ZPN4; Match level="QueryCoverage=99%, HitCoverage=97%, E-value=1e-140, Identity=56%"; Hit description =Anthraniloyal-CoA: methanol anthraniloyal transferase
  Pfam annotation: Domain name=Transferase; Domain location=7-430; Score=388.1; E_value=1.4e-113; Accession=PF02458.6; Description =Transferase family
MSSRTSFSVVHGEPELVVPAGPTPRELKNLSDIDDQEGLRFQHQVIMFYQKSHVMEGKHPATVIKYGLAEALVHYYPLAGRLREWPNRKLTVDCSGEGILFVEAEAHVSLKELGNSILPPCPHMKELLLDVPGSQGILGCPLLLFQVTRLTCGGFAFAARMNHTICDSLGLVQFLTMVGEIARGVSISQFPVWQRELFNARDPPRITYAHHEYDETKHCSNKDTMDFDQMAHESFFFGPKEIATLRSHLPQHLRKCSTFEILSACLWKCRTKALGLEPNEIVGLSPFITARGKVGLHVPNGYYGNAFAFPMALSKAGLLCQSPLEYALGLIKKAKAQMGLEYVKSVADLMVLKGRPKYKTKENYLIGDTTHVGFYDVDFGWGSPIYGGPAGAIPFVSFYGRFRNNEGEDGVVVPILLPHHVMKRFLFELVKITSEVPV

SEQ ID NO: 146305 - protein, 578 aa, Glycine max
  Coding DNA Sequence Number=SeqID_29527
  Gene Ontology: Mol. function=metal ion binding
  Homolog annotation: Hit_ID=Q9FH81; Match level="QueryCoverage=58%, HitCoverage=58%, E-value=2e-67, Identity=47%"; Hit description =Arabidopsis thaliana genomic DNA, chromosome 5, TAC clone:K9E15
  Pfam annotation: Domain name=zf-C3HC4; Domain location=523-564; Score= 37.9; E_value=3.5e-08; Accession=PF00097.15; Description=Zinc finger, C3HC4 type (RING finger)
  Subcellular localization annotation: CTP_CleavageSite=35; ConfidenceScore=5.36e-01
MGSSASKATSSSSSSGSCRKGRSKGHRGFPSYCLGASSGSRDIDSDDQNKVNGEDVTYSSGNEIDSDEVKTESFRKVKSDKSDEVPCVPSNIDLEEWGHTASRTGSSSAHSSSNQSLNPSSRFLSRFSLVPGNISFRLSRTTSLGSSRPCPVSSESLSIFNNEDELNLPPGLPGSLINRNETQHRCDLLNASLASQVPIQCHQEASNNLRSNTLTLVSPGNLVSSRISSVQDVVRDGNGTREVPDMNLFSPRIHTDTEDIETRHTDRRNGAREPVERNVRFSRTLSVGRLRDRVLRRTTVSDFTFCPLQRERDASQDNGRRAGERDTRLSPSGRNATNSSTPRYPLPSTPSSLFGIQDYEVETSRSRETRYQDLLEHRSNFLERRRRIRSQVISNWAVAHPPRAKKVRALQRLGSRFENLSGHDRSCILSGQHRNGRCACRINSRDTNSNDDTNARASISRIVMLAEALFEVLDEIHQQSMVLSSRPSVSSIGSVPAPNEVVESLPVKLYTKLHKHQEEPVQCYICLVEYEDGDSMRVLPCHHEFHTTCVDKWLKEIHRVCPLCRGDICASDSLPREN

SEQ ID NO: 146306 - protein, 658 aa, Glycine max
  Coding DNA Sequence Number=SeqID_29528
  Gene Ontology: Mol. function=beta-amylase activity; Biological process=polysaccharide catabolic process
  Homolog annotation: Hit_ID=Q9FH80; Match level="QueryCoverage=88%, HitCoverage=83%, E-value=0.0, Identity=69%"; Hit description=Beta -amylase-like
  Pfam annotation: Domain name=DUF822; Domain location=53-215; Score =218.0; E_value=2.2e-62; Accession=PF05687.4; Description=Plant protein of unknown function (DUF822)
  Pfam annotation: Domain name=Glyco_hydro_14; Domain location=228-646; Score=232.3; E_value=1e-66; Accession=PF01373.8; Description=Glycosyl hydrolase family 14
  Pfam module annotation: Pfam domain module=DUF822::Glyco_hydro_14; Domain location=53-215::228-646
MKSINDDASTQDVDPQSDHSSDYLAHPNSHPEPHPQPRRPRGFAAAPVTTNTGGKGKKEREKEKERTKLRERHRRAITSRMLAGLRQYGNFPLPARADMNDVLAALAREAGWVVDADGTTYRQCPPPSNVGSFAARSVESQLSGGSLRNCSVKETIENQTAVLRIDECLSPASIDSVVIAERDSKNEKYTNARPINTVDCLEADQLMQDIHSGVHENDFTSTPYVSVYVKLPAGIINKFCQLIDPEGIKQELIHIKSLNVDGVVVDCWWGIVEGWSSQKYVWSGYRELFNIIREFKLKLQVVMAFHECGGNDSSDALISLPQWVLDIGKDNQDIFFTDREGRRNTECLSWGIDKERVLKGRTGIEVYFDMMRSFRTEFDDLFAEGLISAVEVGLGASGELKYPSFSERMGWRYPGIGEFQCYDKYLQNSLRRAAKLHGHSFWARGPDNAGHYNSMPHETGFFCERGDYDNYYGRFFLHWYSQTLIDHADNVLSLATLAFEETKIIVKVVFLVPAVYWWYKTPSHAAELTAGYHNPTYQDGYSPVFEVLRKHAVTMKFVCLGFHLSSQEAYEPLIDPEGLSWQVLNSAWDRGLMAAGENALLCYGREGYKRLVEMAKPRNDPDCRHFSFFVYQQPSLLQANVCLSELDFFVKCMHGKDP

SEQ ID NO: 146307 - protein, 421 aa, Glycine max
  Coding DNA Sequence Number=SeqID_29529
  Gene Ontology: Mol. function=binding; Cellular component=ubiquitin ligase complex; Biological process=protein ubiquitination
  Homolog annotation: Hit_ID=Q9ASI0; Match level="QueryCoverage=90%, HitCoverage=95%, E-value=8e-99, Identity=53%"; Hit description =Putative arm repeat-containing protein
  Pfam annotation: Domain name=Arm; Domain location=135-175; Score =24.5; E_value=0.00037; Accession=PF00514.13; Description =Armadillobeta-catenin-like repeat
  Pfam annotation: Domain name=Arm; Domain location=176-216; Score =31.1; E_value=3.8e-06; Accession=PF00514.13; Description =Armadillobeta-catenin-like repeat
  Pfam annotation: Domain name=Arm; Domain location=20-56; Score=6.7; E_ value=1.8; Accession=PF00514.13; Description=Armadillobeta-catenin -like repeat
  Pfam annotation: Domain name=Arm; Domain location=217-259; Score=3.5; E_value=4.5; Accession=PF00514.13; Description=Armadillobeta-catenin -like repeat
  Pfam annotation: Domain name=Arm; Domain location=261-301; Score=7.4; E_value=1.5; Accession=PF00514.13; Description=Armadillobeta-catenin -like repeat
  Pfam annotation: Domain name=Arm; Domain location=58-96; Score=24.0; E_value=0.00055; Accession=PF00514.13; Description=Armadillobeta -catenin-like repeat
  Pfam module annotation: Pfam domain module=Arm::Arm::Arm::Arm::Arm::Ar m; Domain location=135-175::176-216::20-56::217-259::261-301::58-96
MESPHSLSPSSSSDGVGFETEEPRTPLAVRRALQLLNSGDPDLRLQAARDIRRLTKTSQRCRRQLSQAVGPLVSMLRVDSPESHEPALLALLNLAVKDEKDGSDLCIERDVQPLKGFFHTHESCPHYFCSSGVKMGRNKINIVEAGALEPIISFLKSQNLNLQESATASLLTLSASSTNKPIISACGVIPLLVQILRDGSHQAKADAVMALSNLSTHTNNLSIILETNPIPYMVDLLKTCKKSSKTAEKCCALIESLVDYDEGRTALTSEEGGVLAVVEVLESGTLQSREHAVGALLTMCQSDRCKYREPILREGVIPGLLELTVQGTPKSQSKARTLLQLLRESPYPRSEIQPDTLENIVCNIISQIDGDDQSGKAKKMLAEMVQVSMEQSLRHLQQRALVCTPSDLPIAGCAASEVSSK

SEQ ID NO: 146308 - protein, 83 aa, Glycine max
  Coding DNA Sequence Number=SeqID_29530
MELWNRGGTRRRKNNAKSHKSKNMQTELQEEEMNQRFRKMDEVSDQRFQTLMCGCLEKTRKRSKTGLNNSLAKLKAGSSDINV

SEQ ID NO: 146309 - protein, 295 aa, Glycine max
  Coding DNA Sequence Number=SeqID_29531
  Gene Ontology: Mol. function=protein serine/threonine kinase activity; Cellular component=integral to membrane; Biological process=protein amino acid phosphorylation
  Homolog annotation: Hit_ID=Q9SN81; Match level="QueryCoverage=84%, HitCoverage=31%, E-value=5e-45, Identity=37%"; Hit description =Receptor-kinase like protein
  Pfam annotation: Domain name=Pkinase; Domain location=108-291; Score=- 72.9; E_value=0.00032; Accession=PF00069.15; Description=Protein kinase domain
  Pfam annotation: Domain name=Pkinase_Tyr; Domain location=108-246; Score=-158.4; E_value=0.0094; Accession=PF07714.7; Description =Protein tyrosine kinase
  Pfam module annotation: Pfam domain module=Pkinase::Pkinase_Tyr; Domain location=108-291::108-246
LDGDVPTEGVFRNASGLVLNGNSKLCGGISKLHLPPCPVKGKKLAKDQKFRLIAVIVSVVAFVLILSFILTIYWMRKRSKKPSLESPIVDHQLAQLLYQSLHNGTDGFSSTNLIGSESFSSVYKGTLEFEDEVVAIKYLRNGSLEQWLRPSTLNAEQPRTLNLDQRLNIMIDIAYAIHYLHHECEQSIVHCDLKPINVFLDDDMISHVSDFGIPRLLSTINGTTFKQTSTIGIKGTLGYAPPCKIIGRPVNVTLLCEDAPIIWDQHRLKETLKPGVFTPKAYTLKSPSGSLPPNS

SEQ ID NO: 146310 - protein, 678 aa, Glycine max
  Coding DNA Sequence Number=SeqID_29532
  Gene Ontology: Mol. function=protein serine/threonine kinase activity; Cellular component=integral to membrane; Biological process=protein amino acid phosphorylation
  Homolog annotation: Hit_ID=Q9SD64; Match level="QueryCoverage=98%, HitCoverage=73%, E-value=1e-129, Identity=37%"; Hit description =Receptor kinase-like protein
  Pfam annotation: Domain name=LRRNT_2; Domain location=8-48; Score =46.8; E_value=7.6e-11; Accession=PF08263.3; Description=Leucine rich repeat N-terminal domain
  Pfam annotation: Domain name=LRR_1; Domain location=101-123; Score =13.6; E_value=0.71; Accession=PF00560.23; Description=Leucine Rich Repeat
  Pfam annotation: Domain name=LRR_1; Domain location=125-147; Score =12.5; E_value=1.3; Accession=PF00560.23; Description=Leucine Rich Repeat
  Pfam annotation: Domain name=LRR_1; Domain location=149-171; Score =6.1; E_value=21; Accession=PF00560.23; Description=Leucine Rich Repeat
  Pfam annotation: Domain name=LRR_1; Domain location=173-195; Score =14.5; E_value=0.4; Accession=PF00560.23; Description=Leucine Rich Repeat
  Pfam annotation: Domain name=LRR_1; Domain location=221-244; Score =5.5; E_value=27; Accession=PF00560.23; Description=Leucine Rich Repeat
  Pfam annotation: Domain name=LRR_1; Domain location=246-269; Score =9.7; E_value=4.3; Accession=PF00560.23; Description=Leucine Rich Repeat
  Pfam annotation: Domain name=LRR_1; Domain location=270-291; Score =3.3; E_value=69; Accession=PF00560.23; Description=Leucine Rich Repeat
  Pfam annotation: Domain name=LRR_1; Domain location=293-315; Score =5.8; E_value=24; Accession=PF00560.23; Description=Leucine Rich Repeat
  Pfam annotation: Domain name=LRR_1; Domain location=333-355; Score =14.7; E_value=0.35; Accession=PF00560.23; Description=Leucine Rich Repeat
  Pfam annotation: Domain name=LRR_1; Domain location=357-379; Score =7.2; E_value=13; Accession=PF00560.23; Description=Leucine Rich Repeat
  Pfam annotation: Domain name=LRR_1; Domain location=381-403; Score =11.0; E_value=2.5; Accession=PF00560.23; Description=Leucine Rich Repeat
  Pfam annotation: Domain name=LRR_1; Domain location=405-427; Score =13.3; E_value=0.88; Accession=PF00560.23; Description=Leucine Rich Repeat
  Pfam annotation: Domain name=LRR_1; Domain location=429-451; Score =10.0; E_value=3.8; Accession=PF00560.23; Description=Leucine Rich Repeat
  Pfam annotation: Domain name=LRR_1; Domain location=453-475; Score =12.8; E_value=1.1; Accession=PF00560.23; Description=Leucine Rich Repeat
  Pfam annotation: Domain name=LRR_1; Domain location=477-499; Score =16.9; E_value=0.071; Accession=PF00560.23; Description=Leucine Rich Repeat
  Pfam annotation: Domain name=LRR_1; Domain location=501-522; Score =7.2; E_value=13; Accession=PF00560.23; Description=Leucine Rich Repeat
  Pfam annotation: Domain name=LRR_1; Domain location=524-548; Score =3.7; E_value=58; Accession=PF00560.23; Description=Leucine Rich Repeat
  Pfam annotation: Domain name=LRR_1; Domain location=53-75; Score=3.5; E_value=64; Accession=PF00560.23; Description=Leucine Rich Repeat
  Pfam annotation: Domain name=LRR_1; Domain location=77-99; Score=5.7; E_value=24; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1; Domain location=8 -48::101-123::...
  Pfam module annotation: Domain location=125-147::149-171::173 -195::221-244::246-269::270-291::293-315::333-355::357-379::381 -403::405-427::429-451::453-475::477-499::501-522::524-548::53-75::77- 99
MSAFASRNEVDHLTLLKFRESISSDPYGILLSWNTSAHFCNWHGITCNPMLQRVTKINLRGYNLKGSISPHVGNLSYIKSFILANNSFYGNIPQELGRLSQLQILSIGNNSLVGEIPTNLTGCVQLKILHLNGNNLIGKIPIQIFSLQKLQYFLVVRNQLTGGISSFIGNLSSLTYLQVGGNNLVGDIPQEICHLKSLTTIVIGPNRLSGTFPSCLYNMSSLTAISATVNQFNGSLPPNMFHTLPNLQEVGFGGNQFSGPIPPSIINASFLTIFDISVNHFSGQVSSLGKVQNLFLLNLSENNLGDNSTNDLDFLKSLTNCRFVPSAFGKFQKMQVLELGGNNLSGDIPAFIGNLSQLFHLGIGENMLEGIIPRSIENCQMLQYLKLSQNRLRGTIPLEIFNLSSLTNLNLSQNSLSGSMSEEVGRLKHISSLDVSSNNLSGDIPGMIGECLMLEYLYLRENSFQGFIPTSLASLKGLRKLDLSQNRLSGTIPNVLQNISTLEYLNVSFNMLNGEVPTEGVFQNASELVVTGNSKLCGGIPELHLPPCLVKGNKLVEHHKFRLIAVIVSVLAFLLILSIILTIYCMRKRSKKPSLDSPIIDQLAKVSYQSLHNGTDGFSTANLIGSGNFSFVYKGTLESEDKVVAIKVLNLQRKGAHKSFIAECNALKILNIDILFRF

SEQ ID NO: 146311 - protein, 67 aa, Glycine max
  Coding DNA Sequence Number=SeqID_29533
MECYIIPVRSLFGDERVKFLNNCGKNWMFYAVHSVAQLCNIMHLHSNKEVPSLERHTMTGTAQAFDG

SEQ ID NO: 146312 - protein, 205 aa, Glycine max
  Coding DNA Sequence Number=SeqID_29534
  Homolog annotation: Hit_ID=Q10BI2; Match level="QueryCoverage=95%, HitCoverage=94%, E-value=5e-10, Identity=23%"; Hit description =Expressed protein
  Pfam annotation: Domain name=DUF567; Domain location=4-194; Score =153.6; E_value=5.3e-43; Accession=PF04525.3; Description=Protein of unknown function (DUF567)
MSMMAIISKLYCSSSQTVLGVRKRPHVVNGGGFVVTDCSGQRVVFRVDGCGIHGTKGQLILRDGEGDALLLMRRKGGMVEALSIYKKWNGYSVNYEGLQSLVFSLKEPNSCCLVRNNAIRISIEPRNASNKGWDFEVRGYFPDRSCSIVDVRGNVIAQVGVNKEVEKLMESKDLYHVVVKPGIDQAFVFGVIAILDNIYGESTHC

SEQ ID NO: 146313 - protein, 191 aa, Glycine max
  Coding DNA Sequence Number=SeqID_29535
  Subcellular localization annotation: CTP_CleavageSite=21; ConfidenceScore=5.10e-01
MSTSTRATSNILLSLPLPSPKAAPPSCPDLYGKRREMAKIQMLEREISFLEVVTSLALTCLGSAIGAVMGALNIKTCQVVVPTACHAIAVLVVFHLPIALAALMEYHIAAKIVVVAKFVALSQVAILGGLFPLAAFANALALALGQAQKNVPRFVHVAVVQIPVGTPVHVSKVYNYKCPVNLFHHVDTTTY

SEQ ID NO: 146314 - protein, 366 aa, Glycine max
  Coding DNA Sequence Number=SeqID_29536
  Gene Ontology: Mol. function=RNA-directed DNA polymerase activity; Cellular component=chromatin; Biological process=chromatin assembly or disassembly
  Pfam annotation: Domain name=zf-H2C2; Domain location=209-250; Score =7.8; E_value=0.034; Accession=PF09337.1; Description=His(2)-Cys(2) zinc finger
MAVSKLRNDAKIRASFSIETASQVGRFHSDRRVPRLQEKALGEEAWHIGNGFGKKEGEGNDVFPSLHEKQRLKHSSAYAHGKGSVPHTPDVVFLTSLQRLEECNYDSSGLASAQFRTTLYSGNKRVQRQNGTLHHYYCSKEMTSIFIGPSLNHPHGPSEPQGVDDSSAISDDPAAYPDNTIIQYFIMKGGRICLPQGSPFIHTLLTEFHSSPRGRHMGIAKTLARIRENFNWSGIQQDAKHFVVAYVDCQHTKYETRKVVGIQLGMLPPHHTSYTVALLFMDIEYLHAFVHKKPFSLGKFLNWVEWSCNTSIHSGYGVSPYETTFGKKPLSIPQYIVGTSNTKVVDDFMTKREEVFADLRKKLLKV

SEQ ID NO: 146315 - protein, 68 aa, Glycine max
  Coding DNA Sequence Number=SeqID_29537
MVLIMKCNGNRLTGAKSEEDLHLNLGHFATLSIQIWARRRRRLRRGQWQREKDVGSCPCGSAHHCSLN

SEQ ID NO: 146316 - protein, 128 aa, Glycine max
  Coding DNA Sequence Number=SeqID_29538
MSTSDYELIKIETFVLKTQMNCQGCMNKGGVCSVLDAAICISGSGGAATNCGKKGLTWLVLPAPTAAPARHLTTRQCQWRDIMQEERGVVLHREKTGCFEIIMLRKRNRSVANVPPLALAGCPVSRWC

SEQ ID NO: 146317 - protein, 88 aa, Glycine max
  Coding DNA Sequence Number=SeqID_29539
  Gene Ontology: Mol. function=pyridoxal kinase activity; Biological process=pyridoxine biosynthetic process
  Homolog annotation: Hit_ID=Q4JR83; Match level="QueryCoverage=78%, HitCoverage=22%, E-value=3e-32, Identity=98%"; Hit description =Pyridoxal kinase
MQWFRVNLHHKHHGTGDLMTALLLGWSNKYPDNLEIAAELAVSSLQAVLHRTLSDYKSAGHDPESTSLEIRLIQSQDDICTPQKLESY

SEQ ID NO: 146318 - protein, 100 aa, Glycine max
  Coding DNA Sequence Number=SeqID_29540
MGQTGFVVLAGMWARRNRGGVVRNWCGVVCGRGGDGSNVGDKLVHFLGSSSAWYRQDEQGHPRDGWRSLRACGCRTCGQREHQMLALPSYWLRGTRTSNN

SEQ ID NO: 146319 - protein, 70 aa, Glycine max
  Coding DNA Sequence Number=SeqID_29541
  Subcellular localization annotation: CTP_CleavageSite=46; ConfidenceScore=5.33e-01
MTWTVPSSRLARQANVVVPSLLLASLMTWSVSPFPLARQAQHGHTRVAVAAAGCRGNSRRPAFLNIYCHY

SEQ ID NO: 146320 - protein, 386 aa, Glycine max
  Coding DNA Sequence Number=SeqID_29542
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=91%, HitCoverage=84%, E-value=1e-137, Identity=68%"; Hit description =Protein kinase APK1B, chloroplast precursor
  Pfam annotation: Domain name=Pkinase; Domain location=76-358; Score =164.8; E_value=2.2e-46; Accession=PF00069.15; Description=Protein kinase domain
  Pfam annotation: Domain name=Pkinase_Tyr; Domain location=76-358; Score=117.6; E_value=3.6e-32; Accession=PF07714.7; Description =Protein tyrosine kinase
  Pfam module annotation: Pfam domain module=Pkinase::Pkinase_Tyr; Domain location=76-358::76-358
MGCFFSVPSKIKAESPPRNGLNSKDGSKEENDLSCLSSKVSSSAMLLTPQSEDEILQASNLKNFTFNELRTATRNFRPDSMVGEGGFGCVFKGWIDEHTLAPTKPGTGMVIAVKRLNQESNQGHIEWLTEINYLGQLSHPNLVKLIGYSLEDDHRILVYEFVAKGSLDNHLFRRGSYFQPLSWNIRMKVALDAAKGLAFLHSDEVDVIYRDFKTSNILLDSNYNAKLSDFGLAKNGPEGDKSHVSTRVMGTYGYAAPEYIATGHLTKKSDIYSFGVVLLELMSGKRALDDNRPSGEHSLVEWAKPLLTNKHKISQVMDARIEGQYSKREAKRIAHLAIQCLSTEQKLRPNINEVVRLLEHLHDSKDTSSSSNATPNPSLSPSPLRS

SEQ ID NO: 146321 - protein, 290 aa, Glycine max
  Coding DNA Sequence Number=SeqID_29543
  Gene Ontology: Mol. function=RNA-directed DNA polymerase activity; Cellular component=chromatin; Biological process=chromatin assembly or disassembly
MTSDNGEVLTKKALPPILDHRGDSKQFSDICGSTEEFHIEWFAEEGNEGSGKRLFQLLKSQLGLRGPYKWLNGGGLDHGGCNSGIAYDESPVSLKGSTVYEDIVKEDDDEVVEVWPENQVHCGLEGRWHVAQPKQHYFELVMAVMGSEGGLGDISIMEPIPDRHHVKSTVVDAKPPRTILLLDKQHRRREEARAGLNKPFLKHGINLKLNLLLLIVRITVGPHVDWRGVWDQVNIMIDGPSRRKALGRIFKKYNNMEVGNIVVFPIEATKLGLDMEVEDEDMVLNGQAQG

SEQ ID NO: 146322 - protein, 151 aa, Glycine max
  Coding DNA Sequence Number=SeqID_29544
  Gene Ontology: Mol. function=calcium-dependent phospholipid binding; Cellular component=membrane; Biological process=transport
  Homolog annotation: Hit_ID=Q9M2T2; Match level="QueryCoverage=98%, HitCoverage=98%, E-value=3e-35, Identity=46%"; Hit description =Elicitor responsive/phloem-like protein
  Pfam annotation: Domain name=C2; Domain location=6-91; Score=102.4; E_ value=1.3e-27; Accession=PF00168.20; Description=C2 domain
MAIGFMEVQLVKAKGLCDTDFFGSMDPYVVIQYNGQERRSSVAKGQGNNPVWNEKFEFKVEYPTPSNSYKVILKIMDKDSLSADDFVGQAIVYVEDLLAIGVGDGAAELQPLKYRVIREDQSYCGEIDVGITFKVEEEFNGETKRGRKDSN

SEQ ID NO: 146323 - protein, 463 aa, Glycine max
  Coding DNA Sequence Number=SeqID_29545
  Gene Ontology: Mol. function=protein serine/threonine kinase activity; Cellular component=membrane; Biological process=protein amino acid phosphorylation
  Homolog annotation: Hit_ID=Q84QD9; Match level="QueryCoverage=83%, HitCoverage=88%, E-value=1e-176, Identity=78%"; Hit description =Avr9/Cf-9 induced kinase 1
  Pfam annotation: Domain name=Pkinase; Domain location=79-356; Score =137.6; E_value=3.4e-38; Accession=PF00069.15; Description=Protein kinase domain
  Pfam annotation: Domain name=Pkinase_Tyr; Domain location=79-356; Score=115.6; E_value=1.4e-31; Accession=PF07714.7; Description =Protein tyrosine kinase
  Pfam module annotation: Pfam domain module=Pkinase::Pkinase_Tyr; Domain location=79-356::79-356
  Subcellular localization annotation: CTP_CleavageSite=29; ConfidenceScore=5.02e-01
MTLMKILWKSLFPGCYKGEYPSPKPKKVVATKPNSSHRISVTDLSYPSTTLSEDLSISLAGTNLHVFSIAELKIITQQFSSSNFLGEGGFGPVHKGFIDDKLRHGLKAQPVAVKLLNLDGSQGHKEWLTEVVFLGQLRHPHLVKLIGYCCEEEHRVLVYEYLPRGSLENQLFRRFSASLPWSTRMKIAVGAAKGLAFLHEAEKPVIYRDFKASNILLDSDYNAKLSDFGLAKDGPEGDDTHVSTRVMGTHGYAAPEYVMTGHLTAMSDVYSFGVVLLELLTGRRSVDKNRPPREQNLVEWARPMLNDSRKLSRIMDPRLEGQYSEMGTKKAAALAYQCLSHRPRSRPSMSTVVKTLEPLQDFDDIPIGTFVYTAPPDNNNEVQHKDQCETPKRRENNNNGHNIHRNGHRHHPLKSPKAPRSQSQSQSQSHLRPNDHKHRNGRGSGPNSPPSHVKIIRPGVIAC

SEQ ID NO: 146324 - protein, 163 aa, Glycine max
  Coding DNA Sequence Number=SeqID_29546
MLVLTSEVLQNFTDFAKMLVLRVPKGANKTCSPLADEGADNHEVSPHATRPLSLVVEMRLFCSLGRKTLTSPRMVQMTMLVSACYRTLESDGRNENFSRSRPEDADISRKGADDDKTLTSPGMVQMTTLVSACYRTLESDGRNETFSRSRPEDADISEKGEMT

SEQ ID NO: 146325 - protein, 66 aa, Glycine max
  Coding DNA Sequence Number=SeqID_29547
  Subcellular localization annotation: CTP_CleavageSite=43; ConfidenceScore=5.04e-01
MVICTILGDVSVFRPRLQKSLISTTRLKGLVACGDTSWLSAPSSARGFTFVIQRHSSPTTRKTLLY

SEQ ID NO: 146326 - protein, 55 aa, Glycine max
  Coding DNA Sequence Number=SeqID_29548
MPGYMLEKKVAEAGRKMLEITREERCSSRETTQSYVTESIGFQFEPFALMKGDEK

SEQ ID NO: 146327 - protein, 264 aa, Glycine max
  Coding DNA Sequence Number=SeqID_29549
MTSFHGCHTTLHYLNPYHSPYEAPMAAYHHPHYLSYEASMAALHNCKTTLHYHPQHHLEFLSTTEDRLEAALAKLTLSQHNLAASIDTLATTIDNLLQRLPCNLTPHFSSSFPSPTPPQPPLFKPTPSPTRTAFTTVPPPPATTPPPPPPPPLPPLVPIQSQPTTWSDPLPRPVLHLSDLVRPTMPFTKLFSRVPPRGTAMAGYTLPAMTVAFCTIAKPAPTPRGQGVFDEGRNDRDSNMGLQEVRGLQEAKSMRPKREATIRG

SEQ ID NO: 146328 - protein, 149 aa, Glycine max
  Coding DNA Sequence Number=SeqID_29550
MKKSLHQLLNKNLQLRVLAFHGKEDPFTLKKRNQEKLFAYKGVRMSPPPLGISQSLKNSLISLKDENLAPCSALRSLKFSLFQPLSSELFSWLPSQFCANQALKGLPDLDVAFSMNKVEGDKLYMLKVQSNNHTFSSNWVQVINHSYTR

SEQ ID NO: 146329 - protein, 113 aa, Glycine max
  Coding DNA Sequence Number=SeqID_29551
MARRCATVVSVRLQPSGVTMSVKAFKICQKEVIEGGDGVFGDGWVMIGIVGLLEGGTMAWRLHSLGCYGGRWVCVGVLGGDGDTLVDGGGVNILGEDGVMLVDGGDVWLGCRG

SEQ ID NO: 146330 - protein, 50 aa, Glycine max
  Coding DNA Sequence Number=SeqID_29552
MLERKWSSYYLKRGTLFINVNNLTNNNKRMTNNKKSITNQMANSNKTMTS

SEQ ID NO: 146331 - protein, 426 aa, Glycine max
  Coding DNA Sequence Number=SeqID_29553
  Gene Ontology: Mol. function=cysteine-type endopeptidase activity; Cellular component=vacuole; Biological process=proteolysis
  Homolog annotation: Hit_ID=Q1KK73; Match level="QueryCoverage=86%, HitCoverage=92%, E-value=1e-145, Identity=72%"; Hit description =Cysteine protease
  Pfam annotation: Domain name=Inhibitor_I29; Domain location=55-111; Score=94.5; E_value=3.2e-25; Accession=PF08246.2; Description =Cathepsin propeptide inhibitor domain (
  Pfam annotation: Domain name=Peptidase_C1; Domain location=160-380; Score=375.1; E_value=1.1e-109; Accession=PF00112.13; Description =Papain family cysteine protease
  Pfam module annotation: Pfam domain module=Inhibitor_I29::Peptidase _C1; Domain location=55-111::160-380
MARLITVVWCAVAVLLCAAAGASWVEEAANPIRMVSGVEAEVVRVIGECRRALKFARFVSRFGKSYQSEEEMKERYEIFSQNLRFIRSHNKKRLPYTLSVNHFADWTWEEFKRHRLGAAQNCSATLNGNHKLTDAVLPPTKLCVPRGILEIRVQLLGNSTQASKDWRKEGIVSSVKDQGSCGSCWTFSTTGALEAAYAQAFGKSISLSEQQLVDCAGPFNNFGCHGGLPSQAFEYIKYNGGLETEEAYPYTGKDGVCKFSAENVAVQVLDSVNITLGAEDELKHAVAFVRPVSVAFQVVNGFHFYENGVFTSDTCGSTSQDVNHAVLAVGYGVENGVPYWLIKNSWGESWGENGYFKMELGKNMCEPCPQQIPNLKITSINFPLQVLQLVHLIQLWHKLHNNMVPGDYHLVMLQSLERIADASIDE

SEQ ID NO: 146332 - protein, 160 aa, Glycine max
  Coding DNA Sequence Number=SeqID_29554
  Homolog annotation: Hit_ID=Q8S8K9; Match level="QueryCoverage=96%, HitCoverage=40%, E-value=5e-43, Identity=62%"; Hit description =Expressed protein
MALLQYQRENLHFLSEEILRLQECLSKYEGTDDRSTPQYFIPFCYFNSDPKVDLAHLLAARDQELRTLSAEMNQVQSELRLARSLIAERDSEIQHVRTTNNQYVEENERLRAILGEWSTRAAKLERALEAERMSTLELQRKLSTLRSQSYTADEANELGA

SEQ ID NO: 146333 - protein, 341 aa, Glycine max
  Coding DNA Sequence Number=SeqID_29555
  Gene Ontology: Mol. function=tubulin-tyrosine ligase activity; Cellular component=extracellular space; Biological process=protein modification process
  Homolog annotation: Hit_ID=Q10QY4; Match level="QueryCoverage=98%, HitCoverage=49%, E-value=1e-139, Identity=57%"; Hit description =Tubulin-tyrosine ligase family protein, expressed
  Pfam annotation: Domain name=TTL; Domain location=103-337; Score =71.2; E_value=3.3e-18; Accession=PF03133.5; Description=Tubulin -tyrosine ligase family
MDELGSALRHSDEPNFRVAPFLFMPKGNLSSAVSFSILWPTQNVQKGDRCTRDFLLGIGEDKQRSARLTAWFHTPENYPSKEPKDADIVWTSVQVDEDMKKAVGITEQQYINQFPFEASLVMKHHLAETIQKAHGSPQWLQPTYNLETHLSQLIGDYCTGPKICQKYIEQPALFQGRKFDLRYIVLVRSMHPLELFLSDCFWARIANNQYSLDRSSLFEYETHFTVMNYRGTINHKNANDFVREFEEEHQVKWLDIHTRVRKMIRSVFEAAAGTHPEMQSPTSRAMYGVDVMLDSSFQPKLLEVTYCPDCTRACKYDMDIVVGEGGVAKASDFFNNVSLFE

SEQ ID NO: 146334 - protein, 71 aa, Glycine max
  Coding DNA Sequence Number=SeqID_29556
MGEREREIMRYCRAFGLHTSALRVVFVKRARWRTCKTKDSDAQVKDNLSAEHPCPYVRTNLEGGHMFRNAM

SEQ ID NO: 146335 - protein, 209 aa, Glycine max
  Coding DNA Sequence Number=SeqID_29557
  Gene Ontology: Mol. function=RNA-directed DNA polymerase activity; Biological process=RNA-dependent DNA replication
MGSYLAYVPKIYLKAHQNPRAFFYISGLIFLESSIQCPWGGRIASKSAMNYVFMGPRASYWILNSKFYEPGHHPPCEFRLSQNLLDGIVHFDYHLMTLEVGSKSSGRAPGKLALSESGHLVHIASGLYYFACEAKEWTGMGVDNFKGDLEPLESFPIQDIDGAALVDEDLRHHNKVYNDDKDNHGIVLVDGVNTLEVPICESDRRKTLL

SEQ ID NO: 146336 - protein, 142 aa, Glycine max
  Coding DNA Sequence Number=SeqID_29558
  Subcellular localization annotation: CTP_CleavageSite=30; ConfidenceScore=5.58e-01
MLLALRPDKFASSLSKKTLVAWTSCTNKPRATSRWKKCTDSKMKSDKLDRSTTSAKETARSTHTSQIKGTSHTSADLSHKGLGQTTTKQEQDLEDTKRSNIGITMQIEEEIERKIEVDRDIRNNDASGNLHKNRNPPSKSEV

SEQ ID NO: 146337 - protein, 87 aa, Glycine max
  Coding DNA Sequence Number=SeqID_29559
  Subcellular localization annotation: CTP_CleavageSite=53; ConfidenceScore=5.22e-01
MVISEAQEVKGCSSQLLAHAPYPWSSCTPTPALIAALTQVASQTSGFTTTGCVASGSGDMSRVSSQRRRQWRWWFACHVSHPQRMRQ

SEQ ID NO: 146338 - protein, 138 aa, Glycine max
  Coding DNA Sequence Number=SeqID_29560
  Gene Ontology: Mol. function=transferase activity; Cellular component= cytoplasm; Biological process=glycolysis
  Homolog annotation: Hit_ID=Q2BFI0; Match level="QueryCoverage=87%, HitCoverage=33%, E-value=3e-17, Identity=38%"; Hit description =Transcriptional repressor of the xylose operon
MANLTGGPAAAAEHLAALHQRAAHAVGDAQIEMALRFIELQLLHRQQRGRFDVIHDAQRQLNAAPQRRQHIDILPAERRRKVHPPALRINDAGKTDGHAQQRRMRRAQRLTHFRQLVQQPVGIGRFGAPVCSATTREK

SEQ ID NO: 146339 - protein, 311 aa, Glycine max
  Coding DNA Sequence Number=SeqID_29561
  Gene Ontology: Mol. function=transcription factor activity; Cellular component=intracellular; Biological process=regulation of transcription, DNA-dependent
  Homolog annotation: Hit_ID=Q7CJ81; Match level="QueryCoverage=71%, HitCoverage=67%, E-value=5e-76, Identity=64%"; Hit description =Putative LACI-type transcriptional regulator
  Pfam annotation: Domain name=LacI; Domain location=95-120; Score =44.5; E_value=3.6e-10; Accession=PF00356.11; Description=Bacterial regulatory proteins, lacI f
MAQTGRYLGHALSQVMQLVNPASIIIDGPWNAQPAFVQAVQQAAQAGTLAFTFAHTALHFLPQRIDPANGLALAVIEHYERAALFADRAMKTQRITLDDIATLAGVTKMTVSRYLRTPEKVRAETAAKIASVMAEIGYVAEQENTAASRHPPPRIGVLIPSFNNQIFADLLAGIESVTSAHGYQTLVVNYDYNPQREEEQIATVLAFNVQGLILTESVHTVRAEKYLNAATIPVAEVMGLSETRGRINVGFDNYRAGYDMTAMLLASGKQRVIYFGSMSDRRDQQRYAGYCDAVAAAGLPAGRIVPNKVSS

SEQ ID NO: 146340 - protein, 304 aa, Glycine max
  Coding DNA Sequence Number=SeqID_29562
  Homolog annotation: Hit_ID=Q9FMZ0; Match level="QueryCoverage=40%, HitCoverage=43%, E-value=4e-09, Identity=35%"; Hit description =Arabidopsis thaliana genomic DNA, chromosome 5, P1 clone:MJB21
METHHHHQHQKNTENDVQKQQHQIEEEVAPPPPQLRQQENTELDQIASSSPQSSTPSSPSQEFSFTISLHHSTLFPSDNSKNPPNSSSLALDLSPADDIFFHGHLLPLQLLSHLPSSPPRSSTNSMDSFPLPIRELLEDENHSIKDTSGSSNNSTSDSNNSSKRDQDNNNNIGKKGHKGYQDKEDKVKHKNKVRFDVIHAIKKYLRMVQPRMLFKGQREKIRPRGQCYSYSGNVTPKNYKLQDWRGQYSAPASMRTSPTNSGLLIATTPLPPASDSTMEELQAAIQAAIAHCKNSIAKEENLKC

SEQ ID NO: 146341 - protein, 420 aa, Glycine max
  Coding DNA Sequence Number=SeqID_29563
  Gene Ontology: Mol. function=transcription factor activity; Cellular component=intracellular; Biological process=regulation of transcription, DNA-dependent
  Homolog annotation: Hit_ID=P57134; Match level="QueryCoverage=25%, HitCoverage=44%, E-value=6e-43, Identity=80%"; Hit description=DNA replication protein dnaC
  Pfam annotation: Domain name=ROK; Domain location=200-380; Score =91.9; E_value=1.9e-24; Accession=PF00480.10; Description=ROK family
VLIVTVADLMSSMKGTFSGGSDLTEERLLQDLSHVDLLVIDEIGMQSESRYEKVIINQIVDRRSSSKRPTGMLSNLDPAGMNTLLGERVMDRMRLGNSLWVRFDWESYRSRGAMKAAGKGPAVLRLNNLKRVMTQLRTTRITSRQDLALALDLSKNTVSLIIDDLLAQGLIHELGPVSVAAAGRPKIEIELRAGQLKSAGIMVERQAIHWRVCDYFSRVVAEQTWRTETADADGLLHELTEVCQTLRAAHPALLGVAIGFPGIIDSQRGRVHFSAPLGWQDVDVLTPLRRGVELPLRIMNNVKAAALLAVQQLELNKAQSHFYLRIADGVGGALVERGEVFSGSSWTAGEIGHLSVQPNGARCSCGRQGCLETLVSLPAIQQQLARRKPGLRWQSGDSEPEIVYELMAQTGRYLGHALSQ

SEQ ID NO: 146342 - protein, 244 aa, Glycine max
  Coding DNA Sequence Number=SeqID_29564
  Gene Ontology: Mol. function=transcription factor activity; Cellular component=intracellular; Biological process=regulation of transcription, DNA-dependent
  Homolog annotation: Hit_ID=Q2BFI0; Match level="QueryCoverage=82%, HitCoverage=60%, E-value=2e-30, Identity=34%"; Hit description =Transcriptional repressor of the xylose operon
MADLTGGPAAAAEHLAALHQRAAHAVGDAQIKVALRFIELQLLHRQQRGRFDVIHDAQRQLNAAPQRRQHIDILPAERRRKVHPPALRINDAGKTDGDAQQRRMRRAQRLTHFRQLVQQPVGIGRFGAPGLLGHHARKVVADPPVNRLALHHDARAFQLTRAQFDLNFGPTGRSHADRAKLVNQPLRQQVINNQGNGVFAQVERQRQILAGSDAGGAQLRHHPFEVVQSKYRWSFPGCFHRTLT

SEQ ID NO: 146343 - protein, 215 aa, Glycine max
  Coding DNA Sequence Number=SeqID_29565
MANLPKENQQVTSSTPSIQKSEEDQAASTAMGFKDSLEKQYLKVKEHAETYPYVWASYIVVYGGFALWTTYRWRKLRKTEDRVKTLQERLRKHVEAEESSSSTKVVEKGSTSSDTKAIGKGSASSDTKVVEKGSTSSDKSSNFRNSLLVLTNLWMDCVEGVCQRQREQGGPLPTPMLVEVAILTLPTKHSAWNSCPSGSTKLKNIENRMNMRVNQ

SEQ ID NO: 146344 - protein, 334 aa, Glycine max
  Coding DNA Sequence Number=SeqID_29566
  Gene Ontology: Mol. function=transcription factor activity; Cellular component=intracellular; Biological process=regulation of transcription, DNA-dependent
  Homolog annotation: Hit_ID=Q6D964; Match level="QueryCoverage=98%, HitCoverage=97%, E-value=7e-76, Identity=47%"; Hit description=LysR -family raffinose operon repressor
  Pfam annotation: Domain name=LacI; Domain location=1-26; Score=30.9; E_value=4.4e-06; Accession=PF00356.11; Description=Bacterial regulatory proteins, lacI f
  Pfam annotation: Domain name=Peripla_BP_1; Domain location=58-332; Score=123.1; E_value=7.8e-34; Accession=PF00532.11; Description =Periplasmic binding proteins and sugar b
  Pfam module annotation: Pfam domain module=LacI::Peripla_BP_1; Domain location=1-26::58-332
MSLKAIASALGLSVTTVSRALNGFDDVAAATRKRIEEEADRRGYRPNAAARRLKTGRANAVGLVFPVSNASLNDSYYSEMLLTLDQRLALHEIDLLLLPDKPQDQQRNLLRMLRSGMLDALIVTHTTPQDVRLQRLQQKGFRFLTLGRSQLPQPYAWFDYDNHAGTLLAAQHCQQQGYTRIAYLGGNEPSTYILDRRQGFIDALPATPCAQQAGWMAALPPSRRAGYQQTRAWLAHDIQPDAIITDCSPLGEGAAIALQQAGRLSGAQAIPLYVYDGLPHDSIITQPVNAILQSSQQRIGERVAEMVLQLLEGAPPAQLQTLWQPMLRLTSDAQ

SEQ ID NO: 146345 - protein, 425 aa, Glycine max
  Coding DNA Sequence Number=SeqID_29567
  Homolog annotation: Hit_ID=P37665; Match level="QueryCoverage=47%, HitCoverage=92%, E-value=2e-66, Identity=65%"; Hit description=Inner membrane lipoprotein yiaD precursor
  Pfam annotation: Domain name=Adenine_glyco; Domain location=6-164; Score=262.8; E_value=7.1e-76; Accession=PF03352.4; Description =Methyladenine glycosylase
  Pfam annotation: Domain name=OmpA; Domain location=313-408; Score =141.9; E_value=1.7e-39; Accession=PF00691.11; Description=OmpA family
  Pfam annotation: Domain name=Rick_17kDa_Anti; Domain location=233 -280; Score=45.4; E_value=1.9e-10; Accession=PF05433.5; Description =Rickettsia 17 kDa surface antigen
  Pfam module annotation: Pfam domain module=Adenine_glyco::OmpA::Rick _17kDa_Anti; Domain location=6-164::313-408::233-280
MQRCGWVTQDALYLAYHDTEWGVPQTDKRALFEMLCLEGQQAGLSWITVLKKRENYRQAFHDFDPQAVALMDEADLLRLLQNSGLIRHRGKLEAIINNAKALLALEATGEDFSRFIWSFVDNQPILHRYADYKLAPTTSEPAIALSKALKKRAVSAIPIIFKAKVYKLRLCLTNFPIIERHNSAVLGHFPRFRMRDFFMKKRVLALALLMSGSVALSGCTTNPYTGESQAGKSGIGAGLGAVLGAGVGVLSSSKKDRGKGALIGAASGAALGGGVGYYMDVQEAKLRDKMRGTGVSVTRQGDNIVLNMPNNVTFDSSSANLKPAGANTLTGVAMVLKEYPKTAVNVVGFTDSTGTRALNMRLSQQRAESVASALIVQGVAQNRLRTQGMGPDNPVASNSTEAGRSAAAGRLLTCFYALIDAQSSR

SEQ ID NO: 146346 - protein, 218 aa, Glycine max
  Coding DNA Sequence Number=SeqID_29568
MAMVYIDVNWMNDALHETSFTEATQELMLAAIAALFFFAAWQRPQQRSALILVARRMAVVCAGNDRGLAGDGAASAAANPAGPGGTAAASQLANDGRRAAGGAGVLAARAASCLATACVWWHRCAICGKPARRWQQHAPAVAWYTDRLAPGRRCTGPITARWRCCTTMFPAFYAITPQRLAHLLALEAAAQQPNDVTLDDSLFHSDAAPIAVPVGKFA

SEQ ID NO: 146347 - protein, 88 aa, Glycine max
  Coding DNA Sequence Number=SeqID_29569
MTKLEHKAEMKVAEFRSIEPKEETRLQLQIAKIRTQGRDADGQTARTQGREIRMFSNQKGNMASQELNGTKDCTFFLSLGRDRHTIAH

SEQ ID NO: 146348 - protein, 256 aa, Glycine max
  Coding DNA Sequence Number=SeqID_29570
  Gene Ontology: Mol. function=hydrolase activity, acting on ester bonds; Biological process=lipid metabolic process
  Homolog annotation: Hit_ID=Q8ZLA5; Match level="QueryCoverage=79%, HitCoverage=83%, E-value=1e-21, Identity=34%"; Hit description =Putative lipase
MGADNNVMDVRAATGPTRSLLARQESFMWQNSQRTGQRLLALAFSGGWLLVVALPAHAWDQASESSAPDYNAILAEKISSNHLMLTENRDSDLLDAALNPPGGGMALHSETASVGNSPLVNRYSAGWNLPMNDRLRTGPVAQFAVDDSTLSCAACAPVDRNNAEHIASLGWRVDSSFGWISPWAQVSYSHQLSFDGTAAPRDRPEEMNRETNWMDVSVGARLPLGQNMAAFASFAQTGAVSSGEQFIYNLGVSASF

SEQ ID NO: 146349 - protein, 118 aa, Glycine max
  Coding DNA Sequence Number=SeqID_29571
  Gene Ontology: Mol. function=calcium ion binding
  Homolog annotation: Hit_ID=Q94LH2; Match level="QueryCoverage=66%, HitCoverage=50%, E-value=2e-10, Identity=47%"; Hit description =Putative calmodulin-like protein
  Pfam annotation: Domain name=efhand; Domain location=44-72; Score =16.8; E_value=0.077; Accession=PF00036.22; Description=EF hand
  Pfam annotation: Domain name=efhand; Domain location=80-108; Score =22.1; E_value=0.0019; Accession=PF00036.22; Description=EF hand
  Pfam module annotation: Pfam domain module=efhand::efhand; Domain location=44-72::80-108
MNVHRFNNVHDHTAKFIDAGGENMAFMDRNVTSDGKRVMNLKQFKQWLKTSFDTNKDGRISKDELHEAFKLTVGLFASWKSHKVLKYADTDHDGFIDENEFINLVQFAENHFNVRITK

SEQ ID NO: 146350 - protein, 153 aa, Glycine max
  Coding DNA Sequence Number=SeqID_29572
  Homolog annotation: Hit_ID=Q1SMF0; Match level="QueryCoverage=92%, HitCoverage=27%, E-value=1e-21, Identity=41%"; Hit description =Tetratricopeptide-like helical
MRFDTHTGSRGRSSFVLIGCERSDHYKCRKKEFVKRDTGSRKCGCPFKLRGKPVIGGEGWMVKLICGIHNHELAKSLVGHSYAGRLTKDEKNIIANMTKSMVKPRNILLTSKEHNANSCTTIKQIYNARSAYRSSIRGSDTEMQHLMKLLERD

SEQ ID NO: 146351 - protein, 57 aa, Glycine max
  Coding DNA Sequence Number=SeqID_29573
MEGSSNRVITYVSVRSVWEIYMLILKVQMLLLGRLYSQSNTGKEKFGKARHNSNRRD

SEQ ID NO: 146352 - protein, 50 aa, Glycine max
  Coding DNA Sequence Number=SeqID_29574
MDIGGNGSWMKRISSNIYPIFLITMQHQTNDTEGTSEKNRSHEFYSNEKE

SEQ ID NO: 146353 - protein, 102 aa, Glycine max
  Coding DNA Sequence Number=SeqID_29575
  Subcellular localization annotation: CTP_CleavageSite=55; ConfidenceScore=5.48e-01
MDQLICVERKPATTTRVPLMTLLSNQPPQQSPLASNTFTSTQVAPHSMGKTNRAKSEARTNGKNSTNKLLNEEEDARIILDLLKIIGCTSNNVGAPSNTPQL

SEQ ID NO: 146354 - protein, 371 aa, Glycine max
  Coding DNA Sequence Number=SeqID_29576
MALISELLANTILLVMRHFSLLRLACLFGIRIALTVIYTWTELIGTTISFHANIILRIITWTFGLISLPARVVYAFQRERQVRKCCCLLPRKGKGIGDGLEQKLHEMQIELENLVWDKKELQEHFKMAVKERKMMEMLLVELEEEHDMAIEKIEKLEGKLQDQTNENLRLKEIQGKRYWSSKDQSNSDRVQTINDSNYNISHPILSLNSNYNGSGISLQDLIMCKDIWEDESKTRSELLKLLKAVPKSGPVVKSKTSEALDYHRDVALSQSLFSAIMSLVVGVTVWEAEDPCTPLVVALFAVVGMSLKSVVQFFSTIRNKPASDAVALLSFNWFILGTLTYPTLPRVARMLAPLVLRLMDQTMTPGSVSFP

SEQ ID NO: 146355 - protein, 200 aa, Glycine max
  Coding DNA Sequence Number=SeqID_29577
  Homolog annotation: Hit_ID=Q9FNA1; Match level="QueryCoverage=48%, HitCoverage=51%, E-value=2e-23, Identity=59%"; Hit description =Arabidopsis thaliana genomic DNA, chromosome 5, P1 clone:MSH12
  Pfam annotation: Domain name=UPF0114; Domain location=99-200; Score =72.9; E_value=1e-18; Accession=PF03350.6; Description=Uncharacterized protein family, UPF0114
  Subcellular localization annotation: CTP_CleavageSite=71; ConfidenceScore=5.74e-01
MKLSQTLVRTPFSTTSPALLRTQNSILSSNGKRVSVLEYQSLRLPSCACSNSGSAVSSSSSAAAKKNPSPPAPQVVSNSGYDSAVTQELPGKLEALEEGIEKVSVYGYSGCIWVFNWFISVFYQDVYLLGTVMLVFGMGLYELFVSNLGVDQKPSDRSSLFGLFPLKERPKWLDIKTVDELKTKLGHVIVMLLLIGLFDK

SEQ ID NO: 146356 - protein, 742 aa, Glycine max
  Coding DNA Sequence Number=SeqID_29578
  Gene Ontology: Mol. function=peptidyl-prolyl cis-trans isomerase activity; Biological process=protein folding
  Homolog annotation: Hit_ID=Q9LY75; Match level="QueryCoverage=72%, HitCoverage=79%, E-value=1e-78, Identity=52%"; Hit description =Peptidyl-prolyl cis-trans isomerase
  Pfam annotation: Domain name=Pro_isomerase; Domain location=65-239; Score=351.0; E_value=2e-102; Accession=PF00160.11; Description =Cyclophilin type peptidyl-prolyl cis-
MAHRASMIDLRGGEHPKKNALPLTLSQAEEEHFIVILSDTEPSPPFIHAFMCLLSKVMGLEKNPLVFFDVSIDGDPVERIVIQLFASIVPRTAENFRALCTGEKGIGELTGKPLHYKGTSFHRIIRGFMAQEKILILHGGDFSRGNGTGGESIYGGKFVDENFKLTHDGPGVLSMANSGPNTNGSQFFITFKRQPHLDGKHVVFGKVVNGMDILKKIEPVGTSDGKPTQPVKIIDCGEVSETKIQHTADKEKGKRRKSGKSLSSDDGSDKKSRGKRKKSSKDTRKRRRRYSTSDSDSDSYSSDSESDSDSESDSSVSDSSYSSDGKHQKRRSKRKHGKKRKIGRKQRKRSQHSRSRRARRKSRRSDYSLPLAFPLFLIVALLQSSEDSSDTDSASGSSSGDEKTDRHASGRKTLADNEARRNLDTGKQSSSPPQQRQTIPEQKMDPKVRRIVDKQSHEEGELSPENGAFVNNRHDTEAEFSKPAKQHANSDDLNHNRGASPRRSPTRDSRELNQGHASLLASPGQKVSEPAAPKHGQGFSKSPSPNGMPKRIKKGRGFTERYAFARRYRTPSPERSPRTYRYGDRNIRRNFDRNTSYRSYSGRSPPRRFRSPPGGRNRPRYQSRRSRSRSNSRSPVRGHFSDRDRSRSPRRSPSPEDRRPPISDQLKSRLGPRSDERLPDRGRSKSKSRSNGSSCSRSPDATPPKRYDKRTSVSRSRSRSSSPSGQRGLVSYGDASPDSGSG

SEQ ID NO: 146357 - protein, 173 aa, Glycine max
  Coding DNA Sequence Number=SeqID_29579
  Gene Ontology: Mol. function=RNA-directed DNA polymerase activity; Biological process=RNA-dependent DNA replication
  Homolog annotation: Hit_ID=Q1SQB1; Match level="QueryCoverage=39%, HitCoverage=17%, E-value=3e-11, Identity=43%"; Hit description =Polynucleotidyl transferase, Ribonuclease H fold
MGKILCFGWMNGMGEVVANLGSWENNNWSWSFWWRRDTGGKGKLKCLKQNQEDQWVWTADSSVIFSYPLQHSTFFSVIWKLKVPPKIKFFIWRIALNRVATRDNLRKRGILITDDEYKCPFCSLVEQSISHLLFQCPCSSLIWGQWYSKVGILIASPWTVEAHFNQHYVFLRN

SEQ ID NO: 146358 - protein, 133 aa, Glycine max
  Coding DNA Sequence Number=SeqID_29580
  Homolog annotation: Hit_ID=Q2R165; Match level="QueryCoverage=95%, HitCoverage=60%, E-value=3e-35, Identity=52%"; Hit description =Expressed protein
MDASEPDNVDDYSPSSTVIKFDRPVPLLRGPLPAGPSDDPSAGPYVLAFRDSRAWASSFAACERKIVEQCEEGARIGCAVSASRKCKLPWWKSLAGPTLSDLKEREQCEVREMADCEAAAKEKCVGFARDKCL

SEQ ID NO: 146359 - protein, 299 aa, Glycine max
  Coding DNA Sequence Number=SeqID_29581
  Gene Ontology: Mol. function=N-acetyltransferase activity; Biological process=metabolic process
  Homolog annotation: Hit_ID=Q10R02; Match level="QueryCoverage=71%, HitCoverage=70%, E-value=1e-53, Identity=49%"; Hit description=GCN5 -related N-acetyltransferase, putative, expressed
  Pfam annotation: Domain name=Acetyltransf_1; Domain location=180-284; Score=59.9; E_value=8.5e-15; Accession=PF00583.14; Description =Acetyltransferase (GNAT) family
MPPMSTIPIHRPEFCTLFFNGSPSPYKCPRITASWIMAMDSKFSSTIKNNSDNDYNLKKKKDEELSVQISTPPISKVETLNSNDLQFDRLQPSDQELGRVKRFEFGQFVARETVLDEEYWTAAWLRAESHWEDRPFERYVDNYKRKFAEQEFNALKRRCKVQNGDSCACIITVRKEQKNAKHSILKSVVGTLDLNIRYLLQGETYPGERVKAPLFCSINRTPPSRYGYIANLCVIKSARRQGIASNMMSFAIEAAKSNGLTQVYVHVDRNNRPAQILYQKMGFEVTLLVHVYFSLSMMD

SEQ ID NO: 146360 - protein, 58 aa, Glycine max
  Coding DNA Sequence Number=SeqID_29582
MKGKRGESEEGGKLPSILLFFIRLRIGVDGEGTSFHGSCTPGLEFWIDGIDVVGHAMT

SEQ ID NO: 146361 - protein, 147 aa, Glycine max
  Coding DNA Sequence Number=SeqID_29583
MDANCFRLNKSSALCSTHWNTIKRKPEHPLWLQCSERPQTNITGETRKTNAYKDNLFNRLAIHHLSKSVQEATGLGNNKSGFESLVEAATVAKQKFDPIQQQEVIIQALHKAFPKPILSLARHIKSMERTASLVNAESMEDRRIYGF

SEQ ID NO: 146362 - protein, 46 aa, Glycine max
  Coding DNA Sequence Number=SeqID_29584
MRDEGGRRVIDRLRKENGPVREESDRVRVDRSSVSTSDGGRHIDGK

SEQ ID NO: 146363 - protein, 85 aa, Glycine max
  Coding DNA Sequence Number=SeqID_29585
MAKKNMLLTCCLVFLIVQDNVGLSVQASRMLNIHPPPPIPRVLLKSIQPPSLDLWYSINDEKGNDAFRPTSPGHSPGVGHQTPPP

SEQ ID NO: 146364 - protein, 162 aa, Glycine max
  Coding DNA Sequence Number=SeqID_29586
  Subcellular localization annotation: CTP_CleavageSite=97; ConfidenceScore=5.25e-01
MRGFTFNAKPTLIYGAPKVGSSSLYIGKERNSRVFVSKDGTTLFFLLPSTTTDGVPHRVNSPRYTGSMTRPAHSFKRNNNNSEIELQINSPRSPLVSAEGSVSKRNQHHQKEKKNKFGCWVFLLFCGVCLFLGLLMICASAWWFRSKVHSTHESIIQVSIMP

SEQ ID NO: 146365 - protein, 102 aa, Glycine max
  Coding DNA Sequence Number=SeqID_29587
  Homolog annotation: Hit_ID=Q9FH12; Match level="QueryCoverage=80%, HitCoverage=12%, E-value=4e-35, Identity=83%"; Hit description=Axi 1 (Auxin-independent growth promoter)-like protein
MAKAVQGHRGFKNFKKTINQDKVNFVKLVDKLDEGKISWKKFSSKVKRLHEDRIGAPYPREHGEIPKLEESFYSNPLPGCICERRFKIIQYLFMPRKDGETE

SEQ ID NO: 146366 - protein, 248 aa, Glycine max
  Coding DNA Sequence Number=SeqID_29588
  Gene Ontology: Mol. function=kinase activity; Cellular component =nucleus; Biological process=protein amino acid autophosphorylation
  Homolog annotation: Hit_ID=Q2WBN3; Match level="QueryCoverage=86%, HitCoverage=100%, E-value=1e-119, Identity=95%"; Hit description =Mob1-like protein
  Pfam annotation: Domain name=Mob1_phocein; Domain location=63-239; Score=370.5; E_value=2.6e-108; Accession=PF03637.7; Description =Mob1phocein family
  Subcellular localization annotation: CTP_CleavageSite=55; ConfidenceScore=5.09e-01
MKEKKKKASGIASQDDPLVFGSSRKRDPWDFVTMSLFGLGNRNQKTFRPKKSAPSGSKGAQLQKHIDATLGSGNLREAVKLPPGEDINEWLAVNTVDFFNQVNILFGTLTEFCTPSNCPSMTAGPKYEYRWADGVTIKKPIEVSAPKYVEYLMDWIESQLDDETIFPQRLGAPFPTNFRDVVKTIFKRLFRVYAHIYHSHFQKIVSLKEEAHLNTCFKHFVLFTWEFRLIDKAELAPLEDLVESIVQL

SEQ ID NO: 146367 - protein, 405 aa, Glycine max
  Coding DNA Sequence Number=SeqID_29589
  Gene Ontology: Mol. function=RNA-directed DNA polymerase activity; Cellular component=chromatin; Biological process=chromatin assembly or disassembly
MAAANVSKIAFQTHHGHYEFLVMLFGLYNAPSSFQATMNNTFGPYLCKFIIVFFDDILIYSRSFSEHLEHLKTAFQILRDNNFFLKLPKCSFVTQQVEYLGHVVSKCEVEPVPTKVDAIQQWPTPQSVELCEGLPDFYLPFVVETDASRVGIWAILSQQNHHIAFFSKPFCTKLLHASTYVRELAAITVAVKKWRQYLLGHHFTILTDHRSLKELMVQAIQTPEQQIYLARLLGYDYIIQYHTGKSNLTELKANLLTNQELLGYRQKIKDEPHNHLDYVLRHDLILQKGCIWLPHGAHSIPTNLAEFHSMPTGGHMGIVKTLALVGENFVWATMKKDVHQYVTSYITYQQTKYNHHRQPGLLCPLPIPARPWEDLSLDFIVGSPPPAWQEPSLTFRGKFMACPAV

SEQ ID NO: 146368 - protein, 201 aa, Glycine max
  Coding DNA Sequence Number=SeqID_29590
MEDGDVRHSVLEYILRTDDPLLPSTLIKKTLLLGTLQDHLYSGAGAGEGTFLLSLELEQWRSNIEASLSDLQVRERFAFVDTRREAAVKLELAASEQINNNVVAENRLEAQHQERGELTRGLSNSRREYDSAELQKLADDSLLNSLEVNEEAPTQSRDADWDDSIDGLEDGTSNHATRFHLPSPKGTKVSPLEMYKPESIT

SEQ ID NO: 146369 - protein, 69 aa, Glycine max
  Coding DNA Sequence Number=SeqID_29591
  Gene Ontology: Mol. function=nutrient reservoir activity; Cellular component=apoplast; Biological process=auxin mediated signaling pathway
  Homolog annotation: Hit_ID=Q9AR81; Match level="QueryCoverage=65%, HitCoverage=21%, E-value=2e-14, Identity=86%"; Hit description =Germin-like protein precursor
MRMILTLFFIISSLLSLSHASVVAVTPAFDDAQFSGVKGLGISIARLDLAPGGVIPLHTHPGASELLLL

SEQ ID NO: 146370 - protein, 280 aa, Glycine max
  Coding DNA Sequence Number=SeqID_29592
  Homolog annotation: Hit_ID=Q9C597; Match level="QueryCoverage=76%, HitCoverage=42%, E-value=2e-28, Identity=35%"; Hit description=DNA excision repair protein
MMSGYIGQDRFKIKSIKENVRMGANVLQLDQCGRCLPDYVIVATLAQSPRHYLDGGLLALVSSAPALRSINLSQCSLLTSASIYILAESSKSLLKELHLDDCQGIDAALILPALIELEHLEVLSVAGIQIVCDEFVKNYIVARGQNMKELVLKDCINLTNASIKAIVEHCPRLSVLDLMNLHKLTDLSIGHLTNGCCALHTLKLCRNPFSDEAIAAFVETTGGSLKELSLNNIKRYYKLLCFGLYIALKSGGALAFSLDWFISLIDRGGQELNPNNVVWR

SEQ ID NO: 146371 - protein, 150 aa, Glycine max
  Coding DNA Sequence Number=SeqID_29593
  Gene Ontology: Mol. function=chromatin binding; Cellular component =chromatin; Biological process=chromatin assembly or disassembly
  Homolog annotation: Hit_ID=Q1T2D5; Match level="QueryCoverage=64%, HitCoverage=6%, E-value=2e-24, Identity=56%"; Hit description=Chromo
  Pfam annotation: Domain name=Chromo; Domain location=61-114; Score =12.4; E_value=0.034; Accession=PF00385.14; Description='chromo' (CHRromatin Organisation MOdifier
MRYFGPFPIVAKIGSVPYKLQLHAAKIHPVFHISQLKPFKGIPQEQYMPLPLITTDTGPVIALIAILQTRSIKKGSNFIPQVLVQWDNTTPAEATWEVLMRCTFSTKSAKGDPHGEKGNNVVSIGREMMRQRKRMRNRMTSTKLRDYVCN

SEQ ID NO: 146372 - protein, 276 aa, Glycine max
  Coding DNA Sequence Number=SeqID_29594
MFDFANPPSGEILLRSYGNPANWKLEQLMTPKFRLAATSLDNQVEPPSFIVNLTYTCFMRKDNSNYPHMDMPIHAINVIENLSAVEKAGLAINKKGLTLKELLQQTSHHNPKVRRGCTSTQKSSPIHTGSPELEEPLKILSAKAQTAQEWWVTHNKLSFPCCKGFRLLSALLFSRNNDQRIEMINKIKQWSKGKEGNICSLLSTLQYTNGNWGMDLQIIMQFLGSLDCWRSLNVVNNSLEMAQLAMEDILTQLKKEMAAPWRTYLGSNCIFDVCNI

SEQ ID NO: 146373 - protein, 630 aa, Glycine max
  Coding DNA Sequence Number=SeqID_29595
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=62%, E-value=1e-104, Identity=62%"; Hit description =Chromo
  Pfam annotation: Domain name=rve; Domain location=400-572; Score =42.7; E_value=1.3e-09; Accession=PF00665.16; Description=Integrase core domain
MTYLEPDLATNDHHLSLNAMKGTDSMGILRFTSQIGQISVQVLVDGGSSDNFLQPRIAEFIKLPVEPGPCFKVLVGNGQSMIAEGVIPNLSITLQGHELTIPVFLLPVVGADIILGSSWLATLGPHVADYAALTLKFFNKGKFMALQGERGTPPKLAQFNHYRMMRNTDAIADSFTVQLFQFHTEDDALKYLPQHIAPEIALLLHTYSSVFQTPTSLPPPRSQNHAIPLLEGTQPVKVKSYRYPHSQKEQIEKMVHEMLDQGIIQPSTSPFSSPIVPVKKKDDSWRFCTDYRAYVVTIKDSFPMPTVDELLDDLFGAISFFKTGLKIRLPSDFVLQQHVLFVKLSKCSFGVLKIEYLGHIVSGQGVSMDSSKVQAIYEWPPPTNVTQLRGFLGLTGYYRRFIKAYAKIDAPLTELLKKDGYLWTEETETTFLRLKEAMMTTPVLGLPNFQQPFILETDASGIGDYTSRSVAELFMTYVVMPKSIVSDRDKVFTSNFWKNLFQLQGTTLAMSSAYHPQSDGLSEVVNKCLEMFLRCFTFHNPKAWYKALNWAEFWYNTSFHTSIGMAPFKALYGRDPPTLTRYNPQASDPVTLQEQLINMDSILQQLKQQLERAQVYMKNQADKKRTDVSF

SEQ ID NO: 146374 - protein, 391 aa, Glycine max
  Coding DNA Sequence Number=SeqID_29596
  Gene Ontology: Mol. function=N-acetyltransferase activity; Cellular component=Ada2/Gcn5/Ada3 transcription activator complex; Biological process=metabolic process
  Homolog annotation: Hit_ID=Q9M1G7; Match level="QueryCoverage=90%, HitCoverage=67%, E-value=1e-119, Identity=60%"; Hit description =Histon acetyltransferase HAT1
  Pfam annotation: Domain name=Acetyltransf_1; Domain location=239-317; Score=53.7; E_value=6.3e-13; Accession=PF00583.14; Description =Acetyltransferase (GNAT) family
  Subcellular localization annotation: CTP_CleavageSite=51; ConfidenceScore=5.35e-01
MESHGGGPLRSRSSQSPSPSHSASASATSSIHKRKLASEDHAPPFPPSSFSADTRDGALTSNDDLESISARGADSDSDDDSEDAVVDDDEDDYGNDNDSSIRTFTASRLSNPPSAPRNTKLKTEISTVKIENSDGAKDAVVGACAAASAGSVPGIVVKEDPTKIFTDNLQTSGAYTAREESLKKEEEAGRLKFVCLSNDGVDEHMVWLIGLKNIFARQLPNMPKEYIVRLVMDRSHKSVMVIRRNHVVGGITYRPYASQKFGEIAFCAITADEQVKGYGTRLMNHLKQYARDMDGLTHFLTYADNNAVGYFIKQGFTKEIHLEKDRWQGYIKDYDGGILMECKIDPKLPYTDLSTMIRRQRQAIDEKIRELSNCHIVYAGIDFQKLNSDCI

SEQ ID NO: 146375 - protein, 50 aa, Glycine max
  Coding DNA Sequence Number=SeqID_29597
MLMLIGQVLLSDGGCNNEEEDKENKRVSEMKRLNGREDHHFLTYAGPRDG

SEQ ID NO: 146376 - protein, 111 aa, Glycine max
  Coding DNA Sequence Number=SeqID_29598
  Gene Ontology: Mol. function=N-acetyltransferase activity; Cellular component=polytene chromosome; Biological process=metabolic process
  Homolog annotation: Hit_ID=Q9M1G7; Match level="QueryCoverage=86%, HitCoverage=20%, E-value=2e-41, Identity=66%"; Hit description =Histon acetyltransferase HAT1
  Pfam annotation: Domain name=Bromodomain; Domain location=20-100; Score=107.5; E_value=4e-29; Accession=PF00439.15; Description =Bromodomain
MTGEAGWTPDQWGHSRFRTLNSMFDHADAWPFKEPVDARDVPDYYDIIKDPMDLKTMSKRVDSEQYYVTFEMFVADARRMFANARTYNSPETIYYKCSTRHVLVLPPPGWM

SEQ ID NO: 146377 - protein, 65 aa, Glycine max
  Coding DNA Sequence Number=SeqID_29599
MDDSSTIEETEDSPIQPYFSKSDGGSCTSGKHGEVMLMPRSEMKRKMPLKEPKNLTWVLGVHSLN

SEQ ID NO: 146378 - protein, 324 aa, Glycine max
  Coding DNA Sequence Number=SeqID_29600
  Gene Ontology: Mol. function=protein phosphatase type 2A regulator activity; Cellular component=protein phosphatase type 2A complex; Biological process=multicellular organismal development
  Homolog annotation: Hit_ID=Q6H975; Match level="QueryCoverage=98%, HitCoverage=41%, E-value=1e-107, Identity=64%"; Hit description=STY -L protein
  Pfam annotation: Domain name=LisH; Domain location=12-38; Score=35.3; E_value=2.1e-07; Accession=PF08513.1; Description=LisH
  Pfam annotation: Domain name=SSDP; Domain location=74-276; Score= -95.5; E_value=0.023; Accession=PF04503.4; Description=Single -stranded DNA binding protein, SSDP
  Pfam module annotation: Pfam domain module=LisH::SSDP; Domain location=12-38::74-276
MAQNQSNWEADKMLDVYIYDYLMKRKLHAAAKAFVTEGKVSTDPVAIDAPGGFLYEWWSVFWDIFISRTNEKHSEAAAAYIETQQTKAREQQLQMQQLQLMQQRSAQLQRRDPNHPSLGGSINAMNSEGMLGQPPASVLAMKMYEERMKHPHSMDSEASPTLIDPNRMALLKSAASHQGQLVHGNSGNMSTALQQGRAPLTTDIKGEVNLGATPKSLPMDTSVYRQAILHSKSGLGSAGLNQGVTGLPLKGWPLASGIDQLRPNLGVQIPKPNLTAQNQFVLASQQQQVLAQAQAQNNLGNSNYGDMDPRRLSGLPRGSLSAKD

SEQ ID NO: 146379 - protein, 108 aa, Glycine max
  Coding DNA Sequence Number=SeqID_29601
MGFILYRNREASWKIPLRLKGSSRCGVSTENNGNLWWLMVAVGDGERAWNIGNGFGRKKGEEMTFFLSYLDYKTQNAQVSNALGNGNVMHTPDIFSKITTVRSWTSVL

SEQ ID NO: 146380 - protein, 227 aa, Glycine max
  Coding DNA Sequence Number=SeqID_29602
  Gene Ontology: Mol. function=protein binding; Cellular component =integral to membrane; Biological process=defense response to fungus
  Homolog annotation: Hit_ID=Q1ST34; Match level="QueryCoverage=72%, HitCoverage=88%, E-value=2e-25, Identity=35%"; Hit description =Leucine-rich repeat
  Pfam annotation: Domain name=LRR_1; Domain location=119-141; Score =12.8; E_value=1.2; Accession=PF00560.23; Description=Leucine Rich Repeat
  Pfam annotation: Domain name=LRR_1; Domain location=148-170; Score =8.5; E_value=7.2; Accession=PF00560.23; Description=Leucine Rich Repeat
  Pfam annotation: Domain name=LRR_1; Domain location=15-39; Score=6.0; E_value=22; Accession=PF00560.23; Description=Leucine Rich Repeat
  Pfam annotation: Domain name=LRR_1; Domain location=172-195; Score =11.3; E_value=2.2; Accession=PF00560.23; Description=Leucine Rich Repeat
  Pfam annotation: Domain name=LRR_1; Domain location=197-225; Score =9.3; E_value=5.2; Accession=PF00560.23; Description=Leucine Rich Repeat
  Pfam annotation: Domain name=LRR_1; Domain location=44-67; Score=7.1; E_value=13; Accession=PF00560.23; Description=Leucine Rich Repeat
  Pfam annotation: Domain name=LRR_1; Domain location=70-92; Score =15.7; E_value=0.17; Accession=PF00560.23; Description=Leucine Rich Repeat
  Pfam annotation: Domain name=LRR_1; Domain location=95-117; Score =19.0; E_value=0.017; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=119-141::148-170::15 -39::172-195::197-225::44-67::70-92::95-117
  Subcellular localization annotation: CTP_CleavageSite=77; ConfidenceScore=5.78e-01
MTSLVFQGGFNFSSKLQNLHLQHCSLTDRSFLMPSTSSMSSSSSLVSLDLSSNLLKSSTIFYWLFNSTTNLHKLSLYHNMLEGPIPDGFGKVMNSLEVLDLSGNKLQGQIPSFFGNVCALRSLDLSNNKLNGEFSSFFRNSSWCNRDIFTNLDLSDNRLTGMLPKSIGLLSELEDLNLVRNSLEGEVTESHLSNFSKLKYLRLSENSLSLKFVPSWVPPFQLEYLES

SEQ ID NO: 146381 - protein, 149 aa, Glycine max
  Coding DNA Sequence Number=SeqID_29603
  Homolog annotation: Hit_ID=Q9LX27; Match level="QueryCoverage=81%, HitCoverage=63%, E-value=5e-07, Identity=27%"; Hit description =Calmodulin-like protein
  Pfam annotation: Domain name=efhand; Domain location=119-147; Score =10.1; E_value=1.1; Accession=PF00036.22; Description=EF hand
  Pfam annotation: Domain name=efhand; Domain location=44-72; Score =31.9; E_value=2.3e-06; Accession=PF00036.22; Description=EF hand
  Pfam annotation: Domain name=efhand; Domain location=80-108; Score =10.9; E_value=0.86; Accession=PF00036.22; Description=EF hand
  Pfam module annotation: Pfam domain module=efhand::efhand::efhand; Domain location=119-147::44-72::80-108
MPIFIPAMTEHKALPPNNTYKHVFIPPVPGYRHLPPNIIVTENQIREILRKADSNGDGRLSKEELKKAFIEFGSKMPGWRACRLLRKADTNHDGVLTMEELDTIVDFALASALVNPSIRACRLLRRADANHDGVLTIEELDTIVDFALA

SEQ ID NO: 146382 - protein, 1390 aa, Glycine max
  Coding DNA Sequence Number=SeqID_29604
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=98%, E-value=0.0, Identity=53%"; Hit description=Chromo
  Pfam annotation: Domain name=Chromo; Domain location=1282-1336; Score= 39.7; E_value=9.8e-09; Accession=PF00385.14; Description='chromo' (CHRromatin Organisation MOdifier
  Pfam annotation: Domain name=rve; Domain location=979-1135; Score =104.8; E_value=2.5e-28; Accession=PF00665.16; Description=Integrase core domain
  Pfam annotation: Domain name=zf-H2C2; Domain location=920-961; Score =11.1; E_value=0.012; Accession=PF09337.1; Description=His(2)-Cys(2) zinc finger
  Pfam module annotation: Pfam domain module=Chromo::RVT_1::Retrotrans _gag::rve::zf-H2C2; Domain location=1282-1336::542-711::118-208::979 -1135::920-961
MAENTHMKKLTAEVARLKDLLVDIKKLAEMMESRDQELKSLLEHLTMRENDQDTRFETIESHITSLLRNNSGPSNPPLQVQNVKLDFPRFDGSDVLQWIFKAEQFFNYYHTPDEQRLIIVAVHLDKEVVPCFQMQSRDNAFPSWTTFTRVLKLEYGPSPYECARSDLFKLQQETMVQDYYVKFTALANRVQGVTMEALLDCFVGGLKPNIKRDVIAQNSVILLRCVSLAKLREKGLYFTCDDKFTPAHRCPNKQYLLLQVEDDEVFDESAIEKLDEVTLERPQQTEPHLSFNLKGSSGLGTMRFTGLINGMQVQILLDSGSSDNSLQPIIAHCLKLPIEPIPEFKVLVGNGNALTVEGLIRELEVKIQGHSVVLPAYLLPVAGADVVLGASWLSTLGPHISDYSKLTLKFFSNNHFITLQGDQLQLPSVAQCHQLRRLQHTHSIAELYSLCFTRFHGPQDHLLELPPNMDPALTTLLHTYKDVFVVPVGLPPPRIQNHSIPLMQGSQPVKVKPYRYPHSQKEQIEKMVQDMLNEGIISPSTSPFSSPIILVKKKDGTWRFCTDYRTLNAIIIKDSFPIPTVDELIDELYGARFFSKLDLRSGFHQILMNKEDRYKTAFRTHQGHYEWLVMPFGLTNSPATFQSLMNDVFRGLLRKYVLVFFNDILVYNPTWNSHLQHLESVLQVLQYNQLFAKLSKCAFGLTEVEYLGHTVSGEGVAMDKDKVQAVIDWPVPQNLKQLRGFLGLTGYYRRFIKGYASTASVLTNLLKKDSFTWDPTATVAFTALKQAITKAPKQSAYSRESFAITEAISKFRHYLLGHKFIIQTDQKSLKTLTEQALQTPEQQSWLPKLLGYDFTIEYKPGKENIPADALSRSFFMAWSATKIHFIEVLRKAQAADPDLAGKLVVPKNHDMIQQILKEFHSSTMGGHAGYTRTLARIASQFYWSGMHGDIKDFVQQCLVCQQAKTAIVLPSGLLQPLPIPNQIWEDLAMDFITGLPPSHGYTVIYVVVDRLSKYAHFATLKSDYNSKQVAETFMNMVVKLHGIPKTIVSNRDKVFTSQFWQHLLKLSGTTLTMSTAYHPQTDGHSEALNKCLEMYPRCFTFDNPKEWVKLLPWAEYWYNTAYHTSTGMSPFKAVYGRDPPKLLRYAPINDEPVSVQEQLLLRDQILAQLKTHLLRAQQIQKKNADLKRKHVEFQIGDKALVKLQPYRQHSLALRKNKKLSLHYFGPFTIVKKIGKVAYKLDLPENTKIHPVFHISQLKLCHGNHAQPYIPLPMTTTDSRPMIQPVSILQTRTIIRGNQQVKQHLILWEGLDSSNATWEDQSILSEAFPDFNLEDKVNFDGGGIVTSASSKDKVEGTKEGNNLTQNELVTWLGKRGPQQKGKHTSEGILGV

SEQ ID NO: 146383 - protein, 161 aa, Glycine max
  Coding DNA Sequence Number=SeqID_29605
  Homolog annotation: Hit_ID=Q1SR56; Match level="QueryCoverage=21%, HitCoverage=16%, E-value=6e-09, Identity=71%"; Hit description=HAT dimerisation
  Pfam annotation: Domain name=zf-BED; Domain location=40-87; Score =25.5; E_value=0.00019; Accession=PF02892.5; Description=BED zinc finger
MVGDECNEHVPLTTNKLDGNKNTNQEGEENVIKKKRKKTSSVWKDFDEVEIVGVGKKAICKHFKVRLSTSGPWGSTSHLRRHSKKCNEKKLHMAKEKNQSVIPFKSFNPSNPFLIPGDKYSNERMREIIATTVMVNEYPFSIVENEVWMWAFQYENLDFQK

SEQ ID NO: 146384 - protein, 592 aa, Glycine max
  Coding DNA Sequence Number=SeqID_29606
  Gene Ontology: Mol. function=transferase activity, transferring hexosyl groups; Biological process=carbohydrate biosynthetic process
  Homolog annotation: Hit_ID=Q1RYE8; Match level="QueryCoverage=99%, HitCoverage=99%, E-value=0.0, Identity=78%"; Hit description =Glycosyl transferase, family 8
  Pfam annotation: Domain name=Glyco_transf_8; Domain location=300-511; Score=184.9; E_value=1.9e-52; Accession=PF01501.10; Description =Glycosyl transferase family 8
MDVWSLQKLVKTAPSKALVIRINLVCLAIFLVVYATFLLRPSSSVYFENAASLVRCSLRECHHKGEKSIKMKAVLERNEDRRAKQNASKIEVPSFFGEMGKGMKIGMVNMQEDDVSEWSTLGETSHVYFEKVSQFFNWTDLFPEWIDEEEETDVPSCPEIPMPEFTAYEGMDVIVAKLPCNYPKEGWGRNVFRLQVHLIVANLAVKKGKRDWNWKTKVVLWSKCRPMLELFRCNDLVKQENEWWYYEVDAMRLEQKVSLPVGSCNLALPLWEQGIDKVYDTWNLEQSVKSEARSKREAYATVLHSSEGYVCGAITLAQTLLQTGTKRDLILLLDTSISVAKRRSLELSGWKIRLITRIRNPRAENGTYNEYNYSKFRLWQLTDYERVIFIDADIIVLRNLDILFHFPQMSATGNDQSIFNSGIMVLEPSNCTFHVLMSRRHDVISYNGGDQGFLNEIFMWWHRLPRRVNYLKNFWANTTIEAGRKNAMFGAEPPKLYAIHYLGLKPWHCYRDYDCNWDVEDQRVYASDVAHRRWWKVHDAMDENLQKLCRLTRQRRMELNWERRKAGKLGLPDMHWKINVTDPRRAGSMLIG

SEQ ID NO: 146385 - protein, 60 aa, Glycine max
  Coding DNA Sequence Number=SeqID_29607
MYSLESSESQCIDVSPMLPTPFIGLSEYDADHMLSTKFALSAPLGFFIDILRAKPELTPE

SEQ ID NO: 146386 - protein, 255 aa, Glycine max
  Coding DNA Sequence Number=SeqID_29608
  Gene Ontology: Mol. function=chitin binding; Cellular component =extracellular region; Biological process=chitin metabolic process
  Homolog annotation: Hit_ID=UPI000044A8F0; Match level="QueryCoverage =69%, HitCoverage=99%, E-value=9e-24, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTLRGLHALAFRGLHALAFRGLDVLTFRGLHALTFRGLYVLPLRGLHALTFRGLYILPLRGLHALPLRGPHVLAFGGLHALTFRGLHVLPFRGLHAIAFRGLRVLDFRGLHVLPFRGLHALTFRGLRVLAFKGMHVLTFRGLHVLTFKGLHVLAFKGRHVLNFNGLHALVFRGLRVLIFWASSFLLLVSGPPPDIGGDRAHKTTSGPGEVQQGPGVSRSNYEPLSVLQDARSPQQGIAPTRHPVDPEKSNR

SEQ ID NO: 146387 - protein, 93 aa, Glycine max
  Coding DNA Sequence Number=SeqID_29609
  Homolog annotation: Hit_ID=Q1RYE3; Match level="QueryCoverage=68%, HitCoverage=8%, E-value=2e-10, Identity=59%"; Hit description=IMP dehydrogenase/GMP reductase
MFVNLSCSLTIRCETLTNTGEDLTKGGIGNNELDSSSSWVEEYYNLSKEAEQANTRVEAANCEIEIAKECELKTLEKLNDVNREKGISEDGNG

SEQ ID NO: 146388 - protein, 114 aa, Glycine max
  Coding DNA Sequence Number=SeqID_29610
MKRASSLLQRHGVIGRSAEEEEEEKGQRPKRRCFGGVESWLVLSRQWHPAKEPDMGILKISEALLHYVLPLPLHAGPPMILLGPTLSLTETRQKLILNFSACWVHHKPSMFDVI

SEQ ID NO: 146389 - protein, 253 aa, Glycine max
  Coding DNA Sequence Number=SeqID_29611
MRSGMIFNVLKRKIQRKMSLNRGQTITAVIYRYPISVGSGMFIYQVVTISDDEDIDGMFDLLVQYEQQPSSIANVETTVQSPKIHKTSYINYHTQTYHKGPSSYTPIPYTTTNDYYIPHFEPTEFDTHITSYTQLLGGSSNYCETTPQLNELFQLNVDPITDIHVAQSESNKMSHEYHAQNGLPDEVVGDFSDDEDKILANNNNNDNDDNDIQFLFQQTSTENVYHPYPNSANVGDNQVPNNPDYRHFLDQQQ

SEQ ID NO: 146390 - protein, 59 aa, Glycine max
  Coding DNA Sequence Number=SeqID_29612
MADGKLIEMKGRVNLGILLSNMCSRILALCKKCCVFAGCGKSSTDWVLDVFKQIPTVTM

SEQ ID NO: 146391 - protein, 54 aa, Glycine max
  Coding DNA Sequence Number=SeqID_29613
MVSGASLASIKFLKTLEKIESKCFRNASVSDSVEILHHSSSFFTILRRSSVFNR

SEQ ID NO: 146392 - protein, 344 aa, Glycine max
  Coding DNA Sequence Number=SeqID_29614
  Gene Ontology: Mol. function=hydrolase activity; Cellular component =tRNA-intron endonuclease complex; Biological process=tRNA splicing
  Homolog annotation: Hit_ID=Q5H068; Match level="QueryCoverage=82%, HitCoverage=92%, E-value=1e-104, Identity=65%"; Hit description =Formylglutamate amidohydrolase
  Pfam annotation: Domain name=FGase; Domain location=74-299; Score =301.6; E_value=1.5e-87; Accession=PF05013.3; Description=N -formylglutamate amidohydrolase
MAENAANVIGIELLAAAQGCDFHAPLRSSAALETVRATLRAQWCAGAGPGRPAANRGTAGMNTHPDWLTVHEGDAPLIVSFPHTGSELPHDLIGDYHSPWLARRDADWWVHELYDFVRGMGATTVRSAISRSVIDLNRDPSGVSLYPGQNTTGLCPLTTFDNQPLYHAGREPDDAEIARRRDTYFLPYHDALAAQITRLRAQHGTVVVYDAHSIRSHIPHLFDGELPQFNLDTAGPSGAPDTSCDNALSDVVENLLKISGMSQVRNGRFKGGWITRHYSNIAGGVHSLQMELACRGYMHEPLPDQVDEHSWPTPLDPDHAAPMRHTLAQVLNACLEFATNRSAA

SEQ ID NO: 146393 - protein, 101 aa, Glycine max
  Coding DNA Sequence Number=SeqID_29615
MIASKQVYTLIVAKFITEEETKSNTHFVQQFDRQRFQFQVEKIVNTRERHRMGKFIVRLDQRTCDYGKPQKLHMPCGHVIVAYYVLSVYKVLLAGMRHHDY

SEQ ID NO: 146394 - protein, 105 aa, Glycine max
  Coding DNA Sequence Number=SeqID_29616
MASSDIIPFDINVVAVGTTSDNISSKRKTLDEVSLSSRGQHEAHRCIFQGREMRRVATNVYLRQTSEKPKCVSINFKNKRFGSYFYAQGRVDKSKAFAPTYPQLR

SEQ ID NO: 146395 - protein, 88 aa, Glycine max
  Coding DNA Sequence Number=SeqID_29617
MVMLIQWGEWLPKAQRDRVIYGDTEVSITRGTCLILASPDERVVTIHLARTATNLAMVPSALVMVCFIEFDVFKRRKSVPSLACTYFN

SEQ ID NO: 146396 - protein, 260 aa, Glycine max
  Coding DNA Sequence Number=SeqID_29618
MEHPQTNEQVEAANKVILGKLKNLLDGANERWAKELAETTIEVVQEEFVRHWHIVIQAKCAERLHGCLSIRVKLCRSNIEYVEHTHGRIVKQDPYMKITKQEIVHVKEIHVHPLLVHEHELRGQCGIRPDHAKSDRARIQICYGTNRQPANEVFTSTSTHGYSGSVIGGGGHLSFSIGHFLGQEVAFSNVLALAITANTGPATLSPTFSVVVDGSWLKKAERSLDPSVVERSVKLEKTDPKEWELDNTSKTTFSYPRTSD

SEQ ID NO: 146397 - protein, 198 aa, Glycine max
  Coding DNA Sequence Number=SeqID_29619
  Homolog annotation: Hit_ID=Q10QT4; Match level="QueryCoverage=75%, HitCoverage=65%, E-value=2e-16, Identity=36%"; Hit description =Expressed protein
MAPEWTDEKHSMYIKSIEASFVNQLYDSKQMKTSYDPATTSGQFKVLRGGCWQKINFERVNPQTSRINQCHDLTENPWIQHYRSSSKQRSIAVSSLQESVTTTSKVVDLGQRKGVPSGSGHLHLCESRVCHKDMLYSDTEMSDQNFVDEEVKGKKQNKKSKVKRQRSLISDAQDNDQMVPNRKSSSGGDFTKNFVSAA

SEQ ID NO: 146398 - protein, 54 aa, Glycine max
  Coding DNA Sequence Number=SeqID_29620
MGVALSGRSLSQQIGLARSFACPQAKREQLPCPQVTIRCSDHVQRCMQQKLQIA

SEQ ID NO: 146399 - protein, 247 aa, Glycine max
  Coding DNA Sequence Number=SeqID_29621
  Gene Ontology: Mol. function=protein serine/threonine kinase activity; Cellular component=phragmoplast; Biological process =protein amino acid phosphorylation
  Homolog annotation: Hit_ID=Q1RYC9; Match level="QueryCoverage=94%, HitCoverage=44%, E-value=1e-111, Identity=88%"; Hit description =Serine/threonine protein kinase
  Pfam annotation: Domain name=Pkinase; Domain location=112-247; Score=- 44.0; E_value=6.1e-06; Accession=PF00069.15; Description=Protein kinase domain
  Pfam annotation: Domain name=Pkinase_Tyr; Domain location=112-244; Score=-142.3; E_value=0.00097; Accession=PF07714.7; Description =Protein tyrosine kinase
  Pfam module annotation: Pfam domain module=Pkinase::Pkinase_Tyr; Domain location=112-247::112-244
MDGYDGTVRLGAINLKHDRAADFDSATAAPDVSVSSPVTRQKAAAAKQFIENHYKNYLQGLQDRKDRRRALQRKVQESQVSAEEQEEMMRNLERRETEYMRLQRRKIGIDDFEQLTVIGKGAFGEVRLCRAKDTGEIFAMKKLKKSEMLSRGQVEHVRSERNLLAEVDSRCIVKLHYSFQDSDFLYLIMEYLPGGDIMTLLMREDILSEDVARFYIAESILAIHSIHQHNYVHRYGYYHTVPFLFYW

SEQ ID NO: 146400 - protein, 517 aa, Glycine max
  Coding DNA Sequence Number=SeqID_29622
  Gene Ontology: Mol. function=metabotropic glutamate, GABA-B-like receptor activity; Cellular component=membrane; Biological process =ion transport
  Homolog annotation: Hit_ID=Q69L05; Match level="QueryCoverage=94%, HitCoverage=56%, E-value=4e-61, Identity=29%"; Hit description =Putative Avr9/Cf-9 rapidly elicited protein 141
  Pfam annotation: Domain name=Lig_chan; Domain location=383-516; Score= -92.6; E_value=7.6e-05; Accession=PF00060.17; Description=Ligand -gated ion channel
MSPFTCTSSIIHEFNWRKVTAIYEHSNFFASHSEILTRLSYSLSLVNAEIDHYVAFPSIIITLSNPIENYIEQELVRLKNKSNRVFLLIQSSLEFSTLLFEKVRQMGMMEEGSEWIITDDVATHLDSLDSSIMFNMQGIMGCKTTFMETSETFKRFKFVFGRKFGLEYPEEENSQLPRNILRSDHEGLGGKISFKDRMLLEPPTFKTVKCYWKSENLVEHVVVNTTTTISVGSARVLLGSVDWPGGLKTVPKGWAYNSTEGRPLKIGVPAIDPCPQFVNVSHDKRLNETQFTGFSINVFESVVKRRPYHLPFVFVPFYGSYDQIVEQVNNKDLDAAVGDIQVVEHRYAFAEFSHPYVESGIAMVVKVKADRSKETWMFMDAFTKEMWMLMAVMHLFIAFVIWFIEGENNSELKSLGAILWFSVTTLFFVHREPVKSNLARAVLAPWLFAILIVTSSFTASLSSMMTVSHLEPSVPDIQTLLGTNAIIGCNKNTFLIPKELQHLNEVEPLSESKELCY

SEQ ID NO: 146401 - protein, 302 aa, Glycine max
  Coding DNA Sequence Number=SeqID_29623
  Gene Ontology: Mol. function=ubiquitin thiolesterase activity; Cellular component=intracellular; Biological process=ubiquitin -dependent protein catabolic process
  Homolog annotation: Hit_ID=Q6ZIY2; Match level="QueryCoverage=65%, HitCoverage=59%, E-value=3e-36, Identity=36%"; Hit description =Putative DD1A protein
  Pfam annotation: Domain name=DUF239; Domain location=130-290; Score =57.0; E_value=6.2e-14; Accession=PF03080.5; Description=Arabidopsis proteins of unknown function
MINTLLFVLCLVTSGARHKVHGTQNALQEDLELERQLELLNKPPIKSIHTNFGYIVDCIDINKQPAFDHPLLKYHKLQKDQCPIGTVPIRRTTKDDLIREKSFLNYHIMSQDIPDVHIAEVTLPSSYGPYYGVIGINNVFNPRVSRKDQISSSHLWVQNGPVEATNKIVAGWHVAPQLYGDNETHVYLAWTSDNFKQTGCYNIRCSGFVHISKRVYIGAHVNNYSIYGGTQRELVVSITQFNTLDIFQMTLDILSNLEDPEILPPEGGCFWRKQPGSPGQAELSWGGVKKEGVQPSWHLVIT

SEQ ID NO: 146402 - protein, 101 aa, Glycine max
  Coding DNA Sequence Number=SeqID_29624
MVKNLQGHGTLFIASPKLYGLCNDALFDFQNVAKLYGLRNNALFDFQNVAKLYGLHNNALFDFQNVAELYGLHNNARFGGPEGSKQSSRTDRKHRPNKIRV

SEQ ID NO: 146403 - protein, 226 aa, Glycine max
  Coding DNA Sequence Number=SeqID_29625
  Homolog annotation: Hit_ID=Q47522; Match level="QueryCoverage=25%, HitCoverage=77%, E-value=3e-19, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPEFDRQPLEVADPVIVRVEERLDVDLVDDGVPVPLRIAAIDHRVAASSMKSKEPAVQTTGGRAAVETAAGATGGLSPQPGVVGVNFELGVIMVIAVSFGKPVVPAALMNRPTRGERRFAYWALAECILAYYVGTDEGVSEVLHVAGEKRLH

SEQ ID NO: 146404 - protein, 533 aa, Glycine max
  Coding DNA Sequence Number=SeqID_29626
  Homolog annotation: Hit_ID=A0EXR2; Match level="QueryCoverage=92%, HitCoverage=92%, E-value=1e-166, Identity=61%"; Hit description=Cold- induced protein
MEDGDTTEEAVVVPVSNGDEQSFSHSSSRQRDSEEESPHETLRNTKASIENIVAEILSLKNQAKPKPLLTLRLRELLTQTFLHFVTLRQANRSILLEEERARTETERAKVPLELTTQKLQNLSYEKSQFVKAIKVCNDFKSKYPDIEVVSEEEFFRGAPQDMKDSVLSNHSEHNLVLKRLNFELFQVFVNVKLYYCGHGCFCFWLKFCIDKLVVFQKKDLRRKELCKLHDKLEQKRKTLLDTIANRKKFLSSLPSHLKSLKKASLPVQNQLGVQHTKKLKRHHTAELLPPPLYVIYSQLLAQKEAFGESIDVEIIGSVKDAQAFSHHLAHKDTGISTTVESPKLENNEPDEDGQRQSKRPRRFQGKESLDQAGIFQIHPLTVNLHVYDDEVTDLESAKLISLKFEYLMQLNIICVGNEASNSGSENDILSDLFPDDTGLELPHQSAKLCVGNAIMFNGDRTARPYKWAQHLAGIDFLPEVAPLLLASRETSDSGEAAKGEDFITSLSQYRQQNRLQTVLQKIRSRIKAQLALQ

SEQ ID NO: 146405 - protein, 125 aa, Glycine max
  Coding DNA Sequence Number=SeqID_29627
MELFALLVVAKEMKGNHAVTLFFFFSYKMVIADSDYNGPLFKVSQVFLWDDDLKFSSSAERWVNLIDLVTPEDLELTKQLNDLGLPLSFQTNKEVGCSSSIHSSLWDEVNCTSHFTGVKSTVLKL

SEQ ID NO: 146406 - protein, 199 aa, Glycine max
  Coding DNA Sequence Number=SeqID_29628
  Gene Ontology: Mol. function=Rab escort protein activity; Cellular component=Rab-protein geranylgeranyltransferase complex; Biological process=intracellular protein transport
  Homolog annotation: Hit_ID=Q9C8Z5; Match level="QueryCoverage=95%, HitCoverage=35%, E-value=2e-50, Identity=54%"; Hit description=Rab escort protein, putative; 48705-51166
MYLIIVVFSYPSIDPVNFDLIIVGTALSECVIAVAASVVGKTILHLDPNSFYDSHFASLSFHNLTSYLTSPHSLPSAATVVASSNSDDIVVVDLVHQPFYTDAETATYDESVFLSENLRKFNIDLGGPRALFCADKTIDLLMKSGAAQYLEFKGIDESFVYEANAGLVNVLDSRGMIFRDKKLSLEEKNQLIRFFKLVQ

SEQ ID NO: 146407 - protein, 241 aa, Glycine max
  Coding DNA Sequence Number=SeqID_29629
  Gene Ontology: Mol. function=methyltransferase activity; Cellular component=nucleus; Biological process=regulation of transcription, DNA-dependent
  Homolog annotation: Hit_ID=Q2HU54; Match level="QueryCoverage=88%, HitCoverage=34%, E-value=4e-70, Identity=60%"; Hit description=SAM (And some other nucleotide) binding motif; WW/Rsp5/WWP
MVIDMFGLDTKSDPFESKQGKKVKRRQRQRKLYNEAEDLHFQEMPEVYSVAVGKYWCQRHSLFSRFDDGVKMDEEGWFSVTPEVLARHRAIRCASGVIIDGFTGVGGNAIQFARQLIFHTHPSLWTETADSNTKPYLALWYHADTVFLSPPWGGPDYVKATTFDLKTMLRPHDGYTLFNVAKEIASGVMFLPRNINFNQLAELSLSSCPSWSLEVEKVYLNNKLKAITAYFSDTAVGNVRS

SEQ ID NO: 146408 - protein, 609 aa, Glycine max
  Coding DNA Sequence Number=SeqID_29630
  Homolog annotation: Hit_ID=Q1S2A8; Match level="QueryCoverage=99%, HitCoverage=100%, E-value=0.0, Identity=59%"; Hit description =Remorin, C-terminal region, putative
  Pfam annotation: Domain name=Remorin_C; Domain location=491-602; Score=82.4; E_value=1.4e-21; Accession=PF03763.4; Description =Remorin, C-terminal region
MPELGFQERRSWRRRGGDTSPDSVIFTLESNLSLFSSASASVDRCSFASDAHDHDSLASEISLHLAVQDHDGDFARSESWSGQDPDPDLNKRQQQQQQRHADTDSDAVHGKHRRNRFSGKREKAKVQKEEDSDGGDTEDGNQHLEFDSARNSFSLALKECQDRRSRSETLYKKHDRRRPASLDLNNAIGNGNVSSPRLELGAMKKSTLCTRRSGSGSGNGNFPSPGTPNYLHASVAMQKGWSSERVPLHTSAARKQVGAALFPFNNGRTLPSKWEDAERWILSPVSGDGGTGRASLPAPQRRPKSKSGPLGPPGAAAVAYYSMYSPAVPLFESGNSGSFMAASPFSAAVSVSAAAADGLTASSGGSTDPCMARSVSVHGCSQMQSQSSLPAQGEKFDGFKDAGTNVSPALSRRDMATQMSPEGSSCSSPSLRPSLSASTPSSFPLSEFKSLPFSKMDIRDVPVDERVTMTRWSKKHRALFSGRGSENGDNWKIKESSCRSSFWDISGGSKTVSKSKREEAKINSWENLQKAKAEAAIRKLEMKLEKKRASSMDKIMTKLRLAQKKAQEMRSSTLANQPHQVPRTPHKAILFSRASQMGSLSGCFTCHAF

SEQ ID NO: 146409 - protein, 623 aa, Glycine max
  Coding DNA Sequence Number=SeqID_29631
  Gene Ontology: Mol. function=transferase activity; Cellular component= proton-transporting two-sector ATPase complex; Biological process=DNA integration
  Homolog annotation: Hit_ID=Q1S0E3; Match level="QueryCoverage=73%, HitCoverage=49%, E-value=1e-103, Identity=41%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=rve; Domain location=468-623; Score =146.5; E_value=7e-41; Accession=PF00665.16; Description=Integrase core domain
  Pfam annotation: Domain name=zf-CCHC; Domain location=283-300; Score =31.0; E_value=4.1e-06; Accession=PF00098.13; Description=Zinc knuckle
  Pfam module annotation: Pfam domain module=rve::zf-CCHC; Domain location=468-623::283-300
MGSTNGNFPTNLPILDGKNWNKWSVQMKVIFAYQEVQEVVDEGYPSLVEGATEAQRAVHRENKKKDNKALFFIHQCIDNAHFEKIASAKTSHEAWKILEKCNEGADQLKKVRLQTLRRQYELMQMNVTEKVAEFFNGVIALTNSMKVAGETVTNQMIVEKILRTLIPKFDHVVVAIEESKNLATLKVEELQGSLEAYKQRMLERQSDRSQDQALQAQTWKRGGLSGKKGNRGRGRSREYRSNHGSSGKQSQNNEENDQSESSSRRGGSQNWQGGKKKVYRRFLRCYNCNKLGHFSSECKAPADSRGKFSNEANLVSEKLDQDEEPVTLMMMTKERSSNSGIWYIDSGCTNHMTGHEEWLVNLDLSKKSRVRFADDRHITAEGIGDVYVKKEDGKDVVITEVLYVPGLKSNLISMGQLLEKGFSLYMISGHLGVYDTHQRRILKIWSPKLQEFESSEFKRNGVRNDSNKASLKDVCGPIDTVSLGGNKYFVSFIDEFSRKIWVYLLKAKSEVFSVFKVFKSMAEKQSGKYIKVLRTDGGGEFCSHEMENFCTENGILHEIVAPYTPQHNGIAERRNRTILNMVRSMLKGKNMSHTFWGEAVMTAAYVLNLCPTKKLGSKVPEEI

SEQ ID NO: 146410 - protein, 307 aa, Glycine max
  Coding DNA Sequence Number=SeqID_29632
  Gene Ontology: Mol. function=triacylglycerol lipase activity; Biological process=lipid metabolic process
  Homolog annotation: Hit_ID=Q1S2A7; Match level="QueryCoverage=94%, HitCoverage=98%, E-value=1e-128, Identity=75%"; Hit description =Lipase, putative
  Pfam annotation: Domain name=Lipase_3; Domain location=29-195; Score =155.6; E_value=1.3e-43; Accession=PF01764.16; Description=Lipase (class 3)
MFSILNYQELWSTRAIIVQDTKSEPNLIVVAFRGTEPFDADQWRTDVDISWYELPNVGRIHGGFMKALGLQKNTGWPKEIIDQSSTSGEPHHLYAYYTIREKLRVMLEAKEDAKFILTGHSLGGALAILFAAVLTLHEEEWLLNKLEGVYTFGQPRVGDSRFGEFIKDKLRKYDVRYMRYVYCNDVVPRVPYDDKTLFFKHFGACLYFNSLYHGQVLEEEPNKNYFSLFWVIPKILNAVWELIRGFLIPFIEGRGYIQNWFMTMFRLVGLIIPGLPAHLPTDYVNVTRLGSLNDSQELQNSQDSKAD

SEQ ID NO: 146411 - protein, 443 aa, Glycine max
  Coding DNA Sequence Number=SeqID_29633
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=32%, E-value=1e-129, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVFIGYSSTSAYKLYNPRTKKVEFSRDVLFEEYTAWKSDNCCSGQDQTVAEIDLDLDQTAPDLDNGEELGEELNLPLAPPVESNAPQNERPKRHAEVPARLHDYELFQDSEIGNDGELIHMALLADVSPVSFDEAIVNKNWRKAMKEELVSIEKNETWELVELPANKRPISVKWVFKVKLNPNGSISRHKARLVVRGFMQKEGLDYSEVFAPVARMETIRLLVALASWRGWKLWRLDVKSAFLNGPLEEEVYITQPPGFELKGSEDKVLKLKKALYGLKQAPRAWNKRIDAFLSKIGFRKCSVEHGLYVKKSDSGGILLICLYVDDLLITGSSSTEIAEIKRCLSSEFEMTDLGKLSYFLGIEFEQNNKGILMHQRKYILEILERFNMLQCNPVDTPVEANLKLGSCEQETKVDSTMFRQLVGCLRFLCHSRPEISFGVGLVS

SEQ ID NO: 146412 - protein, 78 aa, Glycine max
  Coding DNA Sequence Number=SeqID_29634
  Gene Ontology: Mol. function=receptor activity; Biological process =DNA integration
  Homolog annotation: Hit_ID=Q1T010; Match level="QueryCoverage=92%, HitCoverage=5%, E-value=2e-19, Identity=58%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVDNKSAINLAKNPVSHGRSKHIETKYHFLRNQVSKEKIKLQHCGTDLQVADILTKPLKIERFKSLRDKMNVEMCCVL

SEQ ID NO: 146413 - protein, 50 aa, Glycine max
  Coding DNA Sequence Number=SeqID_29635
MEMKRSHLCRNSLASISSGHSMNLLFFKLEENKRRPRSTALASCGFSSSP

SEQ ID NO: 146414 - protein, 98 aa, Glycine max
  Coding DNA Sequence Number=SeqID_29636
MAQKTTVSLYVLSGFSSYRQQKVYTDNHSGISARQRDSKVSMTDLQQKVYTDNHLGISARQRDSKVSMTDLVSAEDDVNLRMSTGLSDAIDEGRRRRS

SEQ ID NO: 146415 - protein, 73 aa, Glycine max
  Coding DNA Sequence Number=SeqID_29637
MGTTTAISSEYEVPRRLTPFLFTPPPIYSQIEEELATQLAQASQVASSRSNRLLGEESGRPKWVWLLFAPLFY

SEQ ID NO: 146416 - protein, 120 aa, Glycine max
  Coding DNA Sequence Number=SeqID_29638
MEGLSLCGSDFVKGVLQREWKISTVVYGINLKILMSHNNSFQNCPMYGVACQCYDSTSDSPQISASPYQLDFTLYASGSYNAQWNAPGLLHDKHTLRSSRILRKMEVEEPWLGLWLPLNY

SEQ ID NO: 146417 - protein, 83 aa, Glycine max
  Coding DNA Sequence Number=SeqID_29639
GERAPCRTTEARNQSWKPQGPVRVVMLVRMVRTRLFVAERGKSCPGMHSRCVIASLSGCAHTVGRPPISGGGPGTDKRKLLAP

SEQ ID NO: 146418 - protein, 68 aa, Glycine max
  Coding DNA Sequence Number=SeqID_29640
MRTRSPLKVRACNPLQARMCSPLMVRTYSPLKIDCPFEKGDNSCNLILSFANLSGNSLRVYVLFDLVT

SEQ ID NO: 146419 - protein, 101 aa, Glycine max
  Coding DNA Sequence Number=SeqID_29641
MTIICLCVPSDTTVSEWQKGAGMTIICLRVSSGPPPLDGKRRRMTIICLCVPSDTTVSEWRKGEQNDHNLSPRVIGPAASGWQKMQNGHNLSLRAIGHDCV

SEQ ID NO: 146420 - protein, 95 aa, Glycine max
  Coding DNA Sequence Number=SeqID_29642
MENWRTTLPNNFAGLQTPLGNDILGATKKTGEWRIGEQRYIITSRGSRLVGGGHTNSTRQGHSWGSEKKWRMENWQTALRNNFAGLQTRRWRTHK

SEQ ID NO: 146421 - protein, 85 aa, Glycine max
  Coding DNA Sequence Number=SeqID_29643
ACQTLTKGGLAFHCHERLLHFRGLMWMEEDGWIEEEKRIMDIERGFPKLEILRLRMYSLENSKSSGVVLSRCMGYGLPFYFLIFL

SEQ ID NO: 146422 - protein, 117 aa, Glycine max
  Coding DNA Sequence Number=SeqID_29644
MTRGNPFDLQHFDPEIDRTFHRLVRHHFIPFEHHEHFVTGESVHFVIGDFEHPDFEHYNFEHSENMAQPPPRERTLREMVALDFTYESLCIQYPDEDVQYVLKTGLIHLLPKFHGLA

SEQ ID NO: 146423 - protein, 229 aa, Glycine max
  Coding DNA Sequence Number=SeqID_29645
  Homolog annotation: Hit_ID=UPI0000612705; Match level="QueryCoverage =49%, HitCoverage=50%, E-value=8e-12, Identity=27%"; Hit description =UPI0000612705 related cluster
GLHILAFRGLHILAIRGLHALTFRGLHVLAFRGSSTFIFRELHVLAFRELHALTFRGLHVLAFRELHVLTIKGLHALTFRGLHVLAFRGSCTFTFRGLHVLAFKGLHALTFRGWTPSPSKVLGPPPDIGGRPTMRAQPKEGYHAATVHTGARGRAHKTPSGPGEVQQGPGVSSSDYGPLSVLRSAHRPLQGIAPARHPVDPEKSNRALGFLALIMGLCQFYEAPFAPNK

SEQ ID NO: 146424 - protein, 136 aa, Glycine max
  Coding DNA Sequence Number=SeqID_29646
MSHHSSSVNGEGTSHKDPLSRILDELSSLKLWKEKQERKEKGKKRVEEISQDERKKRREEERRKIMKEMKREKHASYSSHNSCKSLSEELRDYYEGRHRSHLRPHSHRRDKERQPQEANINLSYFHGKDNVEANLD

SEQ ID NO: 146425 - protein, 91 aa, Glycine max
  Coding DNA Sequence Number=SeqID_29647
MTLRSVNMHSSSSFQILSRAQPRSVALCRWLAKPEDWLSEKRENAEKEFVKFGNYECNYRYTYLSSFQPSRLADRYAKRARETFGFSMRLA

SEQ ID NO: 146426 - protein, 58 aa, Glycine max
  Coding DNA Sequence Number=SeqID_29648
MTNASCLQESLHSVSNRNLRFDTAQTLVSRFLQVSSFFEDEGESPVESDETKVQTWSC

SEQ ID NO: 146427 - protein, 114 aa, Glycine max
  Coding DNA Sequence Number=SeqID_29649
ERNIRIGQAEFDEFKAELERRDLHKRLANLQVGSIDVAMVILCIPGKGFVLNVEGQPWKLLRKDLTTLAQTWNVFSYSNLAPTSHTSDLNMDRARLVYGLVTGMDMNIGGLISG

SEQ ID NO: 146428 - protein, 134 aa, Glycine max
  Coding DNA Sequence Number=SeqID_29650
  Pfam annotation: Domain name=zf-CCHC; Domain location=62-79; Score =25.9; E_value=5.3e-05; Accession=PF00098.13; Description=Zinc knuckle
IALKVSSSTQEGSDKEDLIEIDEDDDLSLFVKRFNKFLRIRGNLRRSNFKSKKRAEDSSSTPRCYECNQSGHLRVDCPMFKKRIEKYEKKSFNEKKAKKTYITWDDNYMDSSEESENEVINLSLMDKNYESDEE

SEQ ID NO: 146429 - protein, 69 aa, Glycine max
  Coding DNA Sequence Number=SeqID_29651
MDMELEQLDVKTNFLHGKLEEEILGNNQKVLRRKERKILSIGIIYGSSRSSEGRNLVKGSYEQSWVSIG

SEQ ID NO: 146430 - protein, 96 aa, Glycine max
  Coding DNA Sequence Number=SeqID_29652
MLKVFKCPTYYHVHEGKLEPRAKKVDEFDYTSQNLMRKPNTTALRKSQRQIKAPKRYGFDDIVSYALQVAEELTHLNQPLIMKQLLVLKLISGQWL

SEQ ID NO: 146431 - protein, 110 aa, Glycine max
  Coding DNA Sequence Number=SeqID_29653
  Subcellular localization annotation: CTP_CleavageSite=26; ConfidenceScore=5.38e-01
MRLSASSVTKIVSSAAADACGAKGSKASAEPSNNRLAAVASAFELSIPLFLIFILSLAYLRCVSCNPDKPRNIGERSLPVDTETPCAHDGKNPTNSIENDNEYQYDCQVL

SEQ ID NO: 146432 - protein, 36 aa, Glycine max
  Coding DNA Sequence Number=SeqID_29654
MGFQDKDSTPEDESKVEKLEQSIEITATPPKDLPRE

SEQ ID NO: 146433 - protein, 248 aa, Glycine max
  Coding DNA Sequence Number=SeqID_29655
MAKFDPDVVLEFNANAWPTEEGVRDMRSWVRGQWIPFDADALSQFLGDPLVLEEGQECEYSQRRNRANGFDEEAIAQLLSISGQDFARTTARRQVRIMRTSMTTLTQMWMTLLLSNVLPSDHNSDLPLPKCQLVYAILTRMSVHVAQLIADAIYLFVGMPPTRHPLDPYKSNRALGFPALITGLCQSNGVPVTPSKVIRPPITRAFIEKYCTPRQAQGDAPQAADAPPPPRMADATGSFGMEQYLQNL

SEQ ID NO: 146434 - protein, 119 aa, Glycine max
  Coding DNA Sequence Number=SeqID_29656
  Gene Ontology: Mol. function=RNA-directed DNA polymerase activity; Cellular component=chromatin; Biological process=RNA-dependent DNA replication
MSFGLCNAPATFQRCMLAIFANLVEKCIEVFMDDLSVSDSSIESCLSNMELVLKRCVETNLVLNWEKCHFMVQKGLVLGHKISSQEIEVDKTKIDVIEKLPPPSVPNTCPHGLIVGIIE

SEQ ID NO: 146435 - protein, 160 aa, Glycine max
  Coding DNA Sequence Number=SeqID_29657
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q50HW4; Match level="QueryCoverage=78%, HitCoverage=31%, E-value=4e-64, Identity=82%"; Hit description=Beta -1,3-glucuronosyltransferase
  Pfam annotation: Domain name=Glyco_transf_43; Domain location=1-141; Score=54.5; E_value=2.8e-13; Accession=PF03360.6; Description =Glycosyltransferase family 43
MAKHNFKEEKTEEQASIEANWMNFCLALLSSACRFGTWPVAMLAPSKNKAILEGPVCNASQVIGWHTNEKSKRLRRFHVDMSGFAFNSTILWDPKRWRRPSSNPETTFIEQLVEDESQMEGSPPGCSKILNWHLHLAANNIVYPKGWVLQKNLDAVIPVK

SEQ ID NO: 146436 - protein, 174 aa, Glycine max
  Coding DNA Sequence Number=SeqID_29658
  Gene Ontology: Mol. function=nucleic acid binding; Biological process= DNA integration
  Homolog annotation: Hit_ID=Q0KIN0; Match level="QueryCoverage=99%, HitCoverage=11%, E-value=2e-21, Identity=35%"; Hit description =Integrase core domain containing protein
MHNGKRSIANYAVLSGPLSTPLIPIFRPRNTCELVWSEARALYTNDAQRVHTALHDFNELLPPPTASIATEAKTELKNCTKLFMTLALYGLPQEYSATRDQILGSPMAPTMQSASATLLRISLEPTVDVPESTIGDSSALVSQSNKFGRSGTRPSKPKDRFWCTHCHQDNHSTD

SEQ ID NO: 146437 - protein, 164 aa, Glycine max
  Coding DNA Sequence Number=SeqID_29659
  Gene Ontology: Mol. function=phosphotransferase activity, alcohol group as acceptor
MWYDTDKVVVIWKTKQFQQYGKVERWLEDIWMWMLRFKDAVFGIAVESSAEILGCTLLIMRITNQVLSSYQSMPASVGIKLLALKFLETFVLLFSSDIGDTEKLATKGIRQAVNVEWLVGGHPHPVLDPVVLISDANRTIGILLNLLLSVGSLPGCLTITVVNW

SEQ ID NO: 146438 - protein, 123 aa, Glycine max
  Coding DNA Sequence Number=SeqID_29660
MSSSSSREACQRCVISRNPPLSMTISHPGKFKVQYPINDNGLIISSGSLRSHPQGMFSLPFLSPLLAAHQPLQFPLFLQIISYHPSKVCFCFGSVSWTQRADQGQTEAGNAREKPSTNFHMRT

SEQ ID NO: 146439 - protein, 1003 aa, Glycine max
  Coding DNA Sequence Number=SeqID_29661
  Homolog annotation: Hit_ID=Q69R94; Match level="QueryCoverage=98%, HitCoverage=66%, E-value=9e-74, Identity=34%"; Hit description =Putative symplekin
MSASLAAIARKRPQHYDTILSALLDFDPDFQRVKGCHVTSIQYSFRTAFLGFLRCTYSPILESRERLIRSLRAMNAGDAADQVIRQVDKMIKNGDRSTRDARVSKDDQPSTQSPVSGELSRKRPVPLDNEQLANGHDTISKRIRSGSDSHSTLPAQINDSRQDLSSVNGVSANVPVLDSELTAVEQMIAVIGALLAEGERGAESLEILISKIHPDLLADIVITNMKHLPKTPPPLARIANLPVTRQLSSQVSQSQVIAASVPINSVQSLSGTAQASFPSPTPTVTVTVTTSLPSDTSNFSNQPADSKRDPRRDPRRLDPRRVVVTPGGATVSIADDTGATKEFDEPVSSIKPVSLPVMTADDNTLSDLTVKIKNDDIISEGSPVSGPDQVTPKTEVLEMPGDIHQITEADTSLDPSLSSTDLRDEDLSKAKLSEDTETIGTDSSIFEIDQSSIDVQVESTLEDTCLELPQLPPYIELSEEQGSKVKNMAVRRIIDSYKHLHGTDCQQFCMPLLARLVAQPILTFTIRNLEVQLRKFRLYIIDYKKGWHSAQGSPIVGFGERVDLCITPGHELVLHVLYHLHSLMILDSVGNASSSAVLYEKFLLGLAKTLLDSFPASDKSFSRLLGEVPLLPESSLKILNDLCYSDVIGHDGKIIRDIERVTQGLGAIWSLILGRPQNRQACLGIALKCAVHPQDEIRAKAIRLVTNKLFQLSYISGDVEKFATKMLLSAVDHEVSDTGLLQSGHTEQIAEAELPQLTGCGLVIVVPDKLIIDSAYLILQVESHEISCTSQVSESTISENDTAIFAKPSIQSVPSILFSEAQRLISLFFALCTKKPSLLQIVFNVYGQAPKIVKQAFHRHVPVVVRALGQSYSELLHIISDPPQGSENLLTLVLQILTQDTTPSSDLISTVKHLYETKFRDVTILVPLLSSLSKQEVLPIFPRLVDLPLEKFQRALAHILQGSAHTGPALTPVEVLVAIHGIVPEKDGLALKKACLLSSTLML

SEQ ID NO: 146440 - protein, 140 aa, Glycine max
  Coding DNA Sequence Number=SeqID_29662
  Gene Ontology: Mol. function=phosphotransferase activity, alcohol group as acceptor
MAAPTRDQVLSLLAAANNHGDLAVKTSSLKQAKDLLLSIDPSLAADLFPYLIELQSSPESLVRKLLIQIIEEIGFKAVEHSPTMISLLLTFLRDGDAIVVKQSIVSGTNIFCSVFEELIVQIKLSLRMHRADYLIALCTR

SEQ ID NO: 146441 - protein, 314 aa, Glycine max
  Coding DNA Sequence Number=SeqID_29663
  Gene Ontology: Mol. function=protein binding; Biological process =ubiquitin cycle
  Homolog annotation: Hit_ID=Q1ZXC9; Match level="QueryCoverage=51%, HitCoverage=98%, E-value=3e-69, Identity=72%"; Hit description =Ubiquitin-like (UBL) post-translational modifier
  Pfam annotation: Domain name=DUF1782; Domain location=145-306; Score =414.3; E_value=1.7e-121; Accession=PF08694.1; Description=Protein of unknown function (DUF1782)
LPPLQIRCCCNATSITASSLSRNLWCKSRAQTLADPNLQGDMTLYLACLSTTRMIFADAAIFWVVVAIDPNTLLILELSRMPLFLDDEFVLVVELVIEGARLPSKGVEAFPKGVTGVVVKGGECVVASNKGGGELCEREMEGWDPNTKSTLTQIPLLGTKAGPRDGAAWTQRLKEEYKALIAYTQMNKSNDNDWFRISAANPEGTRWTGKCWYVYNLLKYEFDLQFDVPVTYPSTAPELELPQLDGKTQKMYRGGKICLTVHFKPLWAKNCPRFGIAHALCLGLAPWLAAEVPILVDSGMIKHKDDTATTSTES

SEQ ID NO: 146442 - protein, 506 aa, Glycine max
  Coding DNA Sequence Number=SeqID_29664
  Gene Ontology: Mol. function=phosphoenolpyruvate carboxykinase (ATP) activity; Cellular component=cytosol; Biological process =gluconeogenesis
  Homolog annotation: Hit_ID=P42066; Match level="QueryCoverage=96%, HitCoverage=81%, E-value=1e-175, Identity=59%"; Hit description =Phosphoenolpyruvate carboxykinase [ATP]
  Pfam annotation: Domain name=PEPCK_ATP; Domain location=148-506; Score=803.6; E_value=1.1e-238; Accession=PF01293.11; Description =Phosphoenolpyruvate carboxykinase
METITENGSDGVSLARNTSNNARRGLPMIQTNMKPTDSEFQVCHDDSTPPVRAQTIHELHSLQKKKSTPSTPLSATQGPFATVSDEERQKQQLQSISASLASLTRESGPKVVKGDPATKAEKGTHVHHHPQPHYFASTAFDVSDSALKFTHVLYNLSPAELYEQAIKHEKGSFITATGALATLSGAKTGRSPRDKRVVRDDTTEHDLWWGKCIRPTPEELEEFGTPDFTIYNAGQFPCNRYTHYMTSSTSIDINIARKEMVILGTQYAGEMKKGLFGLMHYLMPKRNILSLHSGCNMGKDGDVALFFGLSGTGKTTLSTDHNRYLIGDDEHCWSENGVANIEGGCYAKCVDLSKDKEPDIWNAIKFGTVLENVVFDEHTREVDFSDKSVTENTRAAYPIEYIPNAKIPCVAPHAKNVILLACDAFGVLPPVSKLSLAQTMYHFISGYTALVAGTEDGIKEPQATFSACFGAAFIMMHPTKYAAMLAEKMQKHGATGWLVNTGWSGG

SEQ ID NO: 146443 - protein, 337 aa, Glycine max
  Coding DNA Sequence Number=SeqID_29665
  Gene Ontology: Mol. function=nucleic acid binding; Cellular component= membrane; Biological process=DNA integration
  Homolog annotation: Hit_ID=Q1S1G2; Match level="QueryCoverage=68%, HitCoverage=18%, E-value=2e-59, Identity=44%"; Hit description =Integrase, catalytic region; Zinc finger, CCHC-type; Peptidase aspartic, catalytic
  Pfam annotation: Domain name=zf-CCHC; Domain location=288-305; Score =11.0; E_value=0.015; Accession=PF00098.13; Description=Zinc knuckle
MKTYSVALLAHSHSPMGKGKTYLVVPKDDTSNLRSLTKHGVEGKSSLVELCISLKTMFDESPSSSKKVTSHSDDPSLNPSSPFFIHPSEGPTSVSVTPALDGTNYHSWCNTLIMSWLLNSISPSIAQSVIFLESAVDIWTDLHERFSQGDLLRIAELQEEIYGLSQANRSVSEFYTALKALWEELDNYRPPAACSCDAKIYHQQDFIIHFLKRLDERFSVVRSQILLMDPLPAVNRIFSMVIQHERQLHIPPTTADDPNSFVNAAGGPSSVKSRGGSRSQPNKTSSNKRCAYCHRSGHTINECWGKHGYPPGHPRYPGHPQFTNILSMIHLSTLIYL

SEQ ID NO: 146444 - protein, 86 aa, Glycine max
  Coding DNA Sequence Number=SeqID_29666
MPTFQVGETPYNKIRLCPMNHDVPNSSPIFIITVVHSWHTEKNNESLRSRLKAEHKWKEAQSISQVLIKTCVEAYLISLCKADINA

SEQ ID NO: 146445 - protein, 119 aa, Glycine max
  Coding DNA Sequence Number=SeqID_29667
  Gene Ontology: Mol. function=phospholipid binding
  Homolog annotation: Hit_ID=Q8LF20; Match level="QueryCoverage=52%, HitCoverage=9%, E-value=2e-09, Identity=49%"; Hit description =Putative clathrin assembly protein At2g25430
MCVVSEVGHVENPRGAEARGVHDLILEGGVGVEQEPVNEQEGFDGNDPIASLVEPLGYGDERSVEGIKSEEEDKAEIVKPHNGRPKRFSCPISLVSVPTSTRLTSLPRFPSFKKSTPSG

SEQ ID NO: 146446 - protein, 757 aa, Glycine max
  Coding DNA Sequence Number=SeqID_29668
  Gene Ontology: Mol. function=metal ion binding
  Pfam annotation: Domain name=PHD; Domain location=109-157; Score= -1.4; E_value=0.078; Accession=PF00628.19; Description=PHD-finger
  Pfam annotation: Domain name=VWA; Domain location=343-536; Score =49.6; E_value=1.1e-11; Accession=PF00092.18; Description=von Willebrand factor type A domain
  Pfam annotation: Domain name=VWA_CoxE; Domain location=288-515; Score= -91.0; E_value=0.069; Accession=PF05762.4; Description=VWA domain containing CoxE-like protei
  Pfam annotation: Domain name=zf-C3HC4; Domain location=110-154; Score= 34.9; E_value=2.7e-07; Accession=PF00097.15; Description=Zinc finger, C3HC4 type (RING finger)
  Pfam module annotation: Pfam domain module=PHD::VWA::VWA_CoxE::zf -C3HC4; Domain location=109-157::343-536::288-515::110-154
  Subcellular localization annotation: CTP_CleavageSite=51; ConfidenceScore=5.50e-01
MGTGWRRAFCTRDPASTISDKHPGSPSPSPRTCTRLGFLSGGSNPSTPRLRCTTKAETASQTVTLSDSPRVQSKNTPRATKSPSVSNPTSPRSPLKLSLFKNSFKFRSSCGICLNSVKTGQGTAIYTAECGHAFHFPCIAAHVRKHGSLVCPVCKATWKDVPLLAAHKNLAPESAAKDDVVAVQRVTESPYPNANDKKPTENNNASPVFKTYNNHVEQPSKHSDSTRSYDDDEPLLSPTSGGRIIPIPEADENAEDDEDEDPGEFQGFFVNPKNSSSSKSYSDSLQTSDGDSRTVQVKLMPECAVISASRTHETYALVLKVKAPPPPPPSRSSGGPSQRAPIDLVTVLDVGGSMIGAKLHMLKRAMRLVISSLGPADRLSIVAFSATSKRLLPLRRMTRQGQRVARRIVDRLMIGQGSSMGDALRKATRVLEDRRERNPVASVMLLSDGQEERVQNQRGNNNNNQRKASSHVSSTRFAHIEIPVHAFGFGAKSGYSQEPGEDAFAKCVGGLLSVVVQDLRIQVGFESESSVEISAIYSCSGRPTLMSSGAVRLGDLYAEEERELLVELRIPAWSGTGAHHHVMTVRCLYKDPATQEIVYGREQGLLVPPPQSVRCSGTRIQRLRNLFITTRAIAESRRLVEHSADFTSAHHLLASARVLLMQSNSASAEEYVRGLEAELAELHWRRQHEQMQIQQQQMMQQRRRGSEREVMALVDENGEPLTPTSAWRAAEKLAKMAMMKKSLNRVSDLHGFENARF

SEQ ID NO: 146447 - protein, 93 aa, Glycine max
  Coding DNA Sequence Number=SeqID_29669
MEDFQRERGGAVQKGRGNCQIELCNVDPPLSQTRFGACGVVSKKGAPNNIVGVSNNYVNGQNYSCLKNMNIFSRKRIFFRVFFRMQPKKNILL

SEQ ID NO: 146448 - protein, 388 aa, Glycine max
  Coding DNA Sequence Number=SeqID_29670
  Gene Ontology: Mol. function=protein disulfide oxidoreductase activity; Biological process=cell redox homeostasis
  Homolog annotation: Hit_ID=P0AC59; Match level="QueryCoverage=53%, HitCoverage=97%, E-value=4e-82, Identity=71%"; Hit description =Glutaredoxin-2
  Pfam annotation: Domain name=DUF1439; Domain location=235-388; Score =237.4; E_value=3.1e-68; Accession=PF07273.2; Description=Protein of unknown function (DUF1439)
  Pfam annotation: Domain name=GST_N; Domain location=14-84; Score =12.0; E_value=0.061; Accession=PF02798.10; Description=Glutathione S- transferase, N-terminal domain
  Pfam annotation: Domain name=Glutaredoxin2_C; Domain location=97-229; Score=230.1; E_value=4.8e-66; Accession=PF04399.3; Description =Glutaredoxin 2, C terminal domain
  Pfam module annotation: Pfam domain module=DUF1439::GST _N::Glutaredoxin2_C; Domain location=235-388::14-84::97-229
GDLRHPENHRRNGMKLYIYDHCPFCVKARMIFGLKNLPVELIVMLNDDEATPKKLIGQKMAPILQKADGSAMPESMDIVRFVDNQDRQPLLTGKQNPAIADWLRRVNGYINKLLLPRIAEAAFAEFATPEARDYFREKKQASLGDFAELRKHAPGFIKNISDDLRQLDKLIVKPNAVNGELSEDDIHLFPLLRSLTLVSGIEWPSRVADYRDNMAKQTQAGLRLFGRINQEEEMMKKAFPGLFALFFAVLLSGCNQLTQYTISEQEVNQALQKRNYYEKDIGVSGLVNAHIVLTDLSSQIGREEPGKVTLSGKANINVSSLFGPQQAEMQLKMKAQPVYNAQQGAIYLQDLEIVDAQVQPEKMASIMKTLTPYLNESLKRYFNEKPAY

SEQ ID NO: 146449 - protein, 127 aa, Glycine max
  Coding DNA Sequence Number=SeqID_29671
  Subcellular localization annotation: CTP_CleavageSite=18; ConfidenceScore=5.19e-01
MPVVTSSACLAAVKNHATASAIFCRKPGKALTTGGVLHMTTEKPEEAMTFGELLAFIAEQQRRLTVLENAFATLTFCLDDRASQLLAHNLTLEAQNQNHDAQLQQHFARLADEIHRRKGQLPAESQG

SEQ ID NO: 146450 - protein, 97 aa, Glycine max
  Coding DNA Sequence Number=SeqID_29672
  Subcellular localization annotation: CTP_CleavageSite=84; ConfidenceScore=5.57e-01
MNSLPSVVHASSTQESGAPRIYCLALFANSPFSTFIRSPVNSLPCAVHVSSTDESGAPRIYCVALFANSPFSTFIRSPMNLLPSAVHASSTNESGAP

SEQ ID NO: 146451 - protein, 178 aa, Glycine max
  Coding DNA Sequence Number=SeqID_29673
MAPKHMEQLTQKIRDQLEESITEKVTRQVLTLPPEPVDGRSATHVSTKENVVIWFCSLHNRLDFLKGIIIRSDIFFNTFTLALFGNINILIVQFTSMFVLNNALKGFDDTPQSKSKATARWIVVKCNRQKGSTACEYYVMHRMSTIILGSFKNNWKMTIETKEIGSASHPTDKLLFES

SEQ ID NO: 146452 - protein, 218 aa, Glycine max
  Coding DNA Sequence Number=SeqID_29674
  Gene Ontology: Mol. function=RNA-directed DNA polymerase activity; Cellular component=chromatin; Biological process=chromatin assembly or disassembly
MAENTRNQASLREMEERLSSKMESRFVELAASMQQTIHGMFQQRQQDSPTTSNPPRGERSSPYSCSTRLARLDFPRFNGEGIKQWLIQCETFFSVDNTPDEFKVRLTVFHFEGKALQWHSAYIKSVGLENLPSWNEYQILLLDRFGDVCEDPMVDLMKLRQTGSIIEYHEEFDSIISRVDLSDEHQLSCFLGGLKQEVQMIVRMFHPNYVRRAYSLAN

SEQ ID NO: 146453 - protein, 153 aa, Glycine max
  Coding DNA Sequence Number=SeqID_29675
  Homolog annotation: Hit_ID=Q6CQF3; Match level="QueryCoverage=36%, HitCoverage=59%, E-value=2e-08, Identity=72%"; Hit description =Kluyveromyces lactis strain NRRL Y-1140 chromosome D of strain NRRL Y- 1140 of Kluyveromyces lactis
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 146454 - protein, 113 aa, Glycine max
  Coding DNA Sequence Number=SeqID_29676
MRTCFSKETKLPTDQSNICFLDEKQCVYRGRKHFVSKRPFRGNTGSNKDRRESLKVYQSHTGLTFSPWVKVYDKLEFWLKACRTVGHDICQGLTSGSGIKGMSYIISMIHMQQ

SEQ ID NO: 146455 - protein, 113 aa, Glycine max
  Coding DNA Sequence Number=SeqID_29677
  Homolog annotation: Hit_ID=P09363; Match level="QueryCoverage=58%, HitCoverage=46%, E-value=1e-31, Identity=100%"; Hit description =Hypothetical 16.8 kDa protein
MTSKELNEEPYEVKISCTFRKGTGAGYHETKDFLSKEIRFGTTICPRISNPSRKRGGTDTQFQVSKQNSILDIIDTYRILWKAVFDESRMYGLEGDLSYLSRSTLQYGAKKPK

SEQ ID NO: 146456 - protein, 112 aa, Glycine max
  Coding DNA Sequence Number=SeqID_29678
LYQLTQVPREFDTRFLPFYTTCAIRCTCRKRTVTCICELLPIVNFIQILFVAPLELVGLGSTSSMDSFASWKMNGSGIEKEGREETPLQGEDESRRSSPPYEVMDKSFGGRR

SEQ ID NO: 146457 - protein, 100 aa, Glycine max
  Coding DNA Sequence Number=SeqID_29679
MRLVWNRQARTKRKLQVTRRGIRGDLFIDVGNALSCACYVCSWGALCIDLSGSLALAFGHVHTLDVVYDRGGALCTDLPGSLALAFGHDHTSYEVYVMGG

SEQ ID NO: 146458 - protein, 310 aa, Glycine max
  Coding DNA Sequence Number=SeqID_29680
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q2QXS1; Match level="QueryCoverage=92%, HitCoverage=80%, E-value=3e-67, Identity=42%"; Hit description =Expressed protein
  Pfam annotation: Domain name=DUF231; Domain location=142-295; Score =70.1; E_value=7e-18; Accession=PF03005.6; Description=Arabidopsis proteins of unknown function
MSLPIIHTNRHSSKHAIIPEAAGCGMKPTIVNCMMKTAPFWIPDSGVAKTDGKMKGFVNGDGNLMAVTFPVLFKSHEYLIATYLDCIVINQWESLLCMLTQGVSNLSKIYEVNGNPISKHNGFLVMRFQEYNMTVEYYRTPFLCVIGRPPLNSSSNVRSTIRLDELHWYFNKWVAADVLVFNSGHWWNPDKTIKSNGTWNDGGECDMQTEPENDPTKLEIEPYYNIFVSGVVKQTQYERRKAHFLNITYLSELRKDGHPSKYREPGTPPDAPQDCSHWCLPGVPDTWNELLYAQLLSEKFGINKIFPERG

SEQ ID NO: 146459 - protein, 102 aa, Glycine max
  Coding DNA Sequence Number=SeqID_29681
MSAIAGRMDMLLKIVGKRMAIQVIFHRIEEEEVELFMVMVEAGILTEAVKCAITVVSLATLRQSASRNKDIHQDIVCTRHPMLISMTQLQNQRIMRIQQQQL

SEQ ID NO: 146460 - protein, 94 aa, Glycine max
  Coding DNA Sequence Number=SeqID_29682
  Subcellular localization annotation: CTP_CleavageSite=54; ConfidenceScore=5.04e-01
MEHQFKFTREKSLRITQQAPNSLSFGKRKTMKTRISESETGSVALTGQRAKPISAEAREEEKKRSGRVYTEIEVDLTKIPGPVHNPKACGHFGV

SEQ ID NO: 146461 - protein, 136 aa, Glycine max
  Coding DNA Sequence Number=SeqID_29683
MSSVEYNRANPLPFIYLIGGSILYYPQLSSISSYQLYVEVVCEELDWLPFYPGITSVTKQSHMHRSKQEGPPNAEAVRQAFDVCSHWMQSFIKYSTWLESPSNVKAAEFLSTGHKKLMECMEELGMIRHQNHKFLE

SEQ ID NO: 146462 - protein, 269 aa, Glycine max
  Coding DNA Sequence Number=SeqID_29684
  Gene Ontology: Mol. function=RNA-directed DNA polymerase activity; Cellular component=chromatin; Biological process=chromatin assembly or disassembly
MADSTRSKTTLDRLEEALAKLTSSHLHITGKLDDLLNRVAVLENTPHHTPSPSSSSTNPAIQTHPIQPHRLKLDVPRFDGTDPSGWVFKISQFFEYHSIPDSERLTIASFYMDGPALAWFQWMARNHQLPTWTGFLQAIEARFAQSPYEDPTGQLFKLTQKGSVSDYLTQFEALANRITGLSPSSLLSCFISRLDPAIRREVQALQPLTMVHAAGLARLQEEKFQDFSHPTCIRPSFPSSPPTLLSLSTPSPPSPLPLLPSPAKPPPLP

SEQ ID NO: 146463 - protein, 193 aa, Glycine max
  Coding DNA Sequence Number=SeqID_29685
  Homolog annotation: Hit_ID=Q2HW42; Match level="QueryCoverage=20%, HitCoverage=4%, E-value=1e-12, Identity=92%"; Hit description =Phospholipase D/Transphosphatidylase; Pleckstrin-like
MEVILGNVTSYFDSAKQLVNGIPLPLDLGSNIDDVKVKVTTVADSLSKKAKENSRMIHKVIDGVRLALVTVAAVMIFVAFLGLSFSLLALPCPVYSLVVIGWILVTGTLLLCAAFLFVPKFISREPLVSIADLTLFIYEELAVNVHYMECFGSFAPIRGLTEDGSQAQWFVDGQATFEAIATSIQDAKSIVHQ

SEQ ID NO: 146464 - protein, 207 aa, Glycine max
  Coding DNA Sequence Number=SeqID_29686
  Homolog annotation: Hit_ID=Q67X40; Match level="QueryCoverage=69%, HitCoverage=74%, E-value=3e-23, Identity=43%"; Hit description =Integral membrane family protein-like
  Pfam annotation: Domain name=DUF588; Domain location=36-192; Score =188.6; E_value=1.5e-53; Accession=PF04535.3; Description=Domain of unknown function (DUF588)
MSTTIDVPAESSKINSIANGIRKVPGAPPRPEGGWKKGVAILDFILRLGAIASALGAAATMATSDETLPFFTQFFQFEASYDSFSTFQFFVIAMAFVGGYLVLSLPFSIVTIIRPHAAGPRLFLIILDTYSYGIQKVFLTLATSSAAAATAIVYLAHNGNQDSNWLAICNQFGDFCQEISGAVVASFVAVVLFVLLIVMCAVALRNH

SEQ ID NO: 146465 - protein, 106 aa, Glycine max
  Coding DNA Sequence Number=SeqID_29687
MIVKADQKQARQCCAESLKVAPYPPTREPVKPHPTTDDTTQVMSVDKVSNLHDDTYDRGPKPIEELVKLQLRPKPEQCTQLNKDLTNHEHRCIADVLHRNVDLFAW

SEQ ID NO: 146466 - protein, 94 aa, Glycine max
  Coding DNA Sequence Number=SeqID_29688
MTVGRMKCGCGRAHSHSGFEVNFVIGEGLQPMSVNREGTILSNDWDDHANLRALHFTSIADEDPQCGSIRPAKRSVSGTVWPANAWRLIWAWGG

SEQ ID NO: 146467 - protein, 419 aa, Glycine max
  Coding DNA Sequence Number=SeqID_29689
  Gene Ontology: Mol. function=RNA-directed DNA polymerase activity; Cellular component=chromatin; Biological process=chromatin assembly or disassembly
  Pfam annotation: Domain name=zf-H2C2; Domain location=307-348; Score =5.8; E_value=0.061; Accession=PF09337.1; Description=His(2)-Cys(2) zinc finger
MTTMLRQGIIHPSTSPFSSPVLLVKKSDAVPGAFAWTTLDPLQGYHQILMAPEDISKTAFRTHHGHYEFVVEYLGHLVSAKGVEPVPKKVIAVQQWPTLNSTRTMRGLLGLSGFYRRFIKGYATLAAPLTALLAKDKFNWNPDADRAFHLLKDALCQAPVLRLPDFNYEFVIETDASGIDHRSLKELMAQAVQTPEQQVYLARLMGFDYTIQYRAGKANGAADALSRLPEPPSGQLYVLTIPNCLFLQELNAELTSNQEFIDRRQQILDEPNQFQEWVVRDTWLLHRGRSWLPPRLKLIPTIIAEFHSTPTGGHMGVMKTLARIRENFVWPSMKRGIHQFVTSCATCLHLGSLPQHHTAAGVAQLFMEISGKLHGMPKSLVSDRDPLCVSHFWQESFKLSGTKLRMSSAYHPESDGQTE

SEQ ID NO: 146468 - protein, 117 aa, Glycine max
  Coding DNA Sequence Number=SeqID_29690
MAKIPFNLFANFLPLILVEEMFRGHLQKNFLPQLTEDGSSVDARRTFLPRVSAEEELRKNHLPWNNAKELLPPESTEEEMTNKAKGKGKEVAGKGAIDKRKVAFGIDKPGGGQKRNK

SEQ ID NO: 146469 - protein, 125 aa, Glycine max
  Coding DNA Sequence Number=SeqID_29691
  Homolog annotation: Hit_ID=Q1SJP8; Match level="QueryCoverage=54%, HitCoverage=3%, E-value=3e-10, Identity=49%"; Hit description=D -galactoside/L-rhamnose binding SUEL lectin; Integrase, catalytic region; ...
  Homolog annotation: Hit description=Galactose-binding like; Peptidase aspartic, catalytic
MGTVFVVKKYSKKGICKCTHYNGDNRVMETCFKLHGYPNWHPKGKTTSNTKVDATSKSHISTAARFVTKSRVTIHSKEKIGSGRESEGLYYLENVSQQTHKGALACLANEHIQDKNKKGIWLWNR

SEQ ID NO: 146470 - protein, 199 aa, Glycine max
  Coding DNA Sequence Number=SeqID_29692
  Gene Ontology: Mol. function=RNA-directed DNA polymerase activity; Biological process=RNA-dependent DNA replication
MHSVAWSKFCKPKLRGGMGFRYLRLFNKSLIMKLGWGLISSPNSLGVKVFRDNYGRNQGFILDVKKTSNCYDVWKGIQGVWNNVLKGGWWILRNGRTILFWKHHWLKSGMVLLLTCPSPPPLSMLNFTANIMVDNSGNWKMKHGYGRFFGKVWLLIFIDGRETWCIEKRDRWLGFLLHACVILDQPMYQLLNYGEFYRP

SEQ ID NO: 146471 - protein, 284 aa, Glycine max
  Coding DNA Sequence Number=SeqID_29693
  Gene Ontology: Mol. function=RNA-directed DNA polymerase activity; Cellular component=chromatin; Biological process=chromatin assembly or disassembly
  Pfam annotation: Domain name=Chromo; Domain location=195-246; Score =18.9; E_value=0.0058; Accession=PF00385.14; Description='chromo' (CHRromatin Organisation MOdifier
MNRIVEQYLRAFVHHQPSTWGRLLTWAEWSYNTSVHSATGMSPYEITFGKKPPCFPQYIEGTSKIKAIDEWFTQRDRMIGSLVKKLTKAQQRMKEVADRRRREVQYAEGDQVLVRLRPHRQTSASGTAHSKLAKRFYGPFQIIKRIGSVAYQLQLPPDSRIHPVFHCSLLKPYIPSNDSVPLFLPPKFIDNQPCVSPLAILDTKWEETASGKQLMVLVQWAGLFPKDTSWELWGTLKQDNNLEDKVFLEACKDDMNKETGHNAEITKGKRRSIKPKYLEDYVAK

SEQ ID NO: 146472 - protein, 171 aa, Glycine max
  Coding DNA Sequence Number=SeqID_29694
  Subcellular localization annotation: CTP_CleavageSite=66; ConfidenceScore=5.21e-01
MQKSEMLHHFDNLHRPIMCFSSRVSLADDISGHCSVASTTSSASGLRFLRSKCSRSEFELNETNPCAGRKSSSCAGTVTSGNGRLSLNSFDNSLGSKFGIVVGGSSITSGSSLPVTSWASVVSFLLSFPDPSKTLYPQEPFDNDENGVDSEEEGLVELHVPDLGGKHDEKG

SEQ ID NO: 146473 - protein, 182 aa, Glycine max
  Coding DNA Sequence Number=SeqID_29695
MVWEGSFFATCELGLWCRAWPLKVADASKGVFRKEGESVVYVNGIKHTHKVTDFDKWCFFEAVGVVKGNLRTYGEESPNSIGEYKALKVNEDQEPIRNGDGSEEDHDSDEASDVYFGGSEEERALGLDDDFGDVVHPVYIVMDEEHDPTFAVEMEQDYESEELDSFDGSDIEEERGNMSFQD

SEQ ID NO: 146474 - protein, 101 aa, Glycine max
  Coding DNA Sequence Number=SeqID_29696
  Gene Ontology: Mol. function=protein binding
  Homolog annotation: Hit_ID=Q1SWI7; Match level="QueryCoverage=72%, HitCoverage=18%, E-value=9e-18, Identity=64%"; Hit description =Leucine-rich repeat
  Pfam annotation: Domain name=LRR_1; Domain location=48-70; Score=7.9; E_value=9.6; Accession=PF00560.23; Description=Leucine Rich Repeat
  Pfam annotation: Domain name=LRR_1; Domain location=72-93; Score=9.2; E_value=5.3; Accession=PF00560.23; Description=Leucine Rich Repeat
  Pfam module annotation: Pfam domain module=LRR_1::LRR_1; Domain location=48-70::72-93
MTLVNRSPYPQIYSHAPNNTEYSSVSGIVSVLLWLKGRGDEYGNILGLVTSIDLSSNKLLGEIPREITDLNGLYFLNLSHNQLIGPIPEGKNSNRNSIANL

SEQ ID NO: 146475 - protein, 195 aa, Glycine max
  Coding DNA Sequence Number=SeqID_29697
MMITKDDDKGDDKKLKDQSKNNSSDSKSIKEQLKGYIYLGLTENKRGYISCGLVLAEGTSTRFKENKGGYIPCGSLLTYQGNPCGVYPDLSSFTGSGVIQNSVDCIKRFAPSQGLVGIVGSVSEKYWDHHLGDISLATMAGVKIFITIIIESLSMSLIVLTRCQVFKRKIRGSRSGVRVWSGCGRCERMGKKAWV

SEQ ID NO: 146476 - protein, 119 aa, Glycine max
  Coding DNA Sequence Number=SeqID_29698
  Subcellular localization annotation: CTP_CleavageSite=25; ConfidenceScore=5.05e-01
MSPLLLIFVFSPSLPKTLFFSRRQSNMSKKNDHLGLIHRWIVAKLKNWVKSSILRHFTVGNYEKISGMREYTSYCSLFFLVETQNCIEKSEEKIKEYQEIARDAAIAVGRHVSPLRGKG

SEQ ID NO: 146477 - protein, 75 aa, Glycine max
  Coding DNA Sequence Number=SeqID_29699
  Pfam annotation: Domain name=DUF588; Domain location=1-60; Score= -15.2; E_value=0.047; Accession=PF04535.3; Description=Domain of unknown function (DUF588)
  Subcellular localization annotation: CTP_CleavageSite=48; ConfidenceScore=5.16e-01
MTLQVFLTLATASGASAAAIVYLAHNGNQDSNWLAICNQFGDFCAQTSSAVVSSFVAVVVLVLLVVMSALSLGKR

SEQ ID NO: 146478 - protein, 155 aa, Glycine max
  Coding DNA Sequence Number=SeqID_29700
  Pfam annotation: Domain name=DUF588; Domain location=31-140; Score =112.4; E_value=1.3e-30; Accession=PF04535.3; Description=Domain of unknown function (DUF588)
MSTTIEIPESSKVAKGKAVAVVAPARPGGWKKGVAIMDFILRLGAIAAALGAAATMGTSDQTLPFFTQFFQFEASYDSFTTFQYAFLTLATAGGASAAAIVYLAHNGDQDTNWLAICNQFGDFCAQTSAAVVSSFVAVVVLVLLIIMSALAIGKP

SEQ ID NO: 146479 - protein, 82 aa, Glycine max
  Coding DNA Sequence Number=SeqID_29701
MTEESDRALISRLRAKCEISALNTVGVFSQAQRTTGEFGYTFTQLYTHLRQGQGTEFHNSHSAHFGKRGLEAAKRSNFCRDI

SEQ ID NO: 146480 - protein, 130 aa, Glycine max
  Coding DNA Sequence Number=SeqID_29702
  Homolog annotation: Hit_ID=Q67X40; Match level="QueryCoverage=75%, HitCoverage=53%, E-value=1e-09, Identity=36%"; Hit description =Integral membrane family protein-like
  Pfam annotation: Domain name=DUF588; Domain location=30-129; Score =63.2; E_value=8.5e-16; Accession=PF04535.3; Description=Domain of unknown function (DUF588)
MSTTIDVPESSNVAKGKAVLAAPPRPGGWKKGVAIMDFILRLGAIAAALGAAATMGTSDQTLPFFTQFFQFEASYDSFTSFQFFVITMALVGGYLVLSLPFSFVAIIRPHAAGPRLFLIILDTVSSFTLN

SEQ ID NO: 146481 - protein, 404 aa, Glycine max
  Coding DNA Sequence Number=SeqID_29703
  Gene Ontology: Mol. function=binding; Cellular component=membrane; Biological process=multicellular organismal development
  Homolog annotation: Hit_ID=Q96301; Match level="QueryCoverage=93%, HitCoverage=34%, E-value=1e-125, Identity=60%"; Hit description =Probable UDP-N-acetylglucosamine--peptide N- acetylglucosaminyltransf erase SPINDLY
MVTWIGYPNTTGLPTIDYRITDSQADPPETKQKHVEELVRLPDCFLCYTPSPEAGPVCPTPALSNGFVTFGSFNNLAKITPKVLQVWAKILCAIPNSRLVVKCKPFCCDSVRQRFLSTLEKLGLEPLRVDLLPLILLNHDHMQAYSLMDISLSYAHDNLSFLSFVLSLDTFPYAGTTTTCESLYMGVPCVTMAGSVHAHNVGVSLLSKVEFNDPKHRGMKTWVPNWLILKQLYMFEINIAIWMSIKESYVQLGGWLQLASLGNLIAKNEDEYVKLAVKLASDISALQNLRMSLRELMSKSPLCNGAKFTLGLESTYRKMWRRYCKGDVPALKRMELLQQPVSSNDPSNKNSEPTRATNSSEGSPGSVKANGFSSTQPPKLNFVNCEENGGSLNHSSKQGMVGSS

SEQ ID NO: 146482 - protein, 147 aa, Glycine max
  Coding DNA Sequence Number=SeqID_29704
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=93%, HitCoverage=30%, E-value=4e-71, Identity=50%"; Hit description =Probable UDP-N-acetylglucosamine--peptide N- acetylglucosaminyltransf erase SPINDLY
  Pfam annotation: Domain name=TPR_1; Domain location=100-133; Score =45.1; E_value=2.3e-10; Accession=PF00515.18; Description =Tetratricopeptide repeat
  Pfam annotation: Domain name=TPR_1; Domain location=2-31; Score=11.2; E_value=0.25; Accession=PF00515.18; Description=Tetratricopeptide repeat
  Pfam annotation: Domain name=TPR_1; Domain location=32-65; Score =42.8; E_value=1.2e-09; Accession=PF00515.18; Description =Tetratricopeptide repeat
  Pfam annotation: Domain name=TPR_1; Domain location=66-99; Score =26.9; E_value=7.2e-05; Accession=PF00515.18; Description =Tetratricopeptide repeat
  Pfam annotation: Domain name=TPR_2; Domain location=1-31; Score=1.9; E_value=20; Accession=PF07719.7; Description=Tetratricopeptide repeat
  Pfam annotation: Domain name=TPR_2; Domain location=100-133; Score =40.0; E_value=8.1e-09; Accession=PF07719.7; Description =Tetratricopeptide repeat
  Pfam annotation: Domain name=TPR_2; Domain location=32-65; Score =32.3; E_value=1.7e-06; Accession=PF07719.7; Description =Tetratricopeptide repeat
  Pfam annotation: Domain name=TPR_2; Domain location=66-99; Score =17.9; E_value=0.038; Accession=PF07719.7; Description=Tetratricopepti de repeat
  Pfam module annotation: Pfam domain module=TPR_1::TPR_1::TPR_1::TPR _1::TPR_2::TPR_2::TPR_2::TPR_2; Domain location=100-133::2-31::32 -65::66-99::1-31::100-133::32-65::66-99
MYNLGVAYGEMLKFDMAIVFYELAFHFNPHCAEACNNLGVIYKDRDNLDKAVECYQLALGIKPNFSQSLNNLGVVYTVQGKMDAAASMIEKAIIANPTYAEAYNNLGVLYRDAGDIALAINAYEQCLKIDPDSRNAGQLKVFIAGAM

SEQ ID NO: 146483 - protein, 68 aa, Glycine max
  Coding DNA Sequence Number=SeqID_29705
MGWNSGNDEGGEIMAMEWWWRQRCSQCDGGVVMVEAAKATCDSDGEMMEVIMVEVTVTVWCWWLECGF

SEQ ID NO: 146484 - protein, 290 aa, Glycine max
  Coding DNA Sequence Number=SeqID_29706
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=80%, HitCoverage=44%, E-value=1e-109, Identity=49%"; Hit description =Probable UDP-N-acetylglucosamine--peptide N- acetylglucosaminyltransf erase SPINDLY
  Pfam annotation: Domain name=TPR_1; Domain location=114-147; Score =32.9; E_value=1.1e-06; Accession=PF00515.18; Description =Tetratricopeptide repeat
  Pfam annotation: Domain name=TPR_1; Domain location=155-188; Score =8.4; E_value=0.53; Accession=PF00515.18; Description=Tetratricopeptid e repeat
  Pfam annotation: Domain name=TPR_1; Domain location=189-222; Score =37.5; E_value=4.5e-08; Accession=PF00515.18; Description =Tetratricopeptide repeat
  Pfam annotation: Domain name=TPR_1; Domain location=223-256; Score =47.9; E_value=3.3e-11; Accession=PF00515.18; Description =Tetratricopeptide repeat
  Pfam annotation: Domain name=TPR_1; Domain location=48-79; Score=0.5; E_value=4.6; Accession=PF00515.18; Description=Tetratricopeptide repeat
  Pfam annotation: Domain name=TPR_1; Domain location=80-113; Score =22.0; E_value=0.0021; Accession=PF00515.18; Description =Tetratricopeptide repeat
  Pfam annotation: Domain name=TPR_2; Domain location=114-147; Score =24.8; E_value=0.00031; Accession=PF07719.7; Description =Tetratricopeptide repeat
  Pfam annotation: Domain name=TPR_2; Domain location=155-188; Score =6.2; E_value=6.2; Accession=PF07719.7; Description=Tetratricopeptide repeat
  Pfam annotation: Domain name=TPR_2; Domain location=189-222; Score =22.8; E_value=0.0012; Accession=PF07719.7; Description =Tetratricopeptide repeat
  Pfam annotation: Domain name=TPR_2; Domain location=223-256; Score =37.1; E_value=5.9e-08; Accession=PF07719.7; Description =Tetratricopeptide repeat
  Pfam annotation: Domain name=TPR_2; Domain location=46-79; Score=5.1; E_value=8.4; Accession=PF07719.7; Description=Tetratricopeptide repeat
  Pfam annotation: Domain name=TPR_2; Domain location=80-113; Score =19.0; E_value=0.018; Accession=PF07719.7; Description=Tetratricopepti de repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=114-147::155-188::189-222::223-256::48-79::80-113::114 -147::155-188::189-222:...
  Pfam module annotation: Domain location=:223-256::46-79::80-113
MAWTEDSDGNNGREKLVGENGFLKVSEPSSDGSVGDGGSVSKRCEGKDDVSYANILRSRNKFVDALALYERVLESDGGNVEALIGKGICLQMQNMGRLAFESFAEAIRLDPQNACALTHCGILYKDEGRLVEAAESYQKALQVDPSYKAAAECLAIVLTDIGTNIKLAGNTQEGIQKYFEALKIDPHYAPAYYNLGVVYSEMMQYDMALTFYEKAASERPMYAEAYCNMGVIYKNRGDLEAAITCYERCLAVSPNFEIAKNNMAIALTDLGTKVMHMPSYIFPIVFEQLY

SEQ ID NO: 146485 - protein, 430 aa, Glycine max
  Coding DNA Sequence Number=SeqID_29707
MEMGLSHEEGLSNKDEKAGALMGANYEGKIGRWDIQSFNSFATKSYAGIKRGSFFSNQRIGHQFSASQRAFIQYQNSQVEPEFLSFQSEPIQPGNTANLRYYFNSTEALGLGYQFSLKKWNFLLSPKVENQKTANFYTSQELFSYKLEANISTTLGAHGFNLTAEYSYSKENNKQDWFNSLKTTLSYRYKSFSLNGTAQWNATSVFDLTSYYNADRNFANYNVYASYNFQMLNHNLTGSFSAGAFYSELYKNLNSNITGNLEYKISPSWSTTGYFNLSGYKSTAEYASSGSYYQFRVGIKKYFTTATALGNHKVAFQFFEDKNYNGLLESGESVLANEIVKLDNYVAMTDKNGKVVFQNVPEGTYTLKVNESAGSRLMTDPVIMVHNNINRKVGLVKNIRVTGKLTEIKQAYDTVETDVTGIVVYAKGED

SEQ ID NO: 146486 - protein, 431 aa, Glycine max
  Coding DNA Sequence Number=SeqID_29708
  Gene Ontology: Mol. function=nucleic acid binding; Cellular component= chromatin; Biological process=DNA integration
  Homolog annotation: Hit_ID=Q1T010; Match level="QueryCoverage=100%, HitCoverage=33%, E-value=1e-100, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=106-269; Score =158.7; E_value=1.5e-44; Accession=PF00665.16; Description=Integrase core domain
MEDKKLKLFDSGGKNGLIFDVSMSRNRTFRANLEALCHKCLAAVVSEDDWVWHHRYGHLNFRDLHDLNTHNMVRGLPLINVPKELCKNCVESKHHKESFKKFVETKAREKLEVIYSDVCGPMQCESLGESRYFVSFLDDFTRKMWVYILKRKSEVLGVFKKFKRMVERQTGFLIKTIITDGRGEYTSNEFDEFYELEGIVHDVAPPYTPQHNGAAERRNRTMVNMVRCMLNGKKLPKFLWAKAISTAVYVLNRSPTKSLNKTTPEKAWSGRKPVLRKKLDSKSEIMILLGYHATSDYKLFNPVTKEVLVSRGVIVDESKECNWDKEMVEEPTKVMIEASIDEPSDSSVVVIDDSDQGGVRKSQRARQVSSRLQDYELIHDSAIGEEGELVHLALFAESESMSLKEAMNDTKWIDAMKEELKAIEKNNTWQL

SEQ ID NO: 146487 - protein, 110 aa, Glycine max
  Coding DNA Sequence Number=SeqID_29709
  Homolog annotation: Hit_ID=Q9FKF4; Match level="QueryCoverage=48%, HitCoverage=17%, E-value=4e-14, Identity=71%"; Hit description =Arabidopsis thaliana genomic DNA, chromosome 5, TAC clone:K11J9
  Subcellular localization annotation: CTP_CleavageSite=56; ConfidenceScore=5.92e-01
MTTFSFFSHFLSSTIPPSPSPSSKNSIFYALFKGNTKQFTFSKATNLLQLQPRITVFSSLKDAGSSDNTPSNFCIIEGPETIEDFVQMQLQEIQDNIKSRRNKIFLLMEE

SEQ ID NO: 146488 - protein, 264 aa, Glycine max
  Coding DNA Sequence Number=SeqID_29710
  Gene Ontology: Mol. function=phosphoinositide binding; Cellular component=multivesicular body; Biological process=cell communication
  Homolog annotation: Hit_ID=Q9FG38; Match level="QueryCoverage=98%, HitCoverage=63%, E-value=8e-98, Identity=73%"; Hit description =Sorting nexin-like protein
  Pfam annotation: Domain name=Vps5; Domain location=19-257; Score =23.9; E_value=4.9e-09; Accession=PF09325.1; Description=Vps5 C terminal like
MERLRSHETGIFKKKPADLMQIFKDVQSKVSDVVLGKEKPVEESNPEYEKMKHYIFELENHLAEAQKHAYRLVKRHRELGQSLSDFGKAVKLLGASEGNALGKAFSELGMKSEILSAKLQKEAHQLLMNFEEPLKDYVRAVQSIKATIAERANAFRRQCELAETMKLKEINLYTPGSLFLLFAKFNFSVRIIPFHLKAESEQATKTFEMIVKLMNEEMGRFQEQKTLDMGIAFHEFAKGQARLANGIADAWRSLLPKLEACSTS

SEQ ID NO: 146489 - protein, 122 aa, Glycine max
  Coding DNA Sequence Number=SeqID_29711
  Subcellular localization annotation: CTP_CleavageSite=58; ConfidenceScore=5.63e-01
MVMMASSSSTMQSVYPRVSGANFHVPLSPHSLVPVYSNSHSFSKLRNSIHLAAAPLPKASAGNGGLTDDGVSLGTMKLPLDTDLQRFDSLLFQWANSLCQGANLPLPVPLKVCVCSLSQGEA

SEQ ID NO: 146490 - protein, 718 aa, Glycine max
  Coding DNA Sequence Number=SeqID_29712
  Gene Ontology: Mol. function=nucleic acid binding; Cellular component= intracellular; Biological process=DNA integration
  Homolog annotation: Hit_ID=Q1RXN8; Match level="QueryCoverage=99%, HitCoverage=77%, E-value=1e-160, Identity=49%"; Hit description =Peptidase S8 and S53, subtilisin, kexin, sedolisin; Integrase, catalytic region; Zinc finger, CCHC-type
MCPIKDFFETLELKEGGVVLLRNNKSYRVHDMGTVRLKMFDDQEMLLQDVKYVLELKRNLLSISMFDNLGYSTKIEHGLIKISNGALIVAEGVKRKGHISERGLVELEKQNLLSGDKLDKLEFCEHCILEQFNEFCRKQEIKRHKTVAGTPQQNGLAERMNKTILKRVGCMLLESDKLEARPVKCIFIGYANGVKGYKLWKLDPRDSRCFISRDVTFDETGMRMSVAEEIQDSEPRNFKEAIEGKESQYWLQVMNEEMQSFVNLPKNQRVVGCKWVFKILMTIVNQYDLELQQLDVKTTFLHGDSRRPSICCMQQPKGFAEDQTKVCLLKKSLYGLKQSLCQLYKKFNDFLLRIGFLRSSYDSCVDILRREEQCIIFLLLYVDYILIASSNKDEISMLKERLSSEFEMKDLGTTRRIKKNFVPHCPEALRYAKAVSGFEPMTNKSPRHNFTAAPGLALTTRRILGMNIVRDQMKGELFLSQQGYLKKIVKRFRMHQSKPVSTPLGHHTKLSITQAPNTEEERRKMDIIPNASGVGSIMYCMVCSRLDLAHVVSIVCEWISGISGLKYKKAAQDGDAIMGYVDADYVGNVDIGKPLSGYVFTMFGTAICWKANLQPVVALSTTKSKYIALAKGVKEALWLKGMIGELGIVQNCVTIHYDSQSVIHLANHHIYHERTKHIDVRLHFIRDVVESEDNPTDVFTKSLPRSKFKHCLDLINFS

SEQ ID NO: 146491 - protein, 114 aa, Glycine max
  Coding DNA Sequence Number=SeqID_29713
MADLEQRSCAQDLVLQRSCNKDNVEISGVGEWNQLTNNQPLGTTKKQWKIKKKKQERRSREEEVAGRGGGGRSRLWQRERKKKKATTTRKEATVEEEERKKQHMRREGEGGSVK

SEQ ID NO: 146492 - protein, 203 aa, Glycine max
  Coding DNA Sequence Number=SeqID_29714
  Gene Ontology: Mol. function=unfolded protein binding; Cellular component=cytosol; Biological process=protein folding
  Homolog annotation: Hit_ID=P55737; Match level="QueryCoverage=99%, HitCoverage=30%, E-value=9e-78, Identity=71%"; Hit description=Heat shock protein 81-2
  Pfam annotation: Domain name=HSP90; Domain location=34-203; Score= -109.6; E_value=3.3e-11; Accession=PF00183.9; Description=Hsp90 protein
SDAGGSFTVTRDNTGEVLGRGTKITLYLKEDQLEYLEERRLKDLIKKHSEFISYPIFLWIEKTTEKEISDDEEGKVEDVDEEKEKEEKKKKKIKEVSHECSLVNKHKPIWMRKHEEITKEEYSAFYKSLTNDWEEHLAVKPFSGEGQLEFKAIVFVPKRAPFDLFDTRKKPNNIKLYVRRVFMMDNCEELIPEYLGFVKCFVK

SEQ ID NO: 146493 - protein, 154 aa, Glycine max
  Coding DNA Sequence Number=SeqID_29715
MDDILRRLMTVIVSDIVKSNDDINDVYDGHGDNTVVNFVGFYDGLVQMPVLDFAAFYGGLVPMIVVDFFAFYEYLVPMTVVDYVAFYDGLVPMTVVDYVAFYDGMLLFGKEPSTWLADSSEVEVVELKTCPPMIFEVPTCRGSSVGITGKLDLL

SEQ ID NO: 146494 - protein, 83 aa, Glycine max
  Coding DNA Sequence Number=SeqID_29716
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=98%, HitCoverage=14%, E-value=2e-32, Identity=83%"; Hit description =Putative chaperonin containing TCP1, subunit 3
MEEEYIEELCMQILKFKPDLVITEKGLSEFAWHFLSNHGLTAIRRLRKTDNNRIAKACGAVIVNKADELQESDVGTGAGLFEV

SEQ ID NO: 146495 - protein, 84 aa, Glycine max
  Coding DNA Sequence Number=SeqID_29717
  Homolog annotation: Hit_ID=Q69S84; Match level="QueryCoverage=88%, HitCoverage=18%, E-value=4e-19, Identity=51%"; Hit description=Kelch repeat-containing F-box-like protein
  Pfam annotation: Domain name=Kelch_1; Domain location=2-47; Score =41.2; E_value=3.5e-09; Accession=PF01344.15; Description=Kelch motif
  Pfam annotation: Domain name=Kelch_2; Domain location=2-47; Score =20.8; E_value=0.005; Accession=PF07646.5; Description=Kelch motif
  Pfam module annotation: Pfam domain module=Kelch_1::Kelch_2; Domain location=2-47::2-47
MPFCGCSIGVVDGCIYALEGFSRSSTIKYVWQYDPIKNSWAEASPMSVGRAYCKTGVTRGRGGLIPLQSAEVYDPPYMHVVPVT

SEQ ID NO: 146496 - protein, 53 aa, Glycine max
  Coding DNA Sequence Number=SeqID_29718
MEDRIATDRLLPLPGDSSGQTLTHKEGGDMVNVPLKRKWQVSSPGRATPAPKL

SEQ ID NO: 146497 - protein, 348 aa, Glycine max
  Coding DNA Sequence Number=SeqID_29719
  Gene Ontology: Mol. function=oxidoreductase activity; Cellular component=cytosol; Biological process=regulation of transcription, DNA-dependent
  Homolog annotation: Hit_ID=Q1M760; Match level="QueryCoverage=81%, HitCoverage=97%, E-value=1e-105, Identity=68%"; Hit description =Putative aldo-keto reductase
  Subcellular localization annotation: CTP_CleavageSite=24; ConfidenceScore=5.20e-01
FSIFIGRRVRNGGQRPSAPASGCRAVRQPGPDTASRSSHTDAVKLGHRLRRQHQVRRGGVLPQVFDRRGARDQQDVGRALQQPGQRGLHRRGLALGGHALQRGRLQRREATQREERHIGDAVLRQLPDQRIVGAVRDVVLVLHADDVGDAARLRHLARGGVAQAQVAYQALALQFGEGGEGRFDVAFGGAGHVEHEAQVDHVQHVQAQVAQVVVHGRFEFGGGIGQQPRGIVAPARADLGDDDQIVAVGVQRFADQLVGDVRAVEVAGVDVVDAEFERFAQDRQGLRLVLGRSEHVGAGQLHGAVAQAVDGQVAQRIGAGLLNRGHDLLRGRGNEASLGRRAACDNPW

SEQ ID NO: 146498 - protein, 612 aa, Glycine max
  Coding DNA Sequence Number=SeqID_29720
  Gene Ontology: Mol. function=signal transducer activity; Cellular component=membrane; Biological process=response to light stimulus
  Homolog annotation: Hit_ID=Q9FKB6; Match level="QueryCoverage=98%, HitCoverage=96%, E-value=0.0, Identity=71%"; Hit description=Non -phototropic hypocotyl-like protein
  Pfam annotation: Domain name=BTB; Domain location=26-123; Score=3.1; E_value=0.0021; Accession=PF00651.21; Description=BTBPOZ domain
  Pfam annotation: Domain name=NPH3; Domain location=203-462; Score =401.9; E_value=9.4e-118; Accession=PF03000.5; Description=NPH3 family
  Pfam module annotation: Pfam domain module=BTB::NPH3; Domain location= 26-123::203-462
MDRTTDKQQQLSLAKGTRQRYNEWIFRDVPSDITIEVNGGTFSLHKFPLVSRSGRIRRLVAEHRDSDISRVELLNLPGGAECFELAAKFCYGINFEITSTNVAQLCCVSDYLEMTEDFSKDNLGSRAEEYLDSIVCKNLEMCVEVLQQCESLLPLADALKVVSRCIDAIASKACAEQIASSFSRLEYSSSGRLHMSRQAKCDGDWWIEDLSVLRIDMYQRVITAMKCRGVRPESIGASLVNYAQKELTKKSSLWNPSSQTNVDSNSTLHEKLVVETIVSLLPVEKLAVPINFLFGLLRSAMMLDCTIASRLDMERRIGSQLDVATLDDILIPSFRHAGDTLFDVDTVHRILVNFCQQDDSEEEPEDASVFESDSPISPSQTALVKVSKLMDNYLAEIAPDANLKLSKFMVIAETLPAHARTIHDGLYRAIDIYLKAHQGLTDLDKKKLCKLIDFQKLSQEAGAHAAQNERLPVQSIVQVLYFEQLRLRNSLSCSYGEDDPKPIHQSWRISSGALSAAMSPRDNYASLRRENRELKLELARLRMRLNDLEREHVCMKRDMAKSGSRKFMSSFSKKIGKLSLFGHNSSRGSSSPSRNSQRTDSKVIERTCASTE

SEQ ID NO: 146499 - protein, 65 aa, Glycine max
  Coding DNA Sequence Number=SeqID_29721
MQSTLEEEEEAKAGLMSRIQRLTKLIMVSSNNAPRMKATPKEISSFTRPGYNRLHIVEQYSNIIN

SEQ ID NO: 146500 - protein, 186 aa, Glycine max
  Coding DNA Sequence Number=SeqID_29722
  Gene Ontology: Mol. function=hydrolase activity, hydrolyzing O -glycosyl compounds; Biological process=carbohydrate metabolic process
  Homolog annotation: Hit_ID=Q43855; Match level="QueryCoverage=54%, HitCoverage=38%, E-value=1e-16, Identity=75%"; Hit description=Beta -fructofuranosidase; cell wall invertase I; fructosidase
MQYQRTSSIEKNLNLLYTHQNPLTNAGVGLGEPLYSQVQLYAIPENKSVVRSSIKHVLKNSLDFTRYEYYTVGTYFKNKGKYIPDNNTSEDGWGGLRYDYVNSENSSLILVGDSCTTTKRAFYIADSMTAVDNLLRRGTPCPRASSLTKSSALLLLPFAVATDKVQAAFRLLVLVGGLLRLGHTLL

SEQ ID NO: 146501 - protein, 316 aa, Glycine max
  Coding DNA Sequence Number=SeqID_29723
  Gene Ontology: Mol. function=oxidoreductase activity; Cellular component=integral to membrane; Biological process=electron transport
  Homolog annotation: Hit_ID=O81974; Match level="QueryCoverage=98%, HitCoverage=61%, E-value=1e-105, Identity=59%"; Hit description =Cytochrome P450 71D8
  Pfam annotation: Domain name=p450; Domain location=1-311; Score=64.3; E_value=3.9e-16; Accession=PF00067.12; Description=Cytochrome P450
VAFGGIYKEQDEFVVSLIRKIVESGGGFDLADVFPSIPFLYFLTGKMTRLKKLHKQVDKVLENIIREHQEKNKIAKEDGAELEDQDFIDLLLRIQQDDTLDIQMTTNNIKALILDIFAAGTDTSASTLEWAMAEMMRNPRVREKAQAELRQAFREKEIIHESDLEQLTYLKLVIKETFRVHPPTPLLLPRECSQPTIIDGYEIPAKTKVMVNAYAICKDSQYWIDADRFVPERFEGSSIDFKGNNFNYLPFGGGRRICPGMTLGLASIMLPLALLLYHFNWELPNKMKPEEMNMDEHFGLAIGRKNELHLIPNVNL

SEQ ID NO: 146502 - protein, 76 aa, Glycine max
  Coding DNA Sequence Number=SeqID_29724
  Subcellular localization annotation: CTP_CleavageSite=36; ConfidenceScore=5.14e-01
MVRHNRSGIQRRSTKDPSLSTELTNTTTITSTAVVNALQRRSRQPDVDTNKLNDGGTYTTSLKMMKTTTAYVNGRR

SEQ ID NO: 146503 - protein, 81 aa, Glycine max
  Coding DNA Sequence Number=SeqID_29725
  Subcellular localization annotation: CTP_CleavageSite=7; ConfidenceScore=5.24e-01
MASMDTSAMVNSKIFPCNLGMRGSGEFVPFLDTTSRGSKMPQHTFLRRRHGPSVWFVYSRDQDRTHMQCLCKRHNAGMYTV

SEQ ID NO: 146504 - protein, 61 aa, Glycine max
  Coding DNA Sequence Number=SeqID_29726
  Homolog annotation: Hit_ID=Q2HU62; Match level="QueryCoverage=85%, HitCoverage=8%, E-value=4e-18, Identity=79%"; Hit description =Glycoside hydrolase, clan GH-D; Ricin B lectin
MQEAQVCVSSQNISESGLQQASLPPRGWNSYDSFCWTISEEEFLESAEMVSQRLKAHGYQE

SEQ ID NO: 146505 - protein, 234 aa, Glycine max
  Coding DNA Sequence Number=SeqID_29727
  Gene Ontology: Mol. function=nucleic acid binding; Cellular component= oxygen evolving complex; Biological process=DNA integration
  Homolog annotation: Hit_ID=Q1RSI0; Match level="QueryCoverage=99%, HitCoverage=27%, E-value=6e-38, Identity=35%"; Hit description=IMP dehydrogenase/GMP reductase
MKGLDFLDTFSPVAKLTIVRLLLALAALNGWHLKQLDINNAFLHGELKEEGITLMKSVISRLFLSNLQNKRSWQFEVFLGHEVARSHKGIHLCQWKYTLDILSDSGMLGCRPTSTPMDYSTRLHATLGTLLSASSSSSYRRLVGRLIYLTNTRPDITHVVQQLSQYMANPTIAHSQATFPVLHYLKGTPGSGIFLSATGTLQHKAFSDSNWAGCRDSRHSITGFSIYLGHSLIS

SEQ ID NO: 146506 - protein, 419 aa, Glycine max
  Coding DNA Sequence Number=SeqID_29728
MKHDYEHTPSEAFKALPTNAIVHLPIPQWTCPVLPNVIKMPPHWLVPDKRSPKTTSRDLFEKHKRDPLLEVELPKREFQKMEDLSSLSKLHEQIYLRDQATAYLPGLHISRATDIKMVADKVSSCLLVWGSAKKKGLKLYYNKEMPSRKRKVEKDNFPRSWSSLFSWKKLVHIPDAYDARTFWNQTVWMDSQKAYTFGYDGSDNVEHRDVVQGTYNLKRMTEDQILVHVTQLHDTRQKRKAKEEEVVVAMKKDVGSVQAKAFAKVVDNTIISGVIIDLTNTGVTDKTLKASNVAIADELEHNNIEPTSKQSTTSNEATSRNKGQPDIFIGLSARYDRGSDASSIGACRPRIFFINGFLCFLEDEWQRNGERKRERRRHFKEKMSLEEAHHHRRPWIRAWRKKEMNEGRGREEHEILCSK

SEQ ID NO: 146507 - protein, 47 aa, Glycine max
  Coding DNA Sequence Number=SeqID_29729
MERDENKTRLNGEDTEYSSRWNGKDGDIPEVGAGLVEHEEIEAICLT

SEQ ID NO: 146508 - protein, 531 aa, Glycine max
  Coding DNA Sequence Number=SeqID_29730
  Gene Ontology: Mol. function=metal ion binding; Cellular component =intracellular; Biological process=metabolic process
  Homolog annotation: Hit_ID=Q2HU53; Match level="QueryCoverage=99%, HitCoverage=85%, E-value=1e-115, Identity=36%"; Hit description =Tetratricopeptide-like helical
  Pfam annotation: Domain name=PPR; Domain location=168-201; Score =22.2; E_value=0.0019; Accession=PF01535.11; Description=PPR repeat
  Pfam annotation: Domain name=PPR; Domain location=202-236; Score=5.7; E_value=1.6; Accession=PF01535.11; Description=PPR repeat
  Pfam annotation: Domain name=PPR; Domain location=268-302; Score =36.2; E_value=1.1e-07; Accession=PF01535.11; Description=PPR repeat
  Pfam annotation: Domain name=PPR; Domain location=303-337; Score =20.8; E_value=0.005; Accession=PF01535.11; Description=PPR repeat
  Pfam annotation: Domain name=PPR; Domain location=339-373; Score =16.8; E_value=0.076; Accession=PF01535.11; Description=PPR repeat
  Pfam annotation: Domain name=PPR; Domain location=405-439; Score=8.2; E_value=0.79; Accession=PF01535.11; Description=PPR repeat
  Pfam annotation: Domain name=PPR; Domain location=67-101; Score=31.7; E_value=2.7e-06; Accession=PF01535.11; Description=PPR repeat
  Pfam module annotation: Pfam domain module=PPR::PPR::PPR::PPR::PPR::PP R::PPR; Domain location=168-201::202-236::268-302::303-337::339 -373::405-439::67-101
MGAESCIDLLLRCRNVFHIRQVHAHVVANGTLQDLVIANKLLYTYAQHKAIDDAYSLFDGLTMRDSKTWSVMVGGFAKAGDHAGCYATFRELLRCGVTPDNYTLPFVIRTCRDRTDLQIGRVIHDVVLKHGLLSDHFVCASLVDMYAKCIVVEDAQRLFERMLSKDLVTWTVMIGAYADCNAYESLVLFDRMREEGVVPDKVAMVTVVNACAKLGAMHRARFANDYIVRNGFSLDVILGTAMIDMYAKCGSVESAREVFDRMKEKNVISWSAMIAAYGYHGRGKDAIDLFHMMLSCAILPNRVTFVSLLYACSHAGLIEEGLRFFNSMWEEHAVRPDVKHYTCMVDLLGRAGRLDEALRLIEAMTVEKDERLWSALLGACRIHSKMELAEKAANSLLELQPQNPGHYVLLSNIYAKAGKWEKVAKFRDMMTQRKLKKIPGWTWIEVDNKTYQFSVGDRSHPQSKEIYEMLMSLIKKLEMAGYVPDTDFVLQDVEEEVKQEMLYTHSEKLAIAFGLIAIPEGEPIRISKNLR

SEQ ID NO: 146509 - protein, 122 aa, Glycine max
  Coding DNA Sequence Number=SeqID_29731
  Gene Ontology: Mol. function=RNA-directed DNA polymerase activity; Biological process=RNA-dependent DNA replication
  Homolog annotation: Hit_ID=Q1RVP6; Match level="QueryCoverage=98%, HitCoverage=83%, E-value=2e-26, Identity=44%"; Hit description=80C09_ 29, related
MYWRQRAKAYWLKDGNMNSKFFHTFASTRKKRNQIDALMNVEGQWIDDQEGICELARSYFEDLFHLDEGSYDPVVDLVHPYLSEEDNHPLLALFMKEEVKAVLFDMHPDKSPSSDGLNPTFF

SEQ ID NO: 146510 - protein, 142 aa, Glycine max
  Coding DNA Sequence Number=SeqID_29732
  Homolog annotation: Hit_ID=Q1SQU8; Match level="QueryCoverage=77%, HitCoverage=34%, E-value=6e-07, Identity=28%"; Hit description =Polynucleotidyl transferase, Ribonuclease H fold
MTWRLECHMEDSNSTPSPIVSMAVFGRPETNKQWNDTGPNIYLTVSRAIQVLHEWINARNLQQPESTSLNNEDFAWWEPPPSGFLKCNVDASFNTQEKTTREALSLLHVMKWAIKLGYTRVYFEVDCKGVQDMIHSSKCNTT

SEQ ID NO: 146511 - protein, 69 aa, Glycine max
  Coding DNA Sequence Number=SeqID_29733
MDEGGDVRNNIHSHGVCSSDICDGGKVGCEDRRKWKKVTNVLRELEDGCNIRIGKLGQMMDVIDVGNTL

SEQ ID NO: 146512 - protein, 68 aa, Glycine max
  Coding DNA Sequence Number=SeqID_29734
MSQEVPDELAQASWLLKAEEIPLAQASWFIALASGNPILLDECFFHLYGFNLVMLGKLGTPFLTKMLL

SEQ ID NO: 146513 - protein, 86 aa, Glycine max
  Coding DNA Sequence Number=SeqID_29735
  Subcellular localization annotation: CTP_CleavageSite=45; ConfidenceScore=5.19e-01
MQTINNKECSAKQKEKTHKVPKQKNSEALPLSHAAFFFSSSSTIVAQQSSNLWPSFLLQIAKGGHFQEAKMVSGNRLQRGVIDYQA

SEQ ID NO: 146514 - protein, 299 aa, Glycine max
  Coding DNA Sequence Number=SeqID_29736
  Gene Ontology: Mol. function=nucleic acid binding; Cellular component= intracellular; Biological process=DNA integration
  Homolog annotation: Hit_ID=Q1RXN8; Match level="QueryCoverage=82%, HitCoverage=20%, E-value=2e-85, Identity=59%"; Hit description =Peptidase S8 and S53, subtilisin, kexin, sedolisin; Integrase, catalytic region; Zinc finger, CCHC-type
MKGELFLSQQGYLKNIVKRFRMHQYKPVSTHLGHHTKLSITQAPNTEEEMRKMDIIPNASGVGSIMYCMLYGRFKSSSLGGFEVGIEYKKAAQDGDAIMGYVDADYAGNVDIGKPLFGYVFTLFGTTICWKENLQPMVALSTTKSKYIALVKGVKEALWLKGMIGELGIVQNCVTIHYDSRSFIHLANHHIYHERMKHITVRLHFIRDVVESKEVRIVKIASKDNVTDVFTKSLPRSKFKHCLDLINFSRSIVSEAREQHYGGRNRLSNIWSQGGEFLYVTQTLLFSLMDVWFDEDCLL

SEQ ID NO: 146515 - protein, 73 aa, Glycine max
  Coding DNA Sequence Number=SeqID_29737
MRNQPCMKRVCNLNQERTKVIATMRVCDLNKSENEGLEAARESVWMERNKCEQVRCRLRVMNETDRRQELQRN

SEQ ID NO: 146516 - protein, 301 aa, Glycine max
  Coding DNA Sequence Number=SeqID_29738
NFFGVVLVELQPNHLRKPGVFCVDELQVGEPEGVERVREHVKPARPHGLLALATWHEIFDCQTHFFFLRTLRGGAVTGGDVEPQCHHPGVGGGARVDGGEEHVFFGGRILPRVTVELEFEDLGQGVGEVRKENVVALVWSRELRIGWEGEDGDAGATADGLAPASLGVAHGSGLWFDHGGSVMIGGGCPGGMVMMASSSSTIQSVYPRVSGANFHVPLSPHSLVPIYNNSHSFSKLRNSIHLAAAPLPKASAGNGGLTDDGVSLGTMKLPLDNDLQRFASLLFQEIIYTDEPCLILLLCQQ

SEQ ID NO: 146517 - protein, 125 aa, Glycine max
  Coding DNA Sequence Number=SeqID_29739
MELPPSYATSSPGRAHYFRAKVQLAWASLNHPKELNQRDLVEGGKKKGEEGKKATMECILGSMEELGGDKWCLLGDFNSIRQPKERSYCISGYVEVNEFDDFMINMDQAEGHPSHWEEIHLVQGK

SEQ ID NO: 146518 - protein, 113 aa, Glycine max
  Coding DNA Sequence Number=SeqID_29740
MALGTMAARPSELMLHLEVTGSPRRLWFGTSRVDMRGPIGIGVKVPSGCADCIGTSLVTIGLTFSTRVFDILEAKQYMEAPVISEKYMYLIGSPLVPKGDKCHPIELDSEERD

SEQ ID NO: 146519 - protein, 81 aa, Glycine max
  Coding DNA Sequence Number=SeqID_29741
MAKYDPEIVMEFYANAWPTEEGVRDKHSWVRGQWIPFDEDANNQSYPASALDRRLQVDWARDAREGPRVLMSLRVDFGPIG

SEQ ID NO: 146520 - protein, 107 aa, Glycine max
  Coding DNA Sequence Number=SeqID_29742
MHEQCLAINSWGFGLDGGGCMNGNQFMGLRIRFDGGGCTNSAWQSIRGASDSMMEDEINSWGFGLDGGGWMNDNQFMGLRIRFDGGGYTSSVRQSIRGAPNSMVEDG

SEQ ID NO: 146521 - protein, 83 aa, Glycine max
  Coding DNA Sequence Number=SeqID_29743
  Gene Ontology: Mol. function=nucleic acid binding; Biological process= RNA-dependent DNA replication
MNTRLVSKLNLTIIPYPKPYKLQWLNEQGEMIVNQQVKVPFSIGTYKDEVNCDIVPMEVGHIYIGLTNEITLTHLSTKFVLHP

SEQ ID NO: 146522 - protein, 69 aa, Glycine max
  Coding DNA Sequence Number=SeqID_29744
  Subcellular localization annotation: CTP_CleavageSite=26; ConfidenceScore=5.00e-01
MYTGRSYRSTTPSPYGWLPVGHPNVSCMRASGAPSPVCSIFCNPTPQGHWIEGTKKIGPEMQEKALGYS

SEQ ID NO: 146523 - protein, 63 aa, Glycine max
  Coding DNA Sequence Number=SeqID_29745
MVGYTPSSFADLVFTDERIKAAITPAKVHQPQFLREYDSNATCACHGEAPGRSIEHCRALKRK

SEQ ID NO: 146524 - protein, 98 aa, Glycine max
  Coding DNA Sequence Number=SeqID_29746
MSIKGGAGGAGGGGRISTSGEAGGSNTGGRDSTGAGSILVGHLVPWLLLEERNGSLSSVTAVKNFAWHEDTGSARGYHDKLLGLGESASLSDKNLSRG

SEQ ID NO: 146525 - protein, 61 aa, Glycine max
  Coding DNA Sequence Number=SeqID_29747
MNIGTITLVKTALVSNATFAKPLPNVSKNKEHVDTLLDLHGVAFALTSKKPNSKTPTKELE

SEQ ID NO: 146526 - protein, 141 aa, Glycine max
  Coding DNA Sequence Number=SeqID_29748
MKGGETLWGLAKRAYEEFANSKKCNKHFSDMADLNFLMCKAIENPGLTPSSSLRTSIMSVFEDTVIDNGGKNQREVGVEDYMGCASVHGVGSSIAIFDTIRDGSLDCVCVYPTPLHSREQMLELVGKMKVILMEGAKTYKK

SEQ ID NO: 146527 - protein, 314 aa, Glycine max
  Coding DNA Sequence Number=SeqID_29749
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=39%, HitCoverage=50%, E-value=7e-12, Identity=51%"; Hit description =Integrase, catalytic region
MFSRSLRILLPVYSRLASITAYLTRLLTKDQFEWSPEAQQAFIGLKDAFTIAPILFLPDFTLPFTLETDMSSVEMGAVLSLKEHPIAFFSKPLVPSYFEPPLTSASSSLSPPRHTAILVVVDCVLKGIHLGMLPTHHTTHTVALLFMEIVGKHHGMPRSLHSGSRTSPNEITFGKKPFNIPLYITITSNLEAVDELLINTEVVITELRKKLLKAQATMKRIADTKHIDVNFKEGDWVMGLSRDETSWEDWDQLKATYDLEDKVFLEGMGDDRKKELQLQPGLRERSTRKVTTLGTSGNMFNLIWVALALARDIA

SEQ ID NO: 146528 - protein, 92 aa, Glycine max
  Coding DNA Sequence Number=SeqID_29750
MEREKKKRIWSKVILNSVLTSTEGIRCQNIYKGRKAMQEEAGECRRLFGGVVAGSVIRPVQNRDIGEVAVGGDERPNDDISKIGTTSSRWSL

SEQ ID NO: 146529 - protein, 58 aa, Glycine max
  Coding DNA Sequence Number=SeqID_29751
MGEGFVRLARMEDVRVLGIKLANIYINNMKLNVNLPRFNRKNRQGPSDQEEGKSQERG

SEQ ID NO: 146530 - protein, 79 aa, Glycine max
  Coding DNA Sequence Number=SeqID_29752
MINDGTYEFGDPTVMWLRMPPDSWDTVTKGGVVDKSRAFAPTYLRAGQCGRNCGAADKSEALAPTYPQFVMRNSYLRSS

SEQ ID NO: 146531 - protein, 63 aa, Glycine max
  Coding DNA Sequence Number=SeqID_29753
MGGWCHLGHKSRKDVFGRIQTRLAMVKGYRESYRRSISTPCVVEVCNLCLSIPIYNTSQLPFK

SEQ ID NO: 146532 - protein, 81 aa, Glycine max
  Coding DNA Sequence Number=SeqID_29754
  Subcellular localization annotation: CTP_CleavageSite=39; ConfidenceScore=5.44e-01
MTPTALKLAISANQGLTAIKNKDSSAQMHSSSFFQILPRAQLRSVALSGWLAKPEGWLSERMKISTSQTCLINLKLRENDY

SEQ ID NO: 146533 - protein, 46 aa, Glycine max
  Coding DNA Sequence Number=SeqID_29755
MWERRLSLKLLLAALNGKDFAVAMCRFCRLMGTTTTELLLNRFKDT

SEQ ID NO: 146534 - protein, 74 aa, Glycine max
  Coding DNA Sequence Number=SeqID_29756
MLASGKIVRANPRAGKKARIEMTVPFFHITLFSLRCTKKALEGRQQKKSYSGRSRNPPHMGHLQRGVALAYSKE

SEQ ID NO: 146535 - protein, 88 aa, Glycine max
  Coding DNA Sequence Number=SeqID_29757
APVSLALARPRRACCDSVTRESRRTQGSRPRAKHEIISLSGTFVSCQAQCTTGAKPKSTNSRKARRKQYKIPEQGHQSANFEIEALEA

SEQ ID NO: 146536 - protein, 38 aa, Glycine max
  Coding DNA Sequence Number=SeqID_29758
  Gene Ontology: Cellular component=membrane
MTLAQGLFYYGLKDTSATYAVNFLNLVPICTFFTSIIF

SEQ ID NO: 146537 - protein, 155 aa, Glycine max
  Coding DNA Sequence Number=SeqID_29759
  Gene Ontology: Mol. function=carboxypeptidase activity; Cellular component=membrane; Biological process=auxin mediated signaling pathway
  Homolog annotation: Hit_ID=Q2QTP5; Match level="QueryCoverage=76%, HitCoverage=31%, E-value=3e-32, Identity=49%"; Hit description =Integral membrane protein DUF6 containing protein, expressed
MLACVLAAIQGGIIGVCIDSSKAAWKLEWNLQLVTIVYSGALATAATFTILSWAITIKGPSYPPMFNPLALIFVAFSEAIILGEPLTVGTLLGMVLIMVGLYSFLWGKNNETMRRVQQLASTKISNITNLSIRTESMTTIVSSSSPMNSVGLART

SEQ ID NO: 146538 - protein, 52 aa, Glycine max
  Coding DNA Sequence Number=SeqID_29760
  Gene Ontology: Mol. function=transporter activity; Cellular component= integral to membrane; Biological process=transport
  Homolog annotation: Hit_ID=Q7CLC8; Match level="QueryCoverage=93%, HitCoverage=17%, E-value=1e-08, Identity=63%"; Hit description =Facilitator for glycerol uptake
MKLTLYAAQRARPVFLFYWFLQGCPAGDGQSAHGNRRHRGRRRPAGQKLAPG

SEQ ID NO: 146539 - protein, 34 aa, Glycine max
  Coding DNA Sequence Number=SeqID_29761
RGASVTLPRRFREQIREGFPSFFTVLHLFFILQQ

SEQ ID NO: 146540 - protein, 495 aa, Glycine max
  Coding DNA Sequence Number=SeqID_29762
  Gene Ontology: Mol. function=DNA binding; Cellular component=nucleus; Biological process=regulation of transcription
  Homolog annotation: Hit_ID=Q1SXG6; Match level="QueryCoverage=98%, HitCoverage=84%, E-value=1e-148, Identity=54%"; Hit description=No apical meristem (NAM) protein
  Pfam annotation: Domain name=NAM; Domain location=2-92; Score=136.2; E_value=8.9e-38; Accession=PF02365.6; Description=No apical meristem (NAM) protein
MEFVVNNDAEDLSVVRNKDPEWFFFCPQDRKYPNGHRLNRATNHGYWKATGKDRKIKSGSTLIGMKKTLVFYTGRAPKGKRTNWVMHEYRPTLKELEGTNPGQNPYVLCRLFKKQDESLEASNGDDVERTASTPTTANYCPDEIQSDSALVPASSSQVTEDDKPLPVISENSEEAISNIITPGDIHSDECDAPDAQYQIVEPVAEEDQLLSVDIFYDPTNQQLDDKLFSPVHAHFPADFYYQANNQSELQYGTSENISEFFDSVVNWDSFSYATSSLDLGSSFLNPKDNGSGSDSDVEMANMLHLQALHDYPKEAVEEKFNVGLFQNNPQMAFSNDGPMGQVHNVANYCEQPRNFDAFVNGDTGIRIRTRHGRNEQPNMNMMIQSQGIAPRRIRLGVVRRPLGSQETAKDGSCACAPEDHNSKTIISAEKKASENHAADESSTVSDESSTVTDDSDEPEEASPKSTDPRKISQQHVATAESISGSKDLLVSRRGC

SEQ ID NO: 146541 - protein, 319 aa, Glycine max
  Coding DNA Sequence Number=SeqID_29763
  Gene Ontology: Mol. function=metal ion binding; Biological process =metal ion transport
  Homolog annotation: Hit_ID=Q1SXE7; Match level="QueryCoverage=85%, HitCoverage=83%, E-value=4e-77, Identity=92%"; Hit description=PPAK motif; Heavy metal transport/detoxification protein
  Pfam annotation: Domain name=HMA; Domain location=137-198; Score =29.9; E_value=9e-06; Accession=PF00403.16; Description=Heavy-metal -associated domain
  Pfam annotation: Domain name=HMA; Domain location=49-110; Score=41.8; E_value=2.3e-09; Accession=PF00403.16; Description=Heavy-metal -associated domain
  Pfam module annotation: Pfam domain module=HMA::HMA; Domain location =137-198::49-110
MGEEAKQEQVQPVAEAKPEEKKEEMAEEKKEEKPEEEKKKEPKPPSPCVLFVDLHCVGCAKKIERYIMKMRGVEGVVIDMAKNEVTIKGIVEPQAICNAITKKTKRRASVISPLPEAEGEPIPEVVNSQVSGPVTVELNVNMHCEACAEQLKRKILQMRGVQTTMTEFSTGKVLVTGTMDANKLVDYVYRRTKKQAKIVPQPEPEPEKKEESKEAEKPAEEENKPEEKKEEEKPPEEPKKEEGGEGGEGGGENKEEKGGEEGKEEAKKEDNVVVVANNIDDEGLKRMMYYYQYPPLYVIERIPPPQLFSDENPNACCIT

SEQ ID NO: 146542 - protein, 495 aa, Glycine max
  Coding DNA Sequence Number=SeqID_29764
  Gene Ontology: Mol. function=fructose-bisphosphate aldolase activity; Cellular component=mitochondrial envelope; Biological process =metabolic process
  Homolog annotation: Hit_ID=P46257; Match level="QueryCoverage=72%, HitCoverage=100%, E-value=1e-177, Identity=87%"; Hit description =Fructose-bisphosphate aldolase, cytoplasmic isozyme 2
  Pfam annotation: Domain name=Glycolytic; Domain location=148-495; Score=870.5; E_value=8.2e-259; Accession=PF00274.9; Description =Fructose-bisphosphate aldolase class-I
MTFHFVGVRNQTRRQVDGGLCIDETKDGVGPNKDGPLNQPKLKPPSKLGHKIFQRQSTETRTQNRTITQVDASRVRILRPTSFFSVVAASTQHHYHYHYIYVNPTLLSFHLFTFFQPLKSNLPLFLLPPTSPSSSSIMSHFKGKYHDELIVNAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 146543 - protein, 111 aa, Glycine max
  Coding DNA Sequence Number=SeqID_29765
  Gene Ontology: Mol. function=ribonuclease H activity; Biological process=RNA-dependent DNA replication
  Homolog annotation: Hit_ID=Q1SUQ9; Match level="QueryCoverage=77%, HitCoverage=35%, E-value=7e-15, Identity=47%"; Hit description =Ribonuclease H
  Pfam annotation: Domain name=RnaseH; Domain location=1-110; Score= -24.0; E_value=0.0099; Accession=PF00075.14; Description=RNase H
MVAVLVILMRANGSHVFMVTLGIKDILYAELIAMLQGLSTAWNINSAKVVCFSDSKHAVDFVNDANSVFHHYAAVISNIMDLLNRLWQAIIHSLCERNQVADFLAKTRAKG

SEQ ID NO: 146544 - protein, 78 aa, Glycine max
  Coding DNA Sequence Number=SeqID_29766
MTTLVSACQSDSGSPNDEVRITVRCLHMLPDSWVMIGKGGVVEKSGVFAPTYPQFVMRNSDLRSSFFCETKIVSVFFH

SEQ ID NO: 146545 - protein, 67 aa, Glycine max
  Coding DNA Sequence Number=SeqID_29767
  Subcellular localization annotation: CTP_CleavageSite=36; ConfidenceScore=5.15e-01
MKLGGRRRYPSGYPYKHSFTIRQTQSPRLTSSSTPLSSRDGESDEMRRYPSGYPYKRVLLILTCEVQ

SEQ ID NO: 146546 - protein, 501 aa, Glycine max
  Coding DNA Sequence Number=SeqID_29768
  Gene Ontology: Mol. function=hydrolase activity; Cellular component =integral to membrane; Biological process=metabolic process
  Homolog annotation: Hit_ID=UPI00006DBC1C; Match level="QueryCoverage =72%, HitCoverage=82%, E-value=3e-80, Identity=42%"; Hit description =COG0402: Cytosine deaminase and related metal-dependent hydrolases
  Pfam annotation: Domain name=Amidohydro_1; Domain location=2-316; Score=78.3; E_value=2.4e-20; Accession=PF01979.10; Description =Amidohydrolase family
  Pfam annotation: Domain name=Amidohydro_3; Domain location=2-314; Score=-45.9; E_value=0.00016; Accession=PF07969.2; Description =Amidohydrolase family
  Pfam module annotation: Pfam domain module=Amidohydro_1::Amidohydro _3; Domain location=2-316::2-314
MIAMPGMVDSHRHAWEGQLRRINPNATCLDDYSNATHFSFAKYYRPSDIYVGNLLTALGAIDAGITTIIDNSHNSRSAAHSDAAVEALLDSGIRAIHASGAPVAGEWDKAHWPGNWQRLQEKYFKDNPESLVSLGVMAQLEPELWAEARRLGLPIVTEFFGAEMASELESLHQKGLLGPDNIFNHCTALPDEGWEILREAGVRVNVCPRSDSHYGIENGMFAIEAAQRHGINPGLSVDNETSYSTDMFMEMRVAFYLQRVMGMHRQHCCDSDRTLTTLPAAQLLKSATVDGAFCAGLQDKLGSLTPGKQADLVLISATDLNLYPNGNAFGTVVHATERSNIDTVMIGGRIVKQNGKVLGVDSERLRAAIDESHNPEQPACKRTRRRLGHRRVVFLFGWGIQPRNLLAAARGIIHLTCRHSFSACVESGRRTDRCLRAVQLRGACTENWFFSPARAGYCRAVALISDDRPFWSAGRDQAAGFNTQAGRNAGHADRARRHALR

SEQ ID NO: 146547 - protein, 154 aa, Glycine max
  Coding DNA Sequence Number=SeqID_29769
MHKCIQNNVEGKDINAEQLEQQAESPPDQFEEGVVLGPIMLIDGDYVLTPSIWSITKRNDFLYKYLFYQFKSGKSSQDLRARVRSSEAEEEWSGGYTEEVFGGKGRSFGKTRRMSVVHGCISITGVWGGVVSESIWTCGFGYVPFLLITIARKA

SEQ ID NO: 146548 - protein, 97 aa, Glycine max
  Coding DNA Sequence Number=SeqID_29770
  Homolog annotation: Hit_ID=Q8GU55; Match level="QueryCoverage=87%, HitCoverage=7%, E-value=2e-15, Identity=46%"; Hit description=SMC2 protein
MKSLSEKVDALSQNLVRETSVLNNKEDTLRSEEANKANLVKNIEELKHSGKEKSSAVKKAEEGAADLKKKVDELTKSLEEHDKEYQVPEINVKKMHQ

SEQ ID NO: 146549 - protein, 103 aa, Glycine max
  Coding DNA Sequence Number=SeqID_29771
MIRTIHQGFDLKNITHRYYPDSGPKKKENCNKELKKSSTIKNKTRVMEVKDEEHKIRTKSLRSEMISLFKFVNESALKKENPIFEVGEEGGRDGRCRNPSGET

SEQ ID NO: 146550 - protein, 62 aa, Glycine max
  Coding DNA Sequence Number=SeqID_29772
  Homolog annotation: Hit_ID=Q69LW2; Match level="QueryCoverage=68%, HitCoverage=9%, E-value=5e-08, Identity=69%"; Hit description=Rab3 -GAP regulatory domain-like
  Subcellular localization annotation: CTP_CleavageSite=25; ConfidenceScore=5.15e-01
MANQLSFCYLGRKSLGLGAILSKVVPATFSTISSFSKLIWRSEQSSPKKSDQKPQPFARGKH

SEQ ID NO: 146551 - protein, 192 aa, Glycine max
  Coding DNA Sequence Number=SeqID_29773
MDRSWMKAPRISDVYENGLKISCNLRNKMHHRTYTKWIWHGELPHESTIPHTEAVDVQIGDRIEDMICDLGQEGFWQTHAPYYEKLQTDSKKPFVFGMDNLRTIISDVSFTELLVLLKNMLPKDNMLPKNQVSRYKVKYDKCSDDLATKNDHPSKTIDRLYSDFGEDPRNLRLGLALDGMNLLGNLSTSHSS

SEQ ID NO: 146552 - protein, 63 aa, Glycine max
  Coding DNA Sequence Number=SeqID_29774
MKGFGDVGNKGGGGCIGGNEATHRVRPIKMCNFEFHVIWLHEKRDERSGECVEDEIRECEWTP

SEQ ID NO: 146553 - protein, 152 aa, Glycine max
  Coding DNA Sequence Number=SeqID_29775
  Homolog annotation: Hit_ID=Q1SMF0; Match level="QueryCoverage=54%, HitCoverage=15%, E-value=6e-11, Identity=40%"; Hit description =Tetratricopeptide-like helical
MVDNHHRSVISIIIECHFCTIVHWLSMNEDQWMYGSIISEKVDMNEQNENEVVVNEEHVDCSDVFNTSQVFVTRDDVLHWAQSVAYEIGFVAVIIRSDTNNGIRGRTSFVLIGCERNGQHKAKKKDLVRTVTGSRKCGCPFKLHVKPALGGK

SEQ ID NO: 146554 - protein, 269 aa, Glycine max
  Coding DNA Sequence Number=SeqID_29776
  Gene Ontology: Mol. function=chromatin binding; Cellular component =chromatin; Biological process=chromatin assembly or disassembly
  Homolog annotation: Hit_ID=Q1SAV4; Match level="QueryCoverage=94%, HitCoverage=85%, E-value=3e-54, Identity=43%"; Hit description =Integrase, catalytic region
  Pfam annotation: Domain name=rve; Domain location=46-196; Score=3.7; E_value=0.0029; Accession=PF00665.16; Description=Integrase core domain
MARLQDNFTWISIRQDIHNFVAQCLDCQHTKYVTRKPAGLLSPLPLPTRPWEDLSLDFIVGLPSYKGNNTILVVVDWFSKGIHLGLLPSQYAAYQVATLFLDIAAKLHIMPRSLVSDRDPLFITIFVCLRSSSPIVMGNTSTGTSSFEVTYSKKPSTILQYIIGSSSVEAVDRLLTTREAVFDSLCHKLLKAQARMKHFADNNHQEVHYAEDDMVMVLCLTSSFFQRTRVSTLSFITHSSSHSDMMRQFNPAHFHYLERTLTIILSSPF

SEQ ID NO: 146555 - protein, 432 aa, Glycine max
  Coding DNA Sequence Number=SeqID_29777
  Pfam annotation: Domain name=Transposase_23; Domain location=231-294; Score=-10.6; E_value=0.017; Accession=PF03017.5; Description =TNP1ENSPM transposase
MGYKDEPFIVVEQARQVFYVQDPRRTSGIGHQNDASTLYINDMPAFSPQMPSINVEHEDDIHANRNDHDEGLWEIFLLKCGIPKCSFEATSRRSRQPTRLRRLTVRSLDHPRQTVNVNPTTGRGSGPHKEKQPRGKVEERSKRGEQNSQRSVVERRKRGKQAQLGESETKVKGGHKNEVIPNGIATLTPVEVPPDIQLLVAHVSTKGSCVKVAANPSREEGGVAMRPTMGLYVERDQCAHLVALGKVFEGASTIHSVPYGDDVVKVSVTKVYDGNAEVPFPTSKIQYVRQTLDSFVAWPTHHVKLVSHEVESSHRSNIVAGDDPFGELFKNLYELYHKLVELVWDATKVGILDVQELFFITYSDVNEIISGEKCLNISILQLWMMFSCISLTIFISNVQNMFMDDWSTRLGHGSVYGFFEPQSIHNAKDIRD

SEQ ID NO: 146556 - protein, 189 aa, Glycine max
  Coding DNA Sequence Number=SeqID_29778
  Homolog annotation: Hit_ID=UPI0000503967; Match level="QueryCoverage =95%, HitCoverage=64%, E-value=3e-07, Identity=25%"; Hit description =UPI0000503967 related cluster
MRSDCLVQFSILDFCSEPNELIVIHASSTCESGAMRSDCLVRFSILHFYSEPHELIVIHASSTHEFGTMRSDFLVQFSILAFYSEPHELIVVHASSTHEFGTMRSDCLVQFPIPPFYSESLELIVVHASSTNEFGAMCIDCLVLFSILHFCSEPHELIVVHASSTRESEAMRSDWLVQFSILHFFSEPH

SEQ ID NO: 146557 - protein, 443 aa, Glycine max
  Coding DNA Sequence Number=SeqID_29779
  Gene Ontology: Mol. function=RNA-directed DNA polymerase activity; Cellular component=intracellular; Biological process=RNA-dependent DNA replication
MIAHGKPQQNFTPYRQVANVASTIPNPSYHQQRPHYPYPYPPQQYPPQQYPPQQYPPQQYHQPQYPQKQQNRPQTPQQPYHSQNRQKTTFDPIPMKYADLLPALLAKNLVQVRTPPRTPDILPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEICHVNVKGCPKVQEDIQRLIDNRELIITRKDKEVCVITPEFQRLEISYNSGESTTTPLVISLPGPMPYASLKAVPYKYSATMLEGGQEVPLPSLTPAISVDNIASDGKVLRNGRVIPTLFAKKVNDPAVKQATVNGPGTRKEVGQSNGTSKNSDHDEILKLIQKSEYKVVDQLLQTPSKISILSLLLNSEAHREALMKVLDQAFVERDVTVNQLDSI

SEQ ID NO: 146558 - protein, 300 aa, Glycine max
  Coding DNA Sequence Number=SeqID_29780
  Gene Ontology: Mol. function=transmembrane receptor activity; Cellular component=membrane; Biological process=signal transduction
  Homolog annotation: Hit_ID=UPI00005F8D36; Match level="QueryCoverage =99%, HitCoverage=90%, E-value=2e-52, Identity=58%"; Hit description =COG0840: Methyl-accepting chemotaxis protein
  Pfam annotation: Domain name=MCPsignal; Domain location=2-89; Score= -79.9; E_value=0.0018; Accession=PF00015.11; Description=Methyl -accepting chemotaxis protein (MCP) signaling domain
  Pfam annotation: Domain name=TarH; Domain location=130-263; Score =117.6; E_value=3.5e-32; Accession=PF02203.6; Description=Tar ligand binding domain homologue
  Pfam module annotation: Pfam domain module=MCPsignal::TarH; Domain location=2-89::130-263
MGSVLVESAGETMGDIVNAVTRVTDIMGEIASASSEQSRGIEQVGQAVAEMDRVTQQNASLVEESASAAAALEEQASMLTQSVAVFRLRAEGQEEFKAPVTSKATVTPLASSGLSYSAFRSDNHNLDIITLGSQQRDSLSLSWVSLLQARNTLNRAGTRAALKLPQEQVNELMSSARSSLQKADLYFNQFMAVERSSEQQSQQTATTKASYERLRGALRELIGFLEKGELQAFMDQPTQKTQDLFEADFVQYLQLVNGDISEARDANQFSFKLAGLMLAGAVLMLIVVTGSAMWWLRTML

SEQ ID NO: 146559 - protein, 66 aa, Glycine max
  Coding DNA Sequence Number=SeqID_29781
MAVGSELEWSPPLLLLVMVLALWAPQSQAPGLWRPPPPLEEEDWSPGQATCASNSSMLIMEGKLKL

SEQ ID NO: 146560 - protein, 218 aa, Glycine max
  Coding DNA Sequence Number=SeqID_29782
ELYANPYDLEDKSPKQVRVRGHLIKFDEDTLNTFLKTSVIVEEGESLCAYSRFALLRPDPQELAAKLCVPGRGFELNADGKPLKILWKNITTLAQTWSVLSFSNLIPTSHTSDVTLDKAIPIYGIIMKMDMNAGYLISHQISLTTQDDTSRLAFPTLITTLCKARRVQSGSRSLESLSLTINLAYIKKNCWNLDDPIVTFRGPKKARGKRYEALSTAP

SEQ ID NO: 146561 - protein, 60 aa, Glycine max
  Coding DNA Sequence Number=SeqID_29783
MSIRTCRKAWAEQMRKMSDKCERGEPFLGKMLLNCAADFLCVQKNACALLVMGKVVHIGF

SEQ ID NO: 146562 - protein, 157 aa, Glycine max
  Coding DNA Sequence Number=SeqID_29784
MGETHEIPHHNLANFEPCLRYATEGQAVGGIPLQNTLDGPSVSPTTTTFAFHSREKLDHLEERLRAIEGGKDYAFANLEELFLVPNIITPPKFKVPDFVKYKGTTCPKNHLKMYCRKMGAYTKDEELLIHFFQESTTGVAVTWYTNLDLPESILGRT

SEQ ID NO: 146563 - protein, 75 aa, Glycine max
  Coding DNA Sequence Number=SeqID_29785
MQKTTLVSACHRTRLCLNGKKARHLWMTKGTEDDVNLCVPSDTTVSEWRKDTTVSEWRKGVRHDHNLSPHVTCPK

SEQ ID NO: 146564 - protein, 215 aa, Glycine max
  Coding DNA Sequence Number=SeqID_29786
  Gene Ontology: Biological process=regulation of transcription, DNA -dependent
  Homolog annotation: Hit_ID=UPI00005F8B55; Match level="QueryCoverage =30%, HitCoverage=57%, E-value=6e-17, Identity=63%"; Hit description =COG0642: Signal transduction histidine kinase
  Pfam annotation: Domain name=Cytochrom_B562; Domain location=1-100; Score=76.9; E_value=6.4e-20; Accession=PF07361.2; Description =Cytochrome b562
  Pfam annotation: Domain name=PRD; Domain location=124-210; Score =35.6; E_value=1.7e-07; Accession=PF00874.10; Description=PRD domain
  Pfam module annotation: Pfam domain module=Cytochrom_B562::PRD; Domain location=1-100::124-210
MDTLKDGLSVVKKTSDAQEMHAALGKMRAAAQDAKKSTPEKLEGQGADSAQIKDYHAGLDSLIAQIDVVDQLAQANKLDEAKTEAKKLEDILARGISTLRSNKVRSDAVPLKPSTPEAIQALADKVMNQIAALYAAHHIAANAVQQQMLASHVRAMAARSLTGEALPDVEAELFEDISPETMALAQKVVDLFGNLPVEEAWLLSVHIEVAKSNEA

SEQ ID NO: 146565 - protein, 404 aa, Glycine max
  Coding DNA Sequence Number=SeqID_29787
  Homolog annotation: Hit_ID=UPI00005F7086; Match level="QueryCoverage =39%, HitCoverage=86%, E-value=1e-48, Identity=71%"; Hit description =COG3840: ABC-type thiamine transport system, ATPase component
PQHHFGAGRGIPPVAMYCGGAVVCAARACGSAGNCLTLWGCLRTIQPLYSAEDSYGSLDPTPVYAIAGVRADCRGAVAGVCRPAAAGNGLDGQPRRAGGQRTNRALSGVGRRAGRLSDWRLARAASAQHVYHPGGALCRTDASADSAGGRHAGAAGGAGRQLQMAAAGGGAAAVDRRLAAVALVAQRQKRRLGHALSATGAAALAGTADGAHRRGCLYCAAVPPDDADFPAAAVESVLRLTRRYAKDGGRRAFTAQQAGGAAIPCAPRTPRAPAAASRCAAPDRVPKTVHPAAVPADYAAGSAPAPRVVADRRRAGRADASASIPARFAPQSAVPAAAVRASASGRDAGPAPDFAAPSGAETDCSPETASIPAALTHRQKAAEQAQQGTFARAARAENGETFTG

SEQ ID NO: 146566 - protein, 52 aa, Glycine max
  Coding DNA Sequence Number=SeqID_29788
MEHTNLGIPRSCGSACPRSLGTRISFLNDHLEEAPGPTKIGENHSKCINLTQ

SEQ ID NO: 146567 - protein, 52 aa, Glycine max
  Coding DNA Sequence Number=SeqID_29789
MTKDSDLKHPHKNETNHFVAKKARNSYLVQKENPLEGSLEERKVPNMGKPPL

SEQ ID NO: 146568 - protein, 655 aa, Glycine max
  Coding DNA Sequence Number=SeqID_29790
  Gene Ontology: Mol. function=transferase activity; Cellular component= membrane; Biological process=protein metabolic process
  Homolog annotation: Hit_ID=Q9M3I0; Match level="QueryCoverage=89%, HitCoverage=96%, E-value=0.0, Identity=77%"; Hit description =Putative glucosyltransferase
  Pfam annotation: Domain name=Glycos_transf_2; Domain location=174 -349; Score=12.9; E_value=0.00011; Accession=PF00535.16; Description =Glycosyl transferase
MAPSFDFSNRWMKETQKGTPVVVTMENPTFSVVEINGADAAFRPVEKTRGKNAKQVTWFLFLKAYHAIGCVVVYLQGWHFGNPSVHIPRAADLEGLMHLVYVAWLRFRGEYIAPPMQALSKFCIVLFLIQSVDRMVLCFGCFWIKYKRIKPKIDGDALKVDDIEGSACSHPMVLVQIPMCNEREVYEQSISAVCQIDWPRDRLLIQVLDDSDDESIQWLIKTEVRKWSQKGINIIYRYRLVRTGYKAGNLKSAMSCDYVKDYEFVAIFDADFQPHPDFLKQTVPYFKDNPELGLVQARWAFVNKDENLLTRLQNINLCFHFEVEQQVNGAFLNFFGFNGTAGVWRIKALEESGGWLERTTVEDMDIAVRAHLNGWKFIFVNDVKVLCEVPESYEAYRKQQHRWHSGPMQLFRLCLPAILRSKYYLNIHNKLKDLDSLQLQISPWKKGNLILLFFLLRKLILPFYSFTLFCIILPLTMFVPEAELPLWVICYIPVFMSFLNILPAPKYFPFLVPYLLFENTMSVTKFNAMISGLFQLGSSYEWIVTKKAGRSSESDLVAAAEREVKSIMEQQKIHRGASDSVLVESNQCKEHKETNGTPVKKANKIYKKELTLALLLLTASVRSLLSAQGVHFYYLLFQGVTFLLVGLDLIGQQMS

SEQ ID NO: 146569 - protein, 53 aa, Glycine max
  Coding DNA Sequence Number=SeqID_29791
MERENGIAQRQYKCRLQSLLCLSDVWELYQSRNWRNLREPLEMPLSISEDTEP

SEQ ID NO: 146570 - protein, 55 aa, Glycine max
  Coding DNA Sequence Number=SeqID_29792
MAFKLKSISVRLFPYKNHALMPLRHFTEHLAGARLGVNSKRTGTMWHVPLLQNAL

SEQ ID NO: 146571 - protein, 200 aa, Glycine max
  Coding DNA Sequence Number=SeqID_29793
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=1e-18, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=28; ConfidenceScore=5.25e-01
MVKNDWPSQSVNLLLSHKVGPLRTTCPRLQRVAHPRLQRTKVLALRGLHALAFRGLQVLAFRGLHVLAFKGLHILTFIGLHVLTFRGLHALTFRGLYVPAFRGLNAVTFRGLHVLTFRGIRALTFRGLHVLAFRGLSALAFRGLHVLPFRGLHVLAFRGLHALARPLLQRTTCPHLERTTRPRLQRVARPRLQRTTRPHL

SEQ ID NO: 146572 - protein, 46 aa, Glycine max
  Coding DNA Sequence Number=SeqID_29794
MEFLELKQGSMTVAEYAARFENLVRFHELAQPLIFWLSASSAKRLI

SEQ ID NO: 146573 - protein, 156 aa, Glycine max
  Coding DNA Sequence Number=SeqID_29795
MKLTDLNEKAPITDCHADAGQWFNTHGEISDNTEKGIEGEHEKALPLEVSMPHNNILNITNPSMVYAASGQHDLKVASEEMGQQTCGPTLSATKVYVRRKEVLRSNSKAQQFEKSIVDFNPASKTDPLPSLHEDSIELQCALLKEMGLTYGEDDNK

SEQ ID NO: 146574 - protein, 370 aa, Glycine max
  Coding DNA Sequence Number=SeqID_29796
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=1e-40, Identity=29%"; Hit description= UPI00006A17C9 related cluster
GLHALVIKGLHVLIFQGLHVLTFRGLHVLAFTGLHTLAFRGLHVLAVRRLNVLAFRELHVLAFGGLQVLAFRGLHVVSFRGLNVLAFRVLYVLASEDCMGLLVLAFKRLHVLAFRGLHVPTVKGVHTLAFRGLHAVAFRGLDILAFRVLHTLAFRGIYVLAFRGLHVLALRGLHVHAFRGLHALAFRGLHVLAFKGLHVLAFRVLHVLACRGLHVLAVRGLHVLAFRGLHVLAFRGLHRATRCSLRGLHIVTFRGLHVLAIDGLHVLAFRGLWVLPFRGLHIVAFIELHVLAFRWFQVLVFIGLHVPAFRRLHALPFRGLHIVAFRGLDVLMQSYPARALARRLQVDWARDPRKGPRVLMSLRVDFEPMG

SEQ ID NO: 146575 - protein, 182 aa, Glycine max
  Coding DNA Sequence Number=SeqID_29797
MLWLCYRQGEGDRRIGRVKGDHKKGQIICVEKACNCYYKSISCEKYHRCKIQQEAGKEVINRTIRKSGTCYSFVTFIYAFLLQQIQLMQLFLAAVGWYSSLVSNCFLASMLAINQPVGWKSIPSLINEMYMEKAIVPMLQLLTCVQFIGFFGHFYITLLGILIPARAALCFAYEVLLLLPSC

SEQ ID NO: 146576 - protein, 68 aa, Glycine max
  Coding DNA Sequence Number=SeqID_29798
MVTWDDSNNNKSSSSNDEQANIFLMVDTDKKVEVKTCFKSDTSSCATSNDAEDMSSDVLLQNSHMISL

SEQ ID NO: 146577 - protein, 78 aa, Glycine max
  Coding DNA Sequence Number=SeqID_29799
MTVAHDEPVVPAPDVEADVFLDDPMAPADVEDIVTDIHADTGVQATEDEHEGFPGGPSDPSVLTQYADHVACSVWTGE

SEQ ID NO: 146578 - protein, 167 aa, Glycine max
  Coding DNA Sequence Number=SeqID_29800
  Homolog annotation: Hit_ID=Q1RXS1; Match level="QueryCoverage=54%, HitCoverage=25%, E-value=7e-07, Identity=30%"; Hit description=Zinc finger, CCHC-type; Peptidase aspartic, catalytic
  Pfam annotation: Domain name=zf-CCHC; Domain location=58-75; Score =9.3; E_value=0.029; Accession=PF00098.13; Description=Zinc knuckle
MLVNEGLRTKLGYDKSYPRKDQGQGILGAAPSKPKDDKGKTIEKQPPKASMQEKTSSIKCFKFLGKGHITSQCPTKKTMNMKGQDIYSSQDEATTSPSFSESEEAKGEESSEEIYPQEEGQPLMVKEECKEVSVSSKRLAKKESHFAIKTNIKETSHLRQPPHLSPL

SEQ ID NO: 146579 - protein, 107 aa, Glycine max
  Coding DNA Sequence Number=SeqID_29801
MTKDSNRYPVGREPKRAMRGTVHEPQANLGADQKFLPMGSYLSHGAEIYPKAHENPRSFSCVSGLIFLESSIQCPWGVGLHHSLPLENDLTSNPEVLKTLGFFPQHL

SEQ ID NO: 146580 - protein, 388 aa, Glycine max
  Coding DNA Sequence Number=SeqID_29802
  Gene Ontology: Mol. function=leucyl aminopeptidase activity; Cellular component=intracellular; Biological process=protein metabolic process
  Homolog annotation: Hit_ID=Q57E51; Match level="QueryCoverage=99%, HitCoverage=77%, E-value=0.0, Identity=87%"; Hit description=Cytosol aminopeptidase family protein
  Pfam annotation: Domain name=Peptidase_M17; Domain location=182-388; Score=259.2; E_value=8.4e-75; Accession=PF00883.11; Description =Cytosol aminopeptidase family, catalytic domain
  Pfam annotation: Domain name=Peptidase_M17_N; Domain location=21-144; Score=106.2; E_value=9.8e-29; Accession=PF02789.7; Description =Cytosol aminopeptidase family, N-terminal domain
  Pfam module annotation: Pfam domain module=Peptidase_M17::Peptidase _M17_N; Domain location=182-388::21-144
MSKRPSISFSDFAVPERGVSIVLVAKGGGFADEAAAAAGGAEKIKRIAEISGFTGALGKTAEAIETTSSGVDKIVLVGVGEPGKLGNDDWLKIGGAAFSRIGKAERATVTLALPETTIAGDEAADLALGMMLRSYKFERYKTRKNDEENGDPKHAAKINICVADAHTAKRALEVAEAVADGVIQARNLVNEPANILGPVEFAQEAEKLEKLGVKVEVLGEKEMKKLGMGALLGVAQGSVRPPRLVVMEWQGAKSKEKPVAFVGKGVVFDTGGISIKPAAGMEDMKGDMGGAAAVTGLMRALAGRKAKVNAIGVIGLVENMPDGNAQRPGDIVTSMSGQTIEVINTDAEGRLVLADALHYTNDRFKPRFIINLATLTGAVMVALGQYHA

SEQ ID NO: 146581 - protein, 95 aa, Glycine max
  Coding DNA Sequence Number=SeqID_29803
MEYNGTTHFVRLHKYGSRYFFSDGLKQFRRTHDIDDSVIMQFLAPDKNTSFEVDVIGPILRQGRPRSIMATRRHIFTADVTEHMMQQTLPLVMVC

SEQ ID NO: 146582 - protein, 160 aa, Glycine max
  Coding DNA Sequence Number=SeqID_29804
QQKLYTDNHSGISGRQRDSKVSMIDLVSAEDDVEEDDVSLCVLSGFSSYRMQNVYTDNHSGISGRQRDSKSGAEDDVSLCVLSGFSSYRQQKVYTDNHSGISGRQRDSKVSMTDLVSAEDDDFRHTECKKFIRITTRVADKSEALAPTYPPMRNSDLRSS

SEQ ID NO: 146583 - protein, 152 aa, Glycine max
  Coding DNA Sequence Number=SeqID_29805
  Gene Ontology: Cellular component=membrane; Biological process =lipopolysaccharide biosynthetic process
  Homolog annotation: Hit_ID=Q577K5; Match level="QueryCoverage=100%, HitCoverage=20%, E-value=7e-63, Identity=80%"; Hit description =Exopolysaccharide biosynthesis protein Bme12
MMLIVPVVAGIGVGFAGYLTAPVSYVSESVLVLDMRRLQALPNESAITPLPQDSPVLRSELDIINSRMMARKVIDILQAENITVPTQFRSRTVLSSASDAASQAKGAREVDPALRERQQIDLLLSRLRVTNDGRSYTIFISYRASDRVYAAQ

SEQ ID NO: 146584 - protein, 156 aa, Glycine max
  Coding DNA Sequence Number=SeqID_29806
  Gene Ontology: Mol. function=two-component response regulator activity; Cellular component=intracellular; Biological process=two -component signal transduction system (phosphorelay)
  Homolog annotation: Hit_ID=Q9XDD4; Match level="QueryCoverage=99%, HitCoverage=61%, E-value=9e-74, Identity=87%"; Hit description=Bme13
MNLHGAFPQFQFIGDDLVRLAPAQRIDHFGLALGEHSAERLQALRIRIGGMPQGEHAAGRNEGSSRHGKPQCFDADIHIDRGGDITLHAMVERLEDLRDFFLVGQKNDGRRGAVRNDAIEIIADRWVGNLLAADIEKHRASRAAPTLMLPLLERAE

SEQ ID NO: 146585 - protein, 123 aa, Glycine max
  Coding DNA Sequence Number=SeqID_29807
  Gene Ontology: Mol. function=protein-methionine-S-oxide reductase activity; Cellular component=membrane; Biological process=protein metabolic process
  Homolog annotation: Hit_ID=P65447; Match level="QueryCoverage=65%, HitCoverage=55%, E-value=2e-36, Identity=87%"; Hit description =Peptide methionine sulfoxide reductase msrB (EC 1.8.4.12) (Peptide- methionine (R)-S-oxide reductase)
MRNIGQFRDIGGFDGLCEAGPAAMGLIFVGRGEKRFARNDVDIDSRLLVIEIFAGSRALGAAFLRDAILLRRQPGNRFRVLANLGRREQLFQPAANDELLKNRKTGNPDLPADPDAWKNFHGQ

SEQ ID NO: 146586 - protein, 237 aa, Glycine max
  Coding DNA Sequence Number=SeqID_29808
VTDRDRRNERWSETDTARTSVKQEEPYGGRRVNIFGRDNDYAEEENWTKVVSRRSMKVMQKSSLAGRQSQNLEIGDNNKHYRLNWRNNADITSFYFTHFPDEANEELLWRHFKNWGDVREVYIAKRLNKDGRRYGFMRFKGVSDAKGLEKKNPIRRKYTDEASKPCGITTGALRRSYVDVMTKGGGGCQGDKRADEAQTPTILINPDEGGEYWCNETWVGMLKKVMEVETLEDRITW

SEQ ID NO: 146587 - protein, 95 aa, Glycine max
  Coding DNA Sequence Number=SeqID_29809
  Subcellular localization annotation: CTP_CleavageSite=67; ConfidenceScore=5.28e-01
MIHLVEVRWGLGFTLATALVAATATALASNTFFMLIMASIIVAICSFMASMSAFICFCTSTTSPITLALARVRNGFMIPTWLAHEENASIMHEKT

SEQ ID NO: 146588 - protein, 523 aa, Glycine max
  Coding DNA Sequence Number=SeqID_29810
  Gene Ontology: Mol. function=carboxypeptidase activity; Cellular component=integral to membrane; Biological process=peptidoglycan biosynthetic process
  Homolog annotation: Hit_ID=Q5PN09; Match level="QueryCoverage=53%, HitCoverage=92%, E-value=1e-90, Identity=59%"; Hit description =Hypothetical protein ycgQ
  Pfam annotation: Domain name=Lactamase_B; Domain location=328-488; Score=9.5; E_value=0.027; Accession=PF00753.17; Description=Metallo -beta-lactamase superfamily
  Pfam annotation: Domain name=Peptidase_S66; Domain location=10-293; Score=221.4; E_value=2.1e-63; Accession=PF02016.6; Description=LD -carboxypeptidase
  Pfam module annotation: Pfam domain module=Lactamase_B::Peptidase _S66; Domain location=328-488::10-293
MEVMLAPRSIRLIAPSGYCHNQDAARRAVERLQAEGHQLQNPEAITRRWQRFAGDDAQRLQDVNALASLASLPDIVLAVRGGYGASRLLDHLDYVALQRRLLNQPVALCGHSDFTAIQLALLAQTGLITFSGPMLAGNFGAEALSEFTVSHFWQTLTSPTVNLAWRSASPDRGRWQGTLWGGNLAMICSLIGTPWLPQIEDGILVIEDVNEHPFRIERMLIQLQQSGILARQRAIVTGSFTSTALSDYDNGFDFATVWQRLRDEYQIAVISDLPFGHDADTVTLPLGASATLEIDQGAARRPLLKPLYEDLWISTPEFPAEETANDLMMHGFMLRHPRGNLLIGRVEQLLDHEVLADAGGVIRHYFTHWHEAAPGARAIQQRFNSALYCHSRSLGPVSLVIEPDETFTHQDVHFGDFHLLPTPGHTPGSCSYLYHSPLGQTYLFVGDTLTRDYHRWISVLVPDSNPAELQQSLELYRSLRPDVVLMSTTRGHLSWAKVDLQSWLAAIDEAEQSPLDLRQQPLL

SEQ ID NO: 146589 - protein, 360 aa, Glycine max
  Coding DNA Sequence Number=SeqID_29811
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=5e-31, Identity=28%"; Hit description= UPI00006A17C9 related cluster
MSSPSEDYTSSPVEDYTSSPSEGYTPSPSENYTSSPSGGCTPSASEDYTSSPSDGCMPSPSEDYMSSSSEDYTSSPVEDYMSSLLESSTSSLGCTPSASEDYTSSPLEGCIFSPSEDYTSSLSEDFTSSPSEGCTPSPIEDYTYSPSEGTFRGQHVLAIRALHALSFRGLHVLAIRGLHTLAFRGLHVLTIRGLHALTTKGQHVLTMRGLQALSFRGLHVLGIGGLHALTFRGLHILTFRGLHAPTCRGLHVLTIKGLHALICRELHVLAIILLHALTFRRLHVIAIRGLHALAIRRLNALPFRGLHVLAIRGLTPSPSVDYMSSPSEGRTPSPSEDYTSSPSEGSTPSPSEDFTTSTSK

SEQ ID NO: 146590 - protein, 213 aa, Glycine max
  Coding DNA Sequence Number=SeqID_29812
  Gene Ontology: Mol. function=signal transducer activity; Cellular component=intracellular; Biological process=signal transduction
  Homolog annotation: Hit_ID=Q8P9J2; Match level="QueryCoverage=69%, HitCoverage=90%, E-value=6e-48, Identity=71%"; Hit description =Chemotaxis protein
MVMVVPVLRAPARPASVPLSALQEGTEGLCDQNVKQGLDVEQDQHAVVLRADAGDEAGIDGGAEFRGRTDLLCRQRDHVRDAVDHDADHAVVDVQHDHHGEGVVAGIVQAQLQAQVDDRDDGAAQVDHALDVVRRIRHAGDGVVAADFLHLEDVHAVVLGTEGEAEEFATGAGGGAGLVVHRGVLVLPEVPVSGSISAPRRGTLGVAPPHCRE

SEQ ID NO: 146591 - protein, 116 aa, Glycine max
  Coding DNA Sequence Number=SeqID_29813
  Subcellular localization annotation: CTP_CleavageSite=75; ConfidenceScore=5.19e-01
QNLEGPTHLFCQPLLTAASHCSPPLSSACHRTIGHKSTIQGQRQQVQVLFSQFPKDLRNFESLLPATARNRRPLPATAPSDTGTIQDQRQQVPILFRSTELLIFLDNFCKKIDVKL

SEQ ID NO: 146592 - protein, 109 aa, Glycine max
  Coding DNA Sequence Number=SeqID_29814
MGERKKRKEGKKAPDQGSKEKQKKYAESGENNETFSSLTSYPELRRSEFLIGGYVGARASLLSTTPPFVAKTQELVARGDTLRLSAPRHSVTPSVIDEQRPMWSSAPFP

SEQ ID NO: 146593 - protein, 90 aa, Glycine max
  Coding DNA Sequence Number=SeqID_29815
MEASSIYIVAPAMDMVLWWITMLMVIIVGFFLMGFWAWVDPFLTHKGVQIATGPTWAFQILPPEGCCFWRKQPSSPGRAGWQAPPLFCYI

SEQ ID NO: 146594 - protein, 135 aa, Glycine max
  Coding DNA Sequence Number=SeqID_29816
MAQAGEILHDKINLQQVVETKSIWPPHERRSRSCNDFVSASPPPPKHPHMRIVSSLSIGKGCITLEEAKSSLYSRKLRHKASEMNKRKRKGFKKDKVDAKDICNYCKNLVIGRKIVPRNNLLWALVKMTPHQKMI

SEQ ID NO: 146595 - protein, 78 aa, Glycine max
  Coding DNA Sequence Number=SeqID_29817
  Gene Ontology: Mol. function=nucleotide binding; Cellular component =intracellular; Biological process=small GTPase mediated signal transduction
  Homolog annotation: Hit_ID=Q9M559; Match level="QueryCoverage=83%, HitCoverage=25%, E-value=1e-17, Identity=94%"; Hit description=Rac -like protein Rop1
MVVMLYLFPISSLGQEDYNRLRPLSYRGADVFVLAFSLVSRASYENVLKKISLLFSNLYALPSGSLNSSILPLASRWC

SEQ ID NO: 146596 - protein, 168 aa, Glycine max
  Coding DNA Sequence Number=SeqID_29818
  Homolog annotation: Hit_ID=Q5TIM8; Match level="QueryCoverage=42%, HitCoverage=18%, E-value=2e-07, Identity=44%"; Hit description =Putative glycosyltransferase
MSRYEVLTPSYSLQGGFPVNISIIVQPKIQISTTKARTLKAEGEGVVRVEELLVVGIGRVSVRSDLNDDAVGLLEEILADDVVIEGAKVDTDGATEDEDDLDAVEGLLDLAVVGKHIVATALCVRGPQAHAGAALTMEPNESSCVVRSSLELQRSPLAAVTKVVRVVL

SEQ ID NO: 146597 - protein, 315 aa, Glycine max
  Coding DNA Sequence Number=SeqID_29819
  Gene Ontology: Mol. function=transferase activity; Cellular component= cytoplasm; Biological process=auxin mediated signaling pathway
  Homolog annotation: Hit_ID=Q5PGQ0; Match level="QueryCoverage=65%, HitCoverage=99%, E-value=2e-93, Identity=76%"; Hit description =Glutathione s-transferase family protein
  Pfam annotation: Domain name=GST_C; Domain location=135-230; Score =27.0; E_value=6.9e-05; Accession=PF00043.15; Description=Glutathione S-transferase, C-terminal domain
  Pfam annotation: Domain name=GST_N; Domain location=33-110; Score =42.6; E_value=1.3e-09; Accession=PF02798.10; Description=Glutathione S-transferase, N-terminal domain
  Pfam module annotation: Pfam domain module=GST_C::GST_N; Domain location=135-230::33-110
MSNSALKPLKKPNEGLSHHGERLTRIHISSGVNMITLWGRNNSTNVKKVLWTLEELDLPFNQIMAGMAFGVNKEADYLAMNPNGLVPLLRDDETDATLWESNTIVRYLAAQYGQGRLWVENPARRAQGEKWMDWANQTLSPTHRVILMGLIRTPEAERDYPAIHAAQDACENLFAMMDDELAKHAWFSGEAFGTGDIAVAPFVWNLTNMGLKWTPRPHLERWLKQLSDRPAYRNVVMIPLPVRLVGQDIQIPIRPHPHVANTLVPVAQNAPVLRHLVSLHAQHDHVLLLQRADKQLVFPLRENVAVVERHAAHRG

SEQ ID NO: 146598 - protein, 63 aa, Glycine max
  Coding DNA Sequence Number=SeqID_29820
  Homolog annotation: Hit_ID=Q7CQJ4; Match level="QueryCoverage=76%, HitCoverage=81%, E-value=3e-13, Identity=69%"; Hit description =Putative cytoplasmic protein
VSAMTQTKQRGGAGNFAEDPERAREAGSAGGKVSGGNFRNDPERAREAGRKGGQKSRRPSKQK

SEQ ID NO: 146599 - protein, 127 aa, Glycine max
  Coding DNA Sequence Number=SeqID_29821
MKKMKAHGVCGGLCCIGATSGIKAGLALSQIHSSRRRGQRRRHPLENKPWKEKLHHQESALDKKLREEASMEEENERERDRRGGMEIEGEEAEKLNFEVRLTSFSFIKVMTSVTHASIYSLAHGKLP

SEQ ID NO: 146600 - protein, 117 aa, Glycine max
  Coding DNA Sequence Number=SeqID_29822
AEIPYGHPRLSSTKGKDFDGIRMMLAGRSGAMEKGSNMVVQPCRFQDAEKSKGSIVAQSVKFRNIPEVKEGVVAGMQIAIRPTWAFKDVPTEGGAFWWKQPSSPRRVERQPPPSFPL

SEQ ID NO: 146601 - protein, 61 aa, Glycine max
  Coding DNA Sequence Number=SeqID_29823
  Subcellular localization annotation: CTP_CleavageSite=45; ConfidenceScore=5.35e-01
MSYGHTKRSCALSAPYKTAKNYKMNAISPSVSLSTFIFSVQLSVELAKRSYALSEYCVLDT

SEQ ID NO: 146602 - protein, 132 aa, Glycine max
  Coding DNA Sequence Number=SeqID_29824
MSALCKASKLHIVQWSASGRHHVGACSVRIVPSGKWRLINPSQAHYCQLAAEFPFWEIPQRVGVYVGIGSCIWSGLYRKWILWVMLGRSLRLVRCSRSEGRWVGRRTDIGRVVVLIVAFDLDDKITNQLTKD

SEQ ID NO: 146603 - protein, 53 aa, Glycine max
  Coding DNA Sequence Number=SeqID_29825
MVVTIRMTTVQHLVIVNKKRRLIIYRIKLDLNRASKEITKATKGSTITASSTR

SEQ ID NO: 146604 - protein, 421 aa, Glycine max
  Coding DNA Sequence Number=SeqID_29826
  Gene Ontology: Mol. function=transcription factor activity; Cellular component=intracellular; Biological process=regulation of transcription, DNA-dependent
  Homolog annotation: Hit_ID=Q7WAN7; Match level="QueryCoverage=46%, HitCoverage=86%, E-value=2e-76, Identity=75%"; Hit description =Putative gntR-family transcriptional regulator
MRQHLLRLAAQHHGGHAAAAVRSHGDQVAVALAGRVDDGLVRIFVGGAQRFARHAGFARLGGGRAQEAFGLGADLVLVLAQAVGHLRRAHGEDVEGFLDREDGGLGAQRPGQLEAFDQGFRGQLRAVRGNENVLVHGVSRVCAAAAATCGGYVTLYRAGDGRRLRVIKGCARSNRHAWRRVLVHQRAGAVDVAGASGFDEGVVLARGTTGVVRALVQHGDHGAARRQLAQHAGQHRVADGLGQQDVEVTQQAVARLHVAAFHGRAFLGQVGVDAAVVGRRGAGDELPRQRGFEDAAHRVDLARLVGVGLADEGALVGHDVDQLVLGQHQQGGADLGPADLVDACQGLFAQAGAGRQAVRHDGGGDFLGDVVGAGVGRYCLGHEARGREDGMGSQSIKNPRTQHLLHTKIVGEPAFRAPGGA

SEQ ID NO: 146605 - protein, 109 aa, Glycine max
  Coding DNA Sequence Number=SeqID_29827
MDPEEPNRALSSSGYGPLSVLQGARPPQDRTRKTPSGPEEVQQGPRFYGVPVAPSKFIKPPINRAFIKKYYAPRQAQGETPQQPRDGRQRATNALPPLLEFTLAHPRKG

SEQ ID NO: 146606 - protein, 116 aa, Glycine max
  Coding DNA Sequence Number=SeqID_29828
MAEEGRTPSTRRAYSFSSSLELNCHHKKGGDCRSKDFAFDVLMMPYDHDVLMPYENALFKFNSRQKSKNNGYNNKKISSVLGREFQIETAKGLAKKFKQKCLFQEIYSLVIDYQRM

SEQ ID NO: 146607 - protein, 54 aa, Glycine max
  Coding DNA Sequence Number=SeqID_29829
MSQNFMDCLTMGVKFLEAVKRRLHAIKQWSPDEIREPIGKITKIVFSPHRGLRT

SEQ ID NO: 146608 - protein, 107 aa, Glycine max
  Coding DNA Sequence Number=SeqID_29830
  Homolog annotation: Hit_ID=Q652J3; Match level="QueryCoverage=76%, HitCoverage=36%, E-value=5e-08, Identity=38%"; Hit description=Auxin responsive protein-like
  Pfam annotation: Domain name=Auxin_inducible; Domain location=1-97; Score=35.3; E_value=6.5e-09; Accession=PF02519.5; Description=Auxin responsive protein
MGARESKLRKWVMSGGSAYYKRLEGTLLVPKGYVPICVGKTDDTCKRFMVHTRALRDAYFKELLGRSAEEYGFKNEGVLRIQFEAQDFEEWLIKRSNSNEKITNEST

SEQ ID NO: 146609 - protein, 232 aa, Glycine max
  Coding DNA Sequence Number=SeqID_29831
  Gene Ontology: Mol. function=oxidoreductase activity; Cellular component=integral to membrane; Biological process=electron transport
  Homolog annotation: Hit_ID=Q8S7V0; Match level="QueryCoverage=90%, HitCoverage=57%, E-value=3e-52, Identity=62%"; Hit description =Putative plant cytochrome P-450 protein
FIFHVFKIRDETNLILVAPFRDLCNMGGMHDWLVNYFSKSKTIVVPMPFTTYTYIADPANVEHVLKTNFNNYPKELLMRMTLDSICKVGFGVEIGTLAPNLPENSYAHAFDTANIIVTLRFIDPLRKIKKMLSIGSEVQLEKSIKVIDDFTYSVKQDILSRFIELGESNATDKSLKDVVLNFAIAGRDTTAPTLSWAIYMFMTHAHVADKLYLELKKFEENRANEEHFLASM

SEQ ID NO: 146610 - protein, 139 aa, Glycine max
  Coding DNA Sequence Number=SeqID_29832
  Gene Ontology: Mol. function=oxidoreductase activity; Cellular component=membrane; Biological process=electron transport
  Homolog annotation: Hit_ID=Q9C788; Match level="QueryCoverage=90%, HitCoverage=24%, E-value=2e-29, Identity=72%"; Hit description =Cytochrome P450, putative
MSFTKDPKGILEDDVLPDGTKIKAGGMVTYVPYSVGRMEYNWGPDAASFVPERWFKDRVLKTESPFKFTAFQAGPRNMPWQGLCISSDEDGASYFVQILQVQLGARSCSEIQDDDYTINGIWFETYHRETFLRCFQEYT

SEQ ID NO: 146611 - protein, 139 aa, Glycine max
  Coding DNA Sequence Number=SeqID_29833
  Gene Ontology: Mol. function=DNA binding; Biological process=DNA integration
  Homolog annotation: Hit_ID=Q1SKC8; Match level="QueryCoverage=71%, HitCoverage=23%, E-value=1e-30, Identity=62%"; Hit description =Integrase, catalytic region
MRMNAYESSKIYKQKIKAYHDKKLQRQNSQPGQQVLLFNSRLRLFPGKLKSKWSGPFVIKEVRPHGFVELVDPTTHTPEKRWIVNGERLKIYNGGQLERLTRFCLGSSQTISPPEDGSTAVDPRGLHLAGCLARSPTLY

SEQ ID NO: 146612 - protein, 59 aa, Glycine max
  Coding DNA Sequence Number=SeqID_29834
MEEKEEFPKGEFSVRVPVFVLSACTCACICAYHASSSPSANACFRGECTLRAERILGWA

SEQ ID NO: 146613 - protein, 631 aa, Glycine max
  Coding DNA Sequence Number=SeqID_29835
  Gene Ontology: Mol. function=DNA binding; Cellular component=nucleus; Biological process=transcription from RNA polymerase II promoter
  Homolog annotation: Hit_ID=Q6YU01; Match level="QueryCoverage=70%, HitCoverage=52%, E-value=4e-48, Identity=66%"; Hit description=CCAAT- box-binding transcription factor-like protein
  Pfam annotation: Domain name=CBF; Domain location=140-374; Score =139.1; E_value=1.2e-38; Accession=PF03914.7; Description=CBFMak21 family
DALNSFLCLRYERFVVALEEASRDMLPALKNKALKAVYVLLSRKSEQERRLLSALVNKLGDPDNKAASNADFHLSNLLSDHPNMKAVVIDEVDSFLFRPHLGPRSQYHAVNFLSQIRLTNKGDGPKVAKRLIDVYFALFKGVNRAFPFVSSNEADDIVDIQTPAEMFIALLLRAMKRDINLKRVAAFSKRLLQIALQQPPQYACACLFLLSELLKARPPLWNMVLQNESVDEELEHFEDVIETDNEPSTVSTKQNDDIGVVQNGEDGNSDSSSSESEDDLPASSEDDDLDDDASEDADFLLAKNEKEHKKPKKSKSVSDKEGQQSQLSVKKSSLPGGYDPRHREPLYCNADRVSWWELMVLASHAHPSVATMAKTLLSGANIVYNGNPLNDLSMTAFLDKFMEKKAKRSTWHGGSQIEPAKQMDVNNQLIGAEILLLAEEDVPPEDLVFHKFYTNKMSSSTKPKKKKKKSADEEAAEELFDVDDGEVDGGDESDNEEIENLLDSTDPTLGPDSDYDYDDLDEVADEEDEDLIGDVSDAEMNMDIPSDMEEEEVDASPPDDDDIDIQVGDVDDASDGDEEEAGKRKRKHESGGKKGVSPFASYEEFEHLMEDDDHAEKKSYPKKTKSKKRKG

SEQ ID NO: 146614 - protein, 84 aa, Glycine max
  Coding DNA Sequence Number=SeqID_29836
MPVVDCMDIISREEDLPLKYMQQNHYPVQYTSSSASRKSMVSIQIKTLNEKAWLKLKVVPATASTGLISGNRSYWTTGWYVKYT

SEQ ID NO: 146615 - protein, 173 aa, Glycine max
  Coding DNA Sequence Number=SeqID_29837
  Gene Ontology: Cellular component=nucleus; Biological process =response to oxidative stress
  Homolog annotation: Hit_ID=Q94EN7; Match level="QueryCoverage=79%, HitCoverage=90%, E-value=4e-44, Identity=65%"; Hit description=Small heat stress protein class CIII
  Pfam annotation: Domain name=HSP20; Domain location=65-171; Score =98.2; E_value=2.5e-26; Accession=PF00011.11; Description=Hsp20alpha crystallin family
MTKNQSLHCCEKMSRVGADVLNVDLAAAVNNLFNLPETMQKFIFPSSRAPDQHETRGISSIIPVDILDTSKEYIFFMDVPGLSKSEIQVIVEDENTLVIRSNGKRKRQDGEDEECKYLRLERRGPQNLLRKFRLPENANVSAITAKCENGVLAVVVEKHPPPPKSKTVEVAIA

SEQ ID NO: 146616 - protein, 102 aa, Glycine max
  Coding DNA Sequence Number=SeqID_29838
MRLYIEENPPRLVALGRVYEGFTTVHNIPLLHDQVKVSVEEVKGADAPIPVPTDKVMWDATMFVVFNEDFPLYIKNEDLPKIDTVVNVSASLSYSCGFSKSI

SEQ ID NO: 146617 - protein, 82 aa, Glycine max
  Coding DNA Sequence Number=SeqID_29839
MKNWMQNSKRDVYLGAYQNGTNNYLKGIINSNINILMFPVFSSALKRLDDTPQPKSKAGARWIVVKCNRQKGSTECGYSLMH

SEQ ID NO: 146618 - protein, 77 aa, Glycine max
  Coding DNA Sequence Number=SeqID_29840
  Gene Ontology: Mol. function=oxidoreductase activity
  Homolog annotation: Hit_ID=Q5ZBH8; Match level="QueryCoverage=79%, HitCoverage=19%, E-value=3e-11, Identity=61%"; Hit description =Putative auxin-induced protein
MDNLISNTNGYTKDILLVVAFLAAKELRKMPAISSLKAHPRFQAENKNIYKRIEGLVKKHQAIPAQLALAWVLQQGD

SEQ ID NO: 146619 - protein, 787 aa, Glycine max
  Coding DNA Sequence Number=SeqID_29841
  Homolog annotation: Hit_ID=Q10C07; Match level="QueryCoverage=94%, HitCoverage=84%, E-value=8e-51, Identity=27%"; Hit description =Expressed protein
  Pfam annotation: Domain name=DUF593; Domain location=523-615; Score =145.6; E_value=1.3e-40; Accession=PF04576.6; Description=Protein of unknown function, DUF593
MATTGISSSEWRKLSPGVTTALASAFLEWLLIFFLFIDAVFSYVIAKFAGYCKLQIPCLLCSRLDHVLGKEDLICSGHKTEISSLVLCRAHDKLVNVQGMCESCLFSFATINKSNAETYRLLVGKLGEGSVTRFDQDPLLGENSKCCSCCNEQWVLKGYDRRLVITKSIGSGNADFDESNVVGNKFHKKRRAKPFVSSRATHLRNKQADPLSHVGYTELKITSDTESEPDVSLSDDDGTSIPVQGTYDTKEDIEVPCEHMEPHIPDSNENLAFEKLGTSASGLQPSLSESGMQLENTDVHGTKSTAETTESRDGLAKLDSQQHVERNAVCASPRELISFNEVPASSNKIGVPVEVSKENYDLTTDEVGTKSKQRITTDCGEIIESVDKLTTSEAGLESTPFSSDIGQQNPNLLDLGDAYKLAVSNSRGRPGMPVEHWLGKDSTRISEDLKILLSQFSATRGTDLSVNDISPRLSINSDEVKTSDVSNSAGIQILQKMISLERNEYGLSLDGSLVSEIEGESAVDRLKRQVDHDRKLNALYKELEEERNASAVAANQALAMITGLQEEKATLHMEALQYLRMMDEESEYETEALQKANCLLVEKEKEIEELEAKLELYRKKFPDESVLESMVDTNSEMKDESILGKSVSENTNISDKSEVLPTSLEKQNVQSVKNSPLEFQDERLYISQRLKKLEKQVYFFLNIHQSRDNWLNSENDEKESLENCEKLDNNILMQETVCSPKLNSDDMGDDSSSKEPPVCKQNGELGYNGHSSPALCRNNDLSSTGSL

SEQ ID NO: 146620 - protein, 445 aa, Glycine max
  Coding DNA Sequence Number=SeqID_29842
  Gene Ontology: Mol. function=nucleic acid binding; Cellular component= nucleus; Biological process=transport
  Homolog annotation: Hit_ID=Q9SR14; Match level="QueryCoverage=100%, HitCoverage=59%, E-value=0.0, Identity=71%"; Hit description=Mutator- like transposase
MANHDLILGQSHNLALGHDQQLMLNHNHSLGLSGNHDLELRRTDDQHLGLEQTHDHEPVLGIVNDHELDLGLNHDDEGVHTYGHENELSMDQKPEHDDHEMPIPTQNHDLDIPENNDLAVSENQEFDENMALTVVQNPEMSIESAEAIGFHESQLMVTTPPVIQARTLAISPNYELSVGQEFPDVRSCRRALRDTAIALHFEMQTIKSDKTRFTAKCQSEGCPWRIHAAKLPGVPTFTIRTVHESHTCGGISHLGHQQASVQWVATSVEQRLKENPNCKPKEILEEIHRVHGITLSYKQAWRGKERIMAAMRGSFEEGYRLLPQYIEQVKRTNPGSIASVYANPTDNCFQRLFISFQASIYGFLNACRPLLELDRIYLKSKYLGTLLLATGFDGDGALFPLAFGVVDEENDDNWMWFLSELHNLLEINTENMPRLTILSNRQKGI

SEQ ID NO: 146621 - protein, 145 aa, Glycine max
  Coding DNA Sequence Number=SeqID_29843
  Gene Ontology: Mol. function=nucleic acid binding
  Homolog annotation: Hit_ID=Q9SR14; Match level="QueryCoverage=91%, HitCoverage=16%, E-value=3e-49, Identity=71%"; Hit description =Mutator-like transposase
  Pfam annotation: Domain name=SWIM; Domain location=6-40; Score=27.1; E_value=6.2e-05; Accession=PF04434.8; Description=SWIM zinc finger
  Pfam annotation: Domain name=zf-CCHC; Domain location=126-143; Score =15.9; E_value=0.0023; Accession=PF00098.13; Description=Zinc knuckle
  Pfam module annotation: Pfam domain module=SWIM::zf-CCHC; Domain location=6-40::126-143
MLQRLLIVHGHTRTRCCQCRGWQLYGLPCAHAVAALLSIRQNVHRFTESCFTVATYRKTYSQTIHPIPDKSLWKELSEAEGDVNASNADQLQLQIAMNPPKSLRPPGRPRKKRVRAEDRGRVKRVVHCSRCNQTGHFRTTCAAPI

SEQ ID NO: 146622 - protein, 423 aa, Glycine max
  Coding DNA Sequence Number=SeqID_29844
  Gene Ontology: Mol. function=RNA binding; Cellular component =ribonucleoprotein complex; Biological process=gynoecium development
  Homolog annotation: Hit_ID=Q58T16; Match level="QueryCoverage=91%, HitCoverage=59%, E-value=1e-137, Identity=66%"; Hit description=FLK
  Pfam annotation: Domain name=KH_1; Domain location=140-244; Score =42.9; E_value=1.1e-09; Accession=PF00013.19; Description=KH domain
  Pfam annotation: Domain name=KH_1; Domain location=360-422; Score =56.8; E_value=6.9e-14; Accession=PF00013.19; Description=KH domain
  Pfam annotation: Domain name=KH_1; Domain location=48-110; Score =51.0; E_value=4.1e-12; Accession=PF00013.19; Description=KH domain
  Pfam annotation: Domain name=KH_2; Domain location=140-185; Score =5.9; E_value=0.024; Accession=PF07650.7; Description=KH domain
  Pfam module annotation: Pfam domain module=KH_1::KH_1::KH_1::KH_2; Domain location=140-244::360-422::48-110::140-185
MAEVDQYTGGEHEVEETIEVEAEEEMHGGEEAVVVAEKKWPGWPGESVFRMLVPAQKVGGIIGRKGEFIKKIVEETRARVKILDGPPGTVQRAVMISAKEEPGSSVPPAVDGLLRVHKRIIDGLESDFTHAPSGVAGKVSTKLLVPASQAGSLIGKQGGTVKSIQEASNCIVRVLGAGKVELFALCTTAVIEHNLDMLLSDSLLLTICMAFSSAEDLPIFALQDDRVVEVVGDPTGVHKALELIASHLRKFLVDRGVIPIFEMNMQTANTHHAEHMPPHQSWGPPQGLPPNVGGGSGFGPPSQYMPPPRQLDSYYPPAEMPPPVDRQPHQGISAYGRDASIGVHASSNTQSAPSIVTQITQQMQIPLSYADAVIGTAGASISYIRRASGATVTIQEARGVPGEMTVEISGTASQVQTAQQLIQ

SEQ ID NO: 146623 - protein, 305 aa, Glycine max
  Coding DNA Sequence Number=SeqID_29845
  Gene Ontology: Mol. function=nucleotidyltransferase activity; Biological process=RNA processing
  Homolog annotation: Hit_ID=Q9LSZ7; Match level="QueryCoverage=71%, HitCoverage=36%, E-value=2e-31, Identity=40%"; Hit description =Similarity to polyA polymerase
HRRPDVHIKTAINKKLNTTADGKVPKTAPQWLELKTHVQRGGYECGYYVMHWMWNIIGAKLKSDWNVVLSSCMRGRKHTVVTAETIKGRLLMEMNYMLAYGSGKASLRLLWNSGSLDILLPFEAAYLLNMDFKDRIEEPICFWQQPYRCTKSHTLSVPVTGLWTIHFSFWDLELKPENGSGGMGIKIGWTKLSTSGIYVFRVGILALHKALSDRLRDPLAVAAFSLAVHNGGNLLEAINITGMINKPHDARFPELLDPSGLDAEALEAEILDLAESVRGTILQMTNEHFVSQAMADYPQSPRSNL

SEQ ID NO: 146624 - protein, 161 aa, Glycine max
  Coding DNA Sequence Number=SeqID_29846
MGREVTGIQVMEKKPNGAIGASNGSLSDRMRVSPKIAAMVQAMDHEIKESAEANSFEKHHERKDVLSAKNMKLNAGLPEEENEKSDQVPSPSAPQPSDQVTEKHVTHAQAVDTEADASGLNLSPKANNIHSPNSSKNSQTGRERPLKWVPPGKTSNVCLEN

SEQ ID NO: 146625 - protein, 228 aa, Glycine max
  Coding DNA Sequence Number=SeqID_29847
  Gene Ontology: Cellular component=nuclear pore; Biological process =transport
  Homolog annotation: Hit_ID=Q9LJH6; Match level="QueryCoverage=66%, HitCoverage=12%, E-value=3e-53, Identity=71%"; Hit description =Arabidopsis thaliana genomic DNA, chromosome 3, P1 clone: MAG2
MKKERVLSLPLPLRSSLLPLPLLCLFLVTIKFVVEKVINYSGVISPQAKHIDPEMAMSQLQTSTIDMLDLAVEYIKNLQQVVNVSISSRDSYCIDVVLRCLAITDDGLEPHHLNDGGILGTIMAAGFKGTITGELPRFQAGVTMEISCLDAWYSDKDGTLECRATYIVKGLCRRCCLPEVILRCMQVSVSLMGSGVLPDCHDTLIELVGSPETDFLHLFSQQQLQARL

SEQ ID NO: 146626 - protein, 468 aa, Glycine max
  Coding DNA Sequence Number=SeqID_29848
  Gene Ontology: Mol. function=nucleic acid binding; Cellular component= cytoplasm; Biological process=negative regulation of cytokine biosynthetic process
  Homolog annotation: Hit_ID=Q2XPV3; Match level="QueryCoverage=99%, HitCoverage=100%, E-value=3e-95, Identity=68%"; Hit description =Oligouridylate binding protein-like protein
  Pfam annotation: Domain name=RRM_1; Domain location=111-172; Score =40.9; E_value=4.3e-09; Accession=PF00076.12; Description=RNA recognition motif. (a.k.a. RRM, R
  Pfam annotation: Domain name=RRM_1; Domain location=24-93; Score =34.0; E_value=5.2e-07; Accession=PF00076.12; Description=RNA recognition motif. (a.k.a. RRM, R
  Pfam annotation: Domain name=RRM_1; Domain location=318-380; Score =16.3; E_value=0.0045; Accession=PF00076.12; Description=RNA recognition motif. (a.k.a. RRM, R
  Pfam module annotation: Pfam domain module=RRM_1::RRM_1::RRM_1; Domain location=111-172::24-93::318-380
MQNHRLKQQQQALMQQALLQQQSLYHPGLLAPPQVTEPLLQEVFAGTGPVEACKLIRKDKSSYGFIHYFDRRSAALAILSLNGRHLFGQPIKVNWAYASGQREDTSGHYNIFVGDLSPEVTDATLDARVMWDQKTGRSRGFGFVSFRNQQDAQSAINDLTGKKFVIGLTTLDGKWLGSRQIRCNWATKGAGGTEEKQNSDAKSVVELTYGSSDGKETSNSDAPENNPQYTTVYVGNLAPELCLGDLLVMGSNPETASLHMQGASPGAAVKLCLGDLLVMGSNPETASLHMQGASPGAAAAYNIPPPYLRIAKSLWAMGYEATQLDLHHHFHSLGAGVIEEVRVQRDKGFGFVRYSTHAEAALAIQMGNAQSLLCGKQIKCSWGSKPTPAGTASNPLPPPAAASLPGLSATDLLVYERQLAMSKMGGVHALMHPQGQHPLKQAAIGASQAIYDGGFQNVAAAQQMMYYQ

SEQ ID NO: 146627 - protein, 314 aa, Glycine max
  Coding DNA Sequence Number=SeqID_29849
  Gene Ontology: Mol. function=binding; Cellular component=thylakoid; Biological process=photosynthesis
  Homolog annotation: Hit_ID=Q8LRH2; Match level="QueryCoverage=72%, HitCoverage=65%, E-value=1e-77, Identity=66%"; Hit description =Tetratricopeptide repeat(TPR)-containing protein-like
  Pfam annotation: Domain name=TPR_1; Domain location=241-274; Score =9.2; E_value=0.43; Accession=PF00515.18; Description=Tetratricopeptid e repeat
  Pfam annotation: Domain name=TPR_1; Domain location=281-314; Score =15.2; E_value=0.083; Accession=PF00515.18; Description =Tetratricopeptide repeat
  Pfam annotation: Domain name=TPR_2; Domain location=184-217; Score =7.1; E_value=5; Accession=PF07719.7; Description=Tetratricopeptide repeat
  Pfam annotation: Domain name=TPR_2; Domain location=241-274; Score =5.8; E_value=6.9; Accession=PF07719.7; Description=Tetratricopeptide repeat
  Pfam annotation: Domain name=TPR_2; Domain location=281-314; Score =13.7; E_value=0.7; Accession=PF07719.7; Description=Tetratricopeptide repeat
  Pfam module annotation: Pfam domain module=TPR_1::TPR_1::TPR_2::TPR _2::TPR_2; Domain location=241-274::281-314::184-217::241-274::281-314
MVMLIRCSCFFARPRFSQPQFYGNNTKPLLPGKLAFLSLKPDKGVPHFEDTLDGSSKISCLLHCSKCKEDIHQRFPSLIFVASNVLMFSMPNTALAETCEADNSVFNMPILLAVALIGATVGGLLARQRRNELQRVNEQLIQINAALRKQAKIESYAPSLSYAPIGGGRILDNEIIVDPKKQELISKLKNGKNFLRNQQPDKAFTEFKNALELAQNLKDPIEEKKAARGLGFYKVLHEYTIEMLHITGASLQRQGKYRDAIKYHSMVLGISEREGEDSGSTEAFGAIADCYTELGELEKAGQFYDKYIARLEKD

SEQ ID NO: 146628 - protein, 35 aa, Glycine max
  Coding DNA Sequence Number=SeqID_29850
MGVSFKVSKTGTRFRPKSIPQLQDGSSDNSKSQPI

SEQ ID NO: 146629 - protein, 271 aa, Glycine max
  Coding DNA Sequence Number=SeqID_29851
  Gene Ontology: Mol. function=hydrolase activity, acting on ester bonds; Biological process=lipid metabolic process
  Homolog annotation: Hit_ID=Q8L8G1; Match level="QueryCoverage=67%, HitCoverage=48%, E-value=9e-31, Identity=42%"; Hit description =Lipase SIL1
  Pfam annotation: Domain name=Lipase_GDSL; Domain location=44-266; Score=2.1; E_value=0.0012; Accession=PF00657.12; Description=GDSL -like LipaseAcylhydrolase
MAKNSTTLSACLEGEASAISRLNNNAFPKMLHELEKQLKGFKYSITELYGALTELKYESAAEHFAKLMWSGNRDVTVTEYAELPLIPPYLHPGYHDHQYIYGVNFASSGAGDLPETNPGLVIDLKTQALYFAQVGKLLRKILGEEKAKKLLSTAVYIFSVGTNDYAVPFYTNSNGTVVLPYPQQIFIDLVICNITTAIKGIYNEGGRKFGFVNVAPLNRSPFLRTFVNGTTIDACLKEQGSALARLHNNSLSQITSKARKTTNKGIQLLNS

SEQ ID NO: 146630 - protein, 71 aa, Glycine max
  Coding DNA Sequence Number=SeqID_29852
MENYRRKYKALAQSMKKWGGWNCEMGCGVTVLPLPVVNGKVDVFTGSAICNGQHASCIMCADHTCLAQVPF

SEQ ID NO: 146631 - protein, 69 aa, Glycine max
  Coding DNA Sequence Number=SeqID_29853
MATFWMFPGLSSPRPASGLPGPWNAFILKQPALLGELIPSAMNDSGIEKKEREETPLQGEDESRRNSPP

SEQ ID NO: 146632 - protein, 114 aa, Glycine max
  Coding DNA Sequence Number=SeqID_29854
MVKKPAHLGELTASGLSFSSPGRAATVPKFQGSKVERIERRRKEEETKLRHYRIGTVIVPTLFLVRCSSHQSIFQENDRSYPAQVVAAQIRTLLYKHEGCTSFSTKSGIEELFL

SEQ ID NO: 146633 - protein, 65 aa, Glycine max
  Coding DNA Sequence Number=SeqID_29855
MTTEAVKWWQQCGGCDGMVATVWWLWWNGGNGSGGGKGNGGGDMVMVKCKHTKTGGHVFRLYVLG

SEQ ID NO: 146634 - protein, 85 aa, Glycine max
  Coding DNA Sequence Number=SeqID_29856
SDLVEAGENIAQIPQSSVSSETLSLADREASFTLNLFPDGYSIGKPSENEAASQSKYQDFPKSLHPYDRSSESLFLVIVLEVGTL

SEQ ID NO: 146635 - protein, 500 aa, Glycine max
  Coding DNA Sequence Number=SeqID_29857
  Gene Ontology: Mol. function=nucleic acid binding
  Homolog annotation: Hit_ID=Q1RWN3; Match level="QueryCoverage=81%, HitCoverage=95%, E-value=1e-110, Identity=54%"; Hit description=Zinc finger, CCCH-type; DNA-binding SAP
  Pfam annotation: Domain name=SAP; Domain location=90-124; Score=42.7; E_value=1.2e-09; Accession=PF02037.17; Description=SAP domain
  Pfam annotation: Domain name=zf-CCCH; Domain location=469-494; Score =30.7; E_value=5.3e-06; Accession=PF00642.15; Description=Zinc finger C-x8-C-x5-C-x3-H type (and similar)
  Pfam module annotation: Pfam domain module=SAP::zf-CCCH; Domain location=90-124::469-494
MATKNLPMELHEITTEFEGSDPDSEWDDSKEDPDFDLLEETHSKFSILSLKHKAKARVVEDKGLGEEVNASAHDGENFQKVQKLIQVGPLEKLKVDECKLYLRKNGLRLTGNKDTLIQRIKEHLDILNGGEKKYPPSSFVLNCKGDACTGDVVLFEQNVYEMFNIASRSASGPPCGKRIVAGRIVKESYGAAKQQHTFTCCGLHFLKDFCYIPRKKHIIPLGQQYKELRNNMLFLKIEVLWSKGEKPLPPLYPLLIKGRNLYRLKTLRQKWEDEAKRQKILMEKHSRGSLAREDREARMQEKEKRKKIKENRVSKKDSARNQSQSNSHITRPQYQPQETNVPINPEKPEFPSRNSGLSANIRKETSSIVHKPAAVTGHHVDSKTLGRTSFTDNMHNQQAWSTGDCRNISDIGHMRRGADHSAYYNYGDSHFREKPTVILKYHHHYHHRMPLANANHSQQVLPDRESYDKQKQVCRHYARGRCYYGDNCKFLHDLRDKGNV

SEQ ID NO: 146636 - protein, 184 aa, Glycine max
  Coding DNA Sequence Number=SeqID_29858
  Subcellular localization annotation: CTP_CleavageSite=47; ConfidenceScore=5.09e-01
MAKTRPDAKASAGKKKKVLKKGPPSSQIAKRSQILHRKGPFSSQPAQVDYVATEDHLLTLPNTHSADLLAQQFCSLFNLPIVDGTRRICEGSARIQLKPNRVNLPLGNQSTSPYNAVAEMQQYGEAIPGQPSIEVAKPASGSNAPINLSQNLVTNPRILPPGNPQALQMPQGLLSGLTTCSTAC

SEQ ID NO: 146637 - protein, 118 aa, Glycine max
  Coding DNA Sequence Number=SeqID_29859
  Gene Ontology: Mol. function=ribonuclease H activity
MLQIPFIIIKNAIVSPLPNPPHRSDTGTPSSTILRFNPSEDILHKESGSVIEPHAHPRNGDNLVDNGGNPHWDGSNECRQQKRPCSSEIWWCSLGGSYGEPAKASISASQEFLISTTT

SEQ ID NO: 146638 - protein, 1212 aa, Glycine max
  Coding DNA Sequence Number=SeqID_29860
  Homolog annotation: Hit_ID=Q7XEZ9; Match level="QueryCoverage=86%, HitCoverage=76%, E-value=2e-95, Identity=31%"; Hit description =Expressed protein
MYLEAIESGHLPGDILDDIPAKYVDGALICVVHDYRRCSSDKGSSVSAESSTVSKVCLKMSLENIVKDIPSITDKSWTYGDLMEVESKILKALQPKLHLDPTPKLDRLCESPLPTKLNLPRKRLKNMPEFAVTSTNKIHGKKVCIDRVQESSISRVGDVGNTASNAIVQQTHENPAMQNLSPNVAMALRSKNFIPDSSIPNFPMMTHQSRYAMAVGTQRSLQEQGPAPSINSSVASPATQYADNANSGASLLGKRDNQDGQASPLSNIAKRMRPGSTVVDAMQHQQIGSHVEALQGSDMNWQNSLQQQPMARGIQYASGGIQKFPQQVFEGGANQETGAIPFASSQQGMRLVAKEEQFEMEKLDGAEINCNKSDMEMEMNNLDPQQLRLQQRLPQHAFMRPNFPQAAWNSLGQHMGKETKKEDQLQKRKSVQSPRLSSAALPHSPLSSKSGEFSNGAVGPSFGPSAMAAAPGTSQKDKAAMASVPATVGTPSNDSTQRQHAQLAAKRRSNSLPKTPAMNGVGSPVSVGTTSVPLNANSPSVVTSGFVDQNLQNMLERFSKIEMVTMRHQLNFKKNKVDDYPIKKQNPYVPNNLSALLANANATNNEGLPEESISISKSLIGGSMNACKMRILNFCVPERVVQGSIVTIIPRMRTRMIMFEKSDGTVAMHCGVIEEVDYVAAEDHLLTLPNTFDYVAAEDHLLTLPNTHSADLLAQQFCSLMVREGYVKEDDRIQLKPNRVNLPLGNQSTTPNNAVVEMQQYGEVIPGQSSNEVAKPASGSNAPINLSQNLLTNPRMLPPGSPQALQMSQGLLSGVSMASRPQQMDSQQAVQQQQQQQQQQQQQQQQQQQQLQQNQHTLIQQQNPQFQRSPMMLGTNQLSHLNPVGQNSNMPLGNHMLNKPSALQMQMFQQQQQQPQMQRKMMMGLGQAVGMGNLRNNLVGLAPMGNPMGMGGARGIGGSGISAPMTSIAGMGNMGQSPMNLSQTSNITNSISQQFRSGSLNAAASADLISRLRLVHSNRQSMLGSPQSNLASISGARQIHPGATPSLSMLGRANTMQRPIGPMGPPKMMAGMNLYMSQQQQHQQPQQQQQQHQQQLQLQQHMQQQLQQQQQQQETTSQLQSVVSPPQVGSPSMGVPPLNQQTQQQASPQQMSQRTPMSPQMSSGAIHAMSAGNPEACPASPQLSSQTLGSVSSITNSPMDMQGVNKSNSNAQ

SEQ ID NO: 146639 - protein, 119 aa, Glycine max
  Coding DNA Sequence Number=SeqID_29861
  Homolog annotation: Hit_ID=Q40538; Match level="QueryCoverage=32%, HitCoverage=69%, E-value=1e-07, Identity=82%"; Hit description =Nicotiana tabacum (clone 5) activating factor DNA sequence
MKHSSKLESGGHNQAYRYRRPRGGARYQLLFPLVRVNFELGVIMVIAVSGGRQIIAIVGLQRGIPSKRESSARVDYVPALCTHRPSLLSIEWSGVVFGLRRRERFADRDVVRSPLNLII

SEQ ID NO: 146640 - protein, 107 aa, Glycine max
  Coding DNA Sequence Number=SeqID_29862
MLCRDDSRGDTVSGAPGESHLTDLSSLAHEAPGFVFVARDEEAGRTGRRGHPLPPDGSVDFSQRRGQRTAHVAAIRTRHRTIQSIGATGGVYKGQGRSQRELKTRAY

SEQ ID NO: 146641 - protein, 593 aa, Glycine max
  Coding DNA Sequence Number=SeqID_29863
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=66%, E-value=0.0, Identity=57%"; Hit description =Receptor-protein kinase-like protein
  Pfam annotation: Domain name=Pkinase; Domain location=303-575; Score =129.1; E_value=1.2e-35; Accession=PF00069.15; Description=Protein kinase domain
  Pfam annotation: Domain name=Pkinase_Tyr; Domain location=303-575; Score=117.2; E_value=4.7e-32; Accession=PF07714.7; Description =Protein tyrosine kinase
  Pfam module annotation: Pfam domain module=Pkinase::Pkinase_Tyr; Domain location=303-575::303-575
MVRLNVGGQYISPTHDSGLTRMWYDDTPYLYGAGTGVTNQAEKNVPIDYQTMPKYIAPSDVYSTSRSMGTDKDVNMGFNLTWIFQVDPNSMYLVRLHFCDYYYSKVNEIVFDVFLNNQTAQAQADVIGWTGGKGVPTYKDYVIYVQDGEGDDKLWLALHPSPDSKPEYYDAMLNGVEIFKLNDTDLSGPNPQLSEMLLRQQKEDEEAGFTSHRAYHKHAVIGGAAGGAAGLAFMAALCVVYNKKKRAPGSEGQTSWLPIYLNSHSKSSASSGKSVSSANLSAMAQGLCRYFSLQEIKQATKNFDEANVIGVGGFGKVYKGVIDNGMKVAIKRSNPQSEQGVNEFQTEIEMLSKLRHKHLVSLIGFCEENDEMCLVYDFMALGTMREHLYKGNKPMSTLSWKQRLEICIGAARGLHYLHTGAKYTIIHRDVKTTNILLDENWNAKVSDFGLSKTGPNMNTGHVSTVVKGSFGYLDPEYFRRQQLTEKSDVYSFGVVLFEALCARPVLNPSLPKEQVSLADWALLCKQKGTLEDLIDPCLKGKINPESLNKFVDTAEKCLSDHGTDRPSMNDLLWNLEFALNLQENVEGGSTHSA

SEQ ID NO: 146642 - protein, 335 aa, Glycine max
  Coding DNA Sequence Number=SeqID_29864
  Gene Ontology: Mol. function=binding; Cellular component=thylakoid; Biological process=photosynthesis
  Homolog annotation: Hit_ID=Q9SR03; Match level="QueryCoverage=61%, HitCoverage=45%, E-value=2e-79, Identity=70%"; Hit description =Ankyrin-like protein
  Pfam annotation: Domain name=Ank; Domain location=106-138; Score =38.3; E_value=2.7e-08; Accession=PF00023.20; Description=Ankyrin repeat
  Pfam annotation: Domain name=Ank; Domain location=139-171; Score =25.7; E_value=0.00017; Accession=PF00023.20; Description=Ankyrin repeat
  Pfam annotation: Domain name=Ank; Domain location=174-203; Score =19.4; E_value=0.013; Accession=PF00023.20; Description=Ankyrin repeat
  Pfam annotation: Domain name=Ank; Domain location=204-236; Score =18.2; E_value=0.029; Accession=PF00023.20; Description=Ankyrin repeat
  Pfam annotation: Domain name=Ank; Domain location=72-105; Score=20.9; E_value=0.0047; Accession=PF00023.20; Description=Ankyrin repeat
  Pfam module annotation: Pfam domain module=Ank::Ank::Ank::Ank::Ank; Domain location=106-138::139-171::174-203::204-236::72-105
FVFYYLKPNSSFFFYITPMAPDASDALAVRQKVQLFLNAARTGSIDLLKKLALQLDEGKDLAKSVEAIKDANKRGALHFAAREGQTSVCEYLLTDLKLSVDSQDDDGETALIHAARQGHTATAKYLIDHGADPTVASNLGATALHHSAGIGDAELLKYLLSRGVNPDLESDAGTPLVWAAGHAQPAAVSVLLEHGANPNAETDDGITPLLSAVAAGSLACLELLIQQMGTIADIGWEWKLQWGRFFLEAEIDTQQYMWRWEGDSSGKYTVGSAYELLNRNLPLERKDCLQRITQEGGMWKLMTSPAHFAEVMMRTRLTYSSLVLTSCRYGGNRDH

SEQ ID NO: 146643 - protein, 126 aa, Glycine max
  Coding DNA Sequence Number=SeqID_29865
  Gene Ontology: Mol. function=binding; Cellular component=thylakoid; Biological process=photosynthesis
  Homolog annotation: Hit_ID=Q8H9C2; Match level="QueryCoverage=61%, HitCoverage=16%, E-value=2e-28, Identity=75%"; Hit description =Ankyrin-like protein
  Pfam annotation: Domain name=TPR_1; Domain location=40-73; Score =20.0; E_value=0.0086; Accession=PF00515.18; Description =Tetratricopeptide repeat
  Pfam annotation: Domain name=TPR_1; Domain location=74-107; Score =2.0; E_value=3.1; Accession=PF00515.18; Description=Tetratricopeptide repeat
  Pfam annotation: Domain name=TPR_2; Domain location=40-73; Score =18.2; E_value=0.031; Accession=PF07719.7; Description=Tetratricopepti de repeat
  Pfam annotation: Domain name=TPR_2; Domain location=74-107; Score =17.7; E_value=0.041; Accession=PF07719.7; Description=Tetratricopepti de repeat
  Pfam module annotation: Pfam domain module=TPR_1::TPR_1::TPR_2::TPR _2; Domain location=40-73::74-107::40-73::74-107
MLVKRMMDNAKNYKAVGSYYPMICDLVIPSQVAPEAKKRAAEAKSRGDGAFKRNDHHMAIDFYTQAIDLNPIDATLLSNRSLCWIKLGQAEHALADAKACRALRPDWPKACYREGAALRLLQACYL

SEQ ID NO: 146644 - protein, 102 aa, Glycine max
  Coding DNA Sequence Number=SeqID_29866
  Gene Ontology: Mol. function=chitinase activity; Cellular component =cellular_component; Biological process=defense response to bacterium
  Homolog annotation: Hit_ID=O81228; Match level="QueryCoverage=75%, HitCoverage=60%, E-value=1e-23, Identity=63%"; Hit description=PR-4 type protein
  Pfam annotation: Domain name=Barwin; Domain location=22-101; Score =71.9; E_value=2e-18; Accession=PF00967.8; Description=Barwin family
MAKVSLFVVCVVCVLALASAQSATNVRATYHLYQPEQHNWDLLADSAYCSTWDADKSMAWRSKYGWTLWASGPTSLWQVTNTRTKAQETVRIVDQCKNGGLR

SEQ ID NO: 146645 - protein, 1532 aa, Glycine max
  Coding DNA Sequence Number=SeqID_29867
  Gene Ontology: Mol. function=receptor activity
  Homolog annotation: Hit_ID=Q6ENK5; Match level="QueryCoverage=99%, HitCoverage=84%, E-value=0.0, Identity=49%"; Hit description=Thyroid hormone receptor-associated protein complex component TRAP170- like protein
  Pfam annotation: Domain name=MED14; Domain location=8-193; Score =207.4; E_value=3.2e-59; Accession=PF08638.1; Description=Mediator complex subunit MED14
MASELGQQTVELSTLVTRAAHDSYASLKELVDKCKSSELSDTDKKISILKFLSKTQQRMIRLNVPLIQHCQLLASTVSNHDMCFTQAADSLFFMHEGLQQARAPVYDVPSAIDILLTGSYQRLPKCIEDVGTQYALTEEQQKPALKKLDTLVRSKLLQVSIPKEFSDIKVSDGTAMLRVDGEFKVLITLGYRGHLSLWRILHLELLVGEKNKPVKLEATRRHLLGDDLERRMAAAENPFSVLYSVLHELCVALVMDTVIRQVQVLRQGRWKDAIRFELISEGHGASSSSAQNPDGESDSSAMRTPGLKIVYWLDFDKNAGASESGTCPFIKIEPGSDLQIKCLHSIFVIDPLTAKDAEFVLDQSCIDVERLLLRAICCNRYTRLLEIKRELVKNVQVCRTTDDVVLQSQMGEPDIEYKQKDEKCHSKDFEGHEVLRVRAYGSSFFTLGINIRNGRFLLQSSQDIVVSSALLECEEALNQGSMTAAEVFISLRSKSILHLFASVGRVLGLEVYEHGFNTVKIPKNVSNGSAMLLMGFPDCGSSYFLLMQLDKDFKPLFKLLETQPDPSGKDNLSGDLNQVLRIKEINIGQMQVQEDEMNLSLVDWGKLRSVLPSAVGPNQTSGDEFFSDVHLENSIQIAKGHPSGFSSLVDEVFGLEKGSSMPPFSVKSLPSSVNTSLPSQYGSVPMNFHSLKAGSPSPKWEVGMQMSQVSNVTKASGATNHYSVKGPLQSSSVGSITTGQGRNSAGKKLSASKSEQDLASLKSPHSVDISSSSAMDEEQLRLLSDTSNDALSGSRSSRLLSPPRPTGSRMSIPNSRPNGLEVESFKAAGSSSCATTPVSQTLESTVSYNTGEDVTSKNDKKSRKRTASDMLTLIPSLQGVESNPGICKRRKISDSSGCQLSLPQGVMSAEMIPKKEGYSYGSLIAEVNKGNVPSSIYIAALLHVVRHCSLCIKHARLTSQMDALDISYVEEVGLRSGSSNIWFRLPLARGDSWQHICLRLGRPGCMYWDVKINDQHFRDLWELQKGSNNTPWGSGVRIANTSDLDSHIHYDPDGVVLSYQSVEVDSIKKLVADIQRLANARTFALGMRKLLGVRAEEKSEELVTSSDTKTSSTKVAPDTADKLTEQMRRAFRIEAVGLMSLWFSFGSSVLARFVVEWESGKEGCTMHVSPDQLWPHTKFLEDFINGGEVSPLLDCIRLTAGPLHALAAATRPARAGPVPGVAAALSSIPKQTGSYISSQGLLLGNSTTNVGQPTSGPGANTVMPTASGLTSQTLSMLAASGRGGPGIVPSSLLPIDVSVVLRGPYWIRIMYRKQFAVDMRCFAGDQVWLQPATPPKEGRLSGGSLPCPQFRPFIMEHVAQELNGLDPSFTGQQAGGLANSNNPNPGSGSQMMAANGNRINLPISAAMPRTGNQVASLNRVGNALAGSSNLALMTSAVSLRRPPGTVVPAHVRGELNTAIIGLGDDGGYGGGWVPLVALKKVLRGILKYLGVLWLFAQLPELLKEILGSILKENEGTLLNLDPEQPALRFFVG

SEQ ID NO: 146646 - protein, 222 aa, Glycine max
  Coding DNA Sequence Number=SeqID_29868
  Gene Ontology: Mol. function=ATPase activity, coupled to transmembrane movement of substances; Cellular component=integral to membrane; Biological process=transport
  Homolog annotation: Hit_ID=Q1RWN5; Match level="QueryCoverage=96%, HitCoverage=57%, E-value=1e-96, Identity=65%"; Hit description=ABC transporter, transmembrane region, type 1
  Pfam annotation: Domain name=ABC_tran; Domain location=4-188; Score =216.7; E_value=5.3e-62; Accession=PF00005.17; Description=ABC transporter
  Pfam annotation: Domain name=SMC_N; Domain location=2-191; Score= -121.5; E_value=0.01; Accession=PF02463.9; Description=RecFRecNSMC N terminal domain
  Pfam module annotation: Pfam domain module=ABC_tran::SMC_N; Domain location=4-188::2-191
SKVEAHVALVGPSGSGKSTVIWLTQRFYDPDQGKVMMSGIDLREIDVKWLRRQMALVGQEPSLFAGSIRENIAFGDPNASWTEIEEAAKEAYIHKFISGLPQGYETQVGESGVQLSGGQKQRIAIARAILKKSRVLLLDEASSALDLESEKHIQEALKKVTKEATTIIVAHRLSTIREADKIAVMRDGEVVEYGSHDNLMASNQNGLYACLVRAETEANAFA

SEQ ID NO: 146647 - protein, 134 aa, Glycine max
  Coding DNA Sequence Number=SeqID_29869
  Gene Ontology: Mol. function=protein binding; Cellular component =integral to membrane; Biological process=vesicle-mediated transport
  Homolog annotation: Hit_ID=Q1RWM9; Match level="QueryCoverage=86%, HitCoverage=55%, E-value=5e-52, Identity=88%"; Hit description =Synaptobrevin
  Pfam annotation: Domain name=Synaptobrevin; Domain location=58-134; Score=39.6; E_value=1.1e-08; Accession=PF00957.11; Description =Synaptobrevin
MCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQKYHAAIGNCVLGIALVI

SEQ ID NO: 146648 - protein, 527 aa, Glycine max
  Coding DNA Sequence Number=SeqID_29870
  Homolog annotation: Hit_ID=Q2QYH0; Match level="QueryCoverage=22%, HitCoverage=17%, E-value=4e-22, Identity=46%"; Hit description =Expressed protein
  Pfam annotation: Domain name=DUF936; Domain location=1-525; Score =494.8; E_value=1e-145; Accession=PF06075.3; Description=Plant protein of unknown function (DUF936)
MASLIPGVLLKLLQSMDSDVKVNGEYRSVLLQVISIVPAITGSELWPNQGFFLKVSDSSHSTYVSLSKEDNELILNNKLQLGQFFYVDRIETGTPVPILVDVRPVPGRHPFIGNPKDLMQMLEPSEGPVQSDNHRVNRSKSMNSTKAKESKSPRQKIVIKEEKAAVASRYMRGVRTPTSNVNVQDANEERKGNDFENGVDSKKVASAKTLSVNTTRSLQLEIPSPRQRVAQSNIQETVMSPKRILTKRNSTKQETTNLNVLSSSEDKSYSTEAIPWSSLPSSLLRPGKELLRRKHLASQVAVEAQSEVTATSVLVKFLSMFANICTSAASENPHVTLNKFFSFQELMDRSNCISTTPHKDKSFQLYKTSSPTETDKTDKKSDLVPGKSSSKSPKYSPELSEAEKQEWVTGNGLKEINELREVLSIETRSWFLIYMEKTLDVWFSTISREKRGKTNKDTAGRQMQHANNIALTLSHLKQANEWLEKLRSTSNMENEELVETVDRLKQNVYSCLLLHVDSAAFALENRV

SEQ ID NO: 146649 - protein, 94 aa, Glycine max
  Coding DNA Sequence Number=SeqID_29871
  Gene Ontology: Cellular component=integral to membrane; Biological process=vesicle-mediated transport
  Homolog annotation: Hit_ID=Q6UU98; Match level="QueryCoverage=67%, HitCoverage=40%, E-value=3e-24, Identity=82%"; Hit description =Putative vesicle trafficking protein
MATVLLPPAFYEVGLEDCELRKMVKLTMIARVTDGLPLAEGLDDGRDLKDAEFYKLQVKALFKNLSRGHYEASRMSVETGPYVFQYPYRIIVIA

SEQ ID NO: 146650 - protein, 137 aa, Glycine max
  Coding DNA Sequence Number=SeqID_29872
  Gene Ontology: Mol. function=carbamoyl-phosphate synthase (glutamine -hydrolyzing) activity; Cellular component=chloroplast; Biological process=nitrogen compound metabolic process
  Homolog annotation: Hit_ID=Q2KVT6; Match level="QueryCoverage=95%, HitCoverage=34%, E-value=1e-67, Identity=95%"; Hit description =Carbamoyl-phosphate synthase small chain
DAGQLAGIDAGNGDDALFGQVLGQRLRGTEVRHAGGTVAHHQAGGVDAIGFDVLGVDAGVADVRIGQRDDLAAIAGIGENFLVPGHRGVEHHFGDGMARRTDRHASKNGTVRQSQNCRREAVDPLGKELRQHSKPRF

SEQ ID NO: 146651 - protein, 196 aa, Glycine max
  Coding DNA Sequence Number=SeqID_29873
  Homolog annotation: Hit_ID=Q672Q9; Match level="QueryCoverage=34%, HitCoverage=54%, E-value=3e-07, Identity=51%"; Hit description=Acyl carrier protein precursor
  Pfam annotation: Domain name=PP-binding; Domain location=51-114; Score=5.2; E_value=0.06; Accession=PF00550.15; Description =Phosphopantetheine attachment site
MAPQNNFPLESSILTHKLLAGSSMFGELKFVNKVQLKRETKTSFALSGGIDTIISCSTAELETLKIVQSTIAKQLFIDEATVEIMMALEEKFEISIGEGGAENISTVQDAADLIEKGERGVVDPEGEEEAEVVVLPKPDWDRTMVMLRLIGTASATVDRTEIPPENELYFRSFPRPVSECEGTYNEKQKDEDEDLT

SEQ ID NO: 146652 - protein, 407 aa, Glycine max
  Coding DNA Sequence Number=SeqID_29874
  Gene Ontology: Mol. function=DNA binding; Cellular component=nucleus; Biological process=regulation of transcription
  Homolog annotation: Hit_ID=Q9LJG8; Match level="QueryCoverage=65%, HitCoverage=74%, E-value=1e-38, Identity=46%"; Hit description =Similarity to DNA-binding protein
MGISPETTEEGYSVVFIVKLVNQGHQTITEKIGGEEDMDDDDEIQSHPSPASGSPPSSPRSNGRITVTVAAPAPQAQPPPPNSLALALPIQQPAKGNGGGGGGGGGGGGREDCWSEGATAVLIDAWGERYLELSRGNLKQKHWKEVAEIVSGREDFTKAPKTDIQCKNRIDTVKKKYKSEKAKIAAGATSKWPFYDRLEQLIGPSAKIPGAGNSNSQPQKVPLGIPVGVRSSANQFHHPHKQPQRQQPQSVPLKNQKIQFRRRGPPVDSDSEERDASSPASSDSFPPESFERKRPRLMSSNTAKGSGERRKAKGWGSAVRELTQAILKFGEAYEQAESSKLQQVVEMEKQRMKFAKDLELQRMQFFLKTQLEISQLKLGRKGGNPSNNLNGTTNNNNNNHNNNSDSE

SEQ ID NO: 146653 - protein, 1235 aa, Glycine max
  Coding DNA Sequence Number=SeqID_29875
  Homolog annotation: Hit_ID=Q8GRM2; Match level="QueryCoverage=99%, HitCoverage=98%, E-value=1e-108, Identity=40%"; Hit description=COP1- interacting protein 7 (CIP7)-like
MKSDTFLDYAVFQLSPRRSRCELLVSSDGNTEKLASGLVKPFLTHLKVAEGQVARASSSIKLEIDRHKNAETWFTKGTFERFVRYVSMPEDLEMVNTFDAEMSQLEAARKIYAQGAGERSDPQGGNGAGAITVADATTKELLRAIDVRLSAVRQDLTSACARASASGFNPHTVSLLKHFADRFGAHRFNEACTKYMSLYERRPDLISHWPGGDDRELRSSVSSDMSIDNDDGPNQAQPTDPPKPKPISNFASLRRSSTSVNSKDETSDTPTKEETESPASAPAPATAPSGRRLSVQDRINLFENKQKENSGGRAPELRRLSSDVLRRWSSASDMSIDVGSGDKKDSDSPLPTPASSVSQTKSVVVSEDKDQNDNKLEKFAKTDQGSSQETGKVSVFDEAKNGGFKDQVGSGGGFSETTLKKGSSEVVVVGPMLSYGDDDVKFYGGVKNHVVAPSLIRGPRSHSRSLSAQFEGGGNGLKFRDVSVRVDQSSQNEVEDTPSSFPNKEEDSQIPKMKFQKPSSGRNEQQMSMAHGKRDGANESSKMKQVLETPDNARATSTPPLEQQHQRVRQSKGNQGMHDELKMKADELEKLFAEHKLRVPGDQSGSVRRVEPADVHVEQSQYRRGGVGDSTPQLPSRSNVTEVAASSSNLASFDAKLVTKMVDSRNYGDSLRQNFSDLNLSEDSRGKFYEKYMKKRNAKLREDWSMNRAEKEARMKAMQDSLERSRAEMKVKFSGSANRQDSASGAHRAEKLRYFKSNIKREQHPIDSLQNEDDEDLSEFSEEKTYGASRQSRKIFPNRHIPSGTPRTTAVSVSRSSGGRRRDNPLAQSVPNFSDLRKENTKPSSGVSKTTRSQVRSYSRSKSTTEEMQGVKEEKSRQTLSLRKSSANPAEFKDLSPLNSDGIVLSPLKFDMDESDLGPYDQSPRPFLKKGNNIGSGSVGNAIQMKASTASDTQKNKEFEDPEFDEEDSLQIAMDEHDDIETMAIEDVAYNNNGKVSLSQESGKSGNSGSEIGDSARSLAQVDPISGGEMATGFTSTFNGVRSLQDSPVGSPVSWNSRTRHPFSYPHESSDIDASIDSPVGSPASWNSHSLNQGDNDASRMRKKWGSAQKPFLVANSSQNQPRKDVTKGFKRLLKFGRKTRGSESMADWISATTSEGDDDTEDGRDLANRSSEDLRKSRMGFSHGHPSDDSFNENELFNEQVQSLQSSIPAPPAHFKLRDDHISGSSIKGDPWVT

SEQ ID NO: 146654 - protein, 1252 aa, Glycine max
  Coding DNA Sequence Number=SeqID_29876
  Gene Ontology: Mol. function=ATPase activity, coupled to transmembrane movement of substances; Cellular component=integral to membrane; Biological process=transport
  Homolog annotation: Hit_ID=Q1RWN5; Match level="QueryCoverage=98%, HitCoverage=98%, E-value=0.0, Identity=61%"; Hit description=ABC transporter, transmembrane region, type 1
  Pfam annotation: Domain name=ABC_membrane; Domain location=289-566; Score=151.6; E_value=2.1e-42; Accession=PF00664.13; Description=ABC transporter transmembrane region
  Pfam annotation: Domain name=ABC_membrane; Domain location=941-1216; Score=162.5; E_value=1.1e-45; Accession=PF00664.13; Description=ABC transporter transmembrane region
  Pfam annotation: Domain name=ABC_tran; Domain location=641-827; Score= 204.6; E_value=2.3e-58; Accession=PF00005.17; Description=ABC transporter
  Pfam module annotation: Pfam domain module=ABC_membrane::ABC _membrane::ABC_tran; Domain location=289-566::941-1216::641-827
  Subcellular localization annotation: CTP_CleavageSite=48; ConfidenceScore=5.53e-01
MAADSFSFEGDSFSSHQRRHYPTPVSYHTVYGSGSGSFISSSSLTNPRARRRNPVPATPFASDDDHSWQGEVSWKFEATGWRDYSTNFGSVLSPWPESSPSGHSRVFRRSANDYYLSRTSRFRGLANSSYEQSGYGRVELQSYDARDNDYSYFDQHSRPQGLSRSGFIQEKSSKKCKTSPLAEEDELSMIDYSITHDHVISPNRNGHGLELPYSKHGHGGDYGGNYHVGHDGPSSHGSQIYRSGGDYTYSHHDIEKLSAYDEEGEEDMDEEDARPPKTVGIFSLFKYSTKLDLVLVFVGCLGALINGGSLPWYSYLFGDVVNKISEAENDKAQMMKDVERICKFMAGLAAVVVFGAYLRKDRAAQRIRTEYLRAVLRQDITFFDTDINTGDIMHGIASDVAQIQEVMGEKMAHFIHHIFTFICGYAVGFKRSWKVSLVVFSVTPLTMFCGMAYKALYGGLTAKEEASYRKAGSIAEQAISSIRTVFSFVAESKLAGKYAELLQKSAPIGARVGFAKGIGMGVIYLITYSTWALAFWYGSVLIARNELDGGSAIACFFGVNVGGRGLALALSYFAQFGQGTVAASRVFYIIERIPEIDSYSPEGRKLSGVRGRIELKSVSFAYPSRPDSLILHSLNLVLPSSKTVALVGASGGGKSTIFALIERFYDPIEGIITLDGHDLRTLQVKWLRDQIGMVGQEPILFATSILENVMMGKDNATKKEAIAACIAADAHSFISSLPLSYDTQCVVGDRGTKLSGGQKQRIALARAMVKDPKILLLDEPTSALDAESESAVQRAIDKISASRTTIVIAHRIATVKNAHAIVVLEHGSVTEIGDHRQLMAKAGAYYNLVKLATEAISKPLAIENEMQKANDLSIYDKPISGLSGSRYLVDDIDIPWPKGLKSTQEEEEKKHQDMEDKQDKMARKYSLSEVWKLQKPEFVMLFSGLILGMFAGAILSLFPLVLGISLGVYFGHDTHKMKRDVGRLCLTLVGLGFGCILSMTGQQGLCGWAGSKLTQRVRDLLFQSILKQEPGWFDFEENSTGVLVSRLSLDCVSFRSVLGDRFSVLLMGLSSAAVGLGVSFAFNWRLTLVAAAVTPFALGASYISLIINVGPRVDNDSYAKASNIASGAVSNIRTVTTFSAQEQIVKSFDRALSEPRRKSLRSSQLQGLMFGLFQGSMYGAYTLTLWFGAYLVEHDKAKLGDVFKIFLILVLSSFSVGQLAGLAPDTTMAAAAIPAVQDIIKRRPLIDNDRTK

SEQ ID NO: 146655 - protein, 132 aa, Glycine max
  Coding DNA Sequence Number=SeqID_29877
  Homolog annotation: Hit_ID=Q1SWX1; Match level="QueryCoverage=92%, HitCoverage=24%, E-value=8e-08, Identity=28%"; Hit description=IMP dehydrogenase/GMP reductase
MGQLERQAFRKAYGKIWDLAMVEVSTEAIASLAQYYDQPLRCFTFEDFQLSPMVEEFEEILGCSLGGRRPYLFSGFYPSLARISKIVQILAQELDHRKQVENGVVGIPRKCLERSTLFLPIITTRKARLSLC

SEQ ID NO: 146656 - protein, 391 aa, Glycine max
  Coding DNA Sequence Number=SeqID_29878
  Gene Ontology: Mol. function=protein dimerization activity; Cellular component=nucleus; Biological process=regulation of transcription, DNA-dependent
  Homolog annotation: Hit_ID=Q0GPG5; Match level="QueryCoverage=98%, HitCoverage=87%, E-value=1e-144, Identity=73%"; Hit description=BZIP transcription factor bZIP105
  Pfam annotation: Domain name=bZIP_1; Domain location=196-260; Score =56.1; E_value=1.2e-13; Accession=PF00170.11; Description=bZIP transcription factor
  Pfam annotation: Domain name=bZIP_2; Domain location=196-253; Score =40.7; E_value=5.1e-09; Accession=PF07716.5; Description=Basic region leucine zipper
  Pfam annotation: Domain name=bZIP_Maf; Domain location=176-256; Score= -24.1; E_value=0.054; Accession=PF03131.7; Description=bZIP Maf transcription factor
  Pfam module annotation: Pfam domain module=bZIP_1::bZIP_2::bZIP_Maf; Domain location=196-260::196-253::176-256
MNRSESEWAFQQFLQEAAASSSSNSDHHHLKFKNEFNINIPVTTTSIQNINVDSQDYHAILKTKLNLACAAVAMTRQIINLLRAFRLLAKAALDLIDEGSLVKSQNPATFSDSGPQASNSSEDGLQATLKGSGPSGNDPSKLQNKDVKAQIGIPSSSSMQNKPAVAMRPTISGSSGEQSDDEEVEGEINMTENMTPVDAKRVRRMLSNRESARRSRRRKQAHLTELETQVSQLRSENSSLLKRFTDVSQKYNNAAVDNRVLKADVETLRTKVKMAEETVKRITGLNPMLHAITEMSSMAMPSFDESPSETSADAAVSVQEDPNHHRCQPTSNNGLGGISSIETVQQNVAAVVGGNKTGRTTSLHRVASLEHLQKRIRGGADSRGPPSNGEQ

SEQ ID NO: 146657 - protein, 258 aa, Glycine max
  Coding DNA Sequence Number=SeqID_29879
  Gene Ontology: Mol. function=receptor activity
  Homolog annotation: Hit_ID=Q6ENK5; Match level="QueryCoverage=80%, HitCoverage=11%, E-value=2e-74, Identity=66%"; Hit description =Thyroid hormone receptor-associated protein complex component TRAP170- like protein
QQQQQQNSNPAPEELSQSEISEICDYFSRRVASEPYDASRVASFITMLTLPVSVLREFLKLIAWKKGLSQAQVGDVVSAQKPRIELCLENHSGLNVDENSENSSAFRSNIHYDRLHNSVDFALTVVLDSAHIPHVNAAGGAAWLPYCVSVRLRYSFGESTNVSFIGMNGSHGGRACWLRVDDWEKCKQRVARTVEVNGNSAADVSQGYAYAVLLEMSFAVMEEVHRSLTRLYNIFADSVVSWYNFLGGGYCYCTDDIK

SEQ ID NO: 146658 - protein, 160 aa, Glycine max
  Coding DNA Sequence Number=SeqID_29880
MCNIGDCVRRKHSLNLVVKVKMNKITLDDTETYECLFKEYWEIIKVKEGLTSGDILAALPNYKKGEEEKQNDSMSRVIDDDSKPAKRKRYNSEMKEGLTSDDIFAAQPNYKKGKDLLHHRKNCKGEEEKQNDSMSRHRGEDYISQPARTGTIQRRKIMIK

SEQ ID NO: 146659 - protein, 446 aa, Glycine max
  Coding DNA Sequence Number=SeqID_29881
  Homolog annotation: Hit_ID=Q10S15; Match level="QueryCoverage=40%, HitCoverage=42%, E-value=9e-11, Identity=33%"; Hit description =Expressed protein
MRCFLPCFRTSKRRNHLRSADEAQNHVGEGAVEELIDSIAESKTTNEEQLNKSVETKDDRKEEAPQIDETNKRSHQEESSESLFSLSISSRKKASDAEPEVNSPIRLVCTKEAFGSSPSVEERKPSENTKQPSFNAIKKEEETKELIKNEGEKEKANDPVTQYRYRDCPDDGYDDINLNVNDLDATLKDDDDDPPSEKKGEAGADVNQTWVQEESSESFFSLSANSRIRISSAEAENEVNSQMSAPATNSITQGKIPDLSLVLNPIQNLTKGRVVKATLKNDKENINMVVKDINIPISPEPSLKLSNRKAKQRFDDKIGVDTSLSSWLVESSETTPISINNTSSVGEQTPKGRRGSPWSREDRPILGALTVEEIRMFSLSASSRRSRSRSPDETPIIGTVGSYWSHTEQTMDLEFNKSGKDVKPKRSSTALQTRLERAFEASAAEV

SEQ ID NO: 146660 - protein, 312 aa, Glycine max
  Coding DNA Sequence Number=SeqID_29882
MDPLNCNNPNVKFLLADWERLPGFGISAQIAGMCGLLAIAINEIRVLLTNFYKRADHDGCKDIIIVINTMALIWGEPWKYLQPTTDINGSLVASHRKMDRRWWRAQAVRYLMRFPTEYTCNLLNEARHAAFGKIAAEMVLESPAEEWPKENSNKAGSDIEEYVLSNHKPWIPSPLLSMHVRMGDKACEMKVVEFEEYMQLAAARSGGISQTLIAYGCPQRCRQNQRIFWLELSHYTKVRRQGRTNVSMAKYEASLGRESSTNYPRVNFMMAADSDFLVGALGSTWCFLIDRMRNTGGKVMAGYLSVNKDGFW

SEQ ID NO: 146661 - protein, 174 aa, Glycine max
  Coding DNA Sequence Number=SeqID_29883
  Gene Ontology: Mol. function=zinc ion binding; Cellular component =integral to membrane; Biological process=protein transport
  Homolog annotation: Hit_ID=Q1SRN3; Match level="QueryCoverage=74%, HitCoverage=35%, E-value=1e-58, Identity=82%"; Hit description=Zinc finger, RING-type; Pex2 / Pex12, N-terminal
MDTSSRISKMRNRERERLRGPQWLKTLQGALLSCTYTVLDYAQTGLIAAVFFFKMMEWWYQSAEERMSAPTVYPPPPPPPPPKVAKEGIPLPPDRTICPLCSQKRANPSVVTVSGFVFCYACIFKYITQVRALDLMAKFKLLEYKSLYLNLSFLIARSYIIPLCLSDGITQTTE

SEQ ID NO: 146662 - protein, 354 aa, Glycine max
  Coding DNA Sequence Number=SeqID_29884
  Homolog annotation: Hit_ID=Q6KA74; Match level="QueryCoverage=83%, HitCoverage=33%, E-value=5e-32, Identity=54%"; Hit description =Ankyrin repeat protein-like
MEPLMVKKMVSAASCETSEANGVVKEKKSWFGWNKKSLKSSSDDPEDSKAVKKNSRFGSEGSNQRSADQQKSASDFLREDSVDSKKGKDKNIKKKKKGANNESEYKKGLRPVLWLTPDFPLKTDELLPLLDILANKVKAIRRLRELLTTKLPHGTFPVKHQNTERTERPEPKAKMQLQMAEISKQTRQRHRWLKSKSKTRNAVLLQQHWGTLVLALFQQRAPPKHVAIPIVPTIRVLVTFTKFEELQPVEEFSTPLSSPAHFYDAKSKESEGSSSWISWMKGSRGGQSSDSDSHRYKDEVDPFSIPADYKWVDANEKKRRMKAKKARSKKHKKQAAAKGGDGVQHQRTEDVEEQ

SEQ ID NO: 146663 - protein, 324 aa, Glycine max
  Coding DNA Sequence Number=SeqID_29885
  Homolog annotation: Hit_ID=Q1SSZ2; Match level="QueryCoverage=37%, HitCoverage=36%, E-value=1e-24, Identity=39%"; Hit description=C2 calcium/lipid-binding region, CaLB
MSAVAPPYQLLEINVISAQELAQFVFRVDDNFLNSDNSVIMVEIYSHAWLRQVLIGTVAVLVTNLLPPNRKPKLRFVALQIRRPSGRPQGILNIGINLLDSTMRSMPLYSELSSSAVGYWDNIIKNKNAKTEDDDDDNTQHHHLPLDSSLLTLQRCQSEKNDSTVNDYAYHGNAKHYGYDGQDSDEGVRKGGVFNEGSLISDGLLPMPPPAPCTSEISGMDGWSENSGTEGMKTKIERWRNELTPAYEDYDDERKKVMRKTSKRVGQTSRRRGRGGGPCSCFGSVFGIEISITCGGGNRRKGQGGGKGRVTTASSELTYDDSYI

SEQ ID NO: 146664 - protein, 93 aa, Glycine max
  Coding DNA Sequence Number=SeqID_29886
  Homolog annotation: Hit_ID=Q6K9F7; Match level="QueryCoverage=41%, HitCoverage=5%, E-value=7e-09, Identity=69%"; Hit description =Putative SET domain protein SUVR2
MGAGYARSRYLNARRGVPKLAFFTNRRVSANEELTWDYGIVFADHDHPIKAFQCCCGSVNSAFSLAGFSILIKLYLYIVCYFLINNVQEAFGL

SEQ ID NO: 146665 - protein, 492 aa, Glycine max
  Coding DNA Sequence Number=SeqID_29887
  Gene Ontology: Mol. function=binding; Cellular component =intracellular; Biological process=RNA processing
  Homolog annotation: Hit_ID=Q10RX5; Match level="QueryCoverage=97%, HitCoverage=93%, E-value=1e-131, Identity=46%"; Hit description=Pre -mRNA processing protein PRP39, putative, expressed
  Pfam annotation: Domain name=DUF946; Domain location=2-489; Score =771.4; E_value=5.5e-229; Accession=PF06101.2; Description=Plant protein of unknown function (DUF946)
MAEKTGFCYGKQSDGFASGRISLGRLEVLKVSKFERVWSCPSSHGKSQGFVFYKPLEIPDGFFCLGHYCQSNDQPLRGHVLVARETCSEPELESPALKKPINYSLIWSADSPHDGCGYFWLPNPPLGYKAMGIVVTNKPDEPEVEEVRCVRADLTETCETCDLLLSMSSKFSRISFKVWNTRPCKRGMWGRGVSVGTFFCSTYSNSEKIADIACLKNLDSTLHAMPNINQVHALINEYGPTVYFHPDEIYLPSSVQWFFKNGALVYSRDSEKGKAIDYQGSNLPSGGTNDGAYWIDLPTNDDARNNLWEEHLLTLLCGFFVPSMDLEYFKWALHASREQLHRRTMEWVDAFGLEFIEGNKPVVYSSRHGHASFPHPGSYLQGSSTLGIGAKNEAAKSKLTVDSSTRYKVVAAEYLGEGAIAEPCWLQYMREWGPTVVYDSRSEIDKLIDLLPVFVRFSLVNLFELFPTELYGEEGPIGPKGKANWVGDEKCY

SEQ ID NO: 146666 - protein, 297 aa, Glycine max
  Coding DNA Sequence Number=SeqID_29888
MAKFDPEIVQEFYANAWPTEEGVRDMRSWERGQWIPFDADALSQFLGDPLVFEEGQQCEFSQRRNRVDGFDEEAIAQLLCTPGQDFARTAAGRRVQIMRTIMTTLTQTWMTLLLSNFLPSDHNFDLPLPKCQLVYAILTRMSAHVAQSYGVPVTPSKVIRPITRPFIEKYCTPRQAQGDAHQAADALPPPRQTDPAGSLGVEHYLQHLVHQQAANHRGQVQIHECLYRFSLSQQGQGSAFFACPTPEQFGAEVAWPGDWLDAQAGEEPAGSPGEPDESHMDEDMTDLLGFLGGSGAT

SEQ ID NO: 146667 - protein, 51 aa, Glycine max
  Coding DNA Sequence Number=SeqID_29889
MEKNREREREGLTRTRRRCNRMVASEGLVEALDGEAKLEKMMADGDKKALL

SEQ ID NO: 146668 - protein, 166 aa, Glycine max
  Coding DNA Sequence Number=SeqID_29890
MAELCLVPNVVIPLKLKVSDFDKYKGTTSPKNHLKMHCKKMGAYIKDEKLQYQYNSYIALDRIQLQNMCKKEHKSFKEYAQRWRNLALQVAPPMMEREMITMIVDTLPVFYYEKMVTYIPSSFVDLVFASKKIKVGLRRGKFDYPTLMNGKPGGMERIRMREETMP

SEQ ID NO: 146669 - protein, 122 aa, Glycine max
  Coding DNA Sequence Number=SeqID_29891
MEAMKDQMAAMMEAMLSMKKIVEVNAAAVATTSTATEVDRTHPSGINQISHPFPDVVGQGGEALGSTSGPHVVQSKNSFPSYGLPPNYAPPDVAHAPNENVNNSTPILIESQQPQFDHAHVS

SEQ ID NO: 146670 - protein, 83 aa, Glycine max
  Coding DNA Sequence Number=SeqID_29892
MEPIARKRTLVMKENTPKETRNKIPQPKARCKEKHSRILPRESIKIPSKATSPGFPLATTYVLHLVGWDQTTSLCWIEWPQNN

SEQ ID NO: 146671 - protein, 90 aa, Glycine max
  Coding DNA Sequence Number=SeqID_29893
KCLCIAGYGKGVDGDPVLRGRRIRATWGYVSSVEGGQLGMVGSCVICGCGRVDLHHRPITYDGVGTWRYVAGGQETLGTSGGGAIAQNQA

SEQ ID NO: 146672 - protein, 86 aa, Glycine max
  Coding DNA Sequence Number=SeqID_29894
MQKFKRPAPPRAGLHSNPVLELLMNLVQAAQALQLVQYPQVLELRKGEPQMMQSYPARVLDRRLQEEWARAAKEGLGVLMNPRLDF

SEQ ID NO: 146673 - protein, 78 aa, Glycine max
  Coding DNA Sequence Number=SeqID_29895
MNASPAAVATGTSIAGSMSISDIVEVESGTGAARIRERSQSFSLISLLILSPKLMLSVPPELLHLLSFTFLVQVYTVL

SEQ ID NO: 146674 - protein, 86 aa, Glycine max
  Coding DNA Sequence Number=SeqID_29896
MGPKSTLRLIRTLGPSLASLAQSTWSFSIQCPCGVGLHQRSANNELMIEAGATKGIGETIWGGSFVGRVALFSAEGEKKGLVSNLL

SEQ ID NO: 146675 - protein, 246 aa, Glycine max
  Coding DNA Sequence Number=SeqID_29897
  Gene Ontology: Mol. function=DNA binding
  Homolog annotation: Hit_ID=Q1RUD8; Match level="QueryCoverage=85%, HitCoverage=43%, E-value=6e-22, Identity=34%"; Hit description=IMP dehydrogenase/GMP reductase
EEYAKALADQGEWASFLDVLALLVFRVILFPNVDGLVDLAAIDAFLVYHHSKESLVIVILADAYDTFDWRCENSSARIVYCTPILYVWLTSHIFRHQSRPVCPLQGHHMCAEKGKANWEQLLAGMEGRAGVLSSYKGFTNVPLMGTRGCINYNPILSIRQLGYPMRGTPSEESIAPFIARGFSDPNAKVLQRVRKAWNTVQRKDKELRGSSNGIVGGYHKWLKARMQEITWLPKLKISSEEEAETP

SEQ ID NO: 146676 - protein, 74 aa, Glycine max
  Coding DNA Sequence Number=SeqID_29898
MNALGGATLFCKITRAPNIFMICVHRDSLGRNNQHENTEKGVPMNPKRIKVIPEWPAPPSVLREKAQSFKNLGI

SEQ ID NO: 146677 - protein, 103 aa, Glycine max
  Coding DNA Sequence Number=SeqID_29899
MWQSLNKIIEKEENLLFKTKKLFSLLTQQNRNFRQPSLSLTLPFSSSSFSIEAPHKASTFGHHFCPKSRKESIFGVVKCVATSGTSKFQTFAESLLKLPCWMS

SEQ ID NO: 146678 - protein, 76 aa, Glycine max
  Coding DNA Sequence Number=SeqID_29900
MGADSILIWEVQPIGIVIDPRSRGAAESRSPSAIQRQASPLAYGDHHGHHIHFEDDNVFIHCMLPKGDNCKSKASW

SEQ ID NO: 146679 - protein, 67 aa, Glycine max
  Coding DNA Sequence Number=SeqID_29901
MGGANSNFQILIWAFQTIFRSWIASEGSNPARLGKLGGNLLPLCPIKRQKGTVLRVPDSPDYAFQLF

SEQ ID NO: 146680 - protein, 86 aa, Glycine max
  Coding DNA Sequence Number=SeqID_29902
MSISPCGCISWDHARKTPSGPGEVQQGLGVSSSDYGLLSPTNQAFIKKYCAPRLAQSKTPQQPGDGWQRATKALPPPLEFISAHPQ

SEQ ID NO: 146681 - protein, 139 aa, Glycine max
  Coding DNA Sequence Number=SeqID_29903
AGESGRAATSLSESSGMSIKGGAGGASGGGRISTFGEAGGSTIGGCSSAGAGSILVGMGLGAQPREIFLTAAELQARPLYLKIAPWILLAYYEPTAAGGGLDNEGMSLALALFLEAIYLAKPKTCRNDVRLALPEPRLA

SEQ ID NO: 146682 - protein, 36 aa, Glycine max
  Coding DNA Sequence Number=SeqID_29904
AMALKKLLAKRARKATIGEGSSVAPQAEIEFDGHHF

SEQ ID NO: 146683 - protein, 85 aa, Glycine max
  Coding DNA Sequence Number=SeqID_29905
MMMKDNYRLKGTLLSFRVFWTGSMNFKPMLVRGLMLWNDKWTCDSMQWTQGSQRIVIIKKGEIVEAMPSKVILMMPKNQELSKIP

SEQ ID NO: 146684 - protein, 363 aa, Glycine max
  Coding DNA Sequence Number=SeqID_29906
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-42, Identity=31%"; Hit description= UPI00006A17C9 related cluster
DRGLHVLAFRGLHVLTFRGLHVLAIRGLHVLPFRGLHILAFRGLHDLAIRGLQALTFRGLDALAFRRLHALAFRGLHALTFRGLHVLPFKGLHVLPFKGLHVLTIRGLHVLTFRGLHTLAFRGQHVLPFRGLHVVTFRGLHILTFRELRILLGLHVLTIRGLHVLAIRGLHVLDFRVLHALAFRGLHILNFKGLHRTTCPRLKRATRPHALTIRGLHVLAFRELHTLAVRGQHAFAVRGLHVLPRATCPHLQRLDAISFRGLHALALRGLHALPFRGLHVLPFRGLHILTFRGLYVLAFRGLHALAFRELHVLPFRGLHVLAFLGLHALTLSPLEGFMLSPSEDYTPSPSEDYTPSPSEDYTS

SEQ ID NO: 146685 - protein, 63 aa, Glycine max
  Coding DNA Sequence Number=SeqID_29907
MTTFQVKKESLDSPLLKELRRSDFLLDGGFSNVFLSINFGGDSAHFPPMEDAPMSLTSLARKG

SEQ ID NO: 146686 - protein, 141 aa, Glycine max
  Coding DNA Sequence Number=SeqID_29908
  Gene Ontology: Mol. function=hydrolase activity, acting on ester bonds; Biological process=lipid metabolic process
  Homolog annotation: Hit_ID=Q1S8F9; Match level="QueryCoverage=44%, HitCoverage=19%, E-value=4e-23, Identity=74%"; Hit description =Lipolytic enzyme, G-D-S-L
MVYVNLDVCNPLLDIIVNYQNYGFKVGDRGCCGTGKIEAAVLCNPLHPTCPDVGDYVFWDSFHPSENYGNNDDQTQRIKKNKPKYSQTYTIISNRLFVKQYMSSPNSSAMPFIGCAIIVLCSEMETRAFLACLHDLMSDVM

SEQ ID NO: 146687 - protein, 157 aa, Glycine max
  Coding DNA Sequence Number=SeqID_29909
  Gene Ontology: Mol. function=nucleic acid binding; Biological process= DNA integration
  Homolog annotation: Hit_ID=Q1RWN2; Match level="QueryCoverage=84%, HitCoverage=18%, E-value=3e-13, Identity=46%"; Hit description =Peptidase S8 and S53, subtilisin, kexin, sedolisin; Integrase, catalytic region; Zinc finger, CCHC-type
  Pfam annotation: Domain name=zf-CCHC; Domain location=109-126; Score =23.4; E_value=0.00014; Accession=PF00098.13; Description=Zinc knuckle
SLIENGILVVTNGVEPTEARHKSIEEQKLKDLKAKNYLFQAISRDVLETILNKDTSNGIWDSMKQKFQGSNKVLKISHEDKSGRGRGRGIFRGGRGKGRGRQPINKAVIECFRCHKLGHYQYECPDWEKRANYAKLEEEENELLLMSYVEQAKKEEA

SEQ ID NO: 146688 - protein, 131 aa, Glycine max
  Coding DNA Sequence Number=SeqID_29910
MAAILVVEEHLLLVEAVEATVVAAISLLMGGRMGLAVVTCTPSKLQRLVIKARKPNALFDFSGFTRFSREKGHLDLSAYDHMGSHDPQPLSRHVENEVTALESKQMVWKAGLTKEGVLEQYSKSVGPMDPL

SEQ ID NO: 146689 - protein, 104 aa, Glycine max
  Coding DNA Sequence Number=SeqID_29911
MWYGTLIINFVKPHGAMVLDDLATKMTWIVNGSRIKHYLGAETRSFRPRRLAWANISGKNNLRNSPNLAKDWPRPINEIYLNSLGLVKSCLGEWSAVMKNKTKE

SEQ ID NO: 146690 - protein, 98 aa, Glycine max
  Coding DNA Sequence Number=SeqID_29912
MDPLSNDVGGRTTMQIYFKERKGYRIYHSIAFSICGWPPVDQPSDACTFAFGVPSSVGVLRWNPRMTIVVVVLEHLLLVEAVEAVVVSAIALAGNSCQ

SEQ ID NO: 146691 - protein, 131 aa, Glycine max
  Coding DNA Sequence Number=SeqID_29913
MSGCWSGQWFRDKGDAPLYFHDTHATLMIRKFYAKLVMHAPMWTLKHQVFMAIKAGVEAKLHDESRLIQRCFDDNKDDEKGDDKKLKGQSKNEFKMFKIESRTLQDSRGKLKNTSRFKRKVEEHFKIQEES

SEQ ID NO: 146692 - protein, 77 aa, Glycine max
  Coding DNA Sequence Number=SeqID_29914
MVLNEIEVVPGDEDEEEDDHEDGVSEEAKEDDGERDNGIVEAEGQERVERSRNSRHGWGVTEEVVVVPVGVVSVKVS

SEQ ID NO: 146693 - protein, 41 aa, Glycine max
  Coding DNA Sequence Number=SeqID_29915
  Homolog annotation: Hit_ID=Q6FY57; Match level="QueryCoverage=92%, HitCoverage=9%, E-value=2e-12, Identity=87%"; Hit description =Similar to sp|P33297 Saccharomyces cerevisiae YOR117w YTA1
MAIFLPVVGLVDPDKLKPDYLVGVNKDSYLILDTLPSEYDS

SEQ ID NO: 146694 - protein, 87 aa, Glycine max
  Coding DNA Sequence Number=SeqID_29916
  Gene Ontology: Mol. function=oxidoreductase activity; Cellular component=membrane; Biological process=electron transport
  Homolog annotation: Hit_ID=O81971; Match level="QueryCoverage=79%, HitCoverage=14%, E-value=3e-30, Identity=88%"; Hit description =Cytochrome P450 71D9
MAEMIKNPRIMEKAQAEFIPFGAGRRMCPGLTFGLSNVECVLAMLMYHFDWKLPNGMKHEDLDMTEIFGITVTRKDNLYLIPKTFHT

SEQ ID NO: 146695 - protein, 206 aa, Glycine max
  Coding DNA Sequence Number=SeqID_29917
  Homolog annotation: Hit_ID=UPI0000E478F5; Match level="QueryCoverage =85%, HitCoverage=7%, E-value=7e-14, Identity=27%"; Hit description =PREDICTED: similar to plus agglutinin
  Subcellular localization annotation: CTP_CleavageSite=55; ConfidenceScore=5.24e-01
MERYPSKVLLQLTYCMTGLDKSQDRCVPGRGSTSSSNPTSTLGESHFSKCSQNPRSTLGESCFSKGLQNPRSALSEFHIAKGSQNQRSALGESLFSKGSSNPRSTLGKSRLSKGLQNPRSTLDESRIAKGSHNPRSTLGQSCFTKGLQNPRSAFGESHFSKGLLTNPRSAFGESRFSKGSQNSRFALGESHFSKGSSNPRSTLGKP

SEQ ID NO: 146696 - protein, 122 aa, Glycine max
  Coding DNA Sequence Number=SeqID_29918
MFCRFKDHLFKVLAIDIVDDGLSLMFNQDEEPYFLFYWQFDPTRFKSFDEDLLTLMERVDKAILEQLPASLDLRAILSLPSADEPSTALDGKVPYLVLFCVSGIMGDFSWRPLVKKVKLGRG

SEQ ID NO: 146697 - protein, 86 aa, Glycine max
  Coding DNA Sequence Number=SeqID_29919
MVEVSTEAIASLAQYYDQPLRCFTFGDFQLTPTVEEFEEILGCSLGGRKPYLFSGFYPSLARISKIVKISTQELDRGKKVENGVVG

SEQ ID NO: 146698 - protein, 242 aa, Glycine max
  Coding DNA Sequence Number=SeqID_29920
MTEVNVTIVVVASTTIEVDLTHPSDLNQVNPPVSGIVGQGGEALGSMGDPHFVQVQNKHSFPPYGLPPNYTPPNVAHAPDENVNNSTPILIESQQPQSDHAHVSQPMEETHDVPHHNLADFDPYPGHAIEGQAFGVGRVPIAKVEREKFNHIEERLRAIEGSGDYTFVDMAEFCLVPNMVIPLKLKVSDFDKYKGATCPKNHLKMYCRKIGAYAKDEKLLMHFFQESLTEATVTWYTNLEPF

SEQ ID NO: 146699 - protein, 60 aa, Glycine max
  Coding DNA Sequence Number=SeqID_29921
MNSRNQSRYLGTDASGDGVTTDRSLPLLCAKQAENVAQGSPVSFGFAVFYYHCLFLLINA

SEQ ID NO: 146700 - protein, 56 aa, Glycine max
  Coding DNA Sequence Number=SeqID_29922
ALKGLDDAPQPKSKAPTRWIVVKMSTIILGTFRNNWEAYFNDPRSLEPERLKALQI

SEQ ID NO: 146701 - protein, 117 aa, Glycine max
  Coding DNA Sequence Number=SeqID_29923
MAVITPGKIYQHPVPKWYDHDATCTYHGKTNIDGEELPLPMNSDRQNHLRQWSDAGTKLKAETNQGKTVTRSQFAAQCHFLFSGTEGRTQVEARVTTNRSSSLAQLWTNEKCHCKAT

SEQ ID NO: 146702 - protein, 33 aa, Glycine max
  Coding DNA Sequence Number=SeqID_29924
MISVNPDPGSQVEGGGPVGWDIGRPNDVPVERN

SEQ ID NO: 146703 - protein, 141 aa, Glycine max
  Coding DNA Sequence Number=SeqID_29925
  Subcellular localization annotation: CTP_CleavageSite=56; ConfidenceScore=5.29e-01
MRSDCLVKFSILNLFRSPKNCVFVHVSSTFEVGAMRSDCLVQFSILNLFRSPKNCVFVHVSSTFEFGAMRSDCLVQFSILNHFRSPMNCVFVHVSSTFEFGAMRSDCLVPFSILNLFGAPLIAVSFMCLPPSSLELCVVIA

SEQ ID NO: 146704 - protein, 112 aa, Glycine max
  Coding DNA Sequence Number=SeqID_29926
  Homolog annotation: Hit_ID=UPI0000612705; Match level="QueryCoverage =92%, HitCoverage=43%, E-value=3e-09, Identity=32%"; Hit description =UPI0000612705 related cluster
MSSPSKDYTSSPSEGYMPSPSEDYISSPSEGCTPSPSEDYTSSPSEGYTLSPSKDLTWLHVLDFRGLHVLAFRELHVLAFRGLHALAFRGLHVLAFRGLHICAFGGLKVLCL

SEQ ID NO: 146705 - protein, 94 aa, Glycine max
  Coding DNA Sequence Number=SeqID_29927
MATMMEAMKSTEGQAVGGIPFENTLEGPQFRPQPQPLHFAVGRAPPAMAEKGKADHLKERLRAIEGGEDYAFANLGKLFLIPKHGHSQVQGAGL

SEQ ID NO: 146706 - protein, 84 aa, Glycine max
  Coding DNA Sequence Number=SeqID_29928
DLEEDPEELPPEPAMDALDLPEDDEEPLPDVDSPEDIMSASEADSTEKSGPGGTANSDDSSSDATIGGIRAEVGISGDYDPEGA

SEQ ID NO: 146707 - protein, 148 aa, Glycine max
  Coding DNA Sequence Number=SeqID_29929
  Homolog annotation: Hit_ID=Q1RTJ9; Match level="QueryCoverage=76%, HitCoverage=34%, E-value=1e-10, Identity=36%"; Hit description =Cyclin-like F-box; F-box protein interaction domain
  Subcellular localization annotation: CTP_CleavageSite=42; ConfidenceScore=5.45e-01
MVPLRYTPPTSGKVQRTGKPLRFLQLLSPTPKTFISVFSDTSSESIVNAIATTLYLSLDGSLPNPNIVLRPMPGEKDSADDSLDITLVALFQKQTWYPFGISLTPQCNPLHEPTRWDGFEADIFYRLKVFQIVLRSRFAKVQFDEIGF

SEQ ID NO: 146708 - protein, 142 aa, Glycine max
  Coding DNA Sequence Number=SeqID_29930
MCDFQTLKTRIHNTLKLTNKQFLDEIYYRQPFTYAATMTPTHDALLYYNGRWNMSRQNEFVGYSFTGKTPKNFDIPTRCTMDELKDLIKQVAPRGIPPYGIDETQMVLIESNYWKKIGPIEILAVFSKPVVQMEDELSLSQN

SEQ ID NO: 146709 - protein, 59 aa, Glycine max
  Coding DNA Sequence Number=SeqID_29931
MTGGCTTRVISFQQVRPRIRSFARWSCPATPSRPSGPIDGYPPRAGARSTVDIYEARCR

SEQ ID NO: 146710 - protein, 227 aa, Glycine max
  Coding DNA Sequence Number=SeqID_29932
MTIHDSVKGRRNLPNDNDTFVERLSLGEDTVEVVFAGNRLKPQEREISGEAEEWNPNLKPKLKQRGSESGLVDGVIEESGGCGRIRMCCDIAGKWRNGMRFLLLLHSLRFFFTSPSISGTYKPKSTSEDFFFFFFVEEVVAIVAVIRRLSRCIEEASANSNATVHRRESFVTVHYRGKRCDPVLLPPLLPPIAERDLKVLVSFTDHLIRKHVMDQVDPEDAYGSLDP

SEQ ID NO: 146711 - protein, 75 aa, Glycine max
  Coding DNA Sequence Number=SeqID_29933
MAHSLSLSRKAILVTTVVPLSIDAASPQDIIFGTMTTTCTKEDRGCLSFSLMLDGESHLESICLSSFPTKTNDNG

SEQ ID NO: 146712 - protein, 140 aa, Glycine max
  Coding DNA Sequence Number=SeqID_29934
  Homolog annotation: Hit_ID=Q1SWQ8; Match level="QueryCoverage=51%, HitCoverage=25%, E-value=1e-10, Identity=43%"; Hit description =Nucleic acid-binding, OB-fold; TonB box, N-terminal
MDVMLFLCCSGEILSCTLWENYCTQFLSYLNERGDDGPMVIILTHARIKDAQGSYPASVSNSFKASKLLINDPILEIQEFKERLLDLGVEVSRVLLPGDQASSQVSGGSQLSSKDSFLSKAEVKTILEINAISELEVEFG

SEQ ID NO: 146713 - protein, 109 aa, Glycine max
  Coding DNA Sequence Number=SeqID_29935
MVREGVQENSQVTISSTFHKIFQVLDIWKVFVREVENPLLLENQLHNIFIGNLKIMGKDKYGLKNCMLMMRQKGRFTNVMWEKKGVCGLKIDKEEWWGQEIKVEECNTD

SEQ ID NO: 146714 - protein, 75 aa, Glycine max
  Coding DNA Sequence Number=SeqID_29936
MKNGEKREVVAAQLAHASSTRPGEQDYTAFFWNLRKAQVGLGLRNNACFEGSEGCKQGSRTDCKYSRMKLGYAVA

SEQ ID NO: 146715 - protein, 119 aa, Glycine max
  Coding DNA Sequence Number=SeqID_29937
YAFANLEELFLAPNIITPPKFKVLDFDKYKGTTCPKNHLKMYCRKMGAYVKDEELLIHSFQESLTGVAVTWYTNLEPSRVHARKDLMVAFVRQCHPSGTPNDGKGDDNRDGRHIIDILL

SEQ ID NO: 146716 - protein, 134 aa, Glycine max
  Coding DNA Sequence Number=SeqID_29938
  Subcellular localization annotation: CTP_CleavageSite=73; ConfidenceScore=5.81e-01
MAYPPTSPPPPPSSPPPPPPYPLSNASALSAIVKRTRKASRLRSLSTRPPSVERPVVHVDPATSKADGGRHVRELEGGPYCSEGLDLGGHSDLTRKWALAAAQDGVDDTVYERYGIRMEKWAQFFQTRRDPSWE

SEQ ID NO: 146717 - protein, 183 aa, Glycine max
  Coding DNA Sequence Number=SeqID_29939
  Gene Ontology: Mol. function=nucleic acid binding; Biological process= DNA integration
MENILRSKEYWQVVSNGIPIPEAGMAMTNAQKTEIEGLRLKDLKAKNCLFQAIDRPILETILCKDTSKDIWDFVKKKYQAIWVRKILEELCFKQQGPTPIYCDNNSVIKLSKNPVLHGHIKHIDVKYHFLRNLSNDGIINLIFCRSKDQVADILTKPLKAPLFQKLQNCLVTWGISMDSVIAG

SEQ ID NO: 146718 - protein, 136 aa, Glycine max
  Coding DNA Sequence Number=SeqID_29940
MTLMNQSTDPRIYSIARYGRSYSSMQSIVSVLLWLKGRGDEYRNILGLGTIPTGTQLQTFDASSFIGNNLCGPPLPINCSSNGKTHSYEGSDGHGVNRFLSCGTVPGVGGQHCPSPEKGRQGLNVCRLPGLEPSQS

SEQ ID NO: 146719 - protein, 45 aa, Glycine max
  Coding DNA Sequence Number=SeqID_29941
MGVEQGGDSILGNHVGVVVTAWASLSFFLTPPVPVLLLPALVEVA

SEQ ID NO: 146720 - protein, 109 aa, Glycine max
  Coding DNA Sequence Number=SeqID_29942
MGAYAKDEKLLMHFFQESLAGAAITWYTNLESFQIRSWKDLMVAFIRGAWVLQRIRPEVEGFDDSSSAPNDGKGNDHNDSRHFTCVLLREDGWVHALKFHGFGICEQKD

SEQ ID NO: 146721 - protein, 203 aa, Glycine max
  Coding DNA Sequence Number=SeqID_29943
  Gene Ontology: Mol. function=DNA binding
  Homolog annotation: Hit_ID=Q1SFS3; Match level="QueryCoverage=80%, HitCoverage=31%, E-value=5e-16, Identity=39%"; Hit description =Lambda repressor-like, DNA-binding
MGSDQVPPFKKRFYHVKVKNLELARLRKLGQWMDQVQCQAFSKMLHFWGLSVSTNHRGVRRDLRMPARGRKPYLFSGFYPSMARIEKMVKISEQELDYVKQNRNGVAGIPRKRLEEKAKALASQGEWAAFINVLALLVFGTILFPNVDGLVDLVAIDAFLAYHHSKESPIIAILADLYDTFDLRCEKSSARIVCCTPALYVWL

SEQ ID NO: 146722 - protein, 288 aa, Glycine max
  Coding DNA Sequence Number=SeqID_29944
  Gene Ontology: Mol. function=DNA binding
  Homolog annotation: Hit_ID=Q1S0F5; Match level="QueryCoverage=59%, HitCoverage=33%, E-value=5e-14, Identity=31%"; Hit description=IMP dehydrogenase/GMP reductase
  Subcellular localization annotation: CTP_CleavageSite=14; ConfidenceScore=5.15e-01
MDGSSSVPSLQQVSTNHRGVRRDLRMPARGRKPYLFSGFYPSMARIEKMVKISEQELDYVKQNRNGVAGIPRKRLEEKAKALASQGEWAAFINVLALLVFGTILFPNVDGLVDLVAIDAFLAYHHSKESPIIAILADLYDTFDLRCEKSSARIVCCTPALYVWLVSQVFIYHEGRFVYPLQGHHMCSKKGKANWEELFAGMTEASISWFPWWNEGGEGVLCHLGYPMRGAPSEEIIMPFISRGFNEANAKILQKIYKAWNRVGRKDKELRGSSNGVIGGYHKWLKSRT

SEQ ID NO: 146723 - protein, 81 aa, Glycine max
  Coding DNA Sequence Number=SeqID_29945
MALGTMAACPSELRLTPKVTGLPRQAGSFSLKPFEGPSEPKTSLGKLGSMKLNKKTFLPLLFGIFLILDQNIERSFVLCGN

SEQ ID NO: 146724 - protein, 79 aa, Glycine max
  Coding DNA Sequence Number=SeqID_29946
MAERNSEELCGVATMSSSSEERKETGHGEFTITKKAQRNPYNTRSRKMDNEEGVQEQMKADLSALKDQMASITEAMLKL

SEQ ID NO: 146725 - protein, 117 aa, Glycine max
  Coding DNA Sequence Number=SeqID_29947
  Subcellular localization annotation: CTP_CleavageSite=28; ConfidenceScore=5.09e-01
MTSKSSSWRSPVVSGGGGGAWGVGGGFRGREGGRRWMFYAARRCYKSSCNPSIESHQNERDPKAEQCSSKGFSMFRKRIQKTPKREGKRVIWKLFLTVGSLRLAFGSLGTPNNFMVK

SEQ ID NO: 146726 - protein, 60 aa, Glycine max
  Coding DNA Sequence Number=SeqID_29948
MHREEQFDRSAIFKTQLEDLVENEASNPSFVVSSRLVLSGDLGSVNLRHDPYMYMRSVTY

SEQ ID NO: 146727 - protein, 43 aa, Glycine max
  Coding DNA Sequence Number=SeqID_29949
MARVRGPKLLMLRPPLRKVLIETPQDRLGIEQSFVSTPEGSST

SEQ ID NO: 146728 - protein, 82 aa, Glycine max
  Coding DNA Sequence Number=SeqID_29950
VQGSIIDKIIQLIKGANDTIIIQGELFGQKACVCTIMAFIMSSLIEAVPESNKHENAATHTPVSPSSVKHECQLGSEAINPT

SEQ ID NO: 146729 - protein, 178 aa, Glycine max
  Coding DNA Sequence Number=SeqID_29951
  Pfam annotation: Domain name=zf-CCHC; Domain location=147-164; Score =19.0; E_value=0.00072; Accession=PF00098.13; Description=Zinc knuckle
MSLHSSSSVNGEGSTPKDPLYKILDELRSLKLWKEKQERKEKGRHRSHLRPHFHRREKERKPQEANINLSYFHGKDNVEANLVWEIRVEQQLKKKSTSKSYGSHSYPKKDQGQGILGVTPSKPKEDKGKKIEKQAPKASMQEKTSSLKCFICLGRGHITSQCPTTKTMIMRGQDIYSS

SEQ ID NO: 146730 - protein, 119 aa, Glycine max
  Coding DNA Sequence Number=SeqID_29952
MEATGNQIFELWFVGFSFSLPRNTYRGQPEATSDVGSHYPEMVPKSMVDKLVDLTKTRLHGLGGRQCAYQKKNDEDMTKSKGKDPLEGLGGPMTRARARKAKEALQQVLSILFEYKPKF

SEQ ID NO: 146731 - protein, 67 aa, Glycine max
  Coding DNA Sequence Number=SeqID_29953
MEFALSATLGFLVGLLHAKRELAAKRASALGRSCALSELSKSPTLLQGFFFKFLHQLSSKALEIFFF

SEQ ID NO: 146732 - protein, 57 aa, Glycine max
  Coding DNA Sequence Number=SeqID_29954
MYNFTMFDNIVNGSTTLDYVTGTYPIAIHNSTYGSQRFVNNDMKETMEFKDQLATSY

SEQ ID NO: 146733 - protein, 77 aa, Glycine max
  Coding DNA Sequence Number=SeqID_29955
MNAQNFENIGLSPLDFVYSICNMFESDEVSTSSGTNELPSSQINEKSENDFIGNIPGSEVQAAATSTNSEPNKRPTP

SEQ ID NO: 146734 - protein, 52 aa, Glycine max
  Coding DNA Sequence Number=SeqID_29956
MNEDQTKNGEEWRIIFMDLLTETSQKQYGSTSAWIFFMETRKKGGVCRPEAS

SEQ ID NO: 146735 - protein, 76 aa, Glycine max
  Coding DNA Sequence Number=SeqID_29957
MVWHLQSSFFHFHSAAIDLQKEKDSIDEEDSRPTSSTWSYVKFSPLLNIETPSNTPRMPIYKQRVTLGKLQLTQVS

SEQ ID NO: 146736 - protein, 70 aa, Glycine max
  Coding DNA Sequence Number=SeqID_29958
MEIHRQCKIVMQVDRVSGHHIAMDVVTLPRPFLHPGSHELRQMIFLDGIKDGVSLVFWTPRVIDNVQHAK

SEQ ID NO: 146737 - protein, 89 aa, Glycine max
  Coding DNA Sequence Number=SeqID_29959
MFFKCDDVVPIALEDAFRELSSCAKQTLWAQRASTVKHSFSALNVTREYGSAQKSRPRAKREISSLSETFVSCQAQRTAGAKPKSTYSR

SEQ ID NO: 146738 - protein, 121 aa, Glycine max
  Coding DNA Sequence Number=SeqID_29960
TRGVLIPYSCVKTTPEPFTLKVRRPHLFRFFRHFPQINVGGDSARLPPLEDAPVSVALPLKGRLRQSAINLVTSKQIAPQTSNGLRRVIRKVMKKERPRRLTSLGMTTIHPKNLKRRKSTF

SEQ ID NO: 146739 - protein, 140 aa, Glycine max
  Coding DNA Sequence Number=SeqID_29961
MELLLLRAGLREEERTSIARFLSGLNMEVRDKVELLPYRDLDELVQLCIRVEQQLKRKPSSKSCGSHSYPRKDQAHGILGAAPSKPKEDKEVTLPLNAPTKKTMIMRGQDIYSSQEETTSCPSSSESEDEVRGEESSEEV

SEQ ID NO: 146740 - protein, 44 aa, Glycine max
  Coding DNA Sequence Number=SeqID_29962
MGPQELQNGADEEWVYARHILSRRQRRPPSWGARAISEIPFWKN

SEQ ID NO: 146741 - protein, 736 aa, Glycine max
  Coding DNA Sequence Number=SeqID_29963
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=81%, HitCoverage=82%, E-value=1e-127, Identity=71%"; Hit description =Strubbelig receptor family 3
  Pfam annotation: Domain name=Extensin_2; Domain location=158-419; Score=-131.2; E_value=0.035; Accession=PF04554.4; Description =Extensin-like region
  Pfam annotation: Domain name=LRR_1; Domain location=123-145; Score =18.7; E_value=0.021; Accession=PF00560.23; Description=Leucine Rich Repeat
  Pfam annotation: Domain name=LRR_1; Domain location=147-168; Score =13.4; E_value=0.81; Accession=PF00560.23; Description=Leucine Rich Repeat
  Pfam annotation: Domain name=LRR_1; Domain location=169-188; Score =6.7; E_value=16; Accession=PF00560.23; Description=Leucine Rich Repeat
  Pfam annotation: Domain name=LRR_1; Domain location=75-97; Score=9.7; E_value=4.3; Accession=PF00560.23; Description=Leucine Rich Repeat
  Pfam annotation: Domain name=LRR_1; Domain location=99-121; Score =10.3; E_value=3.4; Accession=PF00560.23; Description=Leucine Rich Repeat
  Pfam annotation: Domain name=Pkinase; Domain location=404-685; Score =89.2; E_value=1.3e-23; Accession=PF00069.15; Description=Protein kinase domain
  Pfam annotation: Domain name=Pkinase_Tyr; Domain location=404-672; Score=81.7; E_value=2.4e-21; Accession=PF07714.7; Description =Protein tyrosine kinase
  Pfam module annotation: Pfam domain module=Extensin_2::LRR_1::LRR _1::LRR_1::LRR_1::LRR_1::Pkinase::Pkinase_Tyr; Domain location=158 -419::123-145::147-168::169-188::75-97::99-121::404-685::404-672
DASVIGFTESCVLKIKLEVEINGLEEIWFGVGESEDLWTSSIGISVYLHNSDFKCISDLSSNNIGGNIPSSLPVTLRNFFLAANQFTGSIPTSLSTLTGLTDMSLNENFLTGEIPDAFQSLTQLINLDLSHNNLSGELPPSMDNLLALTTLRLQNNQLSGTLDVLQDLPLKDLNVENNQFAGPIPPKLLSIPAFRQAGNPFNVNGTTTPASSPRSPAIAPPGTPISGAPPGTPVSGTPPSSGRVPTKQADGPTADLFSLFQGVAEENGMTEGPSNIKLVHMEPKEGHQAESRRTWVTPNPQGEQEKDVHRNRMATIPKPVEHEIDTSTLEVYSMPPPPPPPPPPPPPPPPPPPPPTEKVIIEPASSRSGTNVNPVNPSIRSSVPPPTFAKFFAIASLQQYTNSFSQENLIGGGMLGNVYRAELPNGKLLAVKKLDKRASAHQKDDEFIELINNIDKIRHANVVELVGYCSEHDQRLLIYEYCSNGSLYDALHSDDDFKTRLSWNSRIRISLGAARALEYLHEQCQPPVVHRNLKSANILLDDDLSVRVSDCGLAPLIASGSVSQLSGNLLTAYGYGAPEFESGIYTYQSDVYSFGVIMLELLTGRQSHDRARARGEQFLVRWAVPQLHDIDALSRMVDPSLNGNYPAKSLSNFADIISRCLQASNVRGRPILTKYDEEGVSAKYLMLKNSIQYLTQKFPPQWETSWFGGDYIEIDLWRVNHGNVWRRNKDGGGGSK

SEQ ID NO: 146742 - protein, 123 aa, Glycine max
  Coding DNA Sequence Number=SeqID_29964
MPISPCGRIAPTRHPVDPEEPNRALGFPALVTGLCQSYRVSVPPSKDRARKIPSGPREVQQGLGVSSSDYGPLSVQRSACRPQQGHQAIDTPPPPLKPLSSSSKARALPTTRGRLAGDQVQSQ

SEQ ID NO: 146743 - protein, 150 aa, Glycine max
  Coding DNA Sequence Number=SeqID_29965
  Homolog annotation: Hit_ID=Q2HTL5; Match level="QueryCoverage=72%, HitCoverage=51%, E-value=3e-08, Identity=35%"; Hit description =Ribonuclease H
MWSLKLFLAKSELLASKRWVGPLLPKDLSKLTLYLAWPKALQMVLEGVYQSHPFAALVDKIPKLISYDWNLSFPHTLREGNRIADLWAKQDVLEVASLVSHCSHPLDLEDSLLADAIGILSISSKFKTDYCCTMQNEHNAHTKTKNAKRI

SEQ ID NO: 146744 - protein, 71 aa, Glycine max
  Coding DNA Sequence Number=SeqID_29966
MKEFNFFIEDMELVDTQLVGGNSLEFEPERIKGLDRIFLKGCFHRVQEAHAIVCPIAYFLLNQSMPHSLIS

SEQ ID NO: 146745 - protein, 155 aa, Glycine max
  Coding DNA Sequence Number=SeqID_29967
  Homolog annotation: Hit_ID=O82347; Match level="QueryCoverage=66%, HitCoverage=51%, E-value=4e-22, Identity=39%"; Hit description =Expressed protein
MGEELKKTIGNIMDDITFKYPLNTFTSIEKYKLIFWSLRFHGKILFREIALEVYRIWQPLENVILIRWNLRDVPQVPWEAKGKFQDNLAFNFPHTLKPVSVLDLVTACPASPNLTFSWGPLDSNSSSWLEFYQAVKYTVDQEERLLPQECMATCS

SEQ ID NO: 146746 - protein, 199 aa, Glycine max
  Coding DNA Sequence Number=SeqID_29968
  Gene Ontology: Mol. function=transferase activity; Cellular component= mitochondrion; Biological process=DNA integration
  Homolog annotation: Hit_ID=Q1SX87; Match level="QueryCoverage=70%, HitCoverage=10%, E-value=3e-59, Identity=75%"; Hit description =Polynucleotidyl transferase, Ribonuclease H fold
KKRRRSRDESRHGLIMERARQTKSVSYLCFPLISDKRLLALGIKGFLILLLPLGSLTKQYAAKIIERAGMSNCSSCPTPVDTMSKLSATGDAPFNDPTKYRSLAGALQYLTFTRPDISYVLQQICLHMHAPTNEHMSALKRIIRYLQGTLSHGLHLYKSTIDRLISYTDADWGGCPDTRRSTSGYCVFLGDNMISWSSK

SEQ ID NO: 146747 - protein, 244 aa, Glycine max
  Coding DNA Sequence Number=SeqID_29969
  Gene Ontology: Mol. function=transcription factor activity; Biological process=regulation of transcription, DNA-dependent
  Homolog annotation: Hit_ID=Q6YUW7; Match level="QueryCoverage=86%, HitCoverage=27%, E-value=5e-48, Identity=46%"; Hit description =Chromosome structural maintenance protein-like
MVLIENIIQTSAKEIFPSYIGQLDEESVTGIQSSARLSWLHLIDLKIAFEKRIKSLVDHSGILLSFDDDIMQKNSSLSVFCDHPDWLDLWAEIELGDALGKLKPDIQDENNCRKKVQSVVLSSYSDDHKSPLISNAFLRHLASIIDRCRSLPSVFLRSKFLRFRGVSIIRNFFDSILIRCQEAKGLTTLTDDDSVIKVTISVNVAHSFQFVLKEWFEDVFFLEMGMDEDDKTELESNSNSYEGN

SEQ ID NO: 146748 - protein, 303 aa, Glycine max
  Coding DNA Sequence Number=SeqID_29970
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-35, Identity=27%"; Hit description= UPI00006A17C9 related cluster
  Subcellular localization annotation: CTP_CleavageSite=62; ConfidenceScore=5.06e-01
RPTRPHLKRPTRPRLQRATHPHLQRTTHPCLQRTTRPHFQRTTRPHLKSATHPYHQRTTRPRLQRATRPLLYRTTRPHLQKATRPRLHRGRCPHLQITTRPHFQRTPRPRFRGATRPPLQRTTCPHLQRNNGSDLQRATRLHLKRPTRPRLQRATHTHLQRITGPDLQRATRPQLKMPTCPRFQSTTRPPLQWSTRPHLPRTTHPRLQRTTHAHLQRTTPPRLQRARFPHLESTTRPRLPRTLRPRFHRATRPPLQRTTRHQLQRATRPNLLRTTRPRLQRTACPPLQRSTFPHLPRTTRPRL

SEQ ID NO: 146749 - protein, 341 aa, Glycine max
  Coding DNA Sequence Number=SeqID_29971
  Gene Ontology: Mol. function=aspartic-type endopeptidase activity; Biological process=proteolysis
  Homolog annotation: Hit_ID=Q8H6Q8; Match level="QueryCoverage=99%, HitCoverage=48%, E-value=7e-24, Identity=30%"; Hit description=CTV.20
MTTPFKTKDINEEVTSKDIKSLMEQANYRNKYLQVLGESIKAKASSKQRTHEESPSNILIEKPLFKPFKVSEKEKQKIRKLRKHKSLTEGVGDNNSELLNKIDSLLKFTPKTPQPSEESSKMRTRNTSKLINVINEDSDQNSEQTSEEGSISGKDINPINSKHWKTPSKLNYQRPIATDLLLEGRGESNFKSFSANNFYEWNIDAQTKCNIMNTLQHMTMVATAYQTSHECSEETIIDILVAGFSGQLKGWWDNYLTNDKKEIHDAVNTLIFTIAQHFIDDPSLWKDRSVELLSNLKCRTLADFRWYRDTFLTRVYTREDSQQPFRKEKFLAGLPRSLGDK

SEQ ID NO: 146750 - protein, 186 aa, Glycine max
  Coding DNA Sequence Number=SeqID_29972
  Gene Ontology: Cellular component=integral to membrane; Biological process=protein transport
  Homolog annotation: Hit_ID=Q9SKT3; Match level="QueryCoverage=85%, HitCoverage=56%, E-value=1e-63, Identity=71%"; Hit description =Putative secretory carrier-associated membrane protein
  Pfam annotation: Domain name=SCAMP; Domain location=98-186; Score =91.6; E_value=2.4e-24; Accession=PF04144.4; Description=SCAMP family
MDVTIPSGYKSLRDGAFKDIRWFWTQNTGSVPSANSRLSPLPPEPYDRGATIDIPLDNAKDIKAKEKELQAKEAELKRREQELKRREDAIARAGIVIEEKNWPPFFPIIHHDIAKEIPIHLQRIQYIAFTTWLGLVLCLLWNIVAVTTAWIKGEGPTIWFLAIIYFISGAPGSYVLWYRPLYRAMR

SEQ ID NO: 146751 - protein, 100 aa, Glycine max
  Coding DNA Sequence Number=SeqID_29973
  Gene Ontology: Cellular component=integral to membrane; Biological process=protein transport
  Homolog annotation: Hit_ID=Q9SKT3; Match level="QueryCoverage=96%, HitCoverage=33%, E-value=3e-27, Identity=66%"; Hit description =Putative secretory carrier-associated membrane protein
  Pfam annotation: Domain name=SCAMP; Domain location=4-82; Score=27.1; E_value=3.2e-08; Accession=PF04144.4; Description=SCAMP family
AHFFFPSFYKQLHIAFCILAAVAPPIIFKGKSLTGILAAIDVLGDNALVGIFYFIGFGFFCLESVLSIWVIQQVYMYFRGSGKATVLKREAARGTMMAAL

SEQ ID NO: 146752 - protein, 570 aa, Glycine max
  Coding DNA Sequence Number=SeqID_29974
  Gene Ontology: Mol. function=protein binding; Cellular component =nucleoplasm; Biological process=snoRNA metabolic process
  Homolog annotation: Hit_ID=P53919; Match level="QueryCoverage=60%, HitCoverage=71%, E-value=2e-18, Identity=31%"; Hit description =Hypothetical 54.9 kDa protein in SPC98-TOM70 intergenic region
  Pfam annotation: Domain name=NAF1; Domain location=184-347; Score =273.4; E_value=4.6e-79; Accession=PF05492.3; Description=NAF1 domain
MAFQHENGSNIDPNPIGVETAMASQHENGSEIDPNPTGVETSMSSLHENGSEIDQNLIGAEAHEAEAEKFGTLGCAGPIEEGLEKITLVGSSLSVEENGVKDDSEIEVEIESESESENSESESPSSDSGSGSSSSSSDSSSDSEDTDDDDKDDDVEVEEGEISGSDEEKMVSWSMADEDDDEDGDVGGGPIRSKNELQNLPPVPPVDVTLEPHHQTLPVGIVTSILGAQVIVEGVEKHGPLNEGSILWLTESRKPLGLIDEIFGPVKNPYYVVRYNSESEVPTGIHEGTLISFVPEFADHVLNNKDLYRKGYDASGADDEELSDEMEFSDDEKEAEYKRMQKQTKRGANDQNHGKKKNNRKKFSPKEHAAPTIHAAPMLHHGNCPPFSGTGQGLMGGTTPLPPLNVAPTFATNGVWTNGTTFPHQQQSPMLPNGYPTNGMPWYPQNPQISPQFPMPGIPFQQQLHPNQGSLPTTMLPGMPDMFAQSQYAAGLAGQNQMAFGMGSPFPQSQPPMFAAQQGFPSTELHSQRNLNFHSNTISGARSQFHPRSNANRGRKTFHGAGRKGWRPPK

SEQ ID NO: 146753 - protein, 209 aa, Glycine max
  Coding DNA Sequence Number=SeqID_29975
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=82%, HitCoverage=72%, E-value=4e-74, Identity=72%"; Hit description =Protein ULTRAPETALA1
MANGLERESGLTLFSEEELREVSGVKRVGDYVEVTCGCTSHRYGDAVGRLRVFVNGYLEITCECTPGCQEDKLTPSAFEKHSGRETARKWKNNVWVIVNGEKVPLCKTVLLKYYNQVSKAANGSHRSHNGRACHRDEFVRCTSCNKERRFRLRTKEECRIHHDALADANWKCSDLPYDNQSILASLLSIMQAIVYSLGDDVIMSQAGGD

SEQ ID NO: 146754 - protein, 79 aa, Glycine max
  Coding DNA Sequence Number=SeqID_29976
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q3BAG2; Match level="QueryCoverage=98%, HitCoverage=26%, E-value=2e-17, Identity=83%"; Hit description=NADH dehydrogenase subunit F
MGEYNQLSLRISSLDQKQAKGGIPQRESVPTKKEVFVIGRTMKRGRSRATRKIPAATIVAACIRAEIGVGPSIASGSHT

SEQ ID NO: 146755 - protein, 89 aa, Glycine max
  Coding DNA Sequence Number=SeqID_29977
MTRSNSNNEVVALQGLVLLFDASRSGAMRRTVSKWSEAFIKNVVRRWLDHSVKNASEALSSKVVETLSEALPKDVNNGLQWINYENGSP

SEQ ID NO: 146756 - protein, 101 aa, Glycine max
  Coding DNA Sequence Number=SeqID_29978
  Subcellular localization annotation: CTP_CleavageSite=52; ConfidenceScore=5.63e-01
MATPTSSPSLPPPPTGVASQFPSILKRTRNATRLRSLATRLVGVERPLVHVDPATGKADDPHNKKLRTYLGIVTRYKVNVTYKNWKQVPAAQKDLIWEDIQ

SEQ ID NO: 146757 - protein, 84 aa, Glycine max
  Coding DNA Sequence Number=SeqID_29979
MCKGLVEDTRRELQRWLDRGRRGSDGLQGRSVGGHREGIALRGPILLTTRREGPRSPLQKLNVESRIECIFELLVNIYGKSSMC

SEQ ID NO: 146758 - protein, 593 aa, Glycine max
  Coding DNA Sequence Number=SeqID_29980
  Gene Ontology: Mol. function=transferase activity, transferring hexosyl groups; Biological process=carbohydrate biosynthetic process
  Homolog annotation: Hit_ID=Q6K1S5; Match level="QueryCoverage=86%, HitCoverage=93%, E-value=1e-167, Identity=58%"; Hit description =Putative glycogenin 1
  Pfam annotation: Domain name=Glyco_transf_8; Domain location=81-309; Score=112.0; E_value=1.7e-30; Accession=PF01501.10; Description =Glycosyl transferase family 8
MTVERRQHFPVELTAVDHKSQARSQRRPPEFWSETTEKTKLRKFNSTSNHYLIRNYKFKSESYRKKKGCVGSKTKKTDEAYVTLLYGDEFLLGVRVLGKSIRNTGSNKDMVVLVSDGVSDYAKSLLRADGWIVEMISLLANPNRVRPKRFWGVYTKLKIFNMTDYKKVVYLDADTIVVKNIDDLFKCGKFCANLKHSERLNSGVMVVEPSATLFNDMMSKIKTTASYTGGDQGFLNSYYSGFPNAHVFEPNLSPEMFSSRPIPEMERLSTLYNADVGLYMLANKWMVDENELRVIHYTLGPLKPWDWWTSWLLKPVDVWQDVREQLDESLPGTGGGQNSKDSFLVKFLFLLPFCALLFCCYHSFTKNQGYFSTLCRSSLCDQVRHLYYRIRSNGPLAYNSISTSTTNSVHQLLNGAQNKAPAYLGGISVCVCFVVAVVSLGLALLIVPRQVMPWTGLLLMYEWTFTIFFILFGGYIHLIYQWGKIVGSRVASSLSQPGSDYDSEKRHQRQISSCDVATWYYGLGMALLAIAAPSLPCLFGITALFLRLGLMVVGGIILASFMTYASEHLAIRSFLKGFDERENARNSGSCFLC

SEQ ID NO: 146759 - protein, 99 aa, Glycine max
  Coding DNA Sequence Number=SeqID_29981
MDWNTFISNEFGMPVGWRNMDNESQFFYQPNLLCGVEPNDDMRDNNDENVGGEDIDMQTQPSYGKGLTMEKLLHIRSPLMTKGLQSTHTSFQRNTISTS

SEQ ID NO: 146760 - protein, 346 aa, Glycine max
  Coding DNA Sequence Number=SeqID_29982
MVACDMQSFISSMLLEAMGTKPRDGYRRPRWEPALPILSTCKDGDDLKLSGILKHLGYFIDSSKGIILSGFHPKTYYVYNTVTKQKYELPEPQQFYKVLCMALIVEEYLDSDICYKVIRARCECKLKERNTVSIETYSSKTRQWKQSTLMCSTTFALCPRTAAMVVGGVVHWFAMWGKLAIYDPRLGDRYIALIKLPTGVLTHEHEESVLGESSDGLLQYGQSNNLGLEIWILEKESGANSSIYCNCTHLKYKWILRWRLNFKVLWKQMPSLSTHSKETQILSFLPQNSTSIFIRSGWNILLCDLETKTVEIVNYQGRGGTISWESSKVVPYFLPAWPHTSSVSVS

SEQ ID NO: 146761 - protein, 78 aa, Glycine max
  Coding DNA Sequence Number=SeqID_29983
MELIRGKETAWSWEWGPKCVFAWEEIIECVDDTVSRVWGVAGEIANANVNTTLPFALVTCNFEQRPQVWSNSSLSCLK

SEQ ID NO: 146762 - protein, 102 aa, Glycine max
  Coding DNA Sequence Number=SeqID_29984
  Pfam annotation: Domain name=VQ; Domain location=13-44; Score=28.9; E_ value=1.6e-05; Accession=PF05678.4; Description=VQ motif
MQKTPKKTVKITYISSPVLVRAYDASEFRSVVQQLTGNDSNSNKKVERPHKGYSSTLMHQRVMQSHEDAHGIGLYHYNRSTTTSLELDEDYYWKELARSVLP

SEQ ID NO: 146763 - protein, 429 aa, Glycine max
  Coding DNA Sequence Number=SeqID_29985
  Gene Ontology: Mol. function=protein-N(PI)-phosphohistidine-sugar phosphotransferase activity; Cellular component=membrane; Biological process=phosphoenolpyruvate-dependent sugar phosphotransferase system
  Homolog annotation: Hit_ID=UPI00005F74A9; Match level="QueryCoverage =53%, HitCoverage=50%, E-value=2e-75, Identity=65%"; Hit description =COG1263: Phosphotransferase system IIC components, glucose/maltose/N- acetylglucosamine-specific
  Pfam annotation: Domain name=PTS_EIIC; Domain location=2-200; Score =14.9; E_value=4.1e-05; Accession=PF02378.9; Description =Phosphotransferase system, EIIC
MAGILSSPALAQITLFGEALQPGRGGVIAVLLVVALMCWVEKRLRTLLPESVELILNPLLTTLVTASLAILILQPIGGIISDAIAHGANLAIDKGGLLVGALLSGLFLPLVLSGLHQGLVPIHVELVQAHGSNPLLPILAMAGVGQVGAALAVLLKTRNARLKKVIKGALPVGILGIGEPLIFGVTLPLGRPFIGACLGGAVGGALISYWKVATVITFGISGLPLALTIVSGVAFERQAATTGRRGAPRGLFRSGRHPASGGYVRQFLALSAAPFAAEPAAGDTGAAADRPGAAAAGARRALADEPAAVGDYFRALRSEAQGAGAAVYRGLSPEGDRVSGGANAAAAVSGRARCRSVADHRLAGTAGGAGVSRFGVSAARAVDRQPHHAPLRRLGLDSALPGDAKSGAAGAAARRAAKAVQRLQRQQAG

SEQ ID NO: 146764 - protein, 81 aa, Glycine max
  Coding DNA Sequence Number=SeqID_29986
METRDATMARDATMVRYETIFGDLTMCFIVDASEGEGEATRPWPVTLPWPEVVTQSEGVDECGHEGEEEDTEERRRRGSFR

SEQ ID NO: 146765 - protein, 65 aa, Glycine max
  Coding DNA Sequence Number=SeqID_29987
MQTCHRIGLLLQCMIDPRLVTQGTNRYALTEKALAIVRGVTNDGNVNPNRGPSGTRCGCGRQGRG

SEQ ID NO: 146766 - protein, 74 aa, Glycine max
  Coding DNA Sequence Number=SeqID_29988
MGGLVLIVMRGLTMHKKDKNVWRSRRWYRARVSGWALSEIFLLSASSHDFKFSKQLPLAKRNLPANRLQRAERA

SEQ ID NO: 146767 - protein, 103 aa, Glycine max
  Coding DNA Sequence Number=SeqID_29989
  Gene Ontology: Mol. function=nucleic acid binding; Biological process= DNA integration
MTPKEAWSGRKPYVNHFKKFGCIAFAHVPDQKRKKPDDKAKKYVFIGVSETSKAYKLFNPSTKKIVTSKDVVFDEENTWDWNRQQPTQVFLDENDEKGQTSAS

SEQ ID NO: 146768 - protein, 275 aa, Glycine max
  Coding DNA Sequence Number=SeqID_29990
  Gene Ontology: Mol. function=nucleic acid binding; Cellular component= proton-transporting two-sector ATPase complex; Biological process=DNA integration
  Homolog annotation: Hit_ID=Q1RSG2; Match level="QueryCoverage=59%, HitCoverage=16%, E-value=2e-27, Identity=37%"; Hit description =Integrase, catalytic region; Zinc finger, CCHC-type
  Pfam annotation: Domain name=rve; Domain location=149-275; Score =19.9; E_value=0.00013; Accession=PF00665.16; Description=Integrase core domain
  Pfam annotation: Domain name=zf-CCHC; Domain location=55-72; Score =20.6; E_value=0.00039; Accession=PF00098.13; Description=Zinc knuckle
  Pfam module annotation: Pfam domain module=rve::zf-CCHC; Domain location=149-275::55-72
MNQDTITEEQALKASTSSRGRGKGTGKSGRGRGRGDQNNNDGRGRGRNQFDKSKIECYRCHRFGHYRSECYTKLPRDKEKEAISKFVEENEAETLLFKIVRNQNQMFDINLLSASQLQEKGYVITIKHGACEIYDSTRGVIVVVQMSSNRLFPLKIETIQSCLVAEIKDPSWLWHFRYGHLSFGGLKTHNQKNMEKSEAFTAFKFFKARVENEAGKNIKTLHIDRGGEYCSNIFENFCVEHGLRRELTIAYTSQQNGASERKNRTILNMVRSLRT

SEQ ID NO: 146769 - protein, 694 aa, Glycine max
  Coding DNA Sequence Number=SeqID_29991
  Gene Ontology: Mol. function=RNA-directed DNA polymerase activity; Cellular component=chromatin; Biological process=chromatin assembly or disassembly
  Pfam annotation: Domain name=RVP_2; Domain location=206-337; Score= -46.8; E_value=0.0044; Accession=PF08284.2; Description=Retroviral aspartyl protease
  Pfam module annotation: Pfam domain module=RVP_2::RVT_1::Retrotrans _gag; Domain location=206-337::464-633::23-154
MGWIFKISQLFEYQNTPEEERITVASFYLDGAALSWYQWIFRNGFITSWSGFLQALESRFVPSYYDDPKGALFKLTQRGMVNEYLTEFKRVSTSTYLASTSHGSCKAARSPASATATPQHPSPSYLPPNRKSQSTYVQRTPDEMALRREKGLYYNCDEKWSSTHRCKGCMPLFIADNPSPVPDEPILDLPSTPSPEQEPATSLDFDPSSDLNSPHVSLHALSGLPSSETFRLVGVINHTSLTILIDSGSTHNFLQPRIAQFLHLKAQNTSPLHVLVGNDSVLDCNQVCPDTSLSLQGHQFTVTFHLLPISGADAVLGIEWLRQFGPITTDYTTFSMKFTYMGRPIELHADVTTGPKPISAPQVKRLLQTESASALFHLKLIPNPQPLLPHPIPAIESLLTRFHHLFQHPSSLPPPRTIVHHINLLPNTTPINVRPYRYPQFQKSEIEKQVLELLSSGLIQPSMSPYSSPVLLVKKKDGTWRMCVDYRALNAVTIRDRFPVLTINELLDELGSVAWFSKLDLRQGFHQILMHGPDVEKTAFRTHQGHYKYPVMPFGLCNTPSTFQAAMNTLLTPFLMKFAAVFFDDILVYSKTLSSHLEHLEVIFQTLLQGQYHLKRTKCLFAQNQVEYLGHIVSGRGVEPEPSKVQAMVQWPIPLSPKELRSFLGLTGFYRKFIKNYAMIAAPLTSLLAKDAFE

SEQ ID NO: 146770 - protein, 91 aa, Glycine max
  Coding DNA Sequence Number=SeqID_29992
  Gene Ontology: Cellular component=membrane
  Subcellular localization annotation: CTP_CleavageSite=84; ConfidenceScore=5.51e-01
MCKALRSSTTTSFGGVILPRLLIIVGVILLVGSTRLVRFLSCSSRQKRSNVEKNFGLRGATSSRVREPSPSAVIQAATLNHLLSSSAKEKA

SEQ ID NO: 146771 - protein, 418 aa, Glycine max
  Coding DNA Sequence Number=SeqID_29993
  Gene Ontology: Mol. function=chromatin binding; Cellular component =chromatin; Biological process=chromatin assembly or disassembly
  Homolog annotation: Hit_ID=Q1SAV4; Match level="QueryCoverage=87%, HitCoverage=96%, E-value=1e-121, Identity=56%"; Hit description =Integrase, catalytic region
  Pfam annotation: Domain name=Chromo; Domain location=316-366; Score =24.8; E_value=0.0003; Accession=PF00385.14; Description='chromo' (CHRromatin Organisation MOdifier
  Pfam annotation: Domain name=rve; Domain location=1-169; Score=72.5; E_value=1.3e-18; Accession=PF00665.16; Description=Integrase core domain
  Pfam module annotation: Pfam domain module=Chromo::rve; Domain location=316-366::1-169
MQCLSTDQGKYTTSRRPSSTTPATNRGLGGHIPRFHHSVAAISRYSKGIHLGALPTNHSAFKVASLFIEIVCKHHGFPKSIVSDRDPLFLSSFWRELFRLSGTRLRMSTAYHPQSDGQTEVMNRVLEQYLRSFVHEQPATWYRYLTLAEWCYNTSLHSSSGLTPFEVIYGKPPPALPHYLQGASANEVVDSLMSYRQEIHQKLQRHLHKAQETMKRLADDKCRDVNFTVGQWVYVKLRPFRQRTVAGLIHPKLSKRYFGPFQAIERVGQVSYRLKLPEEARIHPVFHCSLLREHHGPSPTPLDSLPLQFIAQKPVARPLCILDSKIETSSSPPTRLVLVQWEGQPPEDTTWEKWSEIRDLHHLEDKVVFAGEGIVSNHLQDLEDTEADKGTESLEPETKEARPKRTTSRPSYLKDYEP

SEQ ID NO: 146772 - protein, 65 aa, Glycine max
  Coding DNA Sequence Number=SeqID_29994
MESGDRRGFYSSRPETCEPDDARDSSLLGGRQSSSMAWGSVVVVPLYRFQDTEVLMTLLMPFLSF

SEQ ID NO: 146773 - protein, 112 aa, Glycine max
  Coding DNA Sequence Number=SeqID_29995
  Gene Ontology: Mol. function=nucleotide binding; Cellular component =cytoplasm; Biological process=metabolic process
  Homolog annotation: Hit_ID=Q84MC2; Match level="QueryCoverage=97%, HitCoverage=48%, E-value=2e-43, Identity=81%"; Hit description =Lysine decarboxylase-like protein At5g11950
  Pfam annotation: Domain name=Lysine_decarbox; Domain location=1-112; Score=120.7; E_value=4e-33; Accession=PF03641.4; Description=Lysine decarboxylase family
MISGEPVGEVRIVSDMHERKAAMAQEADAFIALPGGYGTMEELLEMITWAQLGIHKKPNHPPQVGLLNVDGYYNSLLALFDNGVEEGFIKHGARNILVAASSAKELMMKMEV

SEQ ID NO: 146774 - protein, 144 aa, Glycine max
  Coding DNA Sequence Number=SeqID_29996
MLENTTRTTQTQNNDTLVKELPLPLALQQHPNVDPKIVKRTTSERRLSFHLRKKMPKSFSVARNWDQKGNYNDAGKKGKLLKTDNDSMWMKTKGKLKNDDSVWMKTIILGGKSVPDEGKAKKISAYHPRKASVSLSRQCSFINP

SEQ ID NO: 146775 - protein, 104 aa, Glycine max
  Coding DNA Sequence Number=SeqID_29997
MPFMEKDEFFTTEEDKKKKTVLQKKADQFIGQFNGGVTENLTVARVAAAKDTEALELAFGEAMFHFFLSFFLPPFDDDDDDFVLEEIQDHWNSENNINLYHIRS

SEQ ID NO: 146776 - protein, 86 aa, Glycine max
  Coding DNA Sequence Number=SeqID_29998
MDAPDLNFQMQCGTYRIQYQGNSPKRVYTTPHLGNHAVFFEATQSCTVTPPGDQPMATRSSLPGDTPPSTKYILLQFILFPVSYEV

SEQ ID NO: 146777 - protein, 413 aa, Glycine max
  Coding DNA Sequence Number=SeqID_29999
  Homolog annotation: Hit_ID=O64852; Match level="QueryCoverage=99%, HitCoverage=99%, E-value=8e-89, Identity=45%"; Hit description =Putative SF16 protein
  Pfam annotation: Domain name=IQ; Domain location=123-143; Score=5.2; E_value=11; Accession=PF00612.17; Description=IQ calmodulin-binding motif
  Pfam annotation: Domain name=IQ; Domain location=75-95; Score=26.2; E_ value=0.00012; Accession=PF00612.17; Description=IQ calmodulin -binding motif
  Pfam annotation: Domain name=IQ; Domain location=97-117; Score=16.5; E_value=0.097; Accession=PF00612.17; Description=IQ calmodulin -binding motif
  Pfam module annotation: Pfam domain module=IQ::IQ::IQ; Domain location=123-143::75-95::97-117
  Subcellular localization annotation: CTP_CleavageSite=58; ConfidenceScore=5.02e-01
MGASGKWVKALIGLNNKSDLGGKKKKWRLWKSSSAGENRSQGNDYASSVASDSFNFAVATVVRAPPKDFKLLKQEWAATQIQTAFRAFLARRALRALKGVVRLQALVRGRLVRKQAAVTLRCMQALVRVQARVRARRVRMSIEGQAVQIMLNERRTKAELIKQAEEGWCDSKGSLKDVKTKLQMRQEGAFKRERAIAYSLAHKQWRSTPISNSRANAALNNHEMDKANWGWSWLERWMAAKPWESRLMEQTHHADATEKTPPPPPPKKCVDSSNSKTSELCNIKIRKNNVSTRISARPPHIGQATRLSSSPSSEFHYDESCSNSSSICTSTTPIPCDRTEDSNNSRPSYMNLTESTKAKQKTSNHQYNRSQRQQSMDEFQFLKRTAVFSNASDPSTNFSRPLYLPTYMDKSSR

SEQ ID NO: 146778 - protein, 469 aa, Glycine max
  Coding DNA Sequence Number=SeqID_30000
  Gene Ontology: Mol. function=monooxygenase activity; Cellular component=membrane; Biological process=electron transport
  Homolog annotation: Hit_ID=Q1RV73; Match level="QueryCoverage=96%, HitCoverage=85%, E-value=0.0, Identity=83%"; Hit description=E-class P450, group I
  Pfam annotation: Domain name=p450; Domain location=1-465; Score =173.6; E_value=5.1e-49; Accession=PF00067.12; Description=Cytochrome P450
MEKEEKGKDEYELIFHMGRQPLILVADPELCKEVGIKKFKDIPNRSIPSPISASPLHQKGLFFTRDSRWSTMRNTILSVYQPSHLASLVPTMQSFIESATQNLDTPNEDIIFSNLSLRLATDVIGEAAFGVNFGLSKPHSVCESIKSVSVNNVRNDDDEVSDFINQHIYSTTQLKMDLSGSFSIILGLLAPILQEPFRQILKRIPGTMDSKIESTNEKLSGPLDEIVKRRMEDKNRTSKNFLSLILNARESKKVSENVFSPDYISAVTYEHLLAGSATTAFTLSSIVYLVAGHREVEKKLLQEIDGFGPPDRIPTAQDLHDSFPYLDQVIKEAMRFYTVSPLVARETSNEVEIGGYLLPKGTWVWLALGVLAKDPRNFPEPEKFKPERFDPKCEEMKRRHPYAFIPFGIGPRACIGQKFSLQEIKLTLIHLYQKYVFRHSVDMEKPVEMEYGMVLNFKHGIKLRVIRRT

SEQ ID NO: 146779 - protein, 91 aa, Glycine max
  Coding DNA Sequence Number=SeqID_30001
  Gene Ontology: Mol. function=oxidoreductase activity; Cellular component=membrane; Biological process=electron transport
  Homolog annotation: Hit_ID=Q2MIZ8; Match level="QueryCoverage=82%, HitCoverage=14%, E-value=2e-15, Identity=57%"; Hit description =Cytochrome P450 monooxygenase CYP711A12
MVSIVLEWLFPFPCVAMFTTLLMLIGGLLGYLYGPYWGLRKVPGPPTLPLVGHLPLLAKYGPDVFSLLAKQYGPIYSVLVHIAWEEVDIIT

SEQ ID NO: 146780 - protein, 76 aa, Glycine max
  Coding DNA Sequence Number=SeqID_30002
MYIRIKGVTFSSRNCIDNCRYSTINSVCTMSTPESMTHNTMNSVCTMSLILDAYNDAHSVSTRNLTGTMSMHIVST

SEQ ID NO: 146781 - protein, 57 aa, Glycine max
  Coding DNA Sequence Number=SeqID_30003
MTMTMTLTLRLRKLNKEEELDDYDDEDDDLRSTRVWLLLSSHVTSHELSSSLDNQIF

SEQ ID NO: 146782 - protein, 309 aa, Glycine max
  Coding DNA Sequence Number=SeqID_30004
  Gene Ontology: Mol. function=hydrolase activity; Biological process =metabolic process
  Subcellular localization annotation: CTP_CleavageSite=51; ConfidenceScore=5.41e-01
MDFTTFANSISYSHAIPPIHPYRLQPSPFPLHLPFSNLKRSGLVKNRLIARCTSKSDEFGSVNGLQFTPNKLFVEEVFFLYTFHFPSILQNFVGAAIGAEYGEGFETFRADGPLKVDVDYLNEKLQDGFLQRIRYAMKPDEAYGLIFSWDNVVAGTRALKRKAWEQLAFEEGKDIPEEGDMHKLLFYAGADYVLHKFFLSDKAENELNRLKLRFSQIYYDNLVRLEKPMDGLNDWLEAVYTARIPCAVVSSLDRRNMLEALERMGLSKYFQAIVTEEDGMESIAHRFLSAAVKVEFHPPDSIFDEMFLA

SEQ ID NO: 146783 - protein, 559 aa, Glycine max
  Coding DNA Sequence Number=SeqID_30005
  Homolog annotation: Hit_ID=Q10LQ3; Match level="QueryCoverage=94%, HitCoverage=97%, E-value=5e-44, Identity=30%"; Hit description =Expressed protein
  Pfam annotation: Domain name=DUF827; Domain location=48-407; Score =172.3; E_value=1.2e-48; Accession=PF05701.2; Description=Plant protein of unknown function (DUF827)
MAETRDAAADGVPGTPAIREMRPETATHAGIGSGGIRRVNFRAEIDTSPPFGSVKEAVTRFGGSGPWIPFFNNIEDFDLKKVEEQAAELEKDLIVKELETLDVLEELGATKRIVEDLKQQLQKEAMKCLATQDVNSYEQVGTTVIKEMDKENCGSNVNDQEQVMQIPSPCSMSSSPDMILIELKQAKLNLGKTINELGVIQSSVESLNKKMKKEKLFLERTREKLATKFAAVSAQERVQEQTRLNPPAPHVEFNFGNTANNFNSDSRQCNRMAETRRPEPSKPLNVYEEYGFSVKTAEMRWLAAKKMEEAARAAEAIALAEIKALSNNAERSSGLVLPEPEKVTFAFGECSPLNLKAQIPEESTLKKVIDSNFQVDETKISKLTILKKLEEAAEEVLHSKQVLTDALNRVETANRKQHAAKEALRRWIPEDDMKEYNNTINCNKFHQAGIYQDSLQDVTRSTTSNNDPKPALRTTISMRDVLSRKQVPEGYATRKEMEEHTERQKVALSQMLQALREDLTLPPKTEKDGSNQKPFVAQRKKFGFIQISLPLAKPNKKRG

SEQ ID NO: 146784 - protein, 408 aa, Glycine max
  Coding DNA Sequence Number=SeqID_30006
  Gene Ontology: Mol. function=uroporphyrinogen decarboxylase activity; Cellular component=chloroplast; Biological process=chlorophyll biosynthetic process
  Homolog annotation: Hit_ID=Q42967; Match level="QueryCoverage=93%, HitCoverage=94%, E-value=1e-174, Identity=80%"; Hit description =Uroporphyrinogen decarboxylase, chloroplast precursor
  Pfam annotation: Domain name=URO-D; Domain location=52-406; Score =615.5; E_value=4.6e-182; Accession=PF01208.8; Description =Uroporphyrinogen decarboxylase (URO-D)
MLCVNTCLHLFLTQKINLRLFLQINHPNFLHPPSYSGKSCSGTVAEPKSTAAAEPLLLNAVRGIDVERPPVWLMRQAGSGLCCFMKMELLLDSVGSYQTICEKYPSFRERSENVDLVVEISLQPWHVFKPDGVILFSDILTPLSGMNIPFDIVKGKGPVIFDPIHTSAQVDQVKEFIPEESVPYVGEALTILRKEVDNKAAVLGFVGAPFTLASYVVEGGSSKNFSKIKRLAFSESKILHSLLQKFTTSMARYIQYQADNGAQAVQIFDSWATELSPVDFEEFSLPYLKQIIDTVKKSHPDLPLILYASGSGGLLERLALTGVDVVSLDWTVDMADGRRRLGPNIAVQGNVDPGVLFGSKEFITDRITDTVRKAGRGKHILNLGHGIKVGTPEENVAHFFEVAKSIRY

SEQ ID NO: 146785 - protein, 106 aa, Glycine max
  Coding DNA Sequence Number=SeqID_30007
LPTDHREIETALCIPGKWFILNAEGHPGRILRKDLTTLAQVWSALSYSNLAPTSHTSDLTMDRAKGKGIALKISSFPGEKEGDCLEFLTIHGQCIDGAHVSYFIIA

SEQ ID NO: 146786 - protein, 124 aa, Glycine max
  Coding DNA Sequence Number=SeqID_30008
MTITLDDVASLLDILIIGAFYNCEHMDKEATIPVLFEELNIGMPLMRQRKQEVFMGATSLTYLYEHLGDASFAGTNQIGCYATLLQDMKIPLCRNLPFGGRATRDSRDACSTKGIRAESPPTFI

SEQ ID NO: 146787 - protein, 160 aa, Glycine max
  Coding DNA Sequence Number=SeqID_30009
  Gene Ontology: Mol. function=histone-lysine N-methyltransferase activity; Cellular component=nucleus; Biological process =multicellular organismal development
  Homolog annotation: Hit_ID=Q8L8Q3; Match level="QueryCoverage=77%, HitCoverage=78%, E-value=2e-51, Identity=78%"; Hit description=LOB domain-containing protein 25
  Pfam annotation: Domain name=DUF260; Domain location=10-110; Score =230.3; E_value=4.4e-66; Accession=PF03195.5; Description=Protein of unknown function DUF260
MASSSYSNSPCAACKFLRRKCMPDCIFAPYFPPEEPQKFANVHKIFGASNVSKLLNEVQPHQREDAVNSLAYEAEARIKDPVYGCVGAISVLQRQVIRLQKELDATSADLIRYTCNEMPTTTQDGRRIIGEGGGSSLGQSSGYYYPSPWNNDTLGDGYHR

SEQ ID NO: 146788 - protein, 99 aa, Glycine max
  Coding DNA Sequence Number=SeqID_30010
MIETKENLQEEKEDLRGRIPQSKPKESKEKKGKEDKLGLEIPMRGKVKKPQKHLEAIIGLQPQGQSERRELKMVHLIQVEESPNLIINVPTWAYNLIFS

SEQ ID NO: 146789 - protein, 207 aa, Glycine max
  Coding DNA Sequence Number=SeqID_30011
MVYSNEPDEEACSEGRRTFWDKNRVTLDCYITTDELREAITEHQMGDEAAIDEVFNDVDFDKEIFTHVCLCSTPVEKQKIDTWDLATKAGVTAAFIMFVTFAASAITQCRQTHECSTITWLARVACRKTYFLVTVISETTKDKDNKSKAQIKHQGFHQVQCTNLDQTMLNESDNLAHDDTTDEGWQEAVPKGRSLIARKSASSTSPT

SEQ ID NO: 146790 - protein, 66 aa, Glycine max
  Coding DNA Sequence Number=SeqID_30012
MMRTMIQREWREELGFPVAQNAVDSDSKCHSASSMVLPFEKLFRDFNRFKRKGLKKDEVWALWGVI

SEQ ID NO: 146791 - protein, 139 aa, Glycine max
  Coding DNA Sequence Number=SeqID_30013
  Gene Ontology: Mol. function=nucleic acid binding; Biological process= DNA integration
  Homolog annotation: Hit_ID=Q1T693; Match level="QueryCoverage=98%, HitCoverage=18%, E-value=1e-16, Identity=53%"; Hit description =Integrase, catalytic region; Zinc finger, CCHC-type; Peptidase aspartic, catalytic
MVLAERVMIPLEGEISCKIVNAKTDKEVWDILKLSYKGAEKAHKSKFQSLRREYESNMKVYGEDILDNKVVDKTLHTMKRKFSKVEAKEIIEVEEWGNINQGRNNNLGSFGRGRGGDTFGSANQGRGRGLELQTADSNK

SEQ ID NO: 146792 - protein, 156 aa, Glycine max
  Coding DNA Sequence Number=SeqID_30014
  Gene Ontology: Mol. function=nucleic acid binding; Cellular component= endoplasmic reticulum membrane; Biological process=DNA integration
  Homolog annotation: Hit_ID=Q1SB62; Match level="QueryCoverage=75%, HitCoverage=10%, E-value=2e-39, Identity=69%"; Hit description =Integrase, catalytic region; Zinc finger, CCHC-type; Peptidase aspartic, catalytic
MIFLSARACDILKKFKMKNSKPISTPAQENLMLKKESDKKMVDATQYKSIGSLSYMTGTRPYIVFGVGLLNRFIEESHVCHLQGVKRILCYIKGTLTDGIFYANDNDVKLVGYTDSDWAGVGFLLQLLFGPLFLYANMFNGNSVCWKAHRIVNLNY

SEQ ID NO: 146793 - protein, 50 aa, Glycine max
  Coding DNA Sequence Number=SeqID_30015
  Homolog annotation: Hit_ID=Q1T693; Match level="QueryCoverage=96%, HitCoverage=6%, E-value=6e-10, Identity=67%"; Hit description =Integrase, catalytic region; Zinc finger, CCHC-type; Peptidase aspartic, catalytic
MEYVRDVKLETGTENLFQPESLRRKTWVYFLKQNSEAYDAFKMFKALAEK

SEQ ID NO: 146794 - protein, 105 aa, Glycine max
  Coding DNA Sequence Number=SeqID_30016
MGIMPNQGWPPVVVSFRIQILDLLCAFIVILDVAMHCRLSCKLLNWLIQQGNPSSKYLQPMVKDIKQMLSLQGWNTSFDDIYREANGCADLSQLGLLRELSILSC

SEQ ID NO: 146795 - protein, 106 aa, Glycine max
  Coding DNA Sequence Number=SeqID_30017
MGCGENGLRVGIGWGKGCDLLQRLKGREGAQVLVVRAMVELQWWGAVNEETMVEIGPGVVHDTEGKSYRDMMENWIVGLMKEIKLMKVSFLPVINQDDIKIPSWYI

SEQ ID NO: 146796 - protein, 221 aa, Glycine max
  Coding DNA Sequence Number=SeqID_30018
  Homolog annotation: Hit_ID=Q84QI2; Match level="QueryCoverage=49%, HitCoverage=35%, E-value=2e-11, Identity=36%"; Hit description=REX1-B
MEEEYFDFEKKVSIKETMSMEVDPAKVLLLLRGFLQIQQRRAEAYSKLKCGFSDYMASGGELAYKQLCSEITIEFNDCSKKVLEMESLFTSPDYCRVDLAQLLRAIQDQEKLKLQLKTPLQAYFTVVATRNMTATIQVLKKAGRPSERLVSHENCKFTKPAEHECVHVQEITEASGTEEAEADAEYDNALKEAIRGVQDAVMAINERMEEVRYEIAALEAE

SEQ ID NO: 146797 - protein, 481 aa, Glycine max
  Coding DNA Sequence Number=SeqID_30019
  Gene Ontology: Mol. function=protein kinase activity; Cellular component=intracellular; Biological process=protein amino acid phosphorylation
  Homolog annotation: Hit_ID=Q2R8W9; Match level="QueryCoverage=93%, HitCoverage=95%, E-value=1e-108, Identity=43%"; Hit description =Pentatricopeptide, putative
  Pfam annotation: Domain name=PPR; Domain location=175-209; Score =35.5; E_value=1.9e-07; Accession=PF01535.11; Description=PPR repeat
  Pfam annotation: Domain name=PPR; Domain location=279-313; Score =50.0; E_value=7.8e-12; Accession=PF01535.11; Description=PPR repeat
  Pfam annotation: Domain name=PPR; Domain location=314-348; Score=3.4; E_value=2.9; Accession=PF01535.11; Description=PPR repeat
  Pfam annotation: Domain name=PPR; Domain location=74-108; Score=28.8; E_value=1.9e-05; Accession=PF01535.11; Description=PPR repeat
  Pfam module annotation: Pfam domain module=PPR::PPR::PPR::PPR; Domain location=175-209::279-313::314-348::74-108
MNYTSLKTRQRLSFLLRSCITHSAALQCHAQSFVQGLLPNAVLETDLLLVYSKLGLLRKARKVFDKMLDRRNMYSWNIMIASYAQHCMYYDVLMVFHEFKHCCLRPDHYTLPPLFKASVGVDDACIGSMCHGLVIRIGYEGYAIVANSLLEFYVKFGAMPQAFCVFSNMSCKDSVTWNLMISGFGRAGLYSDAMHCFREMLSLNEMMRVDFMTLPSVINACGKEGDLLKVREVHGYVVRSFGFDADAAIGNALIDVYCKCGCLNDSEKIFRTIRHVNLVTWTTMISCYGAHGKGEESLLLFKKMVDEGFRPNPVTLTAILASCSRSGMIDQGKHIFSSICSDYGFEPTVEHYACMVDLLSRCGYLVEALQLLESKKSSVTGSMWGALLAGCVMHKNVEIGEIAAHRLFQLEPDNASNYIALCGIYQSLGMVDSLLIIKEKMRDLGLIKSPACSWINIAGRTHIRPPVPSSGSDDLQNNISN

SEQ ID NO: 146798 - protein, 75 aa, Glycine max
  Coding DNA Sequence Number=SeqID_30020
MISVRKGALWPWYNPPQSWSGNSDIEVLGHSGLSMTLMIYHNHCQMVDVVLESSYALIMVVLHTTTSYQVQSFKS

SEQ ID NO: 146799 - protein, 83 aa, Glycine max
  Coding DNA Sequence Number=SeqID_30021
MLSRQLGGSKKRPPSKTPTAAHLLSRTKVRDHHRHQPHGTKIARGYPIGHCTPHVHTQHTSTMMTSSTSTSSHLNVIINIISS

SEQ ID NO: 146800 - protein, 94 aa, Glycine max
  Coding DNA Sequence Number=SeqID_30022
MIVIVAPLLGQKEVTCLLPRNQYSNEVANLGMIHVLVVFALMFSRVYPVGSRCFTNKTDIELKTHNLNSSLKVIMDVWCSKKQGKITVKIDNTL

SEQ ID NO: 146801 - protein, 68 aa, Glycine max
  Coding DNA Sequence Number=SeqID_30023
MAIVTLSSSLVHTFSSSLVHTWNIVFFTFSFLVYMEDNYVRKMSDEVDMDADMDNDVKIDEDIHIHYG

SEQ ID NO: 146802 - protein, 273 aa, Glycine max
  Coding DNA Sequence Number=SeqID_30024
  Homolog annotation: Hit_ID=Q1RWU1; Match level="QueryCoverage=40%, HitCoverage=41%, E-value=1e-07, Identity=27%"; Hit description =Resistance-like protein HAAS-2-related
MSCTRSGDHTRPTASVGKHERHVVVDEKQEIYAGSKDVAADDVALKDVVFGGGPMDKSVFTEYTNHVAYRCRDEKWDQAIRPYLLHLVACSIFADKSWTQASFANTKQLDGYATLLQEWIYEHFPTIRYIRLGSDMHLHLSKRVLCQFGYTQTILRHLFVFTTVQLSIQDVDERCLNFVYHLIRPDETISGLLGCATVIPNIGDVPETSTQHNSVYDICRKVVEPLQEMIDLRMVIEGTTAWDNVRATLLLLSEGTHGGNNNRGRGGRNVRGS

SEQ ID NO: 146803 - protein, 353 aa, Glycine max
  Coding DNA Sequence Number=SeqID_30025
  Gene Ontology: Mol. function=sequence-specific DNA binding; Cellular component=nucleus; Biological process=regulation of transcription, DNA-dependent
  Homolog annotation: Hit_ID=O80982; Match level="QueryCoverage=99%, HitCoverage=100%, E-value=4e-97, Identity=52%"; Hit description =Putative heat shock transcription factor
  Pfam annotation: Domain name=HSF_DNA-bind; Domain location=41-209; Score=274.6; E_value=2e-79; Accession=PF00447.8; Description=HSF -type DNA-binding
MERIRVKEEEAMTCGGGGSSSSSFISPQAQPMEGLHEVGPPPFLSKIFDMVEDPSTDSIVSWSMARNSFVVWDSHKFSAHILPRYFKHANFSSFIRQLNTYGFRKVDPDKWEFANEGFLAGQRHLLKTIKRRRNVSHSNQQKGGSGACVEVGKFGLEGELERLKRDRNILMAEIVRLRHQQLNSRDQLSAMEARMQATEKKQQQMMSFLAKALSNPSFMQQLVHKTPQSREVLLGVEINRKRRLPACPSVENLQQDNQDLATMETDMDTFFAPAYDNEFGNEIDEPASILVEDSILEDFLNKDLITGNPEDEVIIGDCTQVDVPMEDLVANPDDWSEQLQDLVDHMDYLGSKP

SEQ ID NO: 146804 - protein, 75 aa, Glycine max
  Coding DNA Sequence Number=SeqID_30026
MASYGERSAIPPTGEVGRSAVSPVGESRGAAAQEKRVDSPVEIMGQLVLDQPAQVWAQAEQPRWVSPMEVEFGPG

SEQ ID NO: 146805 - protein, 117 aa, Glycine max
  Coding DNA Sequence Number=SeqID_30027
  Gene Ontology: Mol. function=protein disulfide oxidoreductase activity; Biological process=cell redox homeostasis
  Homolog annotation: Hit_ID=Q1RV70; Match level="QueryCoverage=69%, HitCoverage=60%, E-value=5e-24, Identity=67%"; Hit description =Glutaredoxin
MTTNPVSDSSRDDKLNGAKPQITPLSLSQSHPYAITGADLDEFGDEVAGDVEGDEGLEAADGGASDEDGGGAVVGEGEGGDLVVVQFDDGGVDADGGEELLHDVAHAAGGAREDYDG

SEQ ID NO: 146806 - protein, 294 aa, Glycine max
  Coding DNA Sequence Number=SeqID_30028
  Gene Ontology: Mol. function=transporter activity; Cellular component= membrane; Biological process=oligopeptide transport
  Homolog annotation: Hit_ID=Q1RXN7; Match level="QueryCoverage=99%, HitCoverage=49%, E-value=1e-153, Identity=89%"; Hit description=TGF -beta receptor, type I/II extracellular region
  Pfam annotation: Domain name=PTR2; Domain location=96-294; Score =16.2; E_value=1.6e-06; Accession=PF00854.12; Description=POT family
MEAKADYTQDGTIDFRGQPAVSSKTGKWKACAFLVGYEAFERMAFYGVASNLVNYLTSQLHEDTVSSVRNVNNWSGSVWITPILGAYIADSYLGRFWTFTLSSLIYVLGMTLLTVAVSLKSLRPTCTNGICNKASTSQIAFFYTALYTMAIGAGGTKPNISTFGADQFDDFNPNEKELKASFFNWWMFTSFLGALIATLGLVYIQENLGWGLGYGIPTAGLLLSLVIFYIGTPIYRHKVSTTKTPASDIIRVPIAAFRNRKLQLPSNPSDLYEHNLQDYVNSGKRQVYHTPTLR

SEQ ID NO: 146807 - protein, 81 aa, Glycine max
  Coding DNA Sequence Number=SeqID_30029
MDCGMVLSGYSIQPSLYNLHEHAEKYEAERKNQSYYICCSVEPNFLGHILYDTFYKLLKEQKSEMIMKGGMRVKKLFFGDQ

SEQ ID NO: 146808 - protein, 98 aa, Glycine max
  Coding DNA Sequence Number=SeqID_30030
MKFDPIPIDSCSKEHQTIYKEWFNCVDLVIAQHTSSFNDFVLFQFTAQSVHAPKNTRRSIRSDSDGRITGSDAPKFFATSNLCYWRSMRGDCGVYRTH

SEQ ID NO: 146809 - protein, 414 aa, Glycine max
  Coding DNA Sequence Number=SeqID_30031
  Gene Ontology: Mol. function=nucleic acid binding; Cellular component= oxygen evolving complex; Biological process=DNA integration
ANRKKLDPRAATSVFLGFKPNTKRFIMFALKTKAIYVSRNVIFYENCFPFIGQDKPDHVTVLPIPPSHSINQSDGVSSELPIDHIMPVPNNTNFDPLNLEQSSNITKRSLRQTHRLSKYKDFHVSYPSLTVANYSVASKDPIWIEAMNAEIKPLELNDTWVLTDMPQIRMLLAASGCIRSSTNQMGQWRDIRPVAKLTTMRLLLALAAINKWYLKQLDVNNAFLHGDLNEEVYMMLPQGMQVAKPGQDLGDLRYYLGFEVARKPTGINLCQRKYALDILSDDGMLGSKPVSTPSDYATKLQQLGTPLSLEDSSFFKRLIGRLIYLTNTWPNITYVVQHLSQFVVASTSAHQHVVVRILRYIKGSPRSRIFLSAVSKVHLKGFSDSDWAGCIDTRRSIFGYAMYIGDSLISWKSK

SEQ ID NO: 146810 - protein, 145 aa, Glycine max
  Coding DNA Sequence Number=SeqID_30032
  Gene Ontology: Mol. function=transcription cofactor activity; Cellular component=nucleus; Biological process=regulation of transcription, DNA-dependent
  Homolog annotation: Hit_ID=Q2HVE2; Match level="QueryCoverage=86%, HitCoverage=16%, E-value=6e-11, Identity=28%"; Hit description =Ribonuclease H
MEFVKINMDGSFSPNSRTGACGGIIQDSNSKVLSCFSKRLGYCNVILAELWSLKYGIKFALFEMDAREVVHMIDGIKSVPSSLRPLVEDIRRMLWANGWQNSIVHINREANSIATWATKFGHQRNWSSFLVDDVRRAIASLLRLP

SEQ ID NO: 146811 - protein, 295 aa, Glycine max
  Coding DNA Sequence Number=SeqID_30033
MAEVINNMPPESLDHDQSPSASAPPPPAASSSAADDLPPPPLPLPPRRRDRRDDRDFDRHPNRSRDYYDRDRDFKRRRSPSPGYRDRRYSPPPPSRRSPPPYKRSRRGSPRGGAYVPDDRFGYDYSGGYERGAGGRTGFADEKSYGRLAHRSAGGYHNGISDVDNSRGYADLPSGGAQRNLMCDKAVHHVHLSSPLAINRLLKYRFKCTLQRLKYWFKITCKYKLHSNRRYLIPMESLERRYSVMASKFLESNRDNGCLRTLRVSLGEVVKRGKLTTSSTLSLPFLPFPPLSNRS

SEQ ID NO: 146812 - protein, 306 aa, Glycine max
  Coding DNA Sequence Number=SeqID_30034
  Gene Ontology: Mol. function=nucleic acid binding; Cellular component= intracellular; Biological process=chromatin modification
  Homolog annotation: Hit_ID=Q5Z4U6; Match level="QueryCoverage=99%, HitCoverage=42%, E-value=1e-104, Identity=60%"; Hit description =Putative C2H2 zinc-finger protein
  Pfam annotation: Domain name=ARS2; Domain location=9-257; Score= -88.2; E_value=0.048; Accession=PF04959.3; Description=Arsenite -resistance protein 2
MIETNEAKGFRYVRPEGTGHEETRKSGSDWEKKLDSFWQGRLNGQDPLEVMTAKEKIDAAATDVLDPHVRKIRDEKYGWKYGCGAKGCTKLFHAAEFVHKHLKLKHPELVMELTSKLREDLYFQNYMNDPDAPGGTPVMQQPQKDRPLKRRLGGLEGRLKDDRGNRRDQDRSDRINGDRPDGSPSHERQMGNHDEAMYDAYGGLGVPQFTSDMAPPPVLMPVPGAGPLGPFVPAPPEVAMQMFREQGGPSSYDASGRKIRSGPHMGGPAPIIAVPPSFRPDPRQMRSYQDLDAPEDEVTVIDYRSL

SEQ ID NO: 146813 - protein, 79 aa, Glycine max
  Coding DNA Sequence Number=SeqID_30035
MSHSRESFFHSNSSKMLSPEVRPIGESSNDDSSHRHDGSDVASDQESSVPIAGAIIIVGVAAIVSQNIGGEGGIRSSSL

SEQ ID NO: 146814 - protein, 138 aa, Glycine max
  Coding DNA Sequence Number=SeqID_30036
MTGKEGENSKGIWKLLSGKMARPFRPLDLSLKKQINDSNVKVEDLRLSFTKFVQLTLELVEHMYYTDLASLRIRREIEILSSNFTSIKADYQGSSKLTFNPTYILILVCICPTNLSFGVSLQVHPTIVRGGPHGQVLP

SEQ ID NO: 146815 - protein, 416 aa, Glycine max
  Coding DNA Sequence Number=SeqID_30037
  Gene Ontology: Mol. function=phosphoric monoester hydrolase activity
  Homolog annotation: Hit_ID=Q84K83; Match level="QueryCoverage=35%, HitCoverage=33%, E-value=3e-31, Identity=50%"; Hit description =Putative NLI interacting factor
  Pfam annotation: Domain name=NIF; Domain location=288-415; Score =74.7; E_value=3e-19; Accession=PF03031.8; Description=NLI interacting factor-like phosphatase
  Subcellular localization annotation: CTP_CleavageSite=48; ConfidenceScore=5.36e-01
MPAVKMKAKAIATCKKDGSYPHVSQNSNKISKSTVVRVTNELVNLAISSQTSQNDFCKNEEYSMDLDNKGDMGQPSLSFNGCTDSMEQTDISFNGCTDSVVARDSLSSSLSPDSEAILPYNGLNYAHCQQFETVNREQFTWEPQLDDNFFSTFQMFDLDSAYETGFPIDGLTLFDDSQSYYNLSDLLFPGTNFTIHGTEENMEYPTLKETIGAADFTFGGSSIGFQQTSDSSWVNHLMCHQAIPFTEELSVISSEISSDRVDYWDQETFIKGVLELADDANSLPALLINETSKRKKVTLVLDLDETLIHSSMGQCDGAADFTFKMITDRELTVYVRKRPFLQEFLVKVSEMFEIIIFTASKRMYAETLLDVLDPDKKFFSRRVYRESCTWKDRRCVKDLTVLGIDLAKVFSSLFLP

SEQ ID NO: 146816 - protein, 52 aa, Glycine max
  Coding DNA Sequence Number=SeqID_30038
MKGMATNLHTKVKVLRLKEYDVQPRWRIVVCGWTIMVWTTGVDKGNCTQLVG

SEQ ID NO: 146817 - protein, 134 aa, Glycine max
  Coding DNA Sequence Number=SeqID_30039
MKGIPVVGASEKGNLANMASPSHQELDDHSLIIDLQREINPLKQRNTQEMENAILREYVPTTLKGASLHRYTRLPRNSIDSFVTLVACFGAQYVSRRPHHLTAMAFTNIRQVEDESLHEISWKGSYQSQFGFKT

SEQ ID NO: 146818 - protein, 97 aa, Glycine max
  Coding DNA Sequence Number=SeqID_30040
MVAKEVWLSAEVSTTNCTLDCTRRRLEVEGEGGVALEREACGFTGLVDLLGGVGVRVEEEENGAHRDKKEEEEYDVSNENRNKGRKIKNFKNLKRLK

SEQ ID NO: 146819 - protein, 231 aa, Glycine max
  Coding DNA Sequence Number=SeqID_30041
  Homolog annotation: Hit_ID=Q1SQ90; Match level="QueryCoverage=33%, HitCoverage=28%, E-value=2e-12, Identity=43%"; Hit description =Homeodomain-related
MANRSCTRSVNASSPLPSITPFQCSTEPSGSPSDAESQHEDYNEFKSNEDKDDNQYKKEEKKRKKKKLSEENKGKEYKEFENNEGEDDGQGRKMKKKKLHDKSKNNSEFNSNEGDVNEVDDQCKKMKTKKKAMADIGESPNPAHSGSSKPKRVTFSDQVDVCCDGLIPGKRESHGLGDEGLDMVLHCRSHPEIRDYWKEIGTALPQRPYVSVYTRAHILLERGKNREWTPE

SEQ ID NO: 146820 - protein, 52 aa, Glycine max
  Coding DNA Sequence Number=SeqID_30042
  Homolog annotation: Hit_ID=Q1RV62; Match level="QueryCoverage=71%, HitCoverage=5%, E-value=2e-08, Identity=68%"; Hit description =Glycoside hydrolase, family 32
MEINASPDNINSVKYNVHEKQPYRTWYHFQPPQNWMNDPNGMLVNFSYFQLN

SEQ ID NO: 146821 - protein, 93 aa, Glycine max
  Coding DNA Sequence Number=SeqID_30043
MRLIMATHSQNVFFKGFPLRALSPCVIDYTPLVIDYQRPFNILSAFLSPVIDYTHLAIDYQRPFNLLSPFLSPAIDCTPLELACLGTSQVLTD

SEQ ID NO: 146822 - protein, 144 aa, Glycine max
  Coding DNA Sequence Number=SeqID_30044
  Homolog annotation: Hit_ID=Q2HRX8; Match level="QueryCoverage=57%, HitCoverage=11%, E-value=3e-11, Identity=41%"; Hit description=IMP dehydrogenase/GMP reductase
  Pfam annotation: Domain name=DUF1723; Domain location=67-116; Score =38.1; E_value=3.1e-08; Accession=PF08330.1; Description=Protein of unknown function (DUF1723)
MPHTRGGDHTQPIASVSRHGRRVIVDEEVKASSTLKEVEGFGPPHKEIMRVVQNLGLLPLTKCSYETTDKRFLSSFIERWHHKTNTFHLTLGEITIALDDVSSLVHIPIVGGLYSYPHTSKEVVIALLMELLGVDKEDAFLETK

SEQ ID NO: 146823 - protein, 146 aa, Glycine max
  Coding DNA Sequence Number=SeqID_30045
MAIVILSSSLVHTSPPPLTSPCPKHCFRHLFISCKHFHYPGSLAQVYMEDDYVRKMLDEVDMDNDVRIYEDIRMHYWQEIGKIVDCSEAFITTKIFATQDELLKWARDVSFEMSFIVVILRSDTSNRQPGQKTFVVLGCEKGEKYR

SEQ ID NO: 146824 - protein, 592 aa, Glycine max
  Coding DNA Sequence Number=SeqID_30046
  Gene Ontology: Mol. function=nucleoside-triphosphatase activity; Cellular component=membrane; Biological process=protein catabolic process
  Homolog annotation: Hit_ID=Q1SX89; Match level="QueryCoverage=89%, HitCoverage=75%, E-value=0.0, Identity=75%"; Hit description=DNA repair protein RadA; Peptidase M41, FtsH
  Pfam annotation: Domain name=AAA; Domain location=132-316; Score =313.6; E_value=3.5e-91; Accession=PF00004.19; Description=ATPase family associated with various cellular activities (AAA)
  Pfam annotation: Domain name=AAA_2; Domain location=129-258; Score= -41.8; E_value=0.014; Accession=PF07724.4; Description=ATPase family associated with various
  Pfam annotation: Domain name=AAA_5; Domain location=132-263; Score =20.3; E_value=5.1e-05; Accession=PF07728.4; Description=ATPase family associated with various
  Pfam annotation: Domain name=Peptidase_M41; Domain location=323-524; Score=389.8; E_value=4.1e-114; Accession=PF01434.8; Description =Peptidase family M41
  Pfam module annotation: Pfam domain module=AAA::AAA_2::AAA _5::Peptidase_M41; Domain location=132-316::129-258::132-263::323-524
MSNSVSEEETLAGLSALRNTRKSEKDNTIGTASNPIYMVARDGGNIKDQIWRTLRFIAVSFFMISGVGALIEDKGISKGLGINEEVQPSMESSTKFSDVKGVDEAKEELEEIVHYLRDPKRFTRLGGKLPKGVLLVGPPGTGKTMLARAIAGEAGVPFFSCSGSEFEEMYVGVGARRVRDLFSAARKRAPAIIFIDEIDAIGGKRNAKDQMYMKMTLNQLLVELDGFKQNEGIIVIGATNFPQSLDKALVRPGRFDRHVIVPNPDVKGRQQILESHMSKVLKADDVDLMIIARGTPGFSGADLANLINIAAIKAAMDGAKAVSMADLEHAKDKILMGSERKSAVISAESRKLTAFHEGGHALVAIHTDGALPVHKATIVPRGMALGMVTQLPDQDQTSVSRKQMLARLDVCMGGRVAEELIFGENEVTSGASSDLRQATSLAREMVTKYGMGNEVGLVTHDYKDDGRSMSSETRLLIEKEVKQFLERAYNNAKTILTTHNKELHALANALLEHETLSGTQIKTLLAQVRSQMLQQQQQQPPQTIEAQSSLQSNTVPPSSSNPASAAAAAAAATAAATATAAAAKANSAPVGS

SEQ ID NO: 146825 - protein, 81 aa, Glycine max
  Coding DNA Sequence Number=SeqID_30047
  Homolog annotation: Hit_ID=Q9AWW1; Match level="QueryCoverage=84%, HitCoverage=20%, E-value=4e-12, Identity=50%"; Hit description =Esterase/lipase/thioesterase family protein-like
MADCGAESERKVTIRNNHGENLVGILHNAASISLVIVCHGFQSSKVERIPMVYLAAALGKDGFSSFRFDFAGNGLVKENEQ

SEQ ID NO: 146826 - protein, 142 aa, Glycine max
  Coding DNA Sequence Number=SeqID_30048
MDALISEIERTTPNLKALDQYEALLEKESCLLLERSSAFSTILTLLFLIKPANQPSSTLPDSIGNMCQYLAKIRDMVQSLVPKDLDQLKKPSSRTRELHRPIMDIGRYKESKWTAESTTGEIEPELLNAKKTMKHHSSMIED

SEQ ID NO: 146827 - protein, 80 aa, Glycine max
  Coding DNA Sequence Number=SeqID_30049
MYLRRRSRHNCLSRLGGDIFMNIPLLQCRRSKSLTFLSIVRYYYKSITQASTMYCFPPKEPLLHYPNLSLASRPYSYALA

SEQ ID NO: 146828 - protein, 79 aa, Glycine max
  Coding DNA Sequence Number=SeqID_30050
MRELEYLKKELFNLKFLVASFMDHKSSVEKEIEASNSKMLSCLTTEQDLRREIEEPNEEQVLASVAKIEALKEMTDIEA

SEQ ID NO: 146829 - protein, 814 aa, Glycine max
  Coding DNA Sequence Number=SeqID_30051
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q93YX7; Match level="QueryCoverage=94%, HitCoverage=74%, E-value=0.0, Identity=79%"; Hit description=Type IIB calcium ATPase
  Pfam annotation: Domain name=Cation_ATPase_N; Domain location=115 -191; Score=54.1; E_value=4.7e-13; Accession=PF00690.16; Description =Cation transporterATPase, N-terminus
  Pfam annotation: Domain name=E1-E2_ATPase; Domain location=205-446; Score=236.2; E_value=7.2e-68; Accession=PF00122.10; Description=E1 -E2 ATPase
  Pfam annotation: Domain name=Hydrolase; Domain location=450-778; Score=60.8; E_value=4.4e-15; Accession=PF00702.16; Description =haloacid dehalogenase-like hydrolase
  Pfam module annotation: Pfam domain module=Cation_ATPase_N::E1-E2 _ATPase::Hydrolase; Domain location=115-191::205-446::450-778
NSDMVSFLNPEEFELSDKDRSIEALEKWRSAAWLVKNPRRRFRWAADLVKRKHAEDKRRKIQSTIRTVFNVKWVEGQFISALPQAEYKVSEKTREAGFGIEPDDIASVVRGHDYTNYKKIGQVEGIIEKLRASVDDGVGQASIDTRQEIYGVNRYTEKPSKSFLMFVWEALHDLTLIILMVCAIVSIAIGLPTEGWPKGVYDGLGIILSIFLVVIVTAISDYQQSLQFRDLDKEKKKIFVQVTRDRKRQKISIYDLVVGDIVHLSTGDQVPADGIYISGYSLIIDESSLTGESEPVNIDGKKPFLLSGTKVQDGQGKMIVTTVGMRTEWGKLMETLSEGGEDETPLQVKLNGVATVIGKIGLTFSVLTFVVLTIRFVVEKAVRGEFASWSSNDALKLLDYFAIAVTIIVVAIPEGLPLAVTLSLAFAMKKLMKDKALVRHLSACETMGSATCICTDKTGTLTTNHMVVNKIWICGKSNEIKGNESVDKLKTEISEEVLSILLRSIFQNTSSEVVKDKDGKMTILGTPTESALLEFGLLSGGDFEAQRGTYKILKVEPFNSVRKKMSVLVGLPDGSVQAFCKGASEIVLKLCNKVIDPNGTAVDLSDEEAKKVSDIINGFASEALRTLCLAVKDVNETQGEASIPEDSYSLIAIVGIKDPVRPGVREAVKTCLAAGITVRMVTGDNINTAKAIARECGILTEDGVAIEGPQFQDLSIEQMKSIIPRIQVMARSLPLDKHTLVTHLRKMFGEVVAVTGDGTNDAPALHESDIGLAMGISGTEVCAHDLFTMVCLMVLSVAVLCTVFALLLGILFFR

SEQ ID NO: 146830 - protein, 138 aa, Glycine max
  Coding DNA Sequence Number=SeqID_30052
AEFQEFIDQMRLVDDLIKLWGCPPNGWLEHHGFVGLLGEWWKEFHVAGWKSFVFKEKLKLLKAKIRVWLCDEMLVDSEQRRLVVSGFWRRVQAKESMLAQKLQVRWIREVSYPNFVRGPLLDDMRPFFGPCEVLDTHH

SEQ ID NO: 146831 - protein, 73 aa, Glycine max
  Coding DNA Sequence Number=SeqID_30053
MALDELLDASLDEDSLHVGEVLAFCVVRAKDYHFLNPHLIEVPTHEPLRFQSVLQWTWSLAMDLRIFFLGKGA

SEQ ID NO: 146832 - protein, 116 aa, Glycine max
  Coding DNA Sequence Number=SeqID_30054
YTMNSVITVLYFNGRVYEDNDGVIFEGSKKAIQIKRGISFNALKKKIGDKENILPCKFAMAKTLKRCWKVLNNNKKYSLDEDDSVDGISDTDNEVPENSFRKVLRTALYIRLRDTC

SEQ ID NO: 146833 - protein, 79 aa, Glycine max
  Coding DNA Sequence Number=SeqID_30055
MSVLVNELLAEILILSEYSTPKTLVNKPSEFNIHRKVGRSSSSMDSFASWKIHGSGMEKDEREETPLQGEDESRRSSPT

SEQ ID NO: 146834 - protein, 353 aa, Glycine max
  Coding DNA Sequence Number=SeqID_30056
  Homolog annotation: Hit_ID=Q9XGX0; Match level="QueryCoverage=65%, HitCoverage=64%, E-value=1e-42, Identity=43%"; Hit description =Putative zinc finger protein SHI
  Pfam annotation: Domain name=DUF702; Domain location=113-290; Score =275.8; E_value=8.3e-80; Accession=PF05142.3; Description=Domain of unknown function (DUF702)
MAGFFSLGAGRQNKAEQEEDQREENVNNAGGNNNSQFLFRNNVSEEIYNKGFEIWPQSSYHHHQNLTNFYSFGVGPSRRNNHNNSSSNNVNDDVSVSFSDESNRFGFTVMSSGGGGGGGMNCQDCGNQAKKDCQHLRCRTCCKSRGFQCQTHVKSTWVPAAKRRERQQQLSALQQQQNQHPQFRGDHSKRHRESIEGAAAGSLACVPVPITTTDFIRFFFGDVYVLWREEVCIGLELGQFPPELNSPAVFRCVKVSAMDAPDERYAYQTAVNIGGHVFKGILYDQGMDGPYAGAGCEGSSGVGGEAQPLSLMAAATTTTAATTTSGNPFEASLYTAPMNAYMAGTHFFPPSRS

SEQ ID NO: 146835 - protein, 97 aa, Glycine max
  Coding DNA Sequence Number=SeqID_30057
MSLERNLTYLVITLLIMSVTVYVMYKIVMKKPTIPVSPPATMAEQEDTGVPPPPGATVAEQEASATTTTTTRGCSHVLLSINPKQKRWLYAKTKARG

SEQ ID NO: 146836 - protein, 56 aa, Glycine max
  Coding DNA Sequence Number=SeqID_30058
MAVAFTLRGKELVQASSFWEITFIPSSQEREVTKLELLLAPANEWKNLELISPPFN

SEQ ID NO: 146837 - protein, 133 aa, Glycine max
  Coding DNA Sequence Number=SeqID_30059
  Gene Ontology: Mol. function=RNA-directed DNA polymerase activity; Biological process=RNA-dependent DNA replication
  Homolog annotation: Hit_ID=Q1RZQ1; Match level="QueryCoverage=85%, HitCoverage=22%, E-value=2e-21, Identity=41%"; Hit description=IMP dehydrogenase/GMP reductase
MELKCAKGLQSSHLLFATNCFSFARQEIGKIKEILNDLFNAKTVCKIQKILLLNVQEDKLIWKFSHNGMYTVRSAFFNIMELILDNEHLKVAGKWNSIWSIHAPPKIKHFVWRLLRGCLPTRQRLVHKRVECP

SEQ ID NO: 146838 - protein, 49 aa, Glycine max
  Coding DNA Sequence Number=SeqID_30060
MSLLSISMVARWQKGPVKWLEVQWRSGFRERHDVSRECVVLDEPRGLIN

SEQ ID NO: 146839 - protein, 137 aa, Glycine max
  Coding DNA Sequence Number=SeqID_30061
  Subcellular localization annotation: CTP_CleavageSite=38; ConfidenceScore=5.03e-01
MTSSLLFHLPTSPNESLHSHCYSSSCTTQHFFGERNCCCRVRWRGWWKWFEALLEFKDLIIVWTVDDDKDYNKGGVLGLGFFPFVSEKFRNRMIERGCGVRVLAGVVMWETLLLKLCLAFEKGIGRVEQEKKLMAFA

SEQ ID NO: 146840 - protein, 60 aa, Glycine max
  Coding DNA Sequence Number=SeqID_30062
METEQHPPQQSPSVIANMHDEGLQPHPQSYEFTPQPHHHQEDYEEQPVVPNEQLQPQEHG

SEQ ID NO: 146841 - protein, 131 aa, Glycine max
  Coding DNA Sequence Number=SeqID_30063
MAAEWRRKRERRRHFKEKMSLEEAHHHRRPWIRAWRKKEMNEGRGREEHGILCSKRALKFEIELDEVQSSRLQLPGSNCQFVKNDIDLTSKTPEAGTMRRDACPIALGTPNPVPILHPPLLFADEGAFYSN

SEQ ID NO: 146842 - protein, 89 aa, Glycine max
  Coding DNA Sequence Number=SeqID_30064
MLGLTVRIECAFVCEKEGRVKNWHWIWGSECYWTGISSHVTWCLRSEINVVLHELAVRARKLEPRTLNLVQFNLQGFNVNRVQWKGTIM

SEQ ID NO: 146843 - protein, 115 aa, Glycine max
  Coding DNA Sequence Number=SeqID_30065
  Gene Ontology: Mol. function=hydrolase activity; Biological process =metabolic process
  Homolog annotation: Hit_ID=Q9SSY8; Match level="QueryCoverage=79%, HitCoverage=27%, E-value=2e-17, Identity=46%"; Hit description =Hsr203J homolog
MEIPQSPFLMLDMLDKFLALALPVGATKDHPFTCPMGMAAPPLKGLKLSPLLLCVAEMDFVRDTEMEYCITLEPQRYHVLITDHQTEGFFSHKGQLTYVTPFNPKAYVVIVLDNK

SEQ ID NO: 146844 - protein, 177 aa, Glycine max
  Coding DNA Sequence Number=SeqID_30066
MCSVFPTSLKVVALTWYDGLPSRGSITLHAPRPMAHSMDELCEQAKGYIQIEEMSRFRNEVRQIGQKHDKREGGTKTDSHKSDERDKPDKRQPLPKGPRYERYIPLKTNRITILEEAFNTEFVKGPNSHAAGARHRGHQEDYHNNHDVDRIRDRAEDRGRQRHHQQRRATTSTGTGK

SEQ ID NO: 146845 - protein, 101 aa, Glycine max
  Coding DNA Sequence Number=SeqID_30067
  Gene Ontology: Mol. function=DNA binding; Cellular component =mitochondrion; Biological process=DNA integration
MSEKGLDILRKRGLLENHRVELLQFFEHCVYGKQHHTKFPKVMHITKAIMDYTHFDYWEPSRVPSLGGARALDRRLQVDRVKDAREDLVLMSLRIDFGLMG

SEQ ID NO: 146846 - protein, 181 aa, Glycine max
  Coding DNA Sequence Number=SeqID_30068
  Gene Ontology: Mol. function=nucleic acid binding; Biological process= DNA integration
MSHVPYASVLGSLMYATICTRPDLVQEIGVVSKVQLILDYGIRTKVKSLIPNKAIAEEEIVCCVMTLIVPWWRPRLVYHGDTPCALASYLDSNYATNLDAKRSLIRGRVHGSSRSSKGRNLAKGIKFFLRGLSTLASDTTSSVLGRGLKSDCSGMEKEKDEWRRYFKYKMSLEEAHHHRKS

SEQ ID NO: 146847 - protein, 113 aa, Glycine max
  Coding DNA Sequence Number=SeqID_30069
MGDLSGVSCDFAVIDSLMEVWWYLVGRDEILCSYIGAFGGVLLSELEFYIIITLDYQGKTSNPVGGKDQTHLRNCISFVRLRLLIVLVAGMASLLLEIGNAQHFMLGNVQIPE

SEQ ID NO: 146848 - protein, 436 aa, Glycine max
  Coding DNA Sequence Number=SeqID_30070
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=Q84KG7; Match level="QueryCoverage=98%, HitCoverage=98%, E-value=1e-156, Identity=59%"; Hit description =Sphingolipid delta-8 desaturase
MSVNSLPNQILWNRIGTVSGLQSSIPQGLNRQHIGLPERHTIIRKIMFLAKILNQRRNLPQMAPWQPWKQMVLHLKLQPSMKPVHPRRAVHTKSPLSLLLEPIAAAGGPKVHLRRKMVQTELHMLNTRNRETHENKQKPLPPIGQEGNQQRVPNPECKQTQKLTASVLHLPLRQQQEKRLRKQINPSETHHRVKSPVLNLEVRELKNLEETTKEGQMLEIGVIVEAVACNVVGVVVPLPPADADSGENVAGENLNCAVEAAAEHHVVMAGVVAYPAALNPEKAYQCSGKHVHESAVGEEDAADRERKKGENKGEEDGGCVALAVEEVERGEVGEELAVVGGGGGDGVVGKTVGGGEGGEEEGGGVGRVEGEEGVGGVGAGEGEEWEGAAGVAVEPGGDVVDLAVDGDPGVVARVMLAKFIGGNVGCGRLHWSRSDE

SEQ ID NO: 146849 - protein, 545 aa, Glycine max
  Coding DNA Sequence Number=SeqID_30071
  Gene Ontology: Mol. function=ATP binding; Cellular component=nucleus; Biological process=septin ring assembly
  Homolog annotation: Hit_ID=Q8GUW6; Match level="QueryCoverage=60%, HitCoverage=95%, E-value=1e-147, Identity=75%"; Hit description =Nucleotide binding protein
  Pfam annotation: Domain name=ArsA_ATPase; Domain location=47-286; Score=-159.2; E_value=0.0073; Accession=PF02374.6; Description=Anion- transporting ATPase
  Pfam annotation: Domain name=CbiA; Domain location=49-265; Score =43.5; E_value=7.4e-10; Accession=PF01656.13; Description=Cobyrinic acid a,c-diamide synthase
  Pfam annotation: Domain name=Zip; Domain location=379-545; Score= -51.6; E_value=0.00089; Accession=PF02535.12; Description=ZIP Zinc transporter
  Pfam module annotation: Pfam domain module=ArsA_ATPase::CbiA::Zip; Domain location=47-286::49-265::379-545
CPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLGWSPVYVESNLGVMSIGFMLPNPDEAVIWRGPRKNALIKQFLKDVYWGELDFLIVDAPPGTSDEHISIVQFLDATGVDGAIIVTTPQQVSLIDVRKEVNFCKKVGVKVLGVVENMSGLCQPITDFKFMKLTDNGEQKDVTQWVWEYMREKAPEMLNLLACTEVFDSSGGGAVKMSNDMGVPFLGNVPLDPQLCKAAEEGSSCFAKKDCVVSAPALNKIIEQLIETNGWSMLDLWSLPRLFSESLNLQSLRESFTSSSCDRTESEQCRDESAAMVLKFVAVASILVAGFGGVSIPLVGKSRRFLRPDGDVFAAAKAFAAGVILATGFVHMLRDSWDALREPCLGTHSRAWAKFPFTGFFAMVSALFTLLVDFLATEYYERREARGRVERGKVVDYDEGCDEALLETGIVEVKDLGRGGRHSHSHDGDDVESSVRHVVVSQ

SEQ ID NO: 146850 - protein, 169 aa, Glycine max
  Coding DNA Sequence Number=SeqID_30072
MEEHRQTAPTKQEKHQPRTLSSLCKLKNADYNLKAKRIKKKNDAPMEAAPSGGRKRHCHWRFPAPMASPALLLLLPDPAAVKALTGMATCNVKSPAMSALSSRACHLSDMHEVASSTGASHVGARMRRHTEEGVIERGRRCHRGRGIVAVGVPSRKGCCRGLEKEKGRC

SEQ ID NO: 146851 - protein, 973 aa, Glycine max
  Coding DNA Sequence Number=SeqID_30073
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=62%, E-value=0.0, Identity=38%"; Hit description=Chromo
  Pfam annotation: Domain name=rve; Domain location=668-799; Score =54.5; E_value=3.5e-13; Accession=PF00665.16; Description=Integrase core domain
  Pfam module annotation: Pfam domain module=RVT_1::rve; Domain location=226-395::668-799
MSSRPPPLDPVADLTRQVATLTNTNVALVAALVDGVTSSEETSAHAAQLSLHALSGDNAADTFRLSGADLFSHLQGGVSSNAGSLILIGFVCVGIDIVLGANGVSPTTPVGLHHFQRFTRLDPEAQLFSLHIIDPIKPLHSPHSPLLPDTKHLDHNFNSLITKFSHLFTEPSTLPPPHPTDHTIPLMPYSTPVNVRPYHYPHSQKHEIESQVAIFLQTGWIQPSTSPFSSLILLFKKKDGSWRMCVDYRALNAIAVPDRFSLPTIDELLDELGKVRVFSKLDLTCGFHQIRLAPEDVPKIAFRTHDGHYEYLVMSFGLCNAPATFQATMNDISRELLHKSVIVFFDDILVFNTTMEDHLGHLSQVFSILDKHHFHLKPAKCSFGQSSIAYLGHIVTEGTVEPDPLKIQGVIDWSTAKSVKGLRGFLGLSGFYRRFVQGYATLAYPLTSLLKKIAFEWYDLAQQAFKKLKAALASAPMLALPDFSVPFIVQTDASGYAMGAELLTQVIQTHKQQFYLSKLLGYHYDIQYKLGKTNTVADALSRCFEPTVAEINMLSTPQYLFIEELHRELSSDADYQTRCQQVIADPSLAQDFTVSNGLLLHKGRIWLPSSSRFKNLLLKEYHETPIGGHAGVVKTLKRLSTNFCWPHMCDDIKRFVRECVTCQQTKYVTSKPGELLQPLPIPIHIWEDISLDFVTGLPPSNGFTILLVVSIVSDRDPAFVSKFWSELFKFSGTLLCMSSSYRPQTDGQTEVTNRTIEQYLRVFVHHKPSLWHRFLPWAEYHYNTSFHSGAGLTPYQVIYGKPPPSVLSYIVGTSDPYRQVSLSGIKYNKLHKRYYFPFHVLARIGPAAYKLELPSYSKIHDVFHCSLLKPHVGSTPAESRQLPADSLENHPLLSPLAVLDSRTVTTEGISQQQAMREVYNLEDKIEFEGVGIDTVTRNQGGKTSNSQSTVAKEARPIRTKKPPSKYQDHILYK

SEQ ID NO: 146852 - protein, 157 aa, Glycine max
  Coding DNA Sequence Number=SeqID_30074
  Homolog annotation: Hit_ID=Q1SYR3; Match level="QueryCoverage=34%, HitCoverage=2%, E-value=2e-07, Identity=48%"; Hit description=RNase H, putative
MAIYIKEPRGAEEFAQASCSSPRQICDLVLKAPIHPGDQSNVYSTLLVAYGTPTKRVGRAISNWADLEINLGAQHKHENPNESLGTSNNNLQIAPSIMHRSYNAQWNAPELSYDKHMSHWSCILWEMKVEESLMGSQLPLHYRADTGVSQHTTLELG

SEQ ID NO: 146853 - protein, 59 aa, Glycine max
  Coding DNA Sequence Number=SeqID_30075
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P26969; Match level="QueryCoverage=86%, HitCoverage=4%, E-value=1e-15, Identity=73%"; Hit description =Glycine dehydrogenase [decarboxylating], mitochondrial precursor
VGLTSPGWIGADVCHLNLHKTFCIPHGGGGPGMGPIGVKKHLAPFLPSHPVIVHCFHKN

SEQ ID NO: 146854 - protein, 230 aa, Glycine max
  Coding DNA Sequence Number=SeqID_30076
MQEVELDIWKEGFLGINPFKYPYSYTREVHLDEEIVAPNPNSLIFEHRPTTRKLISLICALNVVLPWDHTRSSETFQIEDIHLEAPEESPSCNDWEQTNNGLVLRTKLSAYKEENISRQASFKRIERLNTRMPFMLGLFKHELETMKKKIELTSLIWSIMKRFYKLKETPFNMVCLWTRKFSVVFDRTFSFVVHLPYSRFTFIHHVQFILEEVDSDVEAATGLDAITVEV

SEQ ID NO: 146855 - protein, 101 aa, Glycine max
  Coding DNA Sequence Number=SeqID_30077
  Pfam annotation: Domain name=LEA_1; Domain location=1-68; Score=35.6; E_value=1.8e-07; Accession=PF03760.6; Description=Late embryogenesis abundant (LEA) group 1
MQAVKEKLQDFNAARKAKAEARAEEKAEKEIANARKNIAHEVRLAKEAEATMDIHVEKAGRIAEKEISKHASKNPNVGYENMNSTDPATVEITNGPASTIN

SEQ ID NO: 146856 - protein, 43 aa, Glycine max
  Coding DNA Sequence Number=SeqID_30078
MHLAKTKEVKLKKQEDIEGTLSPKKDKDKDIESYKRQKTIGQL

SEQ ID NO: 146857 - protein, 373 aa, Glycine max
  Coding DNA Sequence Number=SeqID_30079
MAPRKNEVVVILEINNEEDAFPKDSFILGGWHYCPYALFWGIARQNRVSIRGNIKGIKVVIYPATITDAFGCLKEGLVFDNDWKNNISQETVDLIQIKPQSEEESCSFWYALTQIMRDVGIDVPGMAPSIDTTQLKGTLTPQPSPFVSLPPQSPPPPPSQTYPKLSLSPINIKEATTFAKTMKKSLAEACKKAKLDETLEMKDAWELEEGVLASVKALFAKDHKKKLTEEARLAALVGKESKDIVEEVVLESLMTLSVEVLRKAVEEATMMEINGEPMPESIVRHATELMSIYATKKLAEMEVVTVFEDIDPAKKDVIKAYLAEIEDDIIETNPAQYVAMDENKLRHMEEAYGVLESMSIEDMTICLEQRKIM

SEQ ID NO: 146858 - protein, 264 aa, Glycine max
  Coding DNA Sequence Number=SeqID_30080
  Homolog annotation: Hit_ID=Q1SKJ3; Match level="QueryCoverage=22%, HitCoverage=6%, E-value=4e-11, Identity=48%"; Hit description=Zinc finger, CCHC-type; Endonuclease/exonuclease/phosphatase
MESVFAIVYCDGDILSSSEDMPLEDKEKVLTEGLWLIHDHYLIVRDWSPNFHPQTKAIEKVVAWVRILGLPIEFYDAKVLYAIGDRCLEKGKPNTWQGEHVNKMRNNDKGAPLKGNDIYEFLRNKEACDNVNTHVDNQETNIMNQGIGGMKIEFRRKGPRVQNGGSCCVFKILFEKMVNTIKIEKFTGNKAIGLLYPIKLFEEQIVVGLWLKLEKLFMTKSIYNKLLLKQHLFGLQMKERTPLKEHLDELNLVLMELCDIDAKM

SEQ ID NO: 146859 - protein, 290 aa, Glycine max
  Coding DNA Sequence Number=SeqID_30081
  Gene Ontology: Mol. function=cobalt ion transporter activity; Cellular component=integral to membrane; Biological process=nickel ion transport
  Homolog annotation: Hit_ID=Q8ZM94; Match level="QueryCoverage=77%, HitCoverage=83%, E-value=2e-64, Identity=52%"; Hit description =Nickel/cobalt efflux system rcnA
  Pfam annotation: Domain name=DsbD; Domain location=3-227; Score= -63.1; E_value=0.015; Accession=PF02683.6; Description=Cytochrome C biogenesis protein transmembrane region
  Pfam annotation: Domain name=NicO; Domain location=1-236; Score=74.8; E_value=2.7e-19; Accession=PF03824.6; Description=High-affinity nickel-transport protein
  Pfam module annotation: Pfam domain module=DsbD::NicO; Domain location=3-227::1-236
MAAFIVAIRGTLKQAVLLGLAATLSHTAVVWVIAMAGLWFGRGWDAHTSEPWFQLISGVLIVLIALWMAWRTWKESQPHDHHHHHHHDHDHDHDHQHDHHHEHPLVDDEWQDAHQRAHAQDINRRFSGQNVTTGQIVVFGLTGGLIPCPASITVLLICLQLKHFALGATLVFSFSIGLAITLVASGAIAALSLKHATKRWPGFSELSRKAPWISAALITVVGIYMSLHGLSGILGGSPRNGSGHPADAFPAPARGYHSASHFPSGRYTAYAWPPGAISSAPAVPAAFGPD

SEQ ID NO: 146860 - protein, 267 aa, Glycine max
  Coding DNA Sequence Number=SeqID_30082
  Gene Ontology: Mol. function=telomeric DNA binding; Cellular component=cytosol; Biological process=telomere maintenance
  Homolog annotation: Hit_ID=Q9URU2; Match level="QueryCoverage=97%, HitCoverage=20%, E-value=6e-35, Identity=35%"; Hit description=DNA replication ATP-dependent helicase dna2
MANRVSLGPLTFASTFVLVGDHYQLPPLARFSEAHLEAISALQSQEILDLSNALIYGDRLRCGSFEAANAKLEFSGLNCGLPWLEDVLNPRRPVIFIDTDKLAALEARDQKIVNNPIEAHIIAEVAKELVKNGIGSDHIGIITPYNSQANLIRNDASMTSLEIHTIDKYQVRLKLASRIMLLLRPLDLSTETPTSCAASLLGDWHMINVAHTRAKKKLIMVGSRRTLVKVPLLKLLIKKVEEQFGILTVTKKDIYRKSELKRCSQIR

SEQ ID NO: 146861 - protein, 220 aa, Glycine max
  Coding DNA Sequence Number=SeqID_30083
MHSEAEALEHMKKIDTGHQSVSLENKTGDSTVLKIGDSAKVVIKQDMKGGEHKYGFNNNKREKPQKVKLVDDETGDKHELFEVLRMPSRCVFLKVFMLFLHHSTSSCHSFPESFKIMPSPLASPLPPPPPLSAPSDGSASPSAVKRARKASRLRSLSTRPLGAEIPVVYVDLATGKADGPHRKKLRTYLGIVARDKVDVTYENRKEVPTAQKDLIWEDIQ

SEQ ID NO: 146862 - protein, 115 aa, Glycine max
  Coding DNA Sequence Number=SeqID_30084
MQEMTLWALETMIENERSAKKLKHLNSYQESDAMPSVITTGEDTITDCRPRVRHRRHCSWHNATLRKGNVVNIKLVQWVREFIVPLDTFDSATSKDLKVVLKYDSSLGVACYYRT

SEQ ID NO: 146863 - protein, 71 aa, Glycine max
  Coding DNA Sequence Number=SeqID_30085
MKAYHDKKLQRQNFQPGQQVLLFNSRLRNTGEKMDHQWTMLKNLQWRPPSEVRDTTEVEARDDIIIDLAAD

SEQ ID NO: 146864 - protein, 95 aa, Glycine max
  Coding DNA Sequence Number=SeqID_30086
MVEKGLVRFGDLQTMRRVRTRKRLMMKKMQMAIVKEAEKSILQTASGTGEFAVREGIATGNGNLVMHGEPPVKLASSTAQEASWPKLELPLVLAS

SEQ ID NO: 146865 - protein, 108 aa, Glycine max
  Coding DNA Sequence Number=SeqID_30087
MGSFLKFFREGAVLYVNCMGSQSKPPVELVSLLSVKESPLGMVIWPCMGNRQSNWRVPTARHRRREGQVRVQDSAKQEWCSREAVVVQRTLPFFFQLRGFSLLDFSVF

SEQ ID NO: 146866 - protein, 92 aa, Glycine max
  Coding DNA Sequence Number=SeqID_30088
MEPVAIEALHLHLLRSLFLHFEVESSGTIDNGKAKMCRDGGRGEGIRHEGEEDSLLAMVARSVETEAKEKEYDVRGKEYDVRGKGVRSLNVF

SEQ ID NO: 146867 - protein, 62 aa, Glycine max
  Coding DNA Sequence Number=SeqID_30089
  Subcellular localization annotation: CTP_CleavageSite=48; ConfidenceScore=5.01e-01
MLWKKVSKAPKIQRLVTPLTLQRNRARIAVQVSVLTSECLVKHCCYSSAMELRKLQLAQNNT

SEQ ID NO: 146868 - protein, 86 aa, Glycine max
  Coding DNA Sequence Number=SeqID_30090
  Gene Ontology: Mol. function=binding; Biological process=protein transport
  Homolog annotation: Hit_ID=Q10LA0; Match level="QueryCoverage=79%, HitCoverage=7%, E-value=6e-27, Identity=85%"; Hit description =Adapter-related protein complex 1 beta 1 subunit, putative, expressed
  Pfam annotation: Domain name=HEAT; Domain location=32-68; Score=29.3; E_value=1.3e-05; Accession=PF02985.12; Description=HEAT repeat
MADFLAKNGEECTHLGLIRALAVWTMGCIRVDKIIEYLCDPLQRCLKDDDPYVRQTTAICVSKLYDISAELVEDMRFLESLKDFIR

SEQ ID NO: 146869 - protein, 196 aa, Glycine max
  Coding DNA Sequence Number=SeqID_30091
  Gene Ontology: Mol. function=acid phosphatase activity; Cellular component=integral to membrane
  Homolog annotation: Hit_ID=Q9LL79; Match level="QueryCoverage=99%, HitCoverage=50%, E-value=2e-80, Identity=77%"; Hit description =Putative purple acid phosphatase
MGRVATKLNIDFVISTRDNFYDDGLTGIDDPAFEISFSKIYTAKSLQKQWYSGESRHTNHGCNKLTLLGNHDYRGDVEAQLNPILQKIDPRWICQRSFIVDTGKVTSWNLNRGFILNKIAEFFFIDSTPFVDKYFLKPKDHKYDSRGVLPREKYLSKLLKDLEIALKDSTAKWKIVVGHHPVRSIGHHGDTKELIR

SEQ ID NO: 146870 - protein, 140 aa, Glycine max
  Coding DNA Sequence Number=SeqID_30092
  Gene Ontology: Mol. function=oxidoreductase activity; Cellular component=integral to membrane; Biological process=electron transport
  Homolog annotation: Hit_ID=P0AFY2; Match level="QueryCoverage=90%, HitCoverage=53%, E-value=8e-61, Identity=88%"; Hit description =Protein sanA
  Pfam annotation: Domain name=DUF218; Domain location=2-87; Score =30.5; E_value=8.3e-07; Accession=PF02698.7; Description =Uncharacterized ACR, COG1434
MTMRRDLIKAGVDPSDIVLDYAGFRTLDSIVRTRKVFDTNDFIIITQRFHCERALYIAQHLGIQAQCYAVPSPKNMLSVRFREVGARLGALADLYLMKREPRFLGPLVPIPAVHEVPEDAQSYPAVTPEQLLELEEKLRK

SEQ ID NO: 146871 - protein, 59 aa, Glycine max
  Coding DNA Sequence Number=SeqID_30093
MALGWWPQMTHPPYAEVPGLWDLRLPYEEKATISLNYSTVGIESGGAIICKLCSKMICP

SEQ ID NO: 146872 - protein, 137 aa, Glycine max
  Coding DNA Sequence Number=SeqID_30094
MCCFWQDGDLDLNASPQALDKLLVHVLAFKVRIQSRLKNAVVLKYSKDLDLINAVLEMLADSEACSKIDPSNVDCNDATHAECQFVSVTADHDPVAGLPLTPRKRMSSNEADDGLGSSQISPAQLSSNKLTRHSHRS

SEQ ID NO: 146873 - protein, 118 aa, Glycine max
  Coding DNA Sequence Number=SeqID_30095
YRVEVMVNYKDENTKFLLWNCECTELIGQSADEVNTLKIEDGDLDLNASPKALDKLLGHLFTFKVKIQPQYKNSTVLKCSSDLTLINDVLDMLPDVETCSKIEATTSFDSNDPVHDEC

SEQ ID NO: 146874 - protein, 331 aa, Glycine max
  Coding DNA Sequence Number=SeqID_30096
  Gene Ontology: Mol. function=alpha,alpha-trehalose-phosphate synthase (UDP-forming) activity; Cellular component=alpha,alpha-trehalose -phosphate synthase complex (UDP-forming); Biological process =trehalose biosynthetic process
  Homolog annotation: Hit_ID=Q1R110; Match level="QueryCoverage=56%, HitCoverage=40%, E-value=2e-29, Identity=36%"; Hit description=Alpha, alpha-trehalose-phosphate synthase
LAGKHREDGGALQPHHAVRVEVEKIHGREGQEPHQRHRLHKVDEGQDHPAQWRIACGQHGEYYRKQQRPGHAEEKAHAGSERIIKQVPGIKTNGRDINTAVAVETDVVFAAGAMGGPAEWERPSEGERLPHSGARRRKSINLPAVDAGGENAGGENMPVGLDLVVGQHLQRELGRQAAEKGVAIVGGGKANQIVEQQRRDQLAMFRDAPQQRRRRERQVEEKRAGVKQPLLLQRLGAGQQLVVVDADGIAGAQVLAGDIGKPAVQLPIGAVVFRREMRLLRLVVEHRPQAIVVIALIVAAKLLDRQRKGHLIVTGALAAADRALREILHVA

SEQ ID NO: 146875 - protein, 227 aa, Glycine max
  Coding DNA Sequence Number=SeqID_30097
  Homolog annotation: Hit_ID=Q1G2Y5; Match level="QueryCoverage=47%, HitCoverage=50%, E-value=4e-21, Identity=50%"; Hit description =Protease inhibitor
  Pfam annotation: Domain name=Tryp_alpha_amyl; Domain location=33-113; Score=36.4; E_value=9.6e-08; Accession=PF00234.12; Description =Protease inhibitorseed storageLTP f
  Subcellular localization annotation: CTP_CleavageSite=64; ConfidenceScore=5.35e-01
MASFGPLCCKALVIAVVAMVMGAPSYGQISTPCNASILGTFFTPCMNFLTNSSGNGTSPTTECCSALKSLTSGGMDCLCLIVTGSVPFRIPVNRTLAISLPRACNMAGVPVQCKASGSPLPAPGPVSLGPSPSPASAPSAPSGFTPTPSPQASTVLPSPTSPSLAPQSDTTTPSLLTPPSPSADSGNPSVPTGSGRTNLSPSSAMTSYSVSPSLLFIALGFALLKYY

SEQ ID NO: 146876 - protein, 33 aa, Glycine max
  Coding DNA Sequence Number=SeqID_30098
MALYGSAFAYSNPLKDTRLPCSGIFRLSRAGKR

SEQ ID NO: 146877 - protein, 186 aa, Glycine max
  Coding DNA Sequence Number=SeqID_30099
TSSEEDPEEDPEELPPEPAVDALDFLEGDEDPLPEVDSPEEVMPASEADSTEDSGPREMATGGGSSSLWTVPWTSFIYFLRGRHYAQPRLLLVPPPSLNLQTFVSYSNLHQNTSRKAQSSSFSLLFHFHRLKSTKTSSNVKTIKEEKGIILHRRCCCPLPPRTIRCTHSTYSSLFVISKIIHVVFI

SEQ ID NO: 146878 - protein, 407 aa, Glycine max
  Coding DNA Sequence Number=SeqID_30100
  Gene Ontology: Mol. function=transporter activity; Cellular component= integral to membrane; Biological process=transport
  Homolog annotation: Hit_ID=Q3L7G5; Match level="QueryCoverage=67%, HitCoverage=62%, E-value=1e-103, Identity=68%"; Hit description=EitD
  Pfam annotation: Domain name=MFS_1; Domain location=1-244; Score= -31.0; E_value=0.0083; Accession=PF07690.6; Description=Major Facilitator Superfamily
GTQSEAQGKRGRAEWFALFAVCGELGAVLGPVAGALLTGFGFRQVALAGAAVFVIALMVLYFFLPATGNSKQALKIVPWWMTFRQPRFVAFIVAYSSWLLSYNQLYLALPVEIRRAGGSEKDLGPLFMLASVLIIAFQLPLARFARRVGTVKVLPVGFLLLSAAFASVALFASTTPPDGWLRLIPAVCLVTFLTFGQMLLVPSAKDLIPRFADPATLGAHYGALATAGGFAVLAGNLMFGPLLDNALVPSTQAIYPWLLLALFPLCSAVAMTGLDLQKIAEFHDHDGFNGVMLGRKDLDWHLEFTCCPGHPVIPSPTEDDLLVLYYPDENAWKLACETMIEAGRGDNGESLVQWFSQEKFAVRLEWGLPAVEHLAGEVDCVVIVDVMSFSTCVSMAVNNGACVYPYP

SEQ ID NO: 146879 - protein, 133 aa, Glycine max
  Coding DNA Sequence Number=SeqID_30101
MGMRGCINYNPILAIRQLGYPMRGAPLEEGLIPFIARGFNSTNTGVLQRVCKAWEMVQKKDKELRGSNNGPIGGYHRWLKAYAQGLDWLPNLRATKEVEGEAPEEDEEVQALRTKLEKAQATKEKFKSTTVRI

SEQ ID NO: 146880 - protein, 136 aa, Glycine max
  Coding DNA Sequence Number=SeqID_30102
  Gene Ontology: Mol. function=pectinesterase activity; Cellular component=cell wall; Biological process=cell wall modification
  Homolog annotation: Hit_ID=Q4PSN0; Match level="QueryCoverage=96%, HitCoverage=39%, E-value=7e-39, Identity=50%"; Hit description =Pectinesterase family protein
  Pfam annotation: Domain name=Pectinesterase; Domain location=3-127; Score=-99.4; E_value=3.9e-14; Accession=PF01095.10; Description =Pectinesterase
DCTISAIGANLGPGIIGFITAQGRTNPNDANGFVFKHCNIVGNGTTYLGRPWRGYARVLFYDTKISNIIQPLGWQPWDFAGHEDHITFAEYGNSGPGSDTSKRVSWLKKLDSSTVSKLATTSFIDTEGWLNTLTQL

SEQ ID NO: 146881 - protein, 74 aa, Glycine max
  Coding DNA Sequence Number=SeqID_30103
MTWHTEVLKKLKFGNFRLCLDDVVHASSRTRERKRDGDALAKGADSFLYCYAFMFAVIFLRTYRSKESNVGFSL

SEQ ID NO: 146882 - protein, 65 aa, Glycine max
  Coding DNA Sequence Number=SeqID_30104
MEMKPCSKSRKTHRRRRERNSEARNYFVRETGNWKEGLVPYLEEFESRSKGPTTLRAIGLRSTPN

SEQ ID NO: 146883 - protein, 137 aa, Glycine max
  Coding DNA Sequence Number=SeqID_30105
MSWGETFNQRGNSKDHPPKQSRVRGHLVKIDADSLNTFLETPVVLAEGETLPAYSRYCWLPTNYREIEAALCIPGRGFIMNSEGHPGKILRKHLTTLAQVWSVLSYSNLAPTSHTSDLTVDRARLIFGLVSHLGSLL

SEQ ID NO: 146884 - protein, 511 aa, Glycine max
  Coding DNA Sequence Number=SeqID_30106
  Gene Ontology: Mol. function=nucleoside-triphosphatase activity; Cellular component=membrane; Biological process=peptide transport
  Homolog annotation: Hit_ID=Q8U7K4; Match level="QueryCoverage=99%, HitCoverage=97%, E-value=0.0, Identity=57%"; Hit description=ABC transporter, nucleotide binding/ATPase protein
  Pfam annotation: Domain name=ABC_tran; Domain location=1-148; Score =131.2; E_value=2.8e-36; Accession=PF00005.17; Description=ABC transporter
  Pfam annotation: Domain name=ABC_tran; Domain location=248-438; Score= 202.1; E_value=1.3e-57; Accession=PF00005.17; Description=ABC transporter
  Pfam annotation: Domain name=oligo_HPY; Domain location=151-203; Score=1.7; E_value=0.00061; Accession=PF08352.2; Description =Oligopeptidedipeptide transporter, C-
  Pfam annotation: Domain name=oligo_HPY; Domain location=441-504; Score=45.4; E_value=1.9e-10; Accession=PF08352.2; Description =Oligopeptidedipeptide transporter, C-
  Pfam module annotation: Pfam domain module=ABC_tran::ABC_tran::oligo _HPY::oligo_HPY; Domain location=1-148::248-438::151-203::441-504
MRDIRGNAIAMIFQEPMTSLNPSFTIGHQIAEALIAHRKISARAAREETIRLLEKVRIPNAVKRFNDYPHHFSGGMRQRVMIAMALALRPKLLIADEPTTALDVTIQGQILDLIKTLQEEEGTAVLFITHDMGVVAEVADRTLVMYQGAMVETGSTAAIFSAPAAEYTRTLIATVPQLGAMRGIDGPRKFALNGEAPVAQGRQTPQGQTPLLSVKNLSTRFSIHEGLFSRKTGAVHAVENISFDLLPGETLSLVGESGCGKSTTGRSLTRLVQPASGQIAFDGSDVLTLSRQELRKLRCAMQMIFQDPFASLNPRMSVLEALTEPFLQHRLGSKAAAQSKAAELMTRVGLPATMLKRYPHEFSGGQRQRICIARALMLDPKMIIADESVSALDVTVKAQIINLLLDLQHSLNLSYLFISHDMAVVERISHRVAVMLLGEIVEIGPRAAIFENPQHPYTQKLLASVPVPDPARRHLKRHVDVSELKSPVRANGFVPETRHYQEVSAGHWVMR

SEQ ID NO: 146885 - protein, 134 aa, Glycine max
  Coding DNA Sequence Number=SeqID_30107
MTSIHDVLLYYNGRWNMSRRNEFVGYSFTGKNPKKFDIPSECTMDELKDLIKQVAPHGIPPYGIHETQTKLWLIRMPPTSRPHIHIAFFCDTPGNPDAFFHDLVCLCACRDYPKVEQTLQPFSDRMANILLNRK

SEQ ID NO: 146886 - protein, 78 aa, Glycine max
  Coding DNA Sequence Number=SeqID_30108
DSFEEQATQGSFVPHGRQDVLTAAIGRLEHPGRVRAAGAGVTIKQYFRLAPRTSHNSSLLSPKELQQLTQQIRDQLEE

SEQ ID NO: 146887 - protein, 186 aa, Glycine max
  Coding DNA Sequence Number=SeqID_30109
  Subcellular localization annotation: CTP_CleavageSite=34; ConfidenceScore=5.16e-01
MKNKKNGPQHRGKWYSTPPKQYGNCPNNQRTVAVGFAAGSGSKPNTFPTQGYIQRDCPYPKKEQNDGGLNDQTGHPKATGRVFTLNDAKASKSKDLIQVSKDMMFISANQVMTSLKEDAQVYMILSNLEIETELVPGDGPIFIAPYRMSPIELTELKKQLEELLDKQFVRPGVSCKGQALPLTKLT

SEQ ID NO: 146888 - protein, 73 aa, Glycine max
  Coding DNA Sequence Number=SeqID_30110
MGAKYLEVVKRGSHPNNGWSPNEIRLLKAAQANKDIIQPREPSSKQFEISNEAISKEKGAPDAMIIYLTSSLL

SEQ ID NO: 146889 - protein, 410 aa, Glycine max
  Coding DNA Sequence Number=SeqID_30111
  Homolog annotation: Hit_ID=Q7XE43; Match level="QueryCoverage=92%, HitCoverage=83%, E-value=1e-36, Identity=27%"; Hit description =Expressed protein
MEPVLDKLNAFAKSGQDFFDGLFRRRNPVEILKRLQREAFSDLMKLRERQDKVERVLSFYQSSKVGPFQETTTHVRGQVDFLGALLVLGNLDAVDKLGIRTGVDSRFIFETTMGDKATGAAEFVASHGGRREHCEEKPLSLAKLSFTANVNDWFSFVAMPIGARCRDVAIASNSFHQVGKGLTDFSYFGPPLLNLHNGTAFGITVRKSNVTASLAQIVTGLGMPPSSSITDNRSSTFGQLVYQFSRGSKLSILGLHHMPLSSKKLGRFGALTIPLLVSKQDEDEVSEAVPEVLPLIGTKTRVPAGSIALMAESELDDFTKIGGWVEMDKLNPKYLQLGVTISDVSEDSFGWGTSLSGRMIGNSANEAHFQAESYLKFNMGNNFCLKPGLVLGIDGKSKTAALVLRSNWSL

SEQ ID NO: 146890 - protein, 178 aa, Glycine max
  Coding DNA Sequence Number=SeqID_30112
MFCLVLSIEDHDMYIILLSSHYKKNDLYLRTKTVTINKKSIELKGDKAAKSGEIEAESGDEHNHTENHKPCNMSKESGNSIPIPHKGQGIAEKLTLEFTFHLWCLMGLHGTSSSQCGVRKLDLQCTEKTQQQTIEISAFGRFYLQLILWHTYLLMSGIGTLLATLEAAETTLEAAEPL

SEQ ID NO: 146891 - protein, 197 aa, Glycine max
  Coding DNA Sequence Number=SeqID_30113
  Gene Ontology: Mol. function=D-alanyl-D-alanine endopeptidase activity; Cellular component=integral to membrane; Biological process=cytochrome complex assembly
  Homolog annotation: Hit_ID=Q945B8; Match level="QueryCoverage=60%, HitCoverage=22%, E-value=1e-48, Identity=76%"; Hit description =Growth-on protein GRO10
DGRNIFNAYDLSVDSNCNLYSPLRPAVDVAEVFLWMMAVLTILCASYWSAWTTREAAIEHDKLLKDASDELPNTKYASVSGVVNMNVKATVLFVVFASCFLFMLYKLMSSWFIDVLVVLFCIGGIEGLQTCLVALLSRASPGAAVKLCLGDLLVMGSNPETASLHMQGASPGAAVKLCLSDLLVMGSNPETASLHMQ

SEQ ID NO: 146892 - protein, 147 aa, Glycine max
  Coding DNA Sequence Number=SeqID_30114
  Gene Ontology: Mol. function=D-alanyl-D-alanine endopeptidase activity; Cellular component=integral to membrane; Biological process=cytochrome complex assembly
  Homolog annotation: Hit_ID=Q945B8; Match level="QueryCoverage=94%, HitCoverage=28%, E-value=2e-53, Identity=68%"; Hit description =Growth-on protein GRO10
LLYKMVCEPDETDLNMHIPAVMLPLDAVSVQLHSPLRPAVDVAEVFLWMMAVLTILCASYWSAWTTREAAIEQDKLLKDASDELPNTKYASVSGVVNMNVKAAVLFVVFASCFLFMLYKLMSSWFIDVLVVLFCIGGIEVLTSTKSV

SEQ ID NO: 146893 - protein, 289 aa, Glycine max
  Coding DNA Sequence Number=SeqID_30115
  Gene Ontology: Mol. function=identical protein binding; Cellular component=cellulose and pectin-containing cell wall; Biological process=negative regulation of enzyme activity
  Homolog annotation: Hit_ID=Q9LDM8; Match level="QueryCoverage=95%, HitCoverage=59%, E-value=2e-72, Identity=57%"; Hit description =Putative subtilisin precursor
  Pfam annotation: Domain name=PA; Domain location=184-279; Score=40.8; E_value=4.8e-09; Accession=PF02225.12; Description=PA domain
MSHFSWTECLTASRSSAGNSSNDDTNRKEVYILYMGAADSSNASLKNEHAQILNSVLKRKLIGARVYPDHPDAKNDDNDKTPRDWNGRGGSCLGSAILAAFDDAINYGVDELSLSLGPFGGIQTDLTTDPISIGAVHAVERSIVAVCAARNDGQPSTVVNDAPWILTVAASIIDRDLQSNVVLGNNQVIKGRAIHFSPLSNSPEYPMIYDPNEVIGKIAVYDGKDDDYSTSEKIDIVQALGGIGLAHIIDQDGSVTFNYEDFPATKISSKDGVAILQYIIQPATPWEQY

SEQ ID NO: 146894 - protein, 1078 aa, Glycine max
  Coding DNA Sequence Number=SeqID_30116
  Gene Ontology: Mol. function=identical protein binding; Cellular component=cytoplasm; Biological process=negative regulation of enzyme activity
  Homolog annotation: Hit_ID=Q9LDM8; Match level="QueryCoverage=99%, HitCoverage=89%, E-value=0.0, Identity=71%"; Hit description =Putative subtilisin precursor
  Pfam annotation: Domain name=PA; Domain location=129-224; Score=31.9; E_value=2.2e-06; Accession=PF02225.12; Description=PA domain
  Pfam annotation: Domain name=PA; Domain location=730-834; Score=75.3; E_value=1.9e-19; Accession=PF02225.12; Description=PA domain
  Pfam annotation: Domain name=Peptidase_S8; Domain location=489-973; Score=73.2; E_value=8.5e-19; Accession=PF00082.12; Description =Subtilase family
  Pfam annotation: Domain name=Subtilisin_N; Domain location=396-472; Score=77.6; E_value=3.9e-20; Accession=PF05922.7; Description =Subtilisin N-terminal Region
  Pfam module annotation: Pfam domain module=PA::PA::Peptidase _S8::Subtilisin_N; Domain location=129-224::730-834::489-973::396-472
FAARLSKEEATSIAHKPGVVSVFPDPVLKLHTTRSWDFLKYQTHVKIDTKPNTVSKSSSVIGILDTAILAALDDAIEDGVDVLSVSLGASTGFRPDLTSDPIAIGAFHAVERGILVVCFVGNDGPSSYTLVNDAPWILTVAASTIDRDFQSNVVLGVNKIIKIVVCEGKNDKYSTRKKVITVKAVGGIGLVHITDQNGAIASNYGDFPATVISSKDGITILQYINSTSNPVATILPTTTVLDSKPAPLVPNFSSRGPSSLSSNILKPDIAAPGVNILAAWIENGTYRRATPYDYGVGEMATSEPLQPGLVYETSTIDYLNFLCYIGFNVTAVKVISKTVPHNFNCPKDLSSDHVSNINYPSIAINFSGKRAVNVSRTVTNVVSAGNGSNDDTNRKEVYIVYMGAADSTNAYLRNDHVQILNSVLKRNENAIVRNYKHGFSGFAARLSKEEANSISQKPGVVSVFPDPILKLHTTRSWDFLKSQTRVNIDTKPNTESSSSSSSDVILGILDTGIWPEAASFSDEGFGPVPSRWKGTCMTSKDFNSSNCNRKLIGARFYPDPDGKNDDNDKTPRDSNGHGTHVASTAVCVAVSNASFYGLATGTAKGGSPESRLAVYKVCYRNGCRGSAILAAFDDAIADGVDVLSLSLGVLPLSRPKLTSDTIAIGAFHAVQRGILVVCAAGNAGPLKYSVVNDAPWILTVAASTIDRDLQSNVVLGTNHVVKGRAINFSPLSNSPEYPMVYGESAKAKRANLGTARKCHPNSLDRNKVKGKIVICDGKKDPKYITMEKINIVKAAGGIGLAHITDQDGSVAFNYVDFPATEISSKDGVALLQYINSTSNPVGTILATVTVPDYKPAPVVGFFSSRGPSTLSSNILKPDIAAPGVNILAAWIGDDTSEVPKGRKPSLYNIISGTSMATPHVSGLVCSVKTQNPSWSASAIKSAIMTSAIQNDNLKAPITTDSGSIATPYDYGAGEITTSKPLQPGLVYETNTVDYLNYLCYTGHNLTTVKVISGTVPDNFNCPKDSTSDLISNINYPSIAVNFTGKANVVVSRTVTNVAEEDETVYSAVVEAPKGVFVK

SEQ ID NO: 146895 - protein, 144 aa, Glycine max
  Coding DNA Sequence Number=SeqID_30117
  Homolog annotation: Hit_ID=Q6F2D0; Match level="QueryCoverage=37%, HitCoverage=10%, E-value=3e-07, Identity=51%"; Hit description =Putative selenium-binding protein, related
MSAISSDCDLLFKKSYNQRWWNCCMLIPIWLPTISTNLLYIVESSKDLIGSRIGKICTWYQAPYNRQLRVKAATNLEAGKEEALLAQSEKLVVAYGRHSSSARFPIRLVGRELIIRDVKRFYILKTGYAPSGIMGEHELRTFFL

SEQ ID NO: 146896 - protein, 688 aa, Glycine max
  Coding DNA Sequence Number=SeqID_30118
  Gene Ontology: Mol. function=identical protein binding; Cellular component=cytoplasm; Biological process=negative regulation of enzyme activity
  Homolog annotation: Hit_ID=Q94KL9; Match level="QueryCoverage=100%, HitCoverage=89%, E-value=0.0, Identity=78%"; Hit description =Subtilisin-like protein
  Pfam annotation: Domain name=PA; Domain location=370-473; Score=89.3; E_value=1.2e-23; Accession=PF02225.12; Description=PA domain
  Pfam annotation: Domain name=Peptidase_S8; Domain location=123-612; Score=65.3; E_value=2e-16; Accession=PF00082.12; Description =Subtilase family
  Pfam annotation: Domain name=Subtilisin_N; Domain location=35-111; Score=74.2; E_value=4.2e-19; Accession=PF05922.7; Description =Subtilisin N-terminal Region
  Pfam module annotation: Pfam domain module=PA::Peptidase _S8::Subtilisin_N; Domain location=370-473::123-612::35-111
MKGNNTLLLHLFYTLLLFLGVSAGNGNNDDTNRKEVYIVYMGAADSTNVSLRNDHAQVLNLVLRRNENALVRNYKHGFSGFAARLSKEEAASIAHKPGVVSVFPDPILNLHTTRSWEFLKYQTHVKIDTKPNAVSNSSSSSDIILGVLDTGIWPEAASFSDEGMGPVPSRWKGTCMKSQDFNSSNCNRKLIGARFYTDPTGNDDDEGDNTPRDSVGHGTHVASTAVGATVTNASYYGLAAGSATGGSSESRLAVYRVCSNFGCRGSAILGAFDDAISDGVDVLSLSLGASPGFQPDLTTDPIALGAFHAVERGILVVCSAGNSGPSSSTVVNDAPWILTVAASTIDRDFQSDVVLGVDKTVKGRAINFSPLSNSAEYPMIYGESAKAASTSLAEARQCHPDSLDANKVKGKIVVCDGKNDGYSTSEKIGTVKEAGGIGLVHITDQNGAIASYYGDFPATVISSKDGVTILQYINSTSNPVATILPTATVLDYKPAPVVPNFSSRGPSSLSSNILKPDIAAPGVNILAAWIGNNADDVPKGRKPSLYNIISGTSMACPHVSGLASSVKTRNPTWSASAIKSAIMTSAIQINNLKAPITTDSGRVATPYDYGAGEMTTSESLQPGLVYETNTIDYLNYLCYIGLNITTVKVISRTVPANFSCPKDSSSDLISNINYPSIAVNFTGKAAVN

SEQ ID NO: 146897 - protein, 452 aa, Glycine max
  Coding DNA Sequence Number=SeqID_30119
  Gene Ontology: Mol. function=identical protein binding; Cellular component=proton-transporting two-sector ATPase complex; Biological process=negative regulation of enzyme activity
  Homolog annotation: Hit_ID=Q94KL9; Match level="QueryCoverage=99%, HitCoverage=71%, E-value=1e-82, Identity=56%"; Hit description =Subtilisin-like protein
  Pfam annotation: Domain name=Peptidase_S8; Domain location=13-350; Score=26.2; E_value=3.5e-08; Accession=PF00082.12; Description =Subtilase family
MGPVACRWKGTCMKSYYFYSSNCNRKIIGARHYPDPQGDSEYETPRDKNGHGTHVASTAAGATVPGASYYGVAAGTAQSGSPKSLLAIYKVCFKYECPGSAVLAAFDDAIADGVDVISLSVASLSELKYNPIAIGAFHAVERGILVVASAGNNGPSLNTVVKDAVQGVSGIRVVHIFDPIGGTERKDFGDFPVTEIKFKRCKQNPSVCQFNQVLRMHHGWSHYLETSLETKPAPMMPSFAAKGPSAISKNILKPEITAPGVNILAAWIGNDKEGVPKGKKPSQFNIKSGTSMACSHVSGLAATIKSQNPTWSASAIKSATMATVTQENNLKAPITTDKGSVATPYDYGAGQMTIYGAFHPGLVYETNTIDYLNYLCYVGFNITLVKTISRNAPNNLSCPKHSSSHHISNINYPSIAISDLKGKELVDVNITVTNVGEEDETLYSPVVDAPIG

SEQ ID NO: 146898 - protein, 132 aa, Glycine max
  Coding DNA Sequence Number=SeqID_30120
  Gene Ontology: Mol. function=identical protein binding; Cellular component=cytoplasm; Biological process=negative regulation of enzyme activity
  Homolog annotation: Hit_ID=Q9LDM8; Match level="QueryCoverage=93%, HitCoverage=19%, E-value=9e-28, Identity=54%"; Hit description =Putative subtilisin precursor
  Pfam annotation: Domain name=Subtilisin_N; Domain location=24-88; Score=41.1; E_value=3.7e-09; Accession=PF05922.7; Description =Subtilisin N-terminal Region
MKDNPIFYVLLLFLGESRSSSADIIQAGNGSDDDTNRELYIVNEKAPVRNFKHGFSGFAARLTKEEANSIAQKPRVVSVFPDPILKLLHTTRSCDFLKDQSTPVKIHHPNTVYNSAPSSDVIIGILDSGYQN

SEQ ID NO: 146899 - protein, 50 aa, Glycine max
  Coding DNA Sequence Number=SeqID_30121
MAAEMMATDDHNGDNIMVVAATVVMVVIVTMTMVTKVVAVDNGVNGGSDN

SEQ ID NO: 146900 - protein, 45 aa, Glycine max
  Coding DNA Sequence Number=SeqID_30122
  Gene Ontology: Mol. function=oxidoreductase activity, acting on the CH-OH group of donors, NAD or NADP as acceptor; Biological process =malate metabolic process
  Homolog annotation: Hit_ID=P37221; Match level="QueryCoverage=86%, HitCoverage=6%, E-value=3e-11, Identity=82%"; Hit description=NAD -dependent malic enzyme 62 kDa isoform, mitochondrial precursor
MGILGLGDLGVQGIGIAIGKLDLYVAAAGINPQRVLITLVSLCCR

SEQ ID NO: 146901 - protein, 78 aa, Glycine max
  Coding DNA Sequence Number=SeqID_30123
MYIVVIKRGQDHLGLPSGVETKHERQKPIKVLKDERKRGWGHDRPIITLLCAKQAGNVAARQPRILCILQLSFTICLF

SEQ ID NO: 146902 - protein, 128 aa, Glycine max
  Coding DNA Sequence Number=SeqID_30124
VRSLTSNIKLILDSLRTSTVVEVQLSLITLSTHLISVHCHVSDAVEGDKLRRCNEWMKWLPSAQLRANSGSISPSGSSSNNLAADFEKITVDEAISHKVNTEPTTNEDAAGESSTQSQVPNDATVSSN

SEQ ID NO: 146903 - protein, 194 aa, Glycine max
  Coding DNA Sequence Number=SeqID_30125
  Gene Ontology: Mol. function=protein dimerization activity; Cellular component=nucleus; Biological process=regulation of transcription, DNA-dependent
  Homolog annotation: Hit_ID=Q0GPI1; Match level="QueryCoverage=99%, HitCoverage=100%, E-value=3e-92, Identity=87%"; Hit description=BZIP transcription factor bZIP46
  Pfam annotation: Domain name=bZIP_1; Domain location=107-170; Score =33.1; E_value=9.9e-07; Accession=PF00170.11; Description=bZIP transcription factor
  Pfam annotation: Domain name=bZIP_2; Domain location=108-158; Score =28.7; E_value=2e-05; Accession=PF07716.5; Description=Basic region leucine zipper
  Pfam module annotation: Pfam domain module=bZIP_1::bZIP_2; Domain location=107-170::108-158
MASWPPKPTEIFCVHAREKAMASSPCDCWPHLSPPSSIEHVWNDIKLDSLSNSPVDIDFNNNHSVSDSSFLNLTSTSSSVFHKHDHDHSLLSVSNTSFEASGSKKTTLLDQRHARIIKNRESAVRSRARKQAYRKGLEVEIARLTEENSRLKRQLKEENVVPRFKEKLQCCLSSSDNPPTPRMAALCRTSSSPF

SEQ ID NO: 146904 - protein, 114 aa, Glycine max
  Coding DNA Sequence Number=SeqID_30126
MEENSEGYKHYSTDGGGVTGVAVRTQNQKKLFKVILCLPTWPMKESRRLARQNTQNTTCHHNELEQIFEFTKIDVYSLKLERIERTSRKISALDNCKEISGILSRINNAFLKTL

SEQ ID NO: 146905 - protein, 425 aa, Glycine max
  Coding DNA Sequence Number=SeqID_30127
  Gene Ontology: Mol. function=RNA binding; Cellular component =ribonucleoprotein complex; Biological process=RNA processing
  Homolog annotation: Hit_ID=Q1S8H3; Match level="QueryCoverage=78%, HitCoverage=66%, E-value=3e-71, Identity=44%"; Hit description=RNA -binding protein Lupus La
  Pfam annotation: Domain name=Extensin_2; Domain location=2-390; Score= -125.0; E_value=0.02; Accession=PF04554.4; Description=Extensin-like region
  Pfam annotation: Domain name=La; Domain location=375-419; Score=54.8; E_value=2.9e-13; Accession=PF05383.7; Description=La domain
  Pfam module annotation: Pfam domain module=Extensin_2::La; Domain location=2-390::375-419
  Subcellular localization annotation: CTP_CleavageSite=16; ConfidenceScore=5.56e-01
MVTTTVDSSSNHYSPTAATAAADTSNNFPRKNLPSPWAQVVRGADAEPNHQSPPSSSSSSFSSLDSINSNGPAVQTSDTTVKPAWKKPESNGVSEVGPVMGAHSWPDLSESTKPTAKLTSDSSVKTAADEESLTTTPQDPVNSDSPQKQAIGNANPSPTPAMNYGMANRQRSMKQRGGSNGYNVGSGPVQNNFSGATQNLPPPPPPPPFPVLPMPPRTFAHGIPGVPVPTPRDPYRNNNWDARPPHGGFMPPMSEHRSPSRRGNAGHHPRGDGPYHNSYGSRRDQDRGGYANTRDAHVNQQRMPPRGLMRPPPPNPAPFMGPQPMRPFANPAGFPEFYYFPTLQFEPFGGMPFFTHAPPPAMFFPVAETPLTNTIANQIDYYFSDANLVKDEYLRSNMDEQGWVPITLIASFPRCHLYKMMEGTG

SEQ ID NO: 146906 - protein, 157 aa, Glycine max
  Coding DNA Sequence Number=SeqID_30128
  Gene Ontology: Mol. function=protein binding
  Homolog annotation: Hit_ID=Q28G67; Match level="QueryCoverage=95%, HitCoverage=75%, E-value=1e-12, Identity=29%"; Hit description=Novel protein
MKPAHDHLCVIGLAPSHIAFNDEGGITAVDFNVGKSDRSGIKVTGKRKKNAQHFESNTALCKISTKNDTYIVRCCVKGSLLEINQQLIKQPELLNVSFTKDKKEMLRTVGCGSMDSGKMHAGREGYIAIIMPKPADWLKVKASLVSLQEYKKSREVN

SEQ ID NO: 146907 - protein, 358 aa, Glycine max
  Coding DNA Sequence Number=SeqID_30129
  Homolog annotation: Hit_ID=Q10RR9; Match level="QueryCoverage=87%, HitCoverage=88%, E-value=1e-16, Identity=24%"; Hit description =Expressed protein
  Pfam annotation: Domain name=DUF677; Domain location=38-353; Score= -153.7; E_value=0.0028; Accession=PF05055.3; Description=Protein of unknown function (DUF677)
MTNPRWLSLLQRRTGRSRKKEHEEGSFCGTPNVNGEYLEAFRTKSYVEICNIAHRELGNASTNTNSFKMHLTEYLLEPPQQEIVANMKVHRLLVDYFEASLEACRCCETIVQAIHQTRLAYARVTNVVVKLSQTAPYYDQSQNPIHTQLSSFVLLQNNPLSIVQFHDIHDRYMTLLSRLLSKKRKIQRILTIKSVCKKVGGIGLIVSQGVLMVALLVFAFHSVIGFVAAAPCIVGLVMKKRFKRSCERFNTRNSCMKLCEQLDVAAKGVYVVINELDTMSRMVKRLDDEVEHWRQVADICVKNYCKCEILKRVVKEFQDNESNFLDMLEELEEHIYLCFLTVNRFRRLVMEEIMGKQR

SEQ ID NO: 146908 - protein, 327 aa, Glycine max
  Coding DNA Sequence Number=SeqID_30130
  Gene Ontology: Cellular component=extracellular region; Biological process=cellulose and pectin-containing cell wall organization and biogenesis
  Homolog annotation: Hit_ID=Q8GZD3; Match level="QueryCoverage=78%, HitCoverage=100%, E-value=1e-133, Identity=85%"; Hit description =Expansin
  Pfam annotation: Domain name=DPBB_1; Domain location=136-224; Score =174.0; E_value=3.8e-49; Accession=PF03330.8; Description=Rare lipoprotein A (RlpA)-like double
  Pfam annotation: Domain name=Pollen_allerg_1; Domain location=235 -312; Score=166.1; E_value=8.8e-47; Accession=PF01357.11; Description= Pollen allergen
  Pfam module annotation: Pfam domain module=DPBB_1::Pollen_allerg_1; Domain location=136-224::235-312
MELKLGKRLRRKIRKDRTRWGCAMNRWICLDAFTALVHVSKKGGVRRENVGIIEWHLELYRYAHTNIMQILMAKVMFGLVCSFLVLCCFTINTSAFSPSGWTNAHATFYGGSDASGTMGGACGYGNLYSTGYGTDTAALSTAIFNDGASCGECYKIICDYQTDPRWCLKGASVTITATNFCPPNFALPNNNGGWCNPPLKHFDMAQPAWEKIGIYRGGIVPVLFQRVPCVKKGGIRFSVNGRDYFELVLISNVGGAGSIQSVSIKGSKTGWMTMSRNWGANWQSNAYLNGQSLSFRVTTTDGVTRFFQDVVPSNWAFGQTFPTSVQF

SEQ ID NO: 146909 - protein, 168 aa, Glycine max
  Coding DNA Sequence Number=SeqID_30131
  Gene Ontology: Mol. function=DNA binding; Biological process=DNA integration
  Homolog annotation: Hit_ID=Q1RSZ9; Match level="QueryCoverage=92%, HitCoverage=11%, E-value=2e-48, Identity=63%"; Hit description =Polynucleotidyl transferase, Ribonuclease H fold
MTTSADSSDFIKITLSIEKGTYNTWSELFKIHARVFQVIDHIIPSKPAADPSLKTTNPQLWLRLDAVVLQWIYGTISDDLLNTIIEHNSTAATAWNRLFDIFYDNKNSRALYLEQEFSRTHMEQFSDASSYCQHLKSLSDQLANVGAPISNERLVLQLISGLTDAYAA

SEQ ID NO: 146910 - protein, 155 aa, Glycine max
  Coding DNA Sequence Number=SeqID_30132
  Gene Ontology: Mol. function=DNA binding; Cellular component =mitochondrion; Biological process=DNA integration
  Homolog annotation: Hit_ID=Q1S9T4; Match level="QueryCoverage=98%, HitCoverage=12%, E-value=5e-80, Identity=90%"; Hit description =Integrase, catalytic region
WAGCPDTRRSTSGYCVYLGDNLISWSAKRQHTLSRSSAEAEYRGVANVVSESCWLRNLLLELCCPVTKATLVYCDNISAVYLSDNPVQHQRTKHIEMDIHFVREKVACGQVRVLHIPSRFQIADIFTKGLPLQLFDDFRDSLNIRSPPVSTTGVY

SEQ ID NO: 146911 - protein, 77 aa, Glycine max
  Coding DNA Sequence Number=SeqID_30133
  Homolog annotation: Hit_ID=Q9C795; Match level="QueryCoverage=84%, HitCoverage=20%, E-value=5e-12, Identity=54%"; Hit description =Mitotic checkpoint protein, putative
MKGDWLELELEKEFGDAISRTRFAPHSNNLLISSWDSNLCLYDINASLLILQTPSQAPILDCYFQDNIVLSPSSLMD

SEQ ID NO: 146912 - protein, 81 aa, Glycine max
  Coding DNA Sequence Number=SeqID_30134
MVEASAGRELNVGYVCFFHGESQSAHGDFDFDLITPKHYTATRQLGMFDFYRVCKEKQHSKLKQEYNYCGVMEYICQDFSS

SEQ ID NO: 146913 - protein, 46 aa, Glycine max
  Coding DNA Sequence Number=SeqID_30135
MVSGENALLAKGRRCKGGHYKNLVGLSRTWRSSEAMHREETEEASK

SEQ ID NO: 146914 - protein, 76 aa, Glycine max
  Coding DNA Sequence Number=SeqID_30136
GDLGKASLMLEGFTALLTSSPDLFCARLDAISDVLVLVQGVKREAVPKGQGPCRNTALKLSTHRRLASSSLSSWNR

SEQ ID NO: 146915 - protein, 84 aa, Glycine max
  Coding DNA Sequence Number=SeqID_30137
MRGVATNVYLRKTSEKPETYGLRTLSVKGSRVVFTHREGISTPRVRHKGWQPLTEVFPLLLLSYPNFVRGPLLDDMRPFFGPCE

SEQ ID NO: 146916 - protein, 378 aa, Glycine max
  Coding DNA Sequence Number=SeqID_30138
  Gene Ontology: Mol. function=transporter activity; Cellular component= outer membrane; Biological process=transport
  Homolog annotation: Hit_ID=Q8PP65; Match level="QueryCoverage=97%, HitCoverage=46%, E-value=3e-35, Identity=30%"; Hit description=Outer membrane hemin receptor
  Pfam annotation: Domain name=TonB_dep_Rec; Domain location=106-378; Score=95.8; E_value=1.3e-25; Accession=PF00593.14; Description=TonB dependent receptor
  Subcellular localization annotation: CTP_CleavageSite=35; ConfidenceScore=5.07e-01
FWGADHRLSYGFQGDRTATDYARATATYNHLTGVRTSSRAGGFNFANARTTRADLYLQDEISLMKDRLLLTPGVRWANYAINPRPDSDYVVAPGKEPRKQSRSKFVPQIGTLFKLDDVHSVYAKYAEGFKMPTAQQLYTSLPGVGLTLTPNPELKPESVRSYEVGLRGNFDGSAFFEHASYSIGAFKSDYKDFIQNFYNIPGTDEYTYRNLSRVNIKGMEASGRIQFNKSWAMTSSLAWQHGDSRYDADSRKQAYDAVVPLRAVVGVQWRNPQWGLDLELLGTFAQGVKRASTPGLFKPPGYAVYDAYLNWSPAGQDSGNGRSVTFQVGVENIADRRYFVAPLAGYALRPSSSVAATNPLELQTAPGRTARLSTKIRF

SEQ ID NO: 146917 - protein, 72 aa, Glycine max
  Coding DNA Sequence Number=SeqID_30139
MARLIRICVRGHDGRIGVLYLIAILILGFCGIAVSLRMIAWSAAFYDALQRVDGNEILKQIGVFAALTLTSA

SEQ ID NO: 146918 - protein, 72 aa, Glycine max
  Coding DNA Sequence Number=SeqID_30140
GEVAEEEAVAVVGIGVGGGGERGGIGGGVVEEVLAGEEVGGVEAEGRGFRIRSPFCYVASFTLALQNSNQFY

SEQ ID NO: 146919 - protein, 185 aa, Glycine max
  Coding DNA Sequence Number=SeqID_30141
  Homolog annotation: Hit_ID=Q5CEG7; Match level="QueryCoverage=56%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWDLVIHSCASLIR

SEQ ID NO: 146920 - protein, 168 aa, Glycine max
  Coding DNA Sequence Number=SeqID_30142
  Gene Ontology: Mol. function=catalytic activity; Biological process =cellular metabolic process
  Homolog annotation: Hit_ID=Q1XK07; Match level="QueryCoverage=73%, HitCoverage=58%, E-value=3e-34, Identity=56%"; Hit description=NAD -dependent epimerase/dehydratase
ALKNVDIVISAFNAGWTNPNLYEDFTKGALAIQQAVKDAGVNRFIVIGGAGSLLIDGNRLVDSPDFPKEIKPGALAAADYLDTIRKENQLTWTMFSPAIEMNAHAGGTRTGKYRTGLDAPVFDQEGRLIALGVGAIIGAGLFSLTGIAAAENAGPAVILSFIIAAVGC

SEQ ID NO: 146921 - protein, 94 aa, Glycine max
  Coding DNA Sequence Number=SeqID_30143
MTIEESIHVSFDETNITSPRKEFLDDIADSFEDEHNQERNLKRKRNKENKDDQDDKAQENDDLPKEWKTSKNHPLHNIIRDISKGNLKTLRKPL

SEQ ID NO: 146922 - protein, 310 aa, Glycine max
  Coding DNA Sequence Number=SeqID_30144
  Gene Ontology: Mol. function=nucleic acid binding; Biological process= transport
  Homolog annotation: Hit_ID=Q8H6Q8; Match level="QueryCoverage=80%, HitCoverage=8%, E-value=2e-35, Identity=33%"; Hit description=CTV.20
  Pfam annotation: Domain name=MP; Domain location=1-161; Score=27.4; E_ value=3.1e-06; Accession=PF01107.9; Description=Viral movement protein (MP)
MKDKHNFDYIIKTVENNIPLGQDIGEEFHLLSKNSIYEHSRKYKYLHIGCVQVAIKPLIDMGIDAAMLMCLRDIRHNKFEDSLIGTVETILGQGPVYFNCYPNKTVSLIDRNILDSLFLNIHFHGLDMKEGSIPAALIYRIQYKVMNTCASRVLLQPQKGETTLFITDMKKANVSLKRIIKWDEVTLPEKWVMEKATPSDPRPAPIIEDIKQDNSGKVEIAFNRRNSFSSRIKASRSEYESARRSFSVRTCSIPVGLTRSELHNQFPTVYLQGLDTTSSIPRMTYNQHQEDDQKSIQSPTYSSMEPYDVI

SEQ ID NO: 146923 - protein, 64 aa, Glycine max
  Coding DNA Sequence Number=SeqID_30145
MASYGEANDSIDEEDLRPTSSTWSYIMSRRSLAAREGAWKARKRGRGENPNSKMVSMSRVRWHD

SEQ ID NO: 146924 - protein, 79 aa, Glycine max
  Coding DNA Sequence Number=SeqID_30146
  Subcellular localization annotation: CTP_CleavageSite=43; ConfidenceScore=5.13e-01
MTQAFYRTPRVQYFPVKPDKQMERLVLQQCPRQTSRVPNKVCRLSSTGNRLKIQGPKKSGRSVEGESLPRHRLRHECPG

SEQ ID NO: 146925 - protein, 668 aa, Glycine max
  Coding DNA Sequence Number=SeqID_30147
  Gene Ontology: Mol. function=RNA-directed DNA polymerase activity; Cellular component=chromatin; Biological process=RNA-dependent DNA replication
  Subcellular localization annotation: CTP_CleavageSite=54; ConfidenceScore=5.38e-01
MARRSLWINLSSISASLNCPWLLIGDSTVSSLPMTVSIALTSVLMRCRILLPVVLSLGWGTLTVMGPCIPGLMWWVLNQFDHTPLVVTTEVLMPRDGWSHQVSGCCMFKVCKRLKTLKAPLKLIFKQEFSHIAYQVEQAEAEYNRLLNSLQRTSLVVCNSGPKVPIDCFASLLSPITKQDVWNVILGMGNNKASGPDGYNALFFKKAWNIIGDDIFVAVNEFFMLAKLLKQINHALIALIPKSDQASQHIIGASQSAFLKNWKMMNNIFLIQELLRKYARKRISPRCLLKIDLHKAYNSISWEFLDWMLKSMGFPTQFCSWIMECITTTSFSVVVNGSIYGHFKGQHGLRQGDPLFPYLFVLCLEYFSCDLQSLKDNINFKFHPTCDVVQLSHLAFADDIMLLSRGDLPSVSTIFAKLQHFCNVLGLSINTNKSSIYSVGVDQDVLSNIQQLTGFSLSYFPFRYLDGWSSKTLSYAGKVELIRAVIQGIANFWTDIFPLPQFVLDRINVSYRNFLWGKAEVHHNYFKGGNVWDFISSASDSVLIKKIIHIRDIITIKEDNVEAAKQTLNSWNSNEQLLAGKAYDYIRGVKPAVNWNSVVWNPAIPSKMSFILWLATKNHLLTLDRAAFLNKESPSKSGPISVIGFLSTGKQFHYSALSIPVFVVEPPL

SEQ ID NO: 146926 - protein, 249 aa, Glycine max
  Coding DNA Sequence Number=SeqID_30148
  Homolog annotation: Hit_ID=Q2HRL0; Match level="QueryCoverage=29%, HitCoverage=13%, E-value=6e-07, Identity=36%"; Hit description=RNA -processing protein, HAT helix
  Pfam annotation: Domain name=zf-CCHC; Domain location=68-85; Score =6.0; E_value=0.1; Accession=PF00098.13; Description=Zinc knuckle
MESPSSRKNSVQDSPIRTDYLTASKGSISFSRALVEVDASLDLIEEVCFKLPIGQTFIQKIEYKNRPSFCTRCKMIGHRLAKCKVVSIVKQDNKTTTSEGPTTGSPSVQSQDAEVVAFTKTNPTNPFGKPKEDQIGLSTQPCMQQPQAYDNILALQTPFDISGVETSKSSLHQDSTKDPGDGFARHHAMQKFLHNKGVNVMAILETKLNTISEENTLKRKFGDWNFSLNFASHNVGRILILWKFDKVTL

SEQ ID NO: 146927 - protein, 149 aa, Glycine max
  Coding DNA Sequence Number=SeqID_30149
  Gene Ontology: Mol. function=transporter activity; Cellular component= integral to membrane; Biological process=transport
  Homolog annotation: Hit_ID=Q2QDD7; Match level="QueryCoverage=59%, HitCoverage=70%, E-value=3e-30, Identity=73%"; Hit description =Aquaporin
MSSAIRNTSASECEGREDDVDEDGSDGGALPIVVAAEGYKNVGGVVDEDKDLATECPCDAEKANAVAWSDLIFMVNDGGDGDVEEEKCGDKLSNEGSVEGLELNLDQVDEGGWWRVYVVFPLLAHFLRYSLSLVGTTNGMRVDEVGEKG

SEQ ID NO: 146928 - protein, 130 aa, Glycine max
  Coding DNA Sequence Number=SeqID_30150
MEQPADQQNEEIHLRSRRYRGITWKKLSPFGARMPIYRKVTSCDSQRLTHPSEGRSSRPSIALPRATNLSVCSGIVPPSLNTLGRQLLQFKNLFVPKIMEATLPSNWKNLTIEKYDGTTDLDEHLDVYIT

SEQ ID NO: 146929 - protein, 95 aa, Glycine max
  Coding DNA Sequence Number=SeqID_30151
  Gene Ontology: Mol. function=metal ion binding; Biological process =response to osmotic stress
  Homolog annotation: Hit_ID=Q8S2S3; Match level="QueryCoverage=85%, HitCoverage=53%, E-value=2e-21, Identity=63%"; Hit description =Putative RING zinc finger protein-like protein
MGLSSLPAPSEGVLCVLLVNTALSISIFKGIVRTILQIVGIRVSSLSPSPDISRNPPEPLEFNLSPSEGFIEEFRSRTPTLRTSLMPEDDASCFW

SEQ ID NO: 146930 - protein, 133 aa, Glycine max
  Coding DNA Sequence Number=SeqID_30152
  Gene Ontology: Mol. function=transition metal ion binding
  Homolog annotation: Hit_ID=Q8LAU8; Match level="QueryCoverage=91%, HitCoverage=39%, E-value=4e-40, Identity=66%"; Hit description =Dessication-related protein, putative
MTMCVYIHEQLVAGLLGVESGQDAVLRELLYERKEQLVPPYGVAVEEFTNRISILRSKLGNRGLKDEGIVVPTGLGAEGKVRGNILAGDVNSLAYSRTPEEILRIVYGSGDEHVRGGFYPKGASGHIAQSYLK

SEQ ID NO: 146931 - protein, 52 aa, Glycine max
  Coding DNA Sequence Number=SeqID_30153
MGRRLPPSSPWQAQLDQTSKGYENFTEALRMPQKPFFNKRREVLAAHLAQAN

SEQ ID NO: 146932 - protein, 70 aa, Glycine max
  Coding DNA Sequence Number=SeqID_30154
MQRQHYLTLVAVYCATVPQNSAARKIEALHNTDKDINGHCRFLWFATWVGAFSTPAVPICSKAVVGMGPN

SEQ ID NO: 146933 - protein, 147 aa, Glycine max
  Coding DNA Sequence Number=SeqID_30155
  Gene Ontology: Mol. function=transition metal ion binding
  Homolog annotation: Hit_ID=Q8LAU8; Match level="QueryCoverage=98%, HitCoverage=54%, E-value=2e-44, Identity=54%"; Hit description =Dessication-related protein, putative
MDNAFGKPLVPPFDPYANSLNFIIASYVIPYVGLTGYVGANRLLSATSRELVPPYGVAVEEFTNRISILRSKLGIRGLKDEGIIVPTGLGAEGRVKGNILAGDVNSLAYSRTPEERLRIIYGSGDEHVRGGFYPKGESGHIAQSYLK

SEQ ID NO: 146934 - protein, 153 aa, Glycine max
  Coding DNA Sequence Number=SeqID_30156
  Gene Ontology: Mol. function=integrase activity; Cellular component =chromatin; Biological process=chromatin assembly or disassembly
  Pfam annotation: Domain name=Chromo; Domain location=103-153; Score =40.9; E_value=4.5e-09; Accession=PF00385.14; Description='chromo' (CHRromatin Organisation MOdifier
MASYGGELLLDSLFLEVASPLSLASPLRCHSSSKKQRNPLMEKILGLQAPMELTSGAVAYKIKLPSGSSIHDVFHVSQLKKHVGEAVTSSSLQSSVEGDPLIKEPEAILDRMTVKRRGRAITKVLVKWKHSLPEDATWELFFDLKQRYPHFQP

SEQ ID NO: 146935 - protein, 132 aa, Glycine max
  Coding DNA Sequence Number=SeqID_30157
MIGNSRVKLEIDRKKCDAERKERTENGKLIINDNAKERTNNRSDGGTRETTVHGVKFGGATGEEHVERIRLAGGHECLLLPLLGRHDGVGDVQLLSKGLAVGTTSVVAGRDERIVQDQGAAVHGGGGRGNGV

SEQ ID NO: 146936 - protein, 34 aa, Glycine max
  Coding DNA Sequence Number=SeqID_30158
MEKGTSLPMEKGFKILLFPIIDSLGNPLKFYMWY

SEQ ID NO: 146937 - protein, 170 aa, Glycine max
  Coding DNA Sequence Number=SeqID_30159
  Gene Ontology: Mol. function=RNA-directed DNA polymerase activity; Biological process=RNA-dependent DNA replication
MEVNINDVVVKLTVLDEYLVDLEQPFKRMRLHGLKMNPEKCAFGITAGYFLGFLVHSRGIEQALALPLVLVPPTEEGQLKLHILTTEEIISCLLAQEAEDGTKRVGRLMKWALSLNAYSLNYLPLKAIKVHALANLLAQHPCVDPPYPFDKQVSYIGDKPWMMAFGGDPS

SEQ ID NO: 146938 - protein, 297 aa, Glycine max
  Coding DNA Sequence Number=SeqID_30160
  Gene Ontology: Mol. function=transition metal ion binding
  Homolog annotation: Hit_ID=Q8LAU8; Match level="QueryCoverage=85%, HitCoverage=85%, E-value=2e-80, Identity=59%"; Hit description =Dessication-related protein, putative
MAPYLSRDTASIFVLLASLVLPLILLDYSSSVLFASAKFPKSKDADLLEFALNLEYLEAEFFLFGALGHGLDVAAPNLTGGGPPPLVPKRLNLTVLPMMSSCSLLFRKAIKSKVRGFPRPLLDLSSKSFAKLMDNAFGKPLVPPFDPYANSLNFIIASYVIPYVGLTGHVGANRLLQSATSRESGQDAVLRELLYERKEQLVSQYGVAVEEFTNRISILRSKLGNRGLKDEGIVVPTGLGAEGRVRGNILAGDVNSLAYSRTPEEILRIVYGSGDEHVRGGFYPKGASGHIAQCYLK

SEQ ID NO: 146939 - protein, 115 aa, Glycine max
  Coding DNA Sequence Number=SeqID_30161
MRLISFKLKSMTMSGPMWQHKMYSQLTNMWKQSFQAYFDDAKDSSQESRLKQVSRIKESFNQEIKIQVKFQEKTQDMQELQEIKIQVKIQEKTQDMQELQEKHQENYKKKIKRKD

SEQ ID NO: 146940 - protein, 147 aa, Glycine max
  Coding DNA Sequence Number=SeqID_30162
  Gene Ontology: Mol. function=transition metal ion binding
  Homolog annotation: Hit_ID=Q8LAU8; Match level="QueryCoverage=83%, HitCoverage=46%, E-value=4e-39, Identity=59%"; Hit description =Dessication-related protein, putative
MEKESVRLFQERNAAAPESDVDLLEFPLNLEYLEAEFFLFGSLGHGLDVVAPNLIEGGPPPIGVRLARLGSLVRNIILQFGFQEVGHLRAIKSTVRGFPRPLLDLSTTSFAKLASYVIPYVGLTGYVGANPLLQNATSKKARFTLMK

SEQ ID NO: 146941 - protein, 145 aa, Glycine max
  Coding DNA Sequence Number=SeqID_30163
MSIIALPVVVVAVLRHPSLFIDAISAFDVGNNLSTTPWRYYTFTRNEADGKLEYVGGELDGYFGGQLLSAVGLDRCGSNVFQGYFDDVKESKNEFKIESRTLQGSKGNLISRIKNQVSRFKFQESRSRFKTQDLRIKRRLNQDKY

SEQ ID NO: 146942 - protein, 91 aa, Glycine max
  Coding DNA Sequence Number=SeqID_30164
MTKNILHQHKFGMPSRIAVKSLRFPMLPIDHPWYSEGEVPSMMAPMLEMVFPIPSAIRQQMEIGVHDIMLQMSKKLGDIVKPLVLNRIQKA

SEQ ID NO: 146943 - protein, 106 aa, Glycine max
  Coding DNA Sequence Number=SeqID_30165
MSVAFKQPASNAFVYSLEPDPYSTIETLTLFDNQCCEYFPGPCYLNEGEDTNKMTNKLFNDEKTIFLLLAIGMGFTKFPSNFHTWPKPLLEYQTWLKRVLASDNEE

SEQ ID NO: 146944 - protein, 129 aa, Glycine max
  Coding DNA Sequence Number=SeqID_30166
  Gene Ontology: Mol. function=RNA-directed DNA polymerase activity; Cellular component=mitochondrion; Biological process=RNA-dependent DNA replication
MTGSLRIMGEVHEEICGSHRSEPKMRRLIHRHGYLWPSILADYIKYAKRCEEWKRHGPLQRDPAEELQSIVKPWPFRGWAMDLIGKIHPSSSKHHSFIIVAICYFTKWVEAQPMVTMTQNDIIDSFKMR

SEQ ID NO: 146945 - protein, 177 aa, Glycine max
  Coding DNA Sequence Number=SeqID_30167
MQITSSLLSNLLDVVEEVQSAQIEIRNLVGAKFYSHSVQRLDLQLSFIDFCSGRKVKVTFDITCLKCGVYPAEVLPSQILDPSSGEQKSLPSSLVDELRTAAESMYFPGSSGFNKKQMIGNYGSSDCFRCCHDSSLVSSCLSSLHIMVLLQTGDNVVQYAENSCYYPLDNATMSLRQ

SEQ ID NO: 146946 - protein, 896 aa, Glycine max
  Coding DNA Sequence Number=SeqID_30168
MEPSKTNAQSEEDDTVALRKKRARRVSFADNEITSVHVFRRDDDSTSSPSEPPSSSDPSVLGFFHDLASDSDDDEQPQLDDEAEAANSFLRPIGSPSPGGSTTADDADWESGVMFFKRADRSKGVDDDDDFRGPVSAHFIRPDRLSDSGVSDDVTMDSTAFSLHYRSLARSDSGDIKTRQFAGITTPSSQGSYMELTEAKKRPGQVVLDADSAGRDSNDMSIDGDHQMSFGYDILSPAFDAAAVLVAEEALKDLPQHNLEGSVVSPVTHLHQIQPSDSSIKENKEFSVGAIEIVPVCRQLNFENANRGTPLRVDEDKGTVSDTDHKSDQVNQNPIHGSTPVSLSGRKLLVMRSPDSSRHAGNITQPLVQSGLFVPEVRVAHGATPSSVHRSILKMKTLETTPVMSGLKEGMDRLKARLSKYSPGFSLSNIKDREYKQDESRQTPLEEKLFSLTPDSNVHKGLVDSNDHGIQSFKNICKSSQNEETVDAKIDEKNLSLISAHVSYNDENPKVVEMGASPSQMTHLMKVVDVDQADSMVEKGKDEIPVPSPPIQEVTPQLRSLPDPPSMQDFSTKGNLDGHSLDNSYHSTLQVAQSPLALTKAGINISSGNKLQDPPSMQDLTPKGNLDGHGLDNSYHSACQVAQSPLTKSGINISSGKKLQDPPNMQDLSPKGNLDGHGLDNSYHSALQVAQSPLTKSGINISSGKKRKGVEILSNEDNIDKIGRIDRSLEVHKSGNGDLLLLSEQTGYMRSEREKLGDQTSNDGDLILKKFLARTNQLLPPSVDKLNLRSIGRLEDILVHLQKVKKKEILCSEIQSQLKITDPLNILRDKRVAETRTLLYNIAYEKAKLQLLHVKHDKLQKKVQQVSSGLQECEMIKLNSIPSSSKSGAMDTQAGD

SEQ ID NO: 146947 - protein, 113 aa, Glycine max
  Coding DNA Sequence Number=SeqID_30169
  Gene Ontology: Mol. function=nucleic acid binding; Biological process= DNA integration
MGDSYEESNMKYLRTTNGLKFCSTKFNEICKDEHIVFGCPTYYHISEDKLELKTKKDVFMGYRDGVKEFRIWSSSKRKVILSKYVLFDELFMLHSKFEEDLRMLLNRSSLRSL

SEQ ID NO: 146948 - protein, 143 aa, Glycine max
  Coding DNA Sequence Number=SeqID_30170
  Gene Ontology: Mol. function=RNA-directed DNA polymerase activity; Biological process=DNA integration
MTSAKPVCTPLITSIRLIELNATQSESKREYMYRVPYATVVGSLMYAMVCIRSDMAQAVNGVSRYMGKIGKEHIWKATRQPIVALFTTEVEYMTLAKATKEESRWRLLEGVNDTEREASFMMMNQVDSSSFDDDKDDDKKPKE

SEQ ID NO: 146949 - protein, 63 aa, Glycine max
  Coding DNA Sequence Number=SeqID_30171
MGCNNWTQPWPMGLEIYLKVHENPRAFFSSSNPILLEPHAHGSSDWSLLRKDCISRQLANPYF

SEQ ID NO: 146950 - protein, 741 aa, Glycine max
  Coding DNA Sequence Number=SeqID_30172
  Gene Ontology: Mol. function=RNA-directed DNA polymerase activity; Cellular component=chromatin; Biological process=chromatin assembly or disassembly
  Pfam annotation: Domain name=RVP_2; Domain location=39-163; Score= -46.9; E_value=0.0045; Accession=PF08284.2; Description=Retroviral aspartyl protease
  Pfam module annotation: Pfam domain module=RVP_2::RVT_1; Domain location=39-163::286-455
MTSATDDDEPLPPESPDILEPNPTPPPPPDPDSAQLTLYALSGHPTSATLRVIGTIKGHDTAILMDGGSTHNFIHNRLAHFLNLTPQTIPALPVMVGNDTEIQCDKVCCNVSVSIQGCKFTLDLHVMVLGGTDIVLRVAWLKLLGPVTTDYSHLTMTFHHQGEPITIQGGIDSGPTEIHHGQVRCLINTNRVAALFHIQLHNHDPPSPNLPSTPPSLRPLLTKYASLFQTPTILPPPRPTDHSIHLEPNLKPVNVRPYRYPYYQKHEIERQVDDMFCRQLIRPSRSPYSSPVLLVKKKDGTWRFCVDYRALNSITVKDRFPLPTIDELFDDLGNSSWFLKMDLAQGFHQIRMEEHDISKTAFRTHQGHYEYIVMPFGLCNAPSIFQATMNELFRPFIRKFVLVFFDDILVYSHDFQAHINHLECVFRTLQQGQFHLKPSKCIFGQRRIEYLGHFVSSQGVEPDPSKINAIFFHCYAQIAEPLTQLLRKDGFKWTPEAQEAFVKLKEAMTATPVLALPDFTIPFVIETDASGSGMRAVLMQRGHPIAYFSKQFCPKLLRSSTYIRELHTITTVVKRRCQYLMGHAFVILTDHKSLRELMTQPVQTPEQHVYLAKLLGYNYSIQYKAGRNNVVVDAFSRLHEPEHTTEYFQIVSMPHPKFLDELKRELSGPEEFKTLMLQVRNEPSKNPDFEIRDNLLLFQGRIWINQGNLFISLLLEEYHKSPLGGHMGLAKTLGRLQQSFF

SEQ ID NO: 146951 - protein, 209 aa, Glycine max
  Coding DNA Sequence Number=SeqID_30173
  Gene Ontology: Mol. function=metal ion binding; Cellular component =integral to membrane; Biological process=ubiquitin cycle
  Homolog annotation: Hit_ID=Q9FL42; Match level="QueryCoverage=66%, HitCoverage=75%, E-value=2e-33, Identity=52%"; Hit description =Putative RING-H2 finger protein ATL5E
RGGVPAEGTRGARLEPLVDALRVEAVAALRNAPYRLLGKILAQANRARALVVGPGQALALSDHDLGPVAGLDGGLLQAQDHNTRPIRRVTKTAVIIVVVSLVSVDVVVVAASDDAAVGFDTDAGVGGEHDGGDQDQDAHGDGNAVAEAPASCGGGGGGPVATYPSAGGRRVTREMRVPRKEYARSRHQRLFEENVGKTGKDAIYELLSE

SEQ ID NO: 146952 - protein, 66 aa, Glycine max
  Coding DNA Sequence Number=SeqID_30174
  Subcellular localization annotation: CTP_CleavageSite=33; ConfidenceScore=5.40e-01
MNNIFGLHFPKIKRPQPSHQSLICVNPCRHRAVATAVTVALVRGLVSGTCGWNRLVFLDFESWSWL

SEQ ID NO: 146953 - protein, 50 aa, Glycine max
  Coding DNA Sequence Number=SeqID_30175
MSIRKDLQNENLRMEPHNGFVSYHILTARKCPYLLQKLVRSSVAISVTVE

SEQ ID NO: 146954 - protein, 91 aa, Glycine max
  Coding DNA Sequence Number=SeqID_30176
MVVARHEVLHSHPPIHLLPRTQSSRSSQDPNTNIKSGGDQTGSQCFARMLQPYGINIGLKEHSNRVAPKAYTPKSPSRPLPPDSGPTQKTF

SEQ ID NO: 146955 - protein, 143 aa, Glycine max
  Coding DNA Sequence Number=SeqID_30177
MEKTKKLKSGEWVNDKSREFAEKYQHRRDEILQRLTEEGTSTQDSPNTATSVNDNEIYLNVVGGPNYKGNMYGLGTLSKRFSCSKSAPSTSITPVEDQIEEMCETINKWNAELLAKANKEKILEEKMLQMMENHDHQSQEMRQ

SEQ ID NO: 146956 - protein, 289 aa, Glycine max
  Coding DNA Sequence Number=SeqID_30178
  Gene Ontology: Mol. function=tryptophan-tRNA ligase activity; Cellular component=soluble fraction; Biological process=tRNA aminoacylation for protein translation
  Homolog annotation: Hit_ID=Q2QP62; Match level="QueryCoverage=70%, HitCoverage=50%, E-value=1e-84, Identity=76%"; Hit description =Tryptophanyl-tRNA synthetase, putative, expressed
MCEVGKRVTYNQAVGIFGFAGEDHIGKVSFPPVQAVPSFPSSFPHLFSGKENLRCLIPCAIDQDPYFRMTRDVAPKMGFHKPALIESLFFPALQGETGKMSASDPNSAIYVTDSAKDIKNKVNKHAFSGGQDSIEKHRQLGANLEVDIPVKYLTFFLEDDDELEHIKKEYGEGRMLTGEVKQRLVQVLTELVERHRRARASVTEEFDPKSDCGSGYIFKRFMAPNRQKENMTDALAMTLARMTRVIADLVEVEEWLQKRKKFRVMRCDDAQKVDFTTYMLELDEQLWNT

SEQ ID NO: 146957 - protein, 100 aa, Glycine max
  Coding DNA Sequence Number=SeqID_30179
MIHNHFAYTLFPPVPISPLGLDKVRSQGFRMENENSHSVPCNAGGHKMYHPKMCTLVLDLGVTISLPKSLVSDVGGTEFAKKFRCKNLIVDLFRRKKCAK

SEQ ID NO: 146958 - protein, 85 aa, Glycine max
  Coding DNA Sequence Number=SeqID_30180
MRIKRSFKVVMGPRIRLVVSFKTRKGKQGSKGLSKELSQGKSIWLEAYKNKIASIISKYACELGSINKNQAKAIVQAINGAKHTK

SEQ ID NO: 146959 - protein, 70 aa, Glycine max
  Coding DNA Sequence Number=SeqID_30181
MDGTSVPQRLKDLRETDQEDEGFVQVALHNKKVAALVAFALKRVKKVQPASKPREYVLPYAIPRRIDSDC

SEQ ID NO: 146960 - protein, 98 aa, Glycine max
  Coding DNA Sequence Number=SeqID_30182
MGTTTGEELATQLAQASKVASSRSNSLLEEESGRPNFRRSYENSRIAKNTSFRFPSHYGIFTNHVSLLIFGTSRDFTYCATKAAKYLEAANQGLYIIK

SEQ ID NO: 146961 - protein, 89 aa, Glycine max
  Coding DNA Sequence Number=SeqID_30183
MSASDHAILRDRVHQPTKKSLLELSSQDVVLAQNKFLSKQLEILTETIEQMQEASYMGNQQKQGYNQGGFSGFQQGQWRSHPGNQFNKD

SEQ ID NO: 146962 - protein, 169 aa, Glycine max
  Coding DNA Sequence Number=SeqID_30184
  Subcellular localization annotation: CTP_CleavageSite=31; ConfidenceScore=5.04e-01
MAEPSKKRKGSSSRSQRHSEAHDTPIPSSISSSSLFSSEEQRIRYTNLFSSRSIIDPKFIDMDFFSDESFECIQAFQNSNLNPFMSLKLAVYSELVKAFYYNLEIQESALDHDWKFDFSVHDARQLVCTNQEDMTRRLLAGSLALESHILHYLINSYLTPKIFKPCTGF

SEQ ID NO: 146963 - protein, 69 aa, Glycine max
  Coding DNA Sequence Number=SeqID_30185
MGFTTKGAALPGHRAYPILNLGESVSASVLLAVEDLLSRPSLIAFIFQALSIPCLLRCVNPPIGSLFPA

SEQ ID NO: 146964 - protein, 57 aa, Glycine max
  Coding DNA Sequence Number=SeqID_30186
MASISGGGQQRWCDLVKKCVRYEDLKFREQGVPSHEKGRLCNRLQPCYSNVIDYREW

SEQ ID NO: 146965 - protein, 360 aa, Glycine max
  Coding DNA Sequence Number=SeqID_30187
MVREYDYGRGYFYVDRSKVKNLHGVKSTWHNSMCDDVKAFHKFEFDDKLCCDLVVMIVTVVHDSYVMDEQMLKCSGVDRNEVKAFAPWLRGCEPIWYGYVDTTRFSKGVACNTTYQYGRCILGGFKGEGYDDHSIVFERRGRVSLYGPNVSEGAMDKIGELIYIKGEGSVCEEESRPWEDTRKKGVLGGGIRESRSTNMANTDDSDYYNEEVDLSVSCSQLIEDMLIASNHLCDVNELKSMLGKEFDMKDFGPTKKILEMEIHRNEREVTLGNNEVDLKGDPLILEYVDSNYVGDLDDKRSTRYVFTLASGNACCMAHRLVKELGIEQEPSIFEKNKVHTLENETDMLTKVVKLTNSNTA

SEQ ID NO: 146966 - protein, 122 aa, Glycine max
  Coding DNA Sequence Number=SeqID_30188
  Gene Ontology: Mol. function=protein serine/threonine kinase activity; Biological process=protein amino acid phosphorylation
  Homolog annotation: Hit_ID=Q6RFY3; Match level="QueryCoverage=34%, HitCoverage=6%, E-value=2e-08, Identity=67%"; Hit description=MAP3Ka
MALEVSNLKNQGGYGLAVDIWSLGCTVLEMLTRQPPYSELEGVLPPIAQKHVIQLILSHERNFRADELMEFYKSYSQQAVSKGHKAVAILLCQLPMLTLKVEAKFQLEVINMRRKKSVKECK

SEQ ID NO: 146967 - protein, 179 aa, Glycine max
  Coding DNA Sequence Number=SeqID_30189
  Gene Ontology: Mol. function=oxidoreductase activity; Cellular component=integral to membrane; Biological process=electron transport
  Homolog annotation: Hit_ID=Q8UAG0; Match level="QueryCoverage=77%, HitCoverage=31%, E-value=1e-49, Identity=83%"; Hit description=AgaE protein
  Subcellular localization annotation: CTP_CleavageSite=84; ConfidenceScore=5.15e-01
MPTLARLICAQHMGRHAGSKGKVAPTRPSSELGLVVAQVKQPAAAKAGILAAFGRKSFPERKALRRNRQFSCVAVLLPAPTPVPAGLLRADKPFFDKGDFQGPLREVISSEYADDAAADDAASAVSGRSGDVVICCSRAGMVWLLIVVLIYLGRRANVARLGSLPEFPAVRRPLCNSFC

SEQ ID NO: 146968 - protein, 181 aa, Glycine max
  Coding DNA Sequence Number=SeqID_30190
  Gene Ontology: Mol. function=sequence-specific DNA binding; Cellular component=intracellular; Biological process=regulation of transcription, DNA-dependent
  Homolog annotation: Hit_ID=Q1M3K8; Match level="QueryCoverage=76%, HitCoverage=77%, E-value=4e-69, Identity=91%"; Hit description =Putative AsnC family transcriptional regulatory protein
  Pfam annotation: Domain name=AsnC_trans_reg; Domain location=67-143; Score=51.9; E_value=2.1e-12; Accession=PF01037.11; Description=AsnC family
MKLDRIDIKILYELQKNGRITNVELAELVNLSPSPCLMRVKKLQSEGYIEGYSAQININKLGQTLTVFTEITLKNHRQIDFARFLGVVEKIDQVVECHLVSGGYDYLLKFVTSGIVEYQSIMERLTDMDVGIDKYFSFVGVALTRRHPGLDPGSSAIKSLIAKESCHGVDAPWLYAGSSPA

SEQ ID NO: 146969 - protein, 126 aa, Glycine max
  Coding DNA Sequence Number=SeqID_30191
  Homolog annotation: Hit_ID=Q6CQF3; Match level="QueryCoverage=44%, HitCoverage=59%, E-value=2e-08, Identity=72%"; Hit description =Kluyveromyces lactis strain NRRL Y-1140 chromosome D of strain NRRL Y- 1140 of Kluyveromyces lactis
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPG

SEQ ID NO: 146970 - protein, 307 aa, Glycine max
  Coding DNA Sequence Number=SeqID_30192
MASRKRKSTASRPQAQNVQIYHTEFDEFKAELERQNLHKRLANLQDGSIDVAMVKDFYANLYTIEDQSPKQVKPWKLLRKDLMTLAQTSSVFSYSNLAPTSHTSNLNMDRARLVYDLVTNMDMDIGALISGVTSDSLTYESLSPAINLAYIKKNCWNMDDLTVNFRGARKARVRLVDVPSSSTLPAPCTSATPTPVVAPPGSILTVEQFLENDASFEATIPEPFIFEADPPSPMVDQSSLQQPVDPPTPVHEIPADPSTPLLDLPEDPSTPVLGLTTTPPATLVLHLTDEEGTQDEDTQSQDMSQEF

SEQ ID NO: 146971 - protein, 64 aa, Glycine max
  Coding DNA Sequence Number=SeqID_30193
MPLSRDVHNEDEHSTTWLNSLSACMLAKQVCLEICFVKIECTMQDELEDAMHEFKKTERLQESF

SEQ ID NO: 146972 - protein, 139 aa, Glycine max
  Coding DNA Sequence Number=SeqID_30194
MDEARAKAVDIGENDDEEDSDVDREEEGEEEKLSDYWSVLKSTPELHQSKDEVGYCGYFIWVDQLIEALGVDDSLGTFSMEQRRQFGRDEDKTMWKAQVNSKLDCMGIEMKMFRTIVYGMFLIQLLSMVVFVCNCHFSP

SEQ ID NO: 146973 - protein, 96 aa, Glycine max
  Coding DNA Sequence Number=SeqID_30195
MYKDNWTQPWPMGSEIYLEVHENPRAFFNSSSPILLEPLAHSSSDWSLPREDCIREPSRNEQLGECSPGVHAVDEMSHNGKLDTSTFSEMELPMTC

SEQ ID NO: 146974 - protein, 67 aa, Glycine max
  Coding DNA Sequence Number=SeqID_30196
MPLGFMLREVGQSIDIRVQSYELKCIQQLPEQALQNTFMVTELVLHDNEQSKNSYRQLMKFELSSCP

SEQ ID NO: 146975 - protein, 102 aa, Glycine max
  Coding DNA Sequence Number=SeqID_30197
MKTVQVEASIPAPSLLRLRTLSEQSEEKLEESQETARNAAVTVERHEGETLMDSSECRPWGSLGLSAPLSLCRPHMIGAFSQNIVTLTDLPMILPSESDLTC

SEQ ID NO: 146976 - protein, 262 aa, Glycine max
  Coding DNA Sequence Number=SeqID_30198
  Gene Ontology: Mol. function=RNA-directed DNA polymerase activity; Cellular component=intracellular; Biological process=RNA-dependent DNA replication
  Pfam annotation: Domain name=rve; Domain location=1-139; Score=50.3; E_value=6.3e-12; Accession=PF00665.16; Description=Integrase core domain
MPGTCGHHFILVAIDYFIKWVEVASYASVTRSIVVRFIKKEIICRYGFPRKIITDNATNLNNKMMKEMCEDFKIQHHNSSPYKPKMNEAVEAANKNIKKIVQKMTVSYKDWHKMLPFALHGYRTSVRTSTGATPFSLVYGIEVVLPFEVEVPSLRILAKSRLEELEWARTRFDQLNLIEGKRLAAISHEQLYQSRVKNAFDKKVRPHKFSEGDLNLKKVSQAQKDHRGKWAPNYEGPFIMKMEFSGGALLLARWTMKNCLHP

SEQ ID NO: 146977 - protein, 115 aa, Glycine max
  Coding DNA Sequence Number=SeqID_30199
  Subcellular localization annotation: CTP_CleavageSite=60; ConfidenceScore=5.27e-01
MNKTTYLSLKSDFVKRVWAGIQSFACCRNVPFCGRARARLTGALSKGGKMRGVATNEGISTSHVDKSGAFAPTYPPLERKSDLRSSFLCVNQVIPFTLKGDHFKALDLKNDPFYL

SEQ ID NO: 146978 - protein, 91 aa, Glycine max
  Coding DNA Sequence Number=SeqID_30200
QPVEWILPTPTPYRLVEPVQLIEVSSSEEDLEEDLEELPPEPAMDAPDLPEDGEDPLPDVDSPEDIMSASEADSTEESGPGGTANSDDSPS

SEQ ID NO: 146979 - protein, 67 aa, Glycine max
  Coding DNA Sequence Number=SeqID_30201
MALVRANIEEDTKVVHDGFTNKISFQHHDRKIILKPLSLREEFEDVFPKEIPHGLLNEQKLFKVLDH

SEQ ID NO: 146980 - protein, 158 aa, Glycine max
  Coding DNA Sequence Number=SeqID_30202
YIFCGTSKAYIYLGCNTENKRGYISCGSVQVEGTSTWLFKENKGGYIPCGSLLDAFAAIVDKLKRLLNRRILTNGTKAYIVAEEGSKIEEKTNFAFCIFLENAMNSLSVHVALSEFVNIAGIYAFSDELAKHTYCAKRVHLLGMNIHLPDEIPVAKRG

SEQ ID NO: 146981 - protein, 228 aa, Glycine max
  Coding DNA Sequence Number=SeqID_30203
MATIQVMPVTHHDVERSCGYCSHQPRSLLGDLQYNPKYVMFSGLSDPKGSISLSGLGSGCYHKAVGQWVYNRVRAKATFATQGISSEDNLLTGTGVDGFKGLSSEDEGKERVDEEGAEACGKKLGAGMALGRPRKGRRPENEAAQKKWWRQPNDTIREIFKLRKEEAGEWLCVWFMEMMDKLIELMELILDLEDSAMKQDNESTNLLRPRDEKLALRARDLLRKRKET

SEQ ID NO: 146982 - protein, 109 aa, Glycine max
  Coding DNA Sequence Number=SeqID_30204
MPSKVILMMPKNSRIKRKIQEKFQVSSLGIINSTSLLNYSEATRSNKWKGLSPDDTTWEDWDQLKSAYNLEDKVLFDAGGNDRKIAEQPALREKSTRKMTTPRYLMDYI

SEQ ID NO: 146983 - protein, 326 aa, Glycine max
  Coding DNA Sequence Number=SeqID_30205
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=23%, E-value=6e-77, Identity=41%"; Hit description=Chromo
MNCPYRYPYFQKQEIGAHVDSMLQRGVIRPSTNPFSSPVLPVKKHDGTWRFCVDYRALNQGYHQILMHEDDIYKTAFRTHDGHYEFTVMPFGLCNAPSSFQNEPEKNQVEGTILETAEMHIGTETWKIENQEAPQTTRFDKPRGLPQELSEFLIRSGQFFIKLSKCSFAQTQVEYLGHMVSSKGADFYRQFIRGYATIAAPLKKLTTQDPFEWSATAQTAFDTLKSVLTSAPVLLLPDFTIPYTVETDASGTSIGAVLSQNGHPIAFFNKQFSPKLLRASTYVMELITITATVKKWRHYPLGHQFTIITDYRSLKELLTQVVQTPE

SEQ ID NO: 146984 - protein, 134 aa, Glycine max
  Coding DNA Sequence Number=SeqID_30206
  Gene Ontology: Mol. function=ribonuclease H activity; Biological process=RNA-dependent DNA replication
  Homolog annotation: Hit_ID=Q1T293; Match level="QueryCoverage=80%, HitCoverage=18%, E-value=5e-20, Identity=41%"; Hit description =Ribonuclease H
  Pfam annotation: Domain name=RnaseH; Domain location=3-104; Score= -26.9; E_value=0.018; Accession=PF00075.14; Description=RNase H
MNTDAMHLYNAAAFMTHQEEYNKSDISELSAIEIAFDRGWRKLWIESDSKLAVEAVNNTSLVPWEIRNHWKNSLYLARSMSFLIGHIYREGNSSADLLASQTTILDGFFWRDSCPSFIQRVFVNDRNARPNFRI

SEQ ID NO: 146985 - protein, 157 aa, Glycine max
  Coding DNA Sequence Number=SeqID_30207
  Gene Ontology: Mol. function=DNA binding; Cellular component =mitochondrion; Biological process=DNA integration
  Homolog annotation: Hit_ID=Q0KIN0; Match level="QueryCoverage=73%, HitCoverage=7%, E-value=2e-31, Identity=66%"; Hit description =Integrase core domain containing protein
MEQSPGFVAQGPHHRGSPLLWSVGFAGPYMDLNSPLEPSLATSKLETVPLTPISNQGGKLRYFLGIEVARSKDGLVISQRKYALDILEEAGLLNAKPVNTPMDPSVKFLLDQGEPLSDLGRYRRLVGRLNYLTIIRPNIAFAISVVSQSIGMQLCGS

SEQ ID NO: 146986 - protein, 565 aa, Glycine max
  Coding DNA Sequence Number=SeqID_30208
VMDERRLERDLDNNIIIDGLKLFVNRPKFDRGRVFRAKPFEEPLQKMVNCQEKHNGKQLGDKVPCYDGQPRSYLDMVKEATRAKGSSYLMKEDPQGDTIKIQRSVVLNSTKEDREWLEKAWVGRLKNRGMFEKLEEELRLINAELKNGSTPIMELQKWSPDIRPEYRLTWVLLRGLPLSVWKPEYMKKVMEDIGEMVEVDDYVEERKRMDVARTLIRKNRRLGFHETVWVTIDGEEHQLTVVEDMSSMGAKMKSYQTHSWFPPSPMSTPPNTPLPLTDGTPGRDSGNDVSSDSDAELDGVDTGDPNHWQNLRLSKRRPSKLHRDHWVKSHGRSPLVRSVSDAADVDHSKADNDGGNSAFLRGLDSELHNGHITQSGNAFINEGERQKWNNINIVSSSQKNEVTQEGRAGQTYEEKKESSVIDAEGDREEVRPTEGVFPHRVHALNKKDNFPSGQHALNEVIGEVGQKLKGPIKSATKVYVRRKEVQLSHGKAQYSQGPDVESVLVPEADYTPAVQGDKIEQELSLIRDLGLTYGGDDKGIKEILLDMDNRDTMKAAEMGIKKQIL

SEQ ID NO: 146987 - protein, 144 aa, Glycine max
  Coding DNA Sequence Number=SeqID_30209
  Homolog annotation: Hit_ID=Q1SUI8; Match level="QueryCoverage=57%, HitCoverage=30%, E-value=7e-07, Identity=35%"; Hit description=Beta tubulin
MENWVQIKGVVLGRHEWKDDGISLMEKYPRLYNISQQQNQYIQMGSTSDTGWECQFQWRRFFLEGKIDMVANFMEDIEGLIVQMQRQDVWSWEGDSSGGYTVGSAYWLLDRDSADENQDAVFTTLWKLKVPNLVDLPDMVYLAP

SEQ ID NO: 146988 - protein, 1537 aa, Glycine max
  Coding DNA Sequence Number=SeqID_30210
  Gene Ontology: Mol. function=RNA-directed DNA polymerase activity; Cellular component=chromatin; Biological process=chromatin assembly or disassembly
  Pfam annotation: Domain name=Chromo; Domain location=1444-1498; Score= 38.1; E_value=3e-08; Accession=PF00385.14; Description='chromo' (CHRromatin Organisation MOdifier
  Pfam annotation: Domain name=RVP_2; Domain location=398-521; Score= -30.7; E_value=0.00025; Accession=PF08284.2; Description=Retroviral aspartyl protease
  Pfam annotation: Domain name=RnaseH; Domain location=888-1005; Score=- 14.2; E_value=0.0012; Accession=PF00075.14; Description=RNase H
  Pfam annotation: Domain name=rve; Domain location=1141-1297; Score =116.5; E_value=7.5e-32; Accession=PF00665.16; Description=Integrase core domain
  Pfam annotation: Domain name=zf-H2C2; Domain location=1082-1123; Score=6.0; E_value=0.058; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1444 -1498::398-521::628-797::101-191::888-1005::1141-1297::1082-1123
MGERIDALEDTVNEMQTTLQALVQQMQQQSLIIGEMSKQLGKKKTPPVSESSAEESSHSESRLAGKKVKLPVFEGDDPVAWITRAEIYFDVQNTPGDMRVKLSRLSMEGSTIHWFNLLLETEDDLSWEKLKKALIARYGGRRLENPFEELSTLRQTRSVEEFVEAFELLSSQVGRLPEEQYLGYFMSGLKPQIRRRVRTLNPTTRMQMMRMAKDVEDELKEEDDDGERYYGKKHTGERLGQKDWAGLSQKNRSGSSINPKEMNRTTNSGWTNPTQKTGSVGSNHNSTSSLLSTGKKTENDRRMGSSERWKGVRSLHNDEMEERRAKGLCFKCGGKYHPTLHKCPERSIRVLILGEGESLNEEGEIVTMEVQKEDSEDEVEAECTLIGVLGSMGEYHTMKIEGKLENVDVVVLVDSGASHNFISPKITAALGLPITPMAAKNIKLGDGHKVVSQGVCKGVRINLGAMVVVVDALVLELGGLDVVLGMSWLCTLGKVIMDWKALSMQFWHNDELVVLQGQGGKQEQQCVLNNFLEDRRGEAWWWSLHEQNLEAVEGSQKQLKAVLSQFHTVFQDHIILPPQRSQVHQIKLFSDQNPVNVRPYRYPHHQKEEIERQVQELLEAGVIRPSMSAFSSPVILVKKKDGSWRMCVDYRALNKATIPDKYPIPIVEELLDELFGATIFSKIDLKSGYHQIRVADEDVHKTAFRTHNGHYEYLVMPFGLMNAPATFQATMNDIFRPFLRKFVLVFFDDILIYSKTMADHEKHLHQVLTVLMSNCFIANQSKCKFGCLQVDYLGHIISGAGVEVDPQKIRCIVDWPEPKNVKGVRGFLGLTGYYRKFIKDYGKLAKPLTEMTKKDNFKWGKETSTAFTQLKTVMTTPPVLALPNFSIPFEVECDAAGRGIGAVLMQNRQPVAFFSKALSDGNLSKSVYEKELMALVLAIQHWRHYLLGKQFTVYTDHKSLKHFLQQRISSPDQQCWLAKLLGYQFEVKYKPGWENKAADALSRCYGDVEMNSITSYPKWLEGPKLLQEVQQDPDIQKLVAELTDTPDARPGFTVKQGVLFYHGRLVISPNSPSIPMLLEEFHSTPTGGHSGYLRTYRRLAENLYWVGMQKKIRDFVRACDTCQRQKYAATTPGGLLQPLPIPNAIWEDLSLDFITGLPKSKGYEAVLVVVDRLSKYSHFILLKHPYTAKSIAELFVKEIVRLHGIPTSIISDRDPLFVSHFWMELFKLQGTKLKMSSAYHPETDGQTEVLNRCLEGYLRCFASEQPKTWSYWIPWAEYWYNTTFHVSIGKTPFEVVYGRQPPSLLRFLSNETKVAAVALELTERDEALNQLKSHLLRAQQQMKKYADKKRRDLQFEIGEWVFLKLRPHRQQSVVKRINQKLAARFYGPFKILAKVGAVAYRLQLPAQSRIHPVFHVSLLKKAIGDYHVQGDLPQELEVTNDDSFYPEMVIGSRVNMQGGVSVPQSLIKWKNKTLDDVTWEDNAYLQGQFPDFCLEDKAVVMDGGVDRDLSEEVGLDFGPKPKVWRVYTRRGGKGIKA

SEQ ID NO: 146989 - protein, 381 aa, Glycine max
  Coding DNA Sequence Number=SeqID_30211
MSFTVALFNMRHFVNTPNLKYNGHGKDVYKNVDAGKWSFLEALGIARGIVLEDGLFDFVGDKDALLLSDYAVKNNCQVEIYVEQKMIDQVEYVDDALIGHKEAEETPETNKDHQTLRSADEGKHVRVNCEGLDVDSEDDDSEFEVDGNDLEVTDNDVELEDNELSEVEVDDKEVQFDDRFMPTNMDQMHHLEETYTSEELDPDFDSEEWNSPLKQFKDVVLEHSQVSHKLPYAIKTLYPKHKCGRAFNNKNAKAKWVANAIVDLLKANHKLSVVEIVDHIRINYSIGIKACTAERARAIARYLLAAIATDPNDQYLPLAFAVVESENKECWTWFMTLFLNDVDHDRSQKWDFISDQQKGFVPNFEEMLRDSEHRFCLRFIQ

SEQ ID NO: 146990 - protein, 93 aa, Glycine max
  Coding DNA Sequence Number=SeqID_30212
  Gene Ontology: Mol. function=hydrolase activity
  Homolog annotation: Hit_ID=Q6Z543; Match level="QueryCoverage=82%, HitCoverage=14%, E-value=2e-14, Identity=48%"; Hit description =Putative ectonucleoside triphosphate diphosphohydrolase
MSKTLLLGEEQGISSWVAVNYALGNLGREPQETTGIVELGGASLQVTSAKLNADIAQSLHTIRLSGVMYNLYTRSLPQLGQVLFSFILMSETI

SEQ ID NO: 146991 - protein, 92 aa, Glycine max
  Coding DNA Sequence Number=SeqID_30213
  Subcellular localization annotation: CTP_CleavageSite=47; ConfidenceScore=5.46e-01
MEIDAVINLLTQASQTNPNKKKSNLVSKKTGPASASTNNSGIAKKVSCAATKKKKETLKKPHLSEQSAQCGNIVSAAGEDMDTDIVHSLLNS

SEQ ID NO: 146992 - protein, 176 aa, Glycine max
  Coding DNA Sequence Number=SeqID_30214
MRIGNKSLLPQKDLIWKDIQVEFDIAEACDLRTKKKILQTVGERWRQFKFDLTLRWTLASDKDSVDCLQKDVRMKAQAIQKQNTTPHVLSREGYELLEKKLIYEKKKKQLEEVAKFGSTNTLIDPPSSIRRHVKWKMARTKKTYQMTCEATKEIGDKIVNHFQSLIAIIYIYCVIE

SEQ ID NO: 146993 - protein, 100 aa, Glycine max
  Coding DNA Sequence Number=SeqID_30215
  Homolog annotation: Hit_ID=Q9RK22; Match level="QueryCoverage=46%, HitCoverage=12%, E-value=2e-10, Identity=57%"; Hit description =Putative monooxygenase
LVVNATGDYVRRPIYSLPADFGWAPRPGITLIGDAAHLMPPVGVGVNLAMLDASDLALALCEASHPQNGLRSAEILIMERARDMMPDAIAGFQNWFDEKA

SEQ ID NO: 146994 - protein, 71 aa, Glycine max
  Coding DNA Sequence Number=SeqID_30216
  Pfam annotation: Domain name=Rick_17kDa_Anti; Domain location=23-59; Score=11.2; E_value=0.013; Accession=PF05433.5; Description =Rickettsia 17 kDa surface antigen
MKKQWIAALAAAGLLLVVSAQAEAKGCLKGAVAGGVAGHLVHHGVAGAAAGCAVGHHMAAKKQKEAEQKQQ

SEQ ID NO: 146995 - protein, 203 aa, Glycine max
  Coding DNA Sequence Number=SeqID_30217
  Gene Ontology: Mol. function=signal transducer activity; Cellular component=membrane; Biological process=signal transduction
  Homolog annotation: Hit_ID=Q4BAZ2; Match level="QueryCoverage=80%, HitCoverage=29%, E-value=3e-17, Identity=33%"; Hit description =Chemotaxis sensory transducer precursor
MKISTRLATGFGLLIVLFIICTGIALNALSSATKGMDDAVNVKMKKYQLVLDMRGSIRDMGIAVRNLALLTDVQAMKPEWERVQKQEAQYIASRNALAEVMQEDSTPQGREVMSRITEAEEPALSSLKQAGRLGLENRAEEATAYLLNVTRPVQSTLLKALNDMTLVQMKNTQSAVETNSQATRRASLILMLLAAASALLAVG

SEQ ID NO: 146996 - protein, 93 aa, Glycine max
  Coding DNA Sequence Number=SeqID_30218
MKSIPQQSKTSTSIMFCRGISFLREIPPFSDIGHTLRHEKKESHEDSPNRGFNPFYVSLTFGNSIGAVGGETGGILGNRSRCCYRCRKTRESA

SEQ ID NO: 146997 - protein, 132 aa, Glycine max
  Coding DNA Sequence Number=SeqID_30219
  Gene Ontology: Mol. function=oxidoreductase activity, acting on single donors with incorporation of molecular oxygen, incorporation of two atoms of oxygen; Biological process=flavonoid biosynthetic process
  Homolog annotation: Hit_ID=Q9XIA5; Match level="QueryCoverage=92%, HitCoverage=45%, E-value=1e-30, Identity=45%"; Hit description =Similar to ethylene-forming-enzyme-like dioxygenase
MNHGMKSSFQDKVRQVSKQFFQLLKEEKQKCAREREPNNIEGYGNDIIYSKNQRLDWTDRVYLKVLPEDQRKFKFWPQNPNDFRERAVMFLRFNYYPPCPMPNGLSLKPHADGSTITFLLQDKLLNKWPQIS

SEQ ID NO: 146998 - protein, 57 aa, Glycine max
  Coding DNA Sequence Number=SeqID_30220
MADKTKKKLQKAAQSGSTEGVINLLSPIIRRVKWKIARTKETGQMTSEAAKEIIEEI

SEQ ID NO: 146999 - protein, 32 aa, Glycine max
  Coding DNA Sequence Number=SeqID_30221
MDDGQRNEGLTLTTTISRGGHGASKEDVHLDQ

SEQ ID NO: 147000 - protein, 109 aa, Glycine max
  Coding DNA Sequence Number=SeqID_30222
  Pfam annotation: Domain name=B3; Domain location=28-107; Score=18.2; E_value=0.00063; Accession=PF02362.12; Description=B3 DNA binding domain
MTDDNDVFPLRTLFRPFLVFFDPFSVRFPFKIGWRLLIPAEIVKDFLSRKQKSMLLKLENGDVYECCLKKTNRRRNECFLTDGWYNFVRDHNLKPNDVLRFWMIQKYSM

SEQ ID NO: 147001 - protein, 44 aa, Glycine max
  Coding DNA Sequence Number=SeqID_30223
MAVLITIMLWQARPLLAPETSIHELLGYLFAPIHQGCGGAEGFV

SEQ ID NO: 147002 - protein, 261 aa, Glycine max
  Coding DNA Sequence Number=SeqID_30224
GCISYNPILAIRQLGYPMRGAPLEDGLAPVRKAWGVVQKKDKELRGSGPIGGYREWLKAHVQGLDWLPSLRTAKREEVEAPEEDEEENAELRDVNVATTKALEQKTKRARREEHGRNKFRGALWGSNNELKLWREERDQSRVDSLILKDELKACSRSKRSLSQRLCETETNMLAIITKYQEELSLATAHEHRVADEYAQVYAEKEARGWVIDSLHQEATMWMDRFSLTLNGSQELSRLLANAKAVANTYSVPEEIHELLSY

SEQ ID NO: 147003 - protein, 92 aa, Glycine max
  Coding DNA Sequence Number=SeqID_30225
MTQELVARGDTLRLSAPRHSVTPSVIDEQRPSLVILHPRYAEIPYDTRRYLTVICTPLLGRHSSVRWQAETKFGYSAPKIRGDTLRLSAPLC

SEQ ID NO: 147004 - protein, 409 aa, Glycine max
  Coding DNA Sequence Number=SeqID_30226
  Gene Ontology: Mol. function=helicase activity; Biological process =viral genome replication
  Homolog annotation: Hit_ID=Q9LTU4; Match level="QueryCoverage=94%, HitCoverage=27%, E-value=1e-106, Identity=52%"; Hit description =Helicase-like protein
  Pfam annotation: Domain name=DUF889; Domain location=102-353; Score =386.7; E_value=3.5e-113; Accession=PF05970.5; Description=Eukaryotic protein of unknown function (DUF889)
MQVVIEKKGGIFFLYRYTSLLLPSGRTTHSKFRIPMPTLDDSVCNITQGSDLAEFLKVTSLIIWNEAPMAHKFCFEALDKTLNDIMKISDNNDTVFRGKIVVFCGDFRTILPMIPRGTHSDIVHTTINASYLWSHCHVLKLTKNLRLQSNSDTTHATEVTNFAKWILQIGDGTLGQANDGYGTIEIPKELFILNYTDPIDAIVQSTYPNIRQHYKDSKFLQPRAILASTKEIVDHINDYVLSLIPSEEREYLSSDSIEKSDTIESEGFSTITTEFINSLSTSRLPNHKIKLKVDSRIMLLRNLDQNEGLCNSTRLIITRFADHIIEAKIMSGKGQGNTVYIPRLATSPSQSPWPFKLIRRKFPIIVSYAMTINKSQGQLLASVGLYLPTPVFSHGQLYVALFRCKTKMD

SEQ ID NO: 147005 - protein, 82 aa, Glycine max
  Coding DNA Sequence Number=SeqID_30227
MVVNECVIDICSDITCHGLDLNQEGEPQTDSSESRPWSESDRVYPLCGVLCHVLLSAPVLFFTDMVSLHMMSHMLEMERLSL

SEQ ID NO: 147006 - protein, 146 aa, Glycine max
  Coding DNA Sequence Number=SeqID_30228
  Gene Ontology: Mol. function=helicase activity
  Homolog annotation: Hit_ID=Q9LTU4; Match level="QueryCoverage=98%, HitCoverage=10%, E-value=4e-38, Identity=55%"; Hit description =Helicase-like protein
MLADLTKHHLLGKVLAYMYTIEFQKRGLPHAHLLLFLHPSSKYPTPEDIDNIICAEIPPKNEQNELYQQVQAHMIHGPRGIANRSSLCMKDGKCSRFYPKKFQTCTVVDSDGYPIYRHRDTGNTILKGGVILDNRSVVPYNPNTST

SEQ ID NO: 147007 - protein, 405 aa, Glycine max
  Coding DNA Sequence Number=SeqID_30229
  Gene Ontology: Mol. function=protoporphyrinogen oxidase activity; Cellular component=chloroplast; Biological process=chlorophyll biosynthetic process
  Homolog annotation: Hit_ID=P55826; Match level="QueryCoverage=99%, HitCoverage=77%, E-value=1e-133, Identity=57%"; Hit description =Protoporphyrinogen oxidase, chloroplast precursor
  Pfam annotation: Domain name=Amino_oxidase; Domain location=1-405; Score=3.3; E_value=2.7e-06; Accession=PF01593.14; Description=Flavin containing amine oxidoreductase
MESGGYLWEEGPNSFQPSDPMLTMVVDSGLKDQLVLGDPDAPRFVLWNGKLRPVPGKPTDLPFFDLMSIGGKIRAGFGVLGIRPPPPGLCRRSFKIKYESSIWESLEAGKNGGSIIGGTFKAIQERNGASKPPRDPRLPKPKGQTVGSFRKGLIMLPDAISARLGNKVKLSWKLSSISKLDSGEYSLTYETPEGVVSLQCKTVVLTIPSYVASTLLRPLSAAAADTLSKFYYPPVVAVSISYPKEAIRSECLIDGAIYSSSLFSNRAPPGRVLLLNYIGGATNTGIYQSFSGKLQGWFKELIIFTSGLFGCFKQLRPNGLVSNTDSELVATVDRDLRKILINPNAQDPFVVGVRLWPQAIPQFLIGHLDLLDVAKASLRNTGFEGLFLGGNYVSGVALGRWVEGA

SEQ ID NO: 147008 - protein, 754 aa, Glycine max
  Coding DNA Sequence Number=SeqID_30230
  Gene Ontology: Mol. function=binding; Cellular component =intracellular; Biological process=metabolic process
  Homolog annotation: Hit_ID=Q8LIR0; Match level="QueryCoverage=84%, HitCoverage=91%, E-value=1e-162, Identity=44%"; Hit description =Selenium-binding protein-like
  Pfam annotation: Domain name=PPR; Domain location=126-160; Score =31.9; E_value=2.2e-06; Accession=PF01535.11; Description=PPR repeat
  Pfam annotation: Domain name=PPR; Domain location=226-260; Score =35.1; E_value=2.4e-07; Accession=PF01535.11; Description=PPR repeat
  Pfam annotation: Domain name=PPR; Domain location=327-361; Score =24.2; E_value=0.00046; Accession=PF01535.11; Description=PPR repeat
  Pfam annotation: Domain name=PPR; Domain location=362-396; Score=0.6; E_value=6.3; Accession=PF01535.11; Description=PPR repeat
  Pfam annotation: Domain name=PPR; Domain location=428-462; Score =19.4; E_value=0.013; Accession=PF01535.11; Description=PPR repeat
  Pfam annotation: Domain name=PPR; Domain location=529-563; Score =46.4; E_value=9.4e-11; Accession=PF01535.11; Description=PPR repeat
  Pfam annotation: Domain name=PPR; Domain location=564-598; Score =12.9; E_value=0.22; Accession=PF01535.11; Description=PPR repeat
  Pfam annotation: Domain name=PPR; Domain location=600-633; Score=4.2; E_value=2.4; Accession=PF01535.11; Description=PPR repeat
  Pfam annotation: Domain name=PPR; Domain location=666-700; Score=0.2; E_value=7.1; Accession=PF01535.11; Description=PPR repeat
  Pfam module annotation: Pfam domain module=PPR::PPR::PPR::PPR::PPR::PP R::PPR::PPR::PPR; Domain location=126-160::226-260::327-361::362 -396::428-462::529-563::564-598::600-633::666-700
MLKASLSGRVLLRRLTTLTWSCPCRASMLFGTKVNAHAIAMLITFTRQQHSLPIHFTVTSFHRLKSPPNLHEARTLHALLLVLGFFQPTCPHSSSFASQLVNVYVNFGSLQHAFLTFRALPHKPIIAWNAILRGLVAVGHFTKAIHFYHSMLQHGVTPDNYTYPLVLKACSSLHALQLGRWVHETMHGKTKANVYVQCAVIDMFAKCGSVEDARRMFEEMPDRDLASWTALICGTMWNGECLEALLLFRKMRSEGLMPDSVIVASILPACGRLEAVKLGMALQVCAVRSGFESDLYVSNAVIDMYCKCGDPLEAHRVFSHMVYSDVVSWSTLIAGYSQNCLYQESYKLYIGMINVGLATNAIVATSVLPALGKLELLKQGKEMHNFVLKEGLMSDVVVGSALIVMYANCGSIKEAESIFECTSDKDIMVWNSMIVGYNLVGDFESAFFTFRRIWGAEHRPNFITVVSILPICTQMGALRQGKEIHGYVTKSGLGLNVSVGNSLIDMYSKCGFLELGEKVFKQMMVRNVTTYNTMISACGSHGQGEKGLAFYEQMKEEGNRPNKVTFISLLSACSHAGLLDRGWLLYNSMINDYGIEPNMEHYSCMVDLIGRAGDLDGAYKFITRMPMTPDANVFGSLLGACRLHNKVELTELLAERILQLKADDSGHYVLLSNLYASGKRWEDMSKVRSMIKDKGLEKKPGSSWIQVGHCIYVFHATSAFHPAFAKIEETLNSLLLVMKSEDYMLTNVNDKLLT

SEQ ID NO: 147009 - protein, 123 aa, Glycine max
  Coding DNA Sequence Number=SeqID_30231
MCPVVNFGVQSLIATEYLWSLISIAKLHFSSSVYGFMILVLFLFHFHSSKFMNILECVHCLFLFHTVMVMASSSKVWEGIMQAETTRTFKGLAWNAYREALPVKSLLSEKGVIGDAICLCWGH

SEQ ID NO: 147010 - protein, 483 aa, Glycine max
  Coding DNA Sequence Number=SeqID_30232
  Gene Ontology: Mol. function=sequence-specific DNA binding; Cellular component=nucleus; Biological process=regulation of transcription, DNA-dependent
  Homolog annotation: Hit_ID=Q9ZSI7; Match level="QueryCoverage=88%, HitCoverage=87%, E-value=6e-56, Identity=34%"; Hit description =Probable WRKY transcription factor 47
  Pfam annotation: Domain name=WRKY; Domain location=249-309; Score =137.9; E_value=2.8e-38; Accession=PF03106.6; Description=WRKY DNA -binding domain
MENHHQILQQPNREFTLLRSTDFLRQNLNLDPPTVNTGKHVDPSIKEVDFFSSSSSPPKNSGTYNSSQEESRDRRTNMAKDDRSPTLFNDQLVNTALNLSPGAGVSRSAANDENLKTLLNTLQRESLRLQEENCKLRTMLDQITKNNYQLQLFIALQKQKQCQVETNSMICGQHLLDPRPCTKLDAQVASFPDDKSGQQGDPVEDVLEQTSSHSWGSSKSPTFEKSKPSELPFKKTRVSVRAKSEAPLISDGCQWRKYGQKIAKGNPCPRAYYRCTMAVGCPVRKQVQRCMEDKTVLITTYEGNHNHPLPPSATVMANSTSAAAAMLLSSSCSISNTEALSNTVGVFSSMPYIPMATLSTSAPFPTITLDMTTNPMQLHRETSSALTSLLPLHATSIPQLLGHPVIFPHKMPHPLGQQQQPLFLNETMSAAIASNPNFTIALAAAISSIIGAPRGTDGNNNNSSNGGSHVLPLNGASMLPGST

SEQ ID NO: 147011 - protein, 472 aa, Glycine max
  Coding DNA Sequence Number=SeqID_30233
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=Q75LI0; Match level="QueryCoverage=83%, HitCoverage=82%, E-value=1e-168, Identity=71%"; Hit description =Putative polygalacturonase
  Pfam annotation: Domain name=Glyco_hydro_28; Domain location=83-436; Score=22.0; E_value=2.9e-10; Accession=PF00295.8; Description =Glycosyl hydrolases family 28
MRTLLTDGGTFLLQLVDVFLVLALFSCSTWTVWSSSCCNQINLNEVRPHSVSITEFGAVGDGITLNTKAFQNAIFYLNSFADKGGAKLFVPAGRWLTGSFDLISHLTLWLDNDAVILGSTNSDDWPVVDPLPSYGRGRELPGGRHRSLIYGCNLTDVVITGNNGTIDGQGSIWWNNFWNKTLNYTRPHLVELMNSTGVLISNVTFLNSPFWTIHPVYCSHVTIQNVTIIAPLSSPNTDGINPDSSDNVCIEDCYISTGDDLISIKSGWDGYGISFGRPSTNINIRRLIGKTTSAGIAIGSEMSGGVSEVHAEDIYIFDSHSAIRIKTSPGRGGYVRNVYISNMILANVDIAIRFTGLYGEHPDDTYDPDALPVIERITIKDVIGVKVKHAGLIQGIKGDNFVNICLSNITLNVSSKLPWNCSYIKGFSDLVSPEACEPLKERIFPEHCSDCYYLPNHLKSLSNQNWGAWLLS

SEQ ID NO: 147012 - protein, 62 aa, Glycine max
  Coding DNA Sequence Number=SeqID_30234
MEPVDVVGGAEEVDWFRFGLDAVVVDVKQLGVLVEKGLGFDLEARVFAFLFEVVKRDDLTLF

SEQ ID NO: 147013 - protein, 43 aa, Glycine max
  Coding DNA Sequence Number=SeqID_30235
GRILLGHGQKSRRVYGRSQPRYLGMEANGGQGHGRPLSLPGAR

SEQ ID NO: 147014 - protein, 147 aa, Glycine max
  Coding DNA Sequence Number=SeqID_30236
  Gene Ontology: Mol. function=unspecific monooxygenase activity
  Homolog annotation: Hit_ID=O04892; Match level="QueryCoverage=84%, HitCoverage=33%, E-value=7e-35, Identity=52%"; Hit description =Cytochrome P450 like_TBP
PAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 147015 - protein, 234 aa, Glycine max
  Coding DNA Sequence Number=SeqID_30237
  Gene Ontology: Mol. function=oxidoreductase activity; Cellular component=cytoplasm; Biological process=metabolic process
  Homolog annotation: Hit_ID=Q0XAR8; Match level="QueryCoverage=49%, HitCoverage=45%, E-value=3e-40, Identity=68%"; Hit description=Short- chain dehydrogenase/reductase SDR precursor
MQFDGAVNACYNVCQAALPLMRRRARGSIINLVSDLIARPAVAYHDYITAKAALTGFSRTLAAELGALGIRVNCVAPGLVYPTDASQHTPEAVRHALTAQTPLGRLARAADVAGPVLTIKPGRQSPHWRPATALQANFSTGLTVWMLVLLALPAGQLTGHRRDGTELLAQFTLGSQQLGGYATQRRALLIQANADAHLTGVSVQQTSRCTVVAGGRAAIAQRDTVIEFSVHGFP

SEQ ID NO: 147016 - protein, 67 aa, Glycine max
  Coding DNA Sequence Number=SeqID_30238
  Homolog annotation: Hit_ID=Q7CQJ4; Match level="QueryCoverage=63%, HitCoverage=71%, E-value=2e-11, Identity=74%"; Hit description =Putative cytoplasmic protein
MKDPKKKPEEEEKVTQRRGGSGNFAADNERAAEAGRKGGQVSGGNFNNDPQRAIEAGRKGGKISRRK

SEQ ID NO: 147017 - protein, 68 aa, Glycine max
  Coding DNA Sequence Number=SeqID_30239
MEDDPNTSPENHILLYGHHDDLLSFNHRCAHTYHKPGLIFPRGKSLEPTPWFQIRWLSTTLWVSSSPP

SEQ ID NO: 147018 - protein, 358 aa, Glycine max
  Coding DNA Sequence Number=SeqID_30240
  Gene Ontology: Mol. function=protein binding; Cellular component =membrane; Biological process=intracellular protein transport
  Homolog annotation: Hit_ID=Q1SEN5; Match level="QueryCoverage=99%, HitCoverage=36%, E-value=0.0, Identity=96%"; Hit description=SecA protein
  Pfam annotation: Domain name=SecA_DEAD; Domain location=1-242; Score =155.8; E_value=1.1e-43; Accession=PF07517.4; Description=SecA DEAD -like domain
  Pfam annotation: Domain name=SecA_PP_bind; Domain location=87-198; Score=231.3; E_value=2.1e-66; Accession=PF01043.10; Description=SecA preprotein cross-linking domain
  Pfam module annotation: Pfam domain module=SecA_DEAD::SecA_PP_bind; Domain location=1-242::87-198
MRTGEGKTLVAVLPAYLNALSGKGVHVVTVNDYLARRDCEWVGQVPRFLGLKSVEDLVIRGFNYCIIDEVDSILIDEARTPLIISGPAEKPSDQYYKAAKIAEAFEQDIHYTVDEKQKTVLLSEQGYEDAEEILAVKDLYDPREQWASYILNAIKAKELFLRDVNYIIRGKEVLIVDEFTGRVMQGRRWSDGLHQAVEAKEGLPIQNETVTLASISYQNFFLQFPKLCGMTGTAATESTEFESIYKLKVTIVPTNKPMIRKDESDVVFRATSGKWRAVVVEISRMHKTGRPVLVGTTSVEQSDSLSEQLKEAGIPHEVLNAKPENVEREAEIVAQSGRLGAVTIATNMAGRGTDIILG

SEQ ID NO: 147019 - protein, 50 aa, Glycine max
  Coding DNA Sequence Number=SeqID_30241
GQNRLRPWSEVETKLRAETNQEARVMTDRSSSLPYSGQAENAAARQPSIL

SEQ ID NO: 147020 - protein, 38 aa, Glycine max
  Coding DNA Sequence Number=SeqID_30242
MDEAYKMMQIRLVMENVKLLEPSCKNNLYEVNFVCWDL

SEQ ID NO: 147021 - protein, 146 aa, Glycine max
  Coding DNA Sequence Number=SeqID_30243
  Gene Ontology: Mol. function=nutrient reservoir activity; Cellular component=apoplast; Biological process=auxin mediated signaling pathway
  Homolog annotation: Hit_ID=Q0MYQ7; Match level="QueryCoverage=81%, HitCoverage=55%, E-value=4e-46, Identity=73%"; Hit description =Germin-like protein 2
  Pfam annotation: Domain name=Cupin_1; Domain location=2-135; Score =104.2; E_value=3.8e-28; Accession=PF00190.13; Description=Cupin
  Pfam annotation: Domain name=Cupin_2; Domain location=22-97; Score =49.2; E_value=1.4e-11; Accession=PF07883.2; Description=Cupin domain
  Pfam module annotation: Pfam domain module=Cupin_1::Cupin_2; Domain location=2-135::22-97
MATLDLPISLHLSTLTKPLFIGYSYYKAGGLNPPHTHPRATEIVFVLDGELDVGFISTSNKLISKSIKNGEIFVFPKGLVHYQKNNGDKPASVLSAFDSQLPGTVSIAAALITSTPTVPDNVLAQAFQIDTTKVDDIKAKLAPKKT

SEQ ID NO: 147022 - protein, 54 aa, Glycine max
  Coding DNA Sequence Number=SeqID_30244
VKAADLGGTIILILDLTKIPLQKRKKRSYLQLTSFMGQGRQPWQSSSVEEPTTL

SEQ ID NO: 147023 - protein, 94 aa, Glycine max
  Coding DNA Sequence Number=SeqID_30245
  Subcellular localization annotation: CTP_CleavageSite=40; ConfidenceScore=5.06e-01
MSQIGFYESGAPLKAPKHPTIRSPKNVCHVFGFLARPQVRERRDVQERGVTHRKGRRVQAVEEEVTFLCSVWSGVKRLRASQGRESDVVDLPLE

SEQ ID NO: 147024 - protein, 237 aa, Glycine max
  Coding DNA Sequence Number=SeqID_30246
MNLIIVIKRKEHTLRCPCRTRARARVLGEVEEVQKSMKTDMEAMKEQMATMMEAMMSMKKIMEANAVVVAATSVVAKVNPMSPSGLNQMNHPTSVMVGKDLGSMSGPYYVQIQNKHAFPPYGLPPNYTPPNVAYTPNENVNNYTPILIESQQPQSDHAHVSQPMGETHEMPHHNLADFEPCLGYATEGHVVGDIPLQNTLDGPQYHPQPHLLHSTMVKNPHAMAEMGKLDHLEGGIL

SEQ ID NO: 147025 - protein, 93 aa, Glycine max
  Coding DNA Sequence Number=SeqID_30247
  Gene Ontology: Mol. function=DNA binding; Cellular component=nucleus; Biological process=regulation of transcription, DNA-dependent
  Homolog annotation: Hit_ID=Q1SEP7; Match level="QueryCoverage=78%, HitCoverage=78%, E-value=4e-28, Identity=79%"; Hit description =Homeodomain-related
MVNPEFRHSPLKMSSRTSDMDDFPKGLWGWSWKENKLFEQALAVVDENHPERWEIVAAMVGGQKSAGDVQEHYVFLLDDLMFIESGKLDHKLA

SEQ ID NO: 147026 - protein, 56 aa, Glycine max
  Coding DNA Sequence Number=SeqID_30248
  Subcellular localization annotation: CTP_CleavageSite=44; ConfidenceScore=5.35e-01
MACTKVVIGASSNFARIKGGKLSTSSRNTSMTLIKLDFRLWVTRIMHTRMFPFETP

SEQ ID NO: 147027 - protein, 155 aa, Glycine max
  Coding DNA Sequence Number=SeqID_30249
  Gene Ontology: Mol. function=DNA binding; Biological process=DNA integration
MTSNDSNLFQFPSLTKGNYDNWCNCMKVWQGSQDAWEVVEKGYRQHENEGSLSQNEKETLLKMKKNDQQALTFIYQGLDEGMFEMVSNASTSKEAWEILRTSLEGVDKVKKHYGKNMEDVHVVENILHSLAVKFDFLVCAIEESKDIESMIVDQL

SEQ ID NO: 147028 - protein, 65 aa, Glycine max
  Coding DNA Sequence Number=SeqID_30250
MAEILRLYHIRSTAVSSSTLTPPPKTSMVISVRGVRIDEEDTIFESEDLLLAVVTNLVTNGGASK

SEQ ID NO: 147029 - protein, 335 aa, Glycine max
  Coding DNA Sequence Number=SeqID_30251
  Gene Ontology: Mol. function=enzyme inhibitor activity; Cellular component=cell wall; Biological process=cell wall modification
  Homolog annotation: Hit_ID=Q1SEQ0; Match level="QueryCoverage=91%, HitCoverage=53%, E-value=1e-128, Identity=72%"; Hit description =Pectinesterase; Pectinesterase inhibitor
  Pfam annotation: Domain name=PMEI; Domain location=38-198; Score =107.9; E_value=2.9e-29; Accession=PF04043.6; Description=Plant invertasepectin methylesterase inhibitor
  Pfam annotation: Domain name=Pectinesterase; Domain location=254-335; Score=-137.8; E_value=3.3e-11; Accession=PF01095.10; Description =Pectinesterase
  Pfam module annotation: Pfam domain module=PMEI::Pectinesterase; Domain location=38-198::254-335
MVNGKILVSGVSLILVVGVAIGVVVVVNRKDTSDPEVAAQQKSVKAMCEGTDDPKLCHDTLSTVKSSSVSDPKAYIAAGVEATAKSVIQALNMSDRLKVEHGDKDPGIKMALDDCKDLIEFALDSIESSANLVNEHNIQALHDQSPDLRNWLSAIISYQQSCMDGFNNGTNGEEEVKKQLHTDSLDQMGKLTGIVLDIVTNLSKILQSFDLKLDLNPASRRLLEVDAEGFPTWFSAADRRLLGKMNQGDAPPPNAVVALDGSGQFKSVKQAIDSYPKNFKGRFIIYVKAGVYNEYILIPKKSENIMIYGDGPTKTIITGNKNFIDGVKTMQTATF

SEQ ID NO: 147030 - protein, 183 aa, Glycine max
  Coding DNA Sequence Number=SeqID_30252
  Gene Ontology: Mol. function=DNA binding; Cellular component =chromatin; Biological process=DNA integration
  Pfam annotation: Domain name=rve; Domain location=7-151; Score=-7.2; E_value=0.024; Accession=PF00665.16; Description=Integrase core domain
MVKGISHINHPNHLCEACLLGKHARKSFPKEAESKAKIPFQLVSTNQKSKAFVIFKNFKALVEKESDYVIKALRSNRGGKFTSKNFNEFYENNGIHHPIMVPRTTQQNGCMLKVKSMPKKFWAKAIPHGVYFSNSSPTKNVKSQTLQEAWNGVKPRVDHLKSLGAFHMLICLTNEDSSLTIGV

SEQ ID NO: 147031 - protein, 44 aa, Glycine max
  Coding DNA Sequence Number=SeqID_30253
MMQENYTAVKSVSASTMCKQKRIETLSANQSKVQLKTKISIIDQ

SEQ ID NO: 147032 - protein, 155 aa, Glycine max
  Coding DNA Sequence Number=SeqID_30254
  Homolog annotation: Hit_ID=Q1SPD0; Match level="QueryCoverage=61%, HitCoverage=30%, E-value=8e-13, Identity=40%"; Hit description =Peptidase M, neutral zinc metallopeptidases, zinc-binding site; Nucleic acid-binding, OB-fold
VIGVVEEVVFRQVSGKGRRVVFKLKDLSQQLLSCTLWDDYCLQFVNFLDDYEGDGPITVLLSHCRIKEAQGSYPASINNSLKASKLIINQPVMEIQEFNERYFLLAELGIEARLGFKSHGEGSTQLSGSIHYHQKNHSLARLRQRLLLRLTPSLK

SEQ ID NO: 147033 - protein, 543 aa, Glycine max
  Coding DNA Sequence Number=SeqID_30255
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=87%, HitCoverage=44%, E-value=1e-145, Identity=59%"; Hit description=SBP
  Pfam annotation: Domain name=SBP; Domain location=223-300; Score =75.8; E_value=1.3e-19; Accession=PF03110.5; Description=SBP domain
MNGVDLVQPAPFPSTEPVGNLRGALTDIHSPPICYASHAKPLTYRVGGGHADSTELESWLRGFAIFGTVGAKFGAEAYHFYGVGASSDLRGVGKRSSEWDLNDWRWDGDLFIASRLNPVPADGVGVGQQFFPIGSGIPVAGGPSNSSSTSEEVDPRDPKANKEGDKKRRVIVLEDDGLNEEGGTLSLKLGGHASAVVDREVGSWDGTNGKKSRVSGSTSNRAVCQVEDCSADLSKAKDYHRRHKVCEMHSKASRALVGNAMQRFCQQCSFTYFKSLMKEREAAEDAWQGIINEEGKQIMKLFLMERHGGTGTSVMVQFSVVAVMAQIAAGIVAVADEIVCHMENGMGKQWSDQTTDQDLLTHILRSLASQNGEQGGKNIANLLREPENLLREDGSSRKSEMMSTLFSNGSQGSPSNIRQHETVSMAKMQQQVMHAHDAGASDQQITSSIKPSMSNSPPAYSEARDSTAGQIKMNNFDLNDIYIDSDDGMEDLERLPVSTNLVTSSLDYPWAQQDSHQSSPPQTSGNSDSASAQSPSSSSGEAQ

SEQ ID NO: 147034 - protein, 127 aa, Glycine max
  Coding DNA Sequence Number=SeqID_30256
MKLASTNSNELTGSMSLINATSSNSSNSRPSCIYCGKDIHTIDRCYRKNDTPQNYPSKGGKGNSKQFRQRKLGSKRKQGVQIAPRPTWALQNIPPEGCCFWRKQPGSPGRAELAWASWAATTSPILL

SEQ ID NO: 147035 - protein, 43 aa, Glycine max
  Coding DNA Sequence Number=SeqID_30257
MEQPEKKFKESQDTIRDITIIIGLHTPFDVPMRNRYEIDVFLC

SEQ ID NO: 147036 - protein, 208 aa, Glycine max
  Coding DNA Sequence Number=SeqID_30258
  Subcellular localization annotation: CTP_CleavageSite=75; ConfidenceScore=5.63e-01
MSQRGNNGSIPFDKSSIKPNKPKNPRKALVKRCVSHCLIASTLVGTGSTPCSKTKSKLENQQAPPNSSSSSSMVRIGKREANLWVKEVISRYGGGGVLIKSGIVVPFQLNDLLNMHKLHGEDMKVNREDLALHVNKNIDIEGVAFNFITITHHDSEGHDTRAERACPTGSSGHVLSVGCALNTLARGSCLPKWLLVLSDLRGLSDSDS

SEQ ID NO: 147037 - protein, 181 aa, Glycine max
  Coding DNA Sequence Number=SeqID_30259
MIQFQLGIMDLDLALPMDGSPPIIIKTSINADKSLHEAREWSNRLTLNLMRMTMAVNVKPSMPKTNNASEFMKLVKDCSQSDIIDKLIVGNLSSELTNKKFDWSQLIHDHVTKMDTLVAKLNSMGMQGRRRGIKENKGQINSTHDGASISKSKPDKKNKGKSQLKVKMGGVHKEKKCYFCK

SEQ ID NO: 147038 - protein, 262 aa, Glycine max
  Coding DNA Sequence Number=SeqID_30260
  Gene Ontology: Mol. function=chromatin binding; Cellular component =chromatin; Biological process=chromatin assembly or disassembly
  Homolog annotation: Hit_ID=Q1SAV4; Match level="QueryCoverage=71%, HitCoverage=47%, E-value=2e-40, Identity=44%"; Hit description =Integrase, catalytic region
  Pfam annotation: Domain name=Chromo; Domain location=152-203; Score =17.3; E_value=0.0089; Accession=PF00385.14; Description='chromo' (CHRromatin Organisation MOdifier
MHELSLSPLNRRTDRGTSNIKAVDDFLANHEDVFDNLKNKLIKAQESMKHFADKHRKDITFQIGDWVFVKLHPHRQISTTGESYSKLVKRFYGSYQILWKIVSVAYELQLLEGSRIHPVFHCSILKPCHQPSRSVDTTVDLPPTTVDHQPVISPLAILNTRWDYSKYYPKLMVLVQWKGLSPYDTLWEEYGSLKVDQHLEDNVLFDERRDVMKGIIQLPSGTTDTSIMQQPGTTPGTTGTSTSRNQRPKQRITKPRHLRDFV

SEQ ID NO: 147039 - protein, 88 aa, Glycine max
  Coding DNA Sequence Number=SeqID_30261
MAEPTRLKSNMECIEEAIAKLALNQLNFTTKRDELFQRMTILEPTGTLFKLTQHGSAGLRHALQSASTLTINPGPSGSSGTTLREEVA

SEQ ID NO: 147040 - protein, 126 aa, Glycine max
  Coding DNA Sequence Number=SeqID_30262
  Gene Ontology: Mol. function=DNA binding; Cellular component=nucleus; Biological process=DNA integration
MESDNFKKWLNAMKEELKSMDDNNVWDLVEFPKARLVAKGFIQKDDIDYKETFSPVSKKDSLSIVLALVTHYDLELHQMDVNTTFLNGDLEEEVYMDQSKGFVSTRRENLVCKLKRSIYGLKQTSR

SEQ ID NO: 147041 - protein, 204 aa, Glycine max
  Coding DNA Sequence Number=SeqID_30263
  Gene Ontology: Mol. function=methionine adenosyltransferase activity; Cellular component=cytosol; Biological process=one-carbon compound metabolic process
  Homolog annotation: Hit_ID=P17562; Match level="QueryCoverage=99%, HitCoverage=82%, E-value=2e-62, Identity=68%"; Hit description=S -adenosylmethionine synthetase 2
  Pfam annotation: Domain name=S-AdoMet_synt_C; Domain location=83-193; Score=161.4; E_value=2.3e-45; Accession=PF02773.6; Description=S -adenosylmethionine synthetase, C-te
  Pfam annotation: Domain name=S-AdoMet_synt_M; Domain location=12-81; Score=-22.0; E_value=0.00017; Accession=PF02772.6; Description=S -adenosylmethionine synthetase, cent
  Pfam module annotation: Pfam domain module=S-AdoMet_synt_C::S-AdoMet _synt_M; Domain location=83-193::12-81
MNTCRNVGFVSDDVGLDPDKCKVLVNIEQQSPDIAQGVHGHFTKRPEEVGAGDREHVIKPVIPEKYLDDKTIFHLNPSGRFVIGGPHGDAGLTGRKIIIDTYCGWGAHGGGAFSGKDPTKVDRSGAYVARQQQRFGTGKIPDKEILQLVKKNFDFRPGMITINLDLKRGGHRFLKTAAYGHFGREDPDFTWEVVKPLKWDKPQA

SEQ ID NO: 147042 - protein, 112 aa, Glycine max
  Coding DNA Sequence Number=SeqID_30264
MEKLTLAMQMLIPPLKDKAIGSAGNLNSKGGSFEVGVEGGKRDWKKIEGEDDQKGKIVTVDVPIANISENKDVYAVAESDPIASTSEPTSAKALNEKDERSSGKMEMKALIP

SEQ ID NO: 147043 - protein, 536 aa, Glycine max
  Coding DNA Sequence Number=SeqID_30265
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=99%, HitCoverage=55%, E-value=0.0, Identity=82%"; Hit description=SBP
SRTDRIVFKLFGKEPNDFPLVLRAQILDWLSHSPTDMESYIRPGCIVLTIYLRQAEALWEELCYDLTSSLNRLLDVSDDTFWRNGWVHIRVQHQMAFIFNGQVVIDTSLPFRSNNYSKILTVSPIAVPASKRAQFSVKGKYLVCEDDHMSMDQCSKEPDELQCVQFSCSVPVMNGRGFIEIEDQGLSSSFFPFIVVEEDVCSEICTLEPLLELSETDPDIEGTGKIKAKNQAMDFIHEMGWLLHRSQLKLRMVSSVDLFPLKRFKWLIEFSMDHDWCAAVRKLLNLLFDGTVNTGDHPSLYLALSEMGLLHKAVRRNSKHLVELLLRYVPENISDKLGPEEKALVDGENQTFLFRPDVDGTAGLTPLHIAAGKDGSEDVLDALTNDPCMVGIEAWKNARDSTGSTPEDYARLRGHYAYIHLVQKKINKKQGAAHVVVEIPSNMTENNTNKKQNELSTIFEIGKPEVRRGQGHCKLCDNRISCRTAVGRSMVYRPAMLSMVAIAAVCVCVALLFKSSPEVICMFRPFRWENLDFGTS

SEQ ID NO: 147044 - protein, 84 aa, Glycine max
  Coding DNA Sequence Number=SeqID_30266
  Gene Ontology: Mol. function=methionine adenosyltransferase activity; Biological process=one-carbon compound metabolic process
  Homolog annotation: Hit_ID=Q56TU4; Match level="QueryCoverage=48%, HitCoverage=9%, E-value=2e-09, Identity=90%"; Hit description=S -adenosyl-L-methionine synthetase 1
MSHRQPCCQDPVQGRHRALHQRYGRTHSLSGSPSLTDSETPSNAARDQLPEAVIIEVLSPLDLTAKRRDAICQGWCASERQIIA

SEQ ID NO: 147045 - protein, 319 aa, Glycine max
  Coding DNA Sequence Number=SeqID_30267
  Gene Ontology: Mol. function=peroxidase activity; Cellular component =vacuole; Biological process=response to oxidative stress
  Homolog annotation: Hit_ID=Q1RUM5; Match level="QueryCoverage=99%, HitCoverage=99%, E-value=1e-124, Identity=69%"; Hit description=Haem peroxidase, plant/fungal/bacterial
  Pfam annotation: Domain name=peroxidase; Domain location=39-283; Score=447.1; E_value=2.3e-131; Accession=PF00141.13; Description =Peroxidase
MVLHMHVMLCCFVLIVSSASASLKVDFYKTTCPSAEAIVRRAVNKAVSLNPGIAAGLIRMHFHDCFVRGCDGSVLLESTAGNPSEREHPANNPSLRGFEVIDEAKAQIEAECPHTVSCSDILAFAARDSTNRVGGINYVVPAGRRDGRVSIRDEASQLPRPTFNTQQLISNFEQKGLSADEMVTLSGAHSIGVSHCSSFSDRLYSFNATFPQDPSMDPKFATSLKTKCLPRSDNTVVLDASTPNRLDNNYYALLKNQRGLLTSDQTLLTSPSTRPMVLTNAKHGSKWARKFAKAMVHMGSIQVLTGSQGEIRTRCSVVN

SEQ ID NO: 147046 - protein, 187 aa, Glycine max
  Coding DNA Sequence Number=SeqID_30268
  Homolog annotation: Hit_ID=Q1SSV9; Match level="QueryCoverage=75%, HitCoverage=55%, E-value=6e-37, Identity=75%"; Hit description =Streptomyces cyclase/dehydrase
  Subcellular localization annotation: CTP_CleavageSite=66; ConfidenceScore=5.97e-01
MSITTTQALTPLSSSRKSRSRTTFGANSTSTSFPATPLSSNLLLFKLSHTSSKRTSTTFHAFKRFSPVMEWQDCTVKMEIDVPISVAYTCYSDREAIPNWMPFISSVKHHKISGYILGPNKFQGIESIRQAISSKRAEYTFRHFEVNPFQIRKSTGDLWKVFKTVQHCVKIFEMYDSKEKFRCTFLC

SEQ ID NO: 147047 - protein, 87 aa, Glycine max
  Coding DNA Sequence Number=SeqID_30269
MTGSSFITLDLSDVRSLRCNVLDRRLIACLLKKLVNEKKWYDRGLSKEEKFGLSGLNMDKPINGAKSMSSTSGDATPSSPKTVRLMA

SEQ ID NO: 147048 - protein, 115 aa, Glycine max
  Coding DNA Sequence Number=SeqID_30270
MGEVEEVQEQMKVDTEALKEQMATMMEAMMSIKEIMEVNMAAVATVCTVSRMDPTPPSGLNLINRPTSDTSGPHFVQVLNKHVFLPYGLPPNYTPPNENVNNSTPILVESQSSPN

SEQ ID NO: 147049 - protein, 2740 aa, Glycine max
  Coding DNA Sequence Number=SeqID_30271
  Gene Ontology: Mol. function=kinase activity; Cellular component =membrane; Biological process=signal transduction
  Homolog annotation: Hit_ID=Q1T3X4; Match level="QueryCoverage=65%, HitCoverage=98%, E-value=5e-49, Identity=20%"; Hit description =Prefoldin; t-snare; Protein kinase PKN/PRK1, effector
  Pfam annotation: Domain name=Filament; Domain location=1758-2012; Score=-182.8; E_value=0.083; Accession=PF00038.11; Description =Intermediate filament protein
  Pfam annotation: Domain name=M; Domain location=1242-1262; Score=2.4; E_value=62; Accession=PF02370.7; Description=M protein repeat
  Pfam annotation: Domain name=M; Domain location=1550-1570; Score=0.7; E_value=1e+02; Accession=PF02370.7; Description=M protein repeat
  Pfam annotation: Domain name=M; Domain location=1666-1686; Score=0.9; E_value=95; Accession=PF02370.7; Description=M protein repeat
  Pfam annotation: Domain name=M; Domain location=1832-1852; Score=1.1; E_value=91; Accession=PF02370.7; Description=M protein repeat
  Pfam annotation: Domain name=M; Domain location=2067-2087; Score=0.8; E_value=99; Accession=PF02370.7; Description=M protein repeat
  Pfam annotation: Domain name=M; Domain location=2337-2357; Score=1.6; E_value=78; Accession=PF02370.7; Description=M protein repeat
  Pfam annotation: Domain name=M; Domain location=2587-2607; Score=4.8; E_value=29; Accession=PF02370.7; Description=M protein repeat
  Pfam annotation: Domain name=M; Domain location=425-445; Score=6.2; E_ value=19; Accession=PF02370.7; Description=M protein repeat
  Pfam annotation: Domain name=M; Domain location=579-599; Score=1.9; E_ value=71; Accession=PF02370.7; Description=M protein repeat
  Pfam annotation: Domain name=M; Domain location=635-655; Score=1.0; E_ value=93; Accession=PF02370.7; Description=M protein repeat
  Pfam annotation: Domain name=M; Domain location=873-893; Score=2.0; E_ value=69; Accession=PF02370.7; Description=M protein repeat
  Pfam annotation: Domain name=Osmo_CC; Domain location=1529-1577; Score=0.7; E_value=12; Accession=PF08946.1; Description=Osmosensory transporter coiled coil
  Pfam annotation: Domain name=Osmo_CC; Domain location=918-967; Score =16.1; E_value=0.029; Accession=PF08946.1; Description=Osmosensory transporter coiled coil
  Pfam annotation: Domain name=Pox_A_type_inc; Domain location=1044 -1066; Score=1.1; E_value=56; Accession=PF04508.3; Description=Viral A-type inclusion protein repeat
  Pfam annotation: Domain name=Pox_A_type_inc; Domain location=1328 -1347; Score=1.6; E_value=48; Accession=PF04508.3; Description=Viral A-type inclusion protein repeat
  Pfam annotation: Domain name=Pox_A_type_inc; Domain location=1529 -1551; Score=8.2; E_value=5.2; Accession=PF04508.3; Description=Viral A-type inclusion protein repeat
  Pfam annotation: Domain name=Pox_A_type_inc; Domain location=1814 -1836; Score=4.7; E_value=17; Accession=PF04508.3; Description=Viral A-type inclusion protein repeat
  Pfam annotation: Domain name=Pox_A_type_inc; Domain location=1934 -1956; Score=4.6; E_value=17; Accession=PF04508.3; Description=Viral A-type inclusion protein repeat
  Pfam annotation: Domain name=Pox_A_type_inc; Domain location=635-657; Score=1.4; E_value=50; Accession=PF04508.3; Description=Viral A-type inclusion protein repeat
  Pfam module annotation: Pfam domain module=Filament::M::M::M::M::M::M: :M::M::M::M::M::Osmo_CC::Osmo_CC::Pox_A_type_inc::Pox_A_type_inc::Pox_ A_type_inc::Pox_A_type_inc::Pox_A_type_inc::Pox_A_type_inc; Domain location=...
  Pfam module annotation: Domain location=1758-2012::1242-1262::1550 -1570::1666-1686::1832-1852::2067-2087::2337-2357::2587-2607::425 -445::579-599::635-655::873-893::1529-1577::918-967::1044-1066::1328 -1347::1529-1551::...
  Pfam module annotation: Domain location=1814-1836::1934-1956::635-657
  Subcellular localization annotation: CTP_CleavageSite=24; ConfidenceScore=5.08e-01
IAIATENLTSNDTLRRRFKNPQPRALMVVTVPNLIRFDSVDRRGSFLVTAVVTVGSKNGVDRKMDRNKNRTDLLAAGKKRLQQFRQKKDGKGGSSRGKSSKQAGKPQLPDPDSDAASSASISTVSSQITDGNVEADSHSNMVNTESSESQSVTNSLAPDNTDPSVDSSSVVTTYDTGNETVLDSNAEVAHQVHGVCENDSELSAQDQGEIAQDIGADVLEDVSLRTSDSLVSEGGATHDRESVTVAVLSPPASVTTAVGESVTDEREGEKREELLLLSEDIPNTSVMQTREDQEADGLDMKKSYQSTDPVIDGQKELSLSEVGESDQSLSGIALEKIRVEEASHEAEQLRKSIELLSSQFLLEARGAVSDLDPLASSSVLSDNDISEAFQSLKEELFLANLMKNIFNTQLAEQLESDDQRHQLVDEISQLHASHNKVNDKNQQLTEELANCHVELHDISSKNVEVQNQFNAAMAEVEALSVRVIELQNSFDVSHKDSLELSRELADCRGLISSLQVEKKGMNETLNLMIAEKNKLVEEKEFHLCESKNLATELADFKSLMEGVRVENSNLIDRISLVTEERNKIEAEIEHLKHEIDRLSLDLVENKDLVASLEAENSNLNRNLALSADKIKNLEDENQRHSSEIIALNEQLSTEKAERMRFEGDLKEATVHLEQISKENVFLNDTLDKQKAKIEEIGKEHSQPLSQPRDLGNQAHVARTQSKGLEIAIANDSLHMDQEPDEGALGGPHVNILEHEVFDDSHGFVSLKACSDEVEKVLVKLEKAIDVLHSQSVSSSRAGEKVSSPVVSKLIQAFESKVQEDEHETESRDSSDVLSSSNSFIMLTKEQIGDLKKLLSKWKLNVQIAGTLFNGERDDRKTGDAKYSDLKDQFEQLKQHCSDLEASNIELAVQYETAKQLLGDIQEKKCLLEEFYDALKQEDTHLKAKNNELYEKLGYCQSKISELHTEMNDVKQISNDMASTVGSQLENLQKEVTERAMLLEQGWNMTIAQIVELVGKLKESVGETLCTTVSSDAYGNLDICHQLEVSVNAAAEMIFDLQKKLEATYSEHEIMCTSYKEMNSKCDDLLGRNELAVSLLHKMYSDLRKLVFSNGGTMDEDKIDLQSEVLPDLLNYNSYQPILKHIGNILTEKLELESVTKEIKSELMHRETELEELKMKCLGLDSVSKLIEDVKTRDTEIQYHTTKEGYGSKEMELAELKEKMHFLDTLRLENENEILVLKESLHQAEEALTVAHSELHKKANELEHSEQRVSSIREKLSIAVAKGKGLVVQRDGLKQSLAETSSELERCLQELQLKDTRLHEVETKVKTYAEAGERVEALESELSYIRNSSNALRESFLLKDSMLQRIEEILEDLDLPEQFHSRDIIEKIDWLASSVSANSLPINDWEQKEAMGGGSYSDAGYVVTDSWKDDSQLRPDSDDFRKKFEELQSKYYGLAEQNEMLEQSLMERNSLVQRWEELVNRVEMPSHLQSMETEDKIECIGSALTEANHHIDSMQLKIEKYDSYCGLLNADLEESQRTVSALQEDLSALTSEREHLSEKMESLVYEYEKLSLQTREAELENGKLHDEITSLKDKLEHKTAIEEQIFTIEGKIRKLRDLVGDALSESETENMVSGSANIDSLEELLEKLVEKLNMERKPSAQTREAELENEKLHTEISSLKDKLEQKAAIEEQIFTIDGKIRKLQDLVGDALSVPETENLVSCSANIDSLEELLRKLIENHAKLSLMKPAYGVVGDGLHSQKEDATLLEERSMDVHDKEAADIDIYKRDLEESSNELMHVKEERNRSLEKQISLSGEVEALTKRIEELQGLLNQEEQKSASFREELASEVETLTKRNEELQGLLNQEEQKSASVREKLSGEVETLTKRIDELLGLLNQEEQKSASFREKLNVAVRKGKSLVQQRDSLKQTIKDMTVEMEHLKSEINNRENTLGEQEQKLRQLSTYPDRLEALESESLLLKKHLEETEHHLQDQEYSLKLILNKLGEIEVGGEGHISDPVKKLELVGKLFSDLHSAVASLEQESRKSKRASELLLAELNEVQERNDSFQEELAKVTAELVDLRRERDSAEAAKLEAVAHLEEGKKSHFSDIMELKSSMNQVCKSFGEVQNLLCNAFFMDLESYRKVEAGLESCMKGNNDKNVVDSSITKEHDGILHCSSANKKSSVSADPWSDFDRIDHYDDNTIVEISRLFGHQLQELMVEETDKTLSKLIASIQREMTSQKEACETMKKEVSERDGELAVLRGNVAYLYEACINSVIVLENGKAELVGRKVESSDLGINLEIPSFDDGISEECIKTLTDRLLLSAKGFASLKTEFLDANQKEMKATITNLQRELQEKDVQRDRICSELVKQIKDAEAAANSYSQDLQAFSLQEHNIKKEVEAIEAERKILEQRVNELQDRQETAAELEEKMRSQTGLLAAKDQEIEALMHALDEEETQMEELTNKIVDLETVVQQKNQEIENLGSSRGKVMKKLSITVSKFDELHHLSASLLSEVEKLQSQLLERDTEISFLRQEVTRCTNDALLASQMSNQSSDEIFEFLMWVDTIVSHDGVHDIHPDMKSNSKVHECKEILHKKLTSLLSELENLREVAESKDAMLQIERSKVEELNCKTETLETSLHEKELQLNLLEGVEETGKGAGTSSEIVEMNDWSSSGAFVTPQVRSLRKGNSDHVAIAVDVDPGSTSRIEDEEDDKVHGFKSLTTSRIVPRFTRPLTDLIDGL

SEQ ID NO: 147050 - protein, 72 aa, Glycine max
  Coding DNA Sequence Number=SeqID_30272
  Gene Ontology: Mol. function=catalytic activity; Biological process =metabolic process
  Homolog annotation: Hit_ID=Q1SI48; Match level="QueryCoverage=84%, HitCoverage=15%, E-value=2e-18, Identity=77%"; Hit description=AMP -dependent synthetase and ligase
MLKSESEPWSWCKMWYLWCQFCRMNYEHAGVGAIEFIICHSEVSIALAEEKKIPELFKTFPNATKYLKSKFC

SEQ ID NO: 147051 - protein, 79 aa, Glycine max
  Coding DNA Sequence Number=SeqID_30273
MVLVDRADATPITNDHHQYYYIPWGFMSHRKLERFEDISFYLGMEVTKDQGGHISMMPEEEEVYRELLRDLEPSFKEDD

SEQ ID NO: 147052 - protein, 105 aa, Glycine max
  Coding DNA Sequence Number=SeqID_30274
MSKQVETITKYPQRFHDVGPNIRRDHLRDTPSFAHHGKQSEEKGGLQEEEEVMTTFRRVVFTKVICETDCLEAVKAIHEANSDMADLHTHRDILSAIHVVTYREW

SEQ ID NO: 147053 - protein, 164 aa, Glycine max
  Coding DNA Sequence Number=SeqID_30275
MTNHKGCLTHAARAWKSDVRSVTSSGIQFPDLIIETAHRFAMDNKKRGAREGEDEDEMKMEKFYALLRNFRDARDRRRRELVELEKHESNIWKKMMKGTAPTATKDNKAEVSFEFQDFTTEIQFRKPPLVFPNPVSSCDTSKDNNKGNKKKKQQDLALDLKLAL

SEQ ID NO: 147054 - protein, 473 aa, Glycine max
  Coding DNA Sequence Number=SeqID_30276
  Gene Ontology: Mol. function=RNA-directed DNA polymerase activity; Cellular component=intracellular; Biological process=RNA-dependent DNA replication
  Homolog annotation: Hit_ID=Q1RUM6; Match level="QueryCoverage=97%, HitCoverage=88%, E-value=0.0, Identity=81%"; Hit description =Pentatricopeptide repeat
  Pfam annotation: Domain name=PPR; Domain location=145-178; Score=7.6; E_value=0.93; Accession=PF01535.11; Description=PPR repeat
  Pfam annotation: Domain name=PPR; Domain location=211-245; Score =50.1; E_value=7.3e-12; Accession=PF01535.11; Description=PPR repeat
  Pfam annotation: Domain name=PPR; Domain location=246-280; Score =41.7; E_value=2.5e-09; Accession=PF01535.11; Description=PPR repeat
  Pfam annotation: Domain name=PPR; Domain location=281-315; Score =27.6; E_value=4.3e-05; Accession=PF01535.11; Description=PPR repeat
  Pfam annotation: Domain name=PPR; Domain location=316-350; Score =18.2; E_value=0.03; Accession=PF01535.11; Description=PPR repeat
  Pfam annotation: Domain name=PPR; Domain location=351-385; Score =10.2; E_value=0.46; Accession=PF01535.11; Description=PPR repeat
  Pfam annotation: Domain name=PPR; Domain location=386-420; Score =25.7; E_value=0.00016; Accession=PF01535.11; Description=PPR repeat
  Pfam annotation: Domain name=PPR; Domain location=74-108; Score=2.4; E_value=3.9; Accession=PF01535.11; Description=PPR repeat
  Pfam module annotation: Pfam domain module=PPR::PPR::PPR::PPR::PPR::PP R::PPR::PPR; Domain location=145-178::211-245::246-280::281-315::316 -350::351-385::386-420::74-108
  Subcellular localization annotation: CTP_CleavageSite=47; ConfidenceScore=5.35e-01
SNQNDDVQKVFGILSSTSTPEQLKQSLKSSGVFLSNDVIDQVLKRVRFSHGNPSQTLEFFRYTGRRKGFYHSSFSLDTMLYILGRSRMFGQVWELLIEARRKDQTAITARTVMVVLGRIAKVCSVRQTVESFRKFRKLVQEFDTNCFNALLRTLCQEKSMADARNVYHSLKHRFRPNLQTFNILLSGWKTPEDADLFFKEMKEMGVTPDVVTYNSLMDVYCKGREIEKAYKMLDEMRDQDFSPDVITYTCIIGGLGLIGQPDKARNVLKEMKEYGCYPDAAAYNAAIRNFCIAKRLGDAHGLVEEMVTKGLSPNATTYNLFFRVFYWSNDLQSSWNMYQRMMVEGCLPNTQSCMFLIRLFRRHEKVEMALQFWGDMVEKGFGSYTLVSDVLFDLLCDMGKLEEAEKCFLEMVEKGQKPSHVSFRRIKVLMELANRHEALQSLMQKMAMFGRPLQVDQSTVNPAETSDSLFTKS

SEQ ID NO: 147055 - protein, 85 aa, Glycine max
  Coding DNA Sequence Number=SeqID_30277
MTKIVCAEDDVNLCVSIGLLAAIDKGYLCMSRDSNVSMTEIICVEDDVNLCVSTGLLAAIDKGVSMTEIVGAADKSEALAPMYPQ

SEQ ID NO: 147056 - protein, 137 aa, Glycine max
  Coding DNA Sequence Number=SeqID_30278
MTKEMWDLIQVPLECTPEVRRAMKYSLIQESFLGESHFSKDSSNSRSALGESRISKDLFSSRREDLLHKTNLEFEICPTLHKKPPNVNNVTNLNNSGEEQRSELVFVKMQRDKHAKCKGAKVAAMLGFTGTKKAREF

SEQ ID NO: 147057 - protein, 69 aa, Glycine max
  Coding DNA Sequence Number=SeqID_30279
MAGDATCNRNGDIKCDHGRRRDHGRRCCGGDECGHGGEEEDREEERGKLLEKRRRDVLETERLSRKEEN

SEQ ID NO: 147058 - protein, 115 aa, Glycine max
  Coding DNA Sequence Number=SeqID_30280
  Gene Ontology: Mol. function=binding; Cellular component=nuclear pore; Biological process=NLS-bearing substrate import into nucleus
  Homolog annotation: Hit_ID=Q2HVN9; Match level="QueryCoverage=83%, HitCoverage=8%, E-value=2e-36, Identity=77%"; Hit description =Armadillo-like helical
MEKKERGEYYDSFLPFLLEACNDEYPDVRHVHCPILAVIYGVGVCAEFGGSVFNPLVGEALSRLDVVIRHPNALHADNIIAYDNVVSALGKICQFHRDSINAAQSMVLTFIQMES

SEQ ID NO: 147059 - protein, 206 aa, Glycine max
  Coding DNA Sequence Number=SeqID_30281
  Gene Ontology: Mol. function=pectinesterase activity; Cellular component=cell wall; Biological process=cell wall modification
  Homolog annotation: Hit_ID=Q9FM79; Match level="QueryCoverage=60%, HitCoverage=48%, E-value=3e-21, Identity=34%"; Hit description =Similarity to pectin methylesterase
  Pfam annotation: Domain name=Pectinesterase; Domain location=6-201; Score=-151.8; E_value=3.8e-10; Accession=PF01095.10; Description =Pectinesterase
MGISLEALSAATFEKQNLFHSYVIRALNRSHVSLDGEQNKSMNVISLYVMKQRIILWEEDAKSLCAKTEQCSACGWKEGGTSRGASHDRISGTKAGFYGTQDTLYDHKGLHYFNNCSIQGSVLFIFGSARSLYENCYLNSTTKKVASITAQKLHSNRRVYYGEYKCSGPGANLAGSVPWARVLTDEEAKPFIGMQFIERDTWLASP

SEQ ID NO: 147060 - protein, 267 aa, Glycine max
  Coding DNA Sequence Number=SeqID_30282
  Gene Ontology: Mol. function=transcription regulator activity; Cellular component=nucleus; Biological process=negative regulation of gene expression, epigenetic
  Homolog annotation: Hit_ID=Q9LXN4; Match level="QueryCoverage=51%, HitCoverage=16%, E-value=2e-45, Identity=58%"; Hit description=WD repeat domain protein
  Pfam annotation: Domain name=Hira; Domain location=1-191; Score=31.4; E_value=3.1e-08; Accession=PF07569.2; Description=TUP1-like enhancer of split
MPIMMMGSATTFIDCDECWKLLLVTRNKSLYLWDLFNKTCLLHDSLASLIASSPNSSTKDADTIKVLYAKLSKSGSPLVVYATCHAFLFDMSLKCWLRVANDYFPASSFASSWCMRLIQSGELAALQVDVRKYLARKPGDGCMSLLKKRHFGIRLHVVQKRTPQVLISYSIGKDNGDRFFFIYQLTAITQLVHHGMILIPIGYTFNADMFEMEKVKGGSPYGARTYTGDGSRQPSELELQQVSTKGSTLPATQRSSSKLHNVALPSY

SEQ ID NO: 147061 - protein, 214 aa, Glycine max
  Coding DNA Sequence Number=SeqID_30283
  Gene Ontology: Mol. function=ATPase activity; Cellular component =chromosome; Biological process=chromosome organization and biogenesis
  Homolog annotation: Hit_ID=Q8L6H8; Match level="QueryCoverage=99%, HitCoverage=27%, E-value=3e-36, Identity=47%"; Hit description=SMC4 protein
  Pfam annotation: Domain name=SMC_hinge; Domain location=110-214; Score=39.3; E_value=1.3e-08; Accession=PF06470.4; Description=SMC proteins Flexible Hinge Domain
MRKCKEEFKEFERQDVKYREDFKHVNQKIKKLEDKVEKVEGTLIKEGEESTVLIPKLEDNIPKLQKLLLDEDKVLEEITESSKVETEKYRSELAKVRAELEPWEKDLIEHNGKLEVASKYDVAISTACHGLDYIVVETTNAAQACVELLRRENLGVATFMILEKQVDLLPKLKKNVSTPEGVPRFFDLVKVQDERIKLAFFAALRNTVVAKDLD

SEQ ID NO: 147062 - protein, 112 aa, Glycine max
  Coding DNA Sequence Number=SeqID_30284
MAVAAGIGYRVTWGCFGACRECGFFMVKLLPIEFGKCIDLVFVPDALTSSVFVPNAPALSRSLTQLHSLGFKLVKNRLFQQRLTSPIHCCHGHKYIPTVFSNRLISLNGNVL

SEQ ID NO: 147063 - protein, 156 aa, Glycine max
  Coding DNA Sequence Number=SeqID_30285
  Gene Ontology: Mol. function=hydrolase activity; Cellular component =mitochondrion; Biological process=metabolic process
  Homolog annotation: Hit_ID=Q56XU5; Match level="QueryCoverage=96%, HitCoverage=49%, E-value=5e-45, Identity=51%"; Hit description=3 -hydroxyisobutyryl-coenzyme A hydrolase
MKIVELEKRLISLNSGDENAEAEAYKEGNGWIDAVLKGMKRSSPTALKIALRSVREGRNQTLPECLKKEFRLTMNILRTTISKDMYEGIRALTIDKDNTPKLFHLKWEPSSLDKVEDGKLDLIFQPFEKNLELQIPESEEYRWDGKYENSAYALPN

SEQ ID NO: 147064 - protein, 661 aa, Glycine max
  Coding DNA Sequence Number=SeqID_30286
  Gene Ontology: Mol. function=protein binding; Cellular component =cytoplasm; Biological process=intracellular protein transport
  Homolog annotation: Hit_ID=Q7XJR0; Match level="QueryCoverage=87%, HitCoverage=70%, E-value=1e-161, Identity=62%"; Hit description =Putative vacuolar protein sorting-associated protein
  Pfam annotation: Domain name=Vps16_N; Domain location=6-412; Score =222.6; E_value=8.7e-64; Accession=PF04841.4; Description=Vps16, N -terminal region
MANVSVAAEWQLLYNRYYRKPELYPMPWKHVDLARTKVAAAPFGGPIAVIRDDSKIVQLHAESALRKLRLFSSSGRPLADAVWRHPGGRLVGMSWTDDQTLLCVVQDGTVYRYDVHANLIEPNLSLGKECFEDNVADCVFWGNGLVCITEANQLFCIADFRNPSAVKLADPEIEEMPHCMAVIEPQYTVSGNVEVLLGVDDAVVLAVEEDGVQRLGEGVLRGPLQKMVVSRDGKWLASFTHDGRLLVTTSDLTGVIIERECESALPPQQIAWCGMDAVLLYWDDMLLMMSPEGEPVHYLFDEPIILIPECDGVRILSNTRMEFLQRVPDSTVSIFTIGSTSPAALLYDALDHFDRRSAKADENLRLIRSSLPEAVEACVDAAGHEFDLSRQQTLLRAASYGQAFCSNFQRDRIQEMCKILRVLNAVRSPEIGVPLSIQQYKLLTPSVLIGRLINAHQHLLALKISEYLGMNQEVVIMHWACSKITASLAIPDATLLEILLDKLKLCKGISYAAVAAHADKNGRRKLSALLVEHEPRSSKQVPLLLSIGEEDIALMKATECGDTDLVYLVLFHIWQKRQPLEFFGTIQARPLARDLFITYARYVALNHIPEGKTVWLFLKFRRQQTGPNSLPKASSREEDCSSLITSILAILISTFGVIRLA

SEQ ID NO: 147065 - protein, 231 aa, Glycine max
  Coding DNA Sequence Number=SeqID_30287
  Gene Ontology: Mol. function=nucleic acid binding; Cellular component= nucleus; Biological process=DNA integration
  Homolog annotation: Hit_ID=Q1RWN2; Match level="QueryCoverage=94%, HitCoverage=23%, E-value=6e-43, Identity=35%"; Hit description =Peptidase S8 and S53, subtilisin, kexin, sedolisin; Integrase, catalytic region; Zinc finger, CCHC-type
MVRCLLTKSGVSKGFWLEAVNWSVHILNRSPIFAVKNMTPEEAWSGRKPTMDLFKIFGCISHYQSYISRDVVFDEEGFWENNIDETKQILANFDENNEDEELQTRELEEQQIPAITVEDERPQRARRRPAWMSDYEIVTLQPLKVSSKKKNGEKNDTWELYDLPNGHNTIGVRWIFKTKLKENGEVDKYKTRLVAKGYKQHYGVDYTEVFSPVARHDTIRNKYLSINPLVM

SEQ ID NO: 147066 - protein, 84 aa, Glycine max
  Coding DNA Sequence Number=SeqID_30288
  Gene Ontology: Mol. function=hydrolase activity; Biological process =metabolic process
  Homolog annotation: Hit_ID=Q56XU5; Match level="QueryCoverage=63%, HitCoverage=13%, E-value=3e-12, Identity=62%"; Hit description=3 -hydroxyisobutyryl-coenzyme A hydrolase
MAPSSAVPDEQLPTTNVEFLQFLFEQDKMVVVGEEIEHVRVVTLNRPRQLNAISPELVSQLATYLEKWEKDEKAELVIIKVVFT

SEQ ID NO: 147067 - protein, 129 aa, Glycine max
  Coding DNA Sequence Number=SeqID_30289
MELEYWDKNPFKATTKAFTPEFHFKPIANNKTRKFYEFILIDSNSRHAFVKWWNQFDTTKAEPDKKSKLVAFLAGSKSKDHLTKDLKEVLQLLRSQEERESSSKKVDASSSNYSEDFYQLFKLFRRFLP

SEQ ID NO: 147068 - protein, 95 aa, Glycine max
  Coding DNA Sequence Number=SeqID_30290
MEGSQQNTHYPKEKLPKIITHKWKFGNLLEAPNTLPMKGLFVTKLESNEALKEVGPLLLDSNSSRDDINPHFQFPIWQLTNKETKRQAITKDQKE

SEQ ID NO: 147069 - protein, 242 aa, Glycine max
  Coding DNA Sequence Number=SeqID_30291
  Gene Ontology: Mol. function=oxidoreductase activity; Cellular component=cytoplasm; Biological process=response to red or far red light
  Homolog annotation: Hit_ID=Q4W8C0; Match level="QueryCoverage=92%, HitCoverage=63%, E-value=1e-106, Identity=85%"; Hit description =Gibberellin 2-oxidase
  Pfam annotation: Domain name=2OG-FeII_Oxy; Domain location=57-181; Score=112.5; E_value=1.2e-30; Accession=PF03171.10; Description=2OG -Fe(II) oxygenase superfamily
MEWCEKLHDTNELIPCVVNDYIEAAKELTCELLDLVAEGLWVQDKFSLSKLIRDVHSDSLLRINQYPPVSLKGTKNWDTSKVEARQIQSQNNNNNNNNNIGFGEHSDPQILTIMRSNNVDGLQISTHDGLWIPVPPDPNEFFVMVGDALQVLTNGRFASVRHRVLTNTTKARMSMMYFAAPPLNRWITPLPMMVTPHNPSLYKPFTWAQYKQAAYSLRLGDARLDLFKIQRQQDTHLAPASP

SEQ ID NO: 147070 - protein, 150 aa, Glycine max
  Coding DNA Sequence Number=SeqID_30292
  Gene Ontology: Mol. function=oxidoreductase activity; Biological process=response to red or far red light
  Homolog annotation: Hit_ID=Q4W8C0; Match level="QueryCoverage=84%, HitCoverage=36%, E-value=2e-63, Identity=91%"; Hit description =Gibberellin 2-oxidase
MVAPCPTSMMVRTKKTKAMGVPTIDLSLERSKLAELVVKACEEYGFFKVVNHSVPKEVIARLEEEGKEFFSKTSSEKRQAGPANPFGYGCRNIGPNGDMGHLEYLLLHTNPLSISERSKTIAKDPTKFRERGRARGGCRVGNKPLSVCVS

SEQ ID NO: 147071 - protein, 64 aa, Glycine max
  Coding DNA Sequence Number=SeqID_30293
MKIAQLQHSLSQQHEQLQQQGAEGLKTYGIDKLIQVAASQLSDQLPELYKINIEYRPFSFRTWF

SEQ ID NO: 147072 - protein, 96 aa, Glycine max
  Coding DNA Sequence Number=SeqID_30294
  Homolog annotation: Hit_ID=Q2PMM5; Match level="QueryCoverage=99%, HitCoverage=4%, E-value=1e-50, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSS

SEQ ID NO: 147073 - protein, 301 aa, Glycine max
  Coding DNA Sequence Number=SeqID_30295
  Homolog annotation: Hit_ID=Q1SD94; Match level="QueryCoverage=28%, HitCoverage=28%, E-value=4e-23, Identity=59%"; Hit description =Glycosyl transferase family 8, putative
  Pfam annotation: Domain name=INSIG; Domain location=60-256; Score= -52.0; E_value=0.025; Accession=PF07281.2; Description=Insulin -induced protein (INSIG)
  Subcellular localization annotation: CTP_CleavageSite=84; ConfidenceScore=5.21e-01
TQRGDNMQYLVASGSSSFIEGYSYSLLRHSYPLPRIRKLSLLKPHCSQRQQSRRSLRTSWASVSLTLFGTGFLLGPLLDGLHSRVNLVVYESGSIDIGPLHTNIWVPFLLGLFYSSVGLLQLYLDEKVLNKVQEASLAKTIVSLILLALFIELSADLYKAGISNNIEAYILFAAAEFIWFFLDRTWLGFTLACIVGLGCPLAEVPIMKLFHLWYYPQANIEIFGQNQIGVEVYNPLDAGFEEVSEVIFDGGRDQVADDLWIEVIGLEVQLREGGFDEGFEVGFENEEVEEDVLQALGVLED

SEQ ID NO: 147074 - protein, 48 aa, Glycine max
  Coding DNA Sequence Number=SeqID_30296
MAKVSVEGAASLKQDVPTKGGQGWGQDAVWEINEGALALRKGKGNMPM

SEQ ID NO: 147075 - protein, 191 aa, Glycine max
  Coding DNA Sequence Number=SeqID_30297
  Gene Ontology: Mol. function=mannosyl-oligosaccharide 1,2-alpha -mannosidase activity; Cellular component=membrane; Biological process=ER-associated protein catabolic process
  Homolog annotation: Hit_ID=Q86IK7; Match level="QueryCoverage=85%, HitCoverage=17%, E-value=2e-24, Identity=34%"; Hit description =Similar to Arabidopsis thaliana (Mouse-ear cress). Dbj|BAA91806.1
  Pfam annotation: Domain name=Glyco_hydro_47; Domain location=1-184; Score=-258.2; E_value=0.046; Accession=PF01532.11; Description =Glycosyl hydrolase family 47
MKITPEVIKDISFTIFERVTKNAVCGLWAWRSKLNLVGGHINVFTGEWTQKDAGIGTSIDSFYEYLLKAYLLFGDEQYLYIFQEAYAAAMHYLYHDPCLKLGFVFMLQAGDINPAIRTHAAFLSVWRRYGFTPESFNLASLSVQRENRKISSNVRMERELQKSTTQQCCPVYIRNNESLLKKHKQDCEEKQ

SEQ ID NO: 147076 - protein, 151 aa, Glycine max
  Coding DNA Sequence Number=SeqID_30298
  Gene Ontology: Mol. function=mannosyl-oligosaccharide 1,2-alpha -mannosidase activity; Cellular component=membrane
MGHTSEYIFSTEGHLLPATPQISLLREHCLYYGAYCRSGDLRQTYFVPESNKDKKESNDAGLKLHILRTTLLLSQVPFQGFCPGLNHGQKFGILYAYSTDEQHDYETKQVQQKELTTVQLQSHSVLVLRDQSSAHLLPEDNSSDHNDSQTH

SEQ ID NO: 147077 - protein, 252 aa, Glycine max
  Coding DNA Sequence Number=SeqID_30299
  Homolog annotation: Hit_ID=Q10RD6; Match level="QueryCoverage=60%, HitCoverage=18%, E-value=3e-51, Identity=62%"; Hit description =Expressed protein
MLGKLMYLVLAKSLKTQYVFQGPQARSMIQFMSLYIILRMTHKQLYNLMIKVGQAVLPHVFQTCSATSLPFACVSNALNKPKPLNLDVSLPSIHDIRWSLARLLYLFNIQLERNVATFFVVLLLACFSFVVIGGLLFFKFRGNKNSLEDCFWEAWACLCSSSTHLKQATRVERVIGFLLAIWGILFYSRLLSTMTEQFRAQLQLGKWFRQGSFPLPLSCVLISGFCNMLFHLYAGGRESFLCLIFQENRLIE

SEQ ID NO: 147078 - protein, 153 aa, Glycine max
  Coding DNA Sequence Number=SeqID_30300
MSNGSLGVKNISTFNDALLAKWRTCGGDGVVEWFDNEISWKLGEGDRVRFWLDNWMGDSFDTQISKIISHIFTRKLFLELQQLLSNFVIHGGVRDYYWVWGEEKVKAQPKAGYLIWRMALNRMPMMDNLKIISIIENPIDCVFHFLLLSGRIS

SEQ ID NO: 147079 - protein, 448 aa, Glycine max
  Coding DNA Sequence Number=SeqID_30301
  Homolog annotation: Hit_ID=Q10MH0; Match level="QueryCoverage=77%, HitCoverage=87%, E-value=5e-58, Identity=58%"; Hit description =Expressed protein
MLRYLLVFFLLGLGTRVESHEESGHWSCESESEIRVETEFKPGVITLDGHADDWKDIDGSYFPLLPALDPDAENEFKGGKMSVKSVHDGRDIFFLLQVDGDYAYSKGESNKCPSVALMFQIGDSASYHDMGGCKEHSTSCTDKTCKGHEVDIMHFSIGSAIPGRLYGGNPLDNRDGNGGDRFGHLVDLYAWNPHCRYLDGIGPPGSGGGCVGNDNRDNSGDNNNNDGGGDDGIDGGDNGGNGDSGDNEGNNNDGGGGGDDGGDNGRSDNASDGDGDDGGGDDDSDSDGVANDSSAQNDWKGAWWHSSFTVHSGFVEDESPYADNGKKGTYFFEFSRSLRTMDHLQQDVQFNIGGSSKMSVAFWYPVDGQPWHGSGHYSVYCDWVPIDISVGKSLNGKSVDAASNSSWNVASAFSVILSVAALCVSVFVSYRVFSPKSVSFTPIENNNL

SEQ ID NO: 147080 - protein, 101 aa, Glycine max
  Coding DNA Sequence Number=SeqID_30302
MVKPLSETTKTIKVFPPGLMTQTPAQILEYAKSHYFHFLLETMRFKYTPVQILVPEIPFGVLTLWSKDNSSLEMKLKFGELLKHIPWKKVIATNWQDKTSL

SEQ ID NO: 147081 - protein, 285 aa, Glycine max
  Coding DNA Sequence Number=SeqID_30303
  Gene Ontology: Mol. function=DNA binding
  Homolog annotation: Hit_ID=Q1RTB4; Match level="QueryCoverage=89%, HitCoverage=58%, E-value=5e-26, Identity=30%"; Hit description=IMP dehydrogenase/GMP reductase
MAEVSTEAIASLAQYYDQSLRCFTFGDFQLSPMVEEFEEILGCPLGGRKPYLFSGFYPSLARISKIVQILAQELDHRKGEWALFIDILSLLFFGGVLFPNVDGLVDLAAIDAFLAFHDRKESPVVAIPADLYDTFDRICEKISTRIVCCTPALYVCKEGASVNWFPRWKEGRTGFLISCGGFPNVPLMGTRGCISYNPVLAIRQLGYPIRGAPLEEELAPIIARGFNNTDVEALQKVRKAWEMVQKKDKELRGSNNGPIGGYLSYPNFVRGPLLDDMRPLFGPCK

SEQ ID NO: 147082 - protein, 158 aa, Glycine max
  Coding DNA Sequence Number=SeqID_30304
MQQFLPGMVVDKETLPMPPQGGQPVKGFIMFHHLFLEFQIVYQRVSILQAHSSSRWNMVVRDHLLGGMQPSLGRVKGYANSNQAHLDLPGCSNRRWCLLVEATQLAWASWAATTSLFSPINRGKRAEQIRSTLLVFGIHLKLVRKIVSVKKIQAEALA

SEQ ID NO: 147083 - protein, 74 aa, Glycine max
  Coding DNA Sequence Number=SeqID_30305
MAYTVVPFLWKQHLHRSREAMPSLNPKIQPLLVQASFSDFAKLEQVKIDDALVTAWSKGGDLSHTYFIFLLVNA

SEQ ID NO: 147084 - protein, 265 aa, Glycine max
  Coding DNA Sequence Number=SeqID_30306
  Gene Ontology: Mol. function=cysteine-tRNA ligase activity; Cellular component=mitochondrion; Biological process=cysteinyl-tRNA aminoacylation
  Homolog annotation: Hit_ID=Q9FMB9; Match level="QueryCoverage=61%, HitCoverage=48%, E-value=4e-49, Identity=52%"; Hit description =Cysteine-tRNA ligase
  Pfam annotation: Domain name=tRNA-synt_1e; Domain location=1-183; Score=12.5; E_value=9.6e-16; Accession=PF01406.10; Description=tRNA synthetases class I (C)
RANETGEDPLLLSNHFCDEYNVDMVDLQFETPSKEPHVSEHLNEIKNMITQIINNGYAYKVNDDVFYIVDKGPNYGEPSWDNPWDPGSPGWHIECSAMSACYLTHKFDIHGGGIDLIFPHHENEIAQSWAADHESRVNYWMHNGHISTKLLNLTARELIRCYLYFRLFKIVKMLPLLQGEAKKNEKMLKKKMQKIAQLQLIQSILEVEKEVGKVLDILGLLSCKSYVELNDTYHFEDKVLPDGTGNARQRIMRPKRQIKPPRHLK

SEQ ID NO: 147085 - protein, 63 aa, Glycine max
  Coding DNA Sequence Number=SeqID_30307
MSRGSGDLGDVRWGAIAQNQAWPIPTQPGHSQPGLKIETGRSVASGNRLPIVCNRLHSVICYW

SEQ ID NO: 147086 - protein, 230 aa, Glycine max
  Coding DNA Sequence Number=SeqID_30308
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=97%, HitCoverage=17%, E-value=1e-41, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASNSPFPSNLPILTGKNFNRWSVQMKALLGFQDLTDVIENGIEIPKEGASDSQKTEFKDLKKKDCKALKIANAKSAKEAWDILNKAYAGADKIKKVRLQTLRRQFELLQMEETESIGDYFGRLQVLANSITSCGDTITNLTLVEKVLRTLNPRFDHIVVAIEESKDLESLSVDELQGSLEAHEQRLQERLQERANDKATEQALQAHHQSRNGGSDNHRGKKGRRRFQNT

SEQ ID NO: 147087 - protein, 39 aa, Glycine max
  Coding DNA Sequence Number=SeqID_30309
MIHGQCIDEAHVSYFILHENSIIFVSYFLDEWYHVAFES

SEQ ID NO: 147088 - protein, 124 aa, Glycine max
  Coding DNA Sequence Number=SeqID_30310
MRQFFFPYKEYPSLFPFPTPTTIHPLPQITYKSIFIYYKAKQPRKSIDAILPRKGPVTRAMSKRLQEDWARVAEEGPRVLMNLKTTIALSERISRLAHGLEIDALPDSSVALSALKLRLALDAR

SEQ ID NO: 147089 - protein, 62 aa, Glycine max
  Coding DNA Sequence Number=SeqID_30311
MALVGNINILIVQYAFMFVLNALKGLDDTPQSKSKVVARWTVVKYFNDARPLELERLKVLHI

SEQ ID NO: 147090 - protein, 102 aa, Glycine max
  Coding DNA Sequence Number=SeqID_30312
MVLFVGEKMKNKKVEAAGVSLSVAYALSELHPLSEALSSLSGLGESGRESAKHARAQRAISSPSESFVSFCAQRAQLAKPKFTNSRLARNGAKRAFRIRKPF

SEQ ID NO: 147091 - protein, 143 aa, Glycine max
  Coding DNA Sequence Number=SeqID_30313
MRAGNSDIYGFLEPQSIQRSGQSQFESESYIKSWMQSSQCDVYLGAYLNGFHCSGHWQMVVILPKEHLVVWFCSLHNRPDNYLKGIINSAIKGLDDAPQPKSKAPARWIVVKYFNDPRPLEPERLKALRIQWAQFYLRIRDQA

SEQ ID NO: 147092 - protein, 74 aa, Glycine max
  Coding DNA Sequence Number=SeqID_30314
MEVEEPWLGLWPPLNYRVDMGVSQHTTPELGEFYKLLFWKIPSSIGVLVCVKAGFVADLGVAFVVDWVVGNEKG

SEQ ID NO: 147093 - protein, 74 aa, Glycine max
  Coding DNA Sequence Number=SeqID_30315
MWSLHRMLSRHRKLRWCPFQSCHALQLLFKHFNWLCLYIYGEHRISMKVYQALENSINGFDSRPQSNIGNAFKF

SEQ ID NO: 147094 - protein, 190 aa, Glycine max
  Coding DNA Sequence Number=SeqID_30316
  Subcellular localization annotation: CTP_CleavageSite=25; ConfidenceScore=5.06e-01
MHAAKGEFWPLSFSFLFSLQVWVVRVMVVGFVSRLGWRHDGRALLVVVRSRTADGGDSNSAVVILWWWWLKVVMGVRVISVARLRILLKKSFFTLVKSNVQRWWRPVFDYGIVVDLAPIFDGCQNTVLESFDSYVGDDINTDVEIRGFYVGGGVSTDLEIKYFYDGADIITVVESSLSKTLITLATTSKQ

SEQ ID NO: 147095 - protein, 80 aa, Glycine max
  Coding DNA Sequence Number=SeqID_30317
  Homolog annotation: Hit_ID=O81004; Match level="QueryCoverage=59%, HitCoverage=16%, E-value=3e-08, Identity=56%"; Hit description=GTP -binding protein At2g22870
MVVQSWVEDVSDLGRRSDSPRRGGAVLSGGCSGFPSMGIALNQLDVLDSRIAGVGSDGDVGAGKDRGVVDLVGLNAWRDQ

SEQ ID NO: 147096 - protein, 359 aa, Glycine max
  Coding DNA Sequence Number=SeqID_30318
  Gene Ontology: Mol. function=transferase activity, transferring nitrogenous groups; Cellular component=intracellular; Biological process=regulation of transcription, DNA-dependent
  Homolog annotation: Hit_ID=Q6D2U1; Match level="QueryCoverage=96%, HitCoverage=72%, E-value=1e-128, Identity=63%"; Hit description =Putative bifunctional protein, includes [GntR-family transcriptional regulator and aminotransferase]
  Pfam annotation: Domain name=Aminotran_1_2; Domain location=9-344; Score=38.8; E_value=2.6e-09; Accession=PF00155.11; Description =Aminotransferase class I and II
MFPQRQLMRSLVKVSHNLNPTDALNNLPPGNEALRKILAQRYAQQGITLSPDDIVITNGAMEALNLSLQAVTEPGDWVVIENPSFYGALQAIERLKLNAIAIASDVEQGIDLDELEQALQRWPVKACWLMTNRQNPLGFTLSAERKQQLVALLTRYQVAMIEDDVYSDLYHGHDKPLPARAFDREGYVLHCGSFSKNLVAGFRVGWVAAGRYAQRVQRIQMMSTLSTSAPMQLALADFLSTRSYDTHLKKLRQTLAKRKQLAQQALRRVLPAEAHISDTPGGYFLWISLPEQINATQLYHLALQQGISIAPGQLFSSSESFSHCFRFNTAWPWDARAEAAVETLGALIGQLAQGVAVEK

SEQ ID NO: 147097 - protein, 762 aa, Glycine max
  Coding DNA Sequence Number=SeqID_30319
  Gene Ontology: Mol. function=nucleic acid binding; Cellular component= intracellular; Biological process=DNA integration
  Homolog annotation: Hit_ID=Q1S9T9; Match level="QueryCoverage=99%, HitCoverage=63%, E-value=0.0, Identity=58%"; Hit description =Peptidase S8 and S53, subtilisin, kexin, sedolisin; Integrase, catalytic region; Zinc finger, CCHC-type
  Pfam annotation: Domain name=rve; Domain location=124-261; Score =53.9; E_value=5.5e-13; Accession=PF00665.16; Description=Integrase core domain
  Pfam module annotation: Pfam domain module=RVT_2::rve; Domain location=448-703::124-261
MDSGCTYHMCSVKDYFEDLEQKEHGTVLLGNNKACKVYDIGTVRLRMFDNREMLLQDVRYVPELKRNLISISMFDLMGYTTKVEDGMMKVSIGASIIAKGRRRNGLYILEGSTVIGQAFVASQTMEDKSKLWHLRLGHISEKGLIELEKQHLLMGDKLHKLEFCDQCVLGKSHRVKFGTDQFNTFYTHHGIKRHKIVAGTPQQNGLAERMNRTILERVRCMLLGVGLPKVLWGEAANTTVYLINRSPSSALEYKTPMEVWSGSPADYSNLRVFGALAYAHVKKDKLDARVVKCLFLGYAEGVKGYRLWRLDPKPFKLIISRDVTFDETRMGMYSENSECGKEKTHIEVEPLTNKVQENTQINPTTNLDSTTEETGHSASNLRRSDHDINDYQLVRDTERRIPKPNRKLGQADLICYALTAAEEIERSTEPRNFKDAHESEERQLWLHAMEEELEALRKNNTWRLVELPKGQKVVGCKWIFKRKGEIPGVQKTRYKARLVAKGFTQVKGVNYNEIFAPMVKHCSIIILMSIANQFKLHLEQLDVKTAFLHGNLEETIYMRQPEGFAVDDRVCFLQKSLYGLKQSPRQWYKKFDDFLIKMEFKRCSYDNCVYVLHQEDYLYLLLYVDDILVASCNKCMIDDLKSRLNSEFEMKDLGESRRILGVDIKRDQLKGTLLLSQQAYMHKVVERFRMHQSKLVSTPMGQHMKLSKSQGPISDDDRKKMDVVPYTSGVGSIMYGMVCTRPDLAHAMSVVSRFMVESGQAH

SEQ ID NO: 147098 - protein, 173 aa, Glycine max
  Coding DNA Sequence Number=SeqID_30320
  Gene Ontology: Mol. function=glutathione transferase activity; Cellular component=cytoplasm; Biological process=auxin mediated signaling pathway
  Homolog annotation: Hit_ID=Q9FQE9; Match level="QueryCoverage=89%, HitCoverage=99%, E-value=2e-72, Identity=68%"; Hit description =Glutathione S-transferase GST 9
  Pfam annotation: Domain name=GST_C; Domain location=53-149; Score =51.1; E_value=3.8e-12; Accession=PF00043.15; Description=Glutathione S-transferase, C-terminal domain
MADEVVLLGTWASMFGMRVRIALAEKVQYIDEVWNDKAPILPSDPYERAQARFWVDYIDKKVNDTWRKMWLSTGEEHETWKKEFISVFKQLEEALGDKPFYGGDTFGFVDLGLIPFYTWFYTFETYGNFKMEAECPKLVAWAKRCLQREAVSKTLPDEKKVYDHVGLKKAFES

SEQ ID NO: 147099 - protein, 86 aa, Glycine max
  Coding DNA Sequence Number=SeqID_30321
MTLSHSTNTFSLSIVLYLSISLIALLIPRLSAWCHFLRLYFLELRAWGSIYIVLERRTHLYNQQLSGTNVKGDHDGLMLVEIEEYI

SEQ ID NO: 147100 - protein, 219 aa, Glycine max
  Coding DNA Sequence Number=SeqID_30322
  Gene Ontology: Mol. function=glutathione transferase activity; Cellular component=cytoplasm; Biological process=auxin mediated signaling pathway
  Homolog annotation: Hit_ID=O49235; Match level="QueryCoverage=99%, HitCoverage=100%, E-value=3e-65, Identity=56%"; Hit description=2,4 -D inducible glutathione S-transferase
  Pfam annotation: Domain name=GST_C; Domain location=97-193; Score =61.8; E_value=2.3e-15; Accession=PF00043.15; Description=Glutathione S-transferase, C-terminal domain
  Pfam annotation: Domain name=GST_N; Domain location=3-76; Score=85.9; E_value=1.2e-22; Accession=PF02798.10; Description=Glutathione S -transferase, N-terminal domain
  Pfam module annotation: Pfam domain module=GST_C::GST_N; Domain location=97-193::3-76
MGDEVILLNFWLSPYGMRVRIALEEKGIKYESREEDLSNKSSLLLQMNAVHKKIPVLIHNGKPVCESLIIVEYIDEVWNDQSPLLPSDPYQRNQARFWANYVDTKMYEIALKFWRTEGEEKEAAKEEFSECLELFEEQLGDKPYFGGDNLGLVDVVLVPLICYFYVYNLYGNFINENKCPKIIAWAKRCTQKESVSKCFPEVQRVKEFISQKKKNLNSE

SEQ ID NO: 147101 - protein, 76 aa, Glycine max
  Coding DNA Sequence Number=SeqID_30323
  Gene Ontology: Mol. function=two-component sensor activity; Biological process=two-component signal transduction system (phosphorelay)
  Homolog annotation: Hit_ID=Q3KD89; Match level="QueryCoverage=93%, HitCoverage=10%, E-value=1e-15, Identity=59%"; Hit description =Putative diguanylate cyclase/phosphodiesterase (GGDEF & EAL domains) precursor
AKSEDATIVSAIVALAQSLDLKVVAEGVETQDQQAFLTGLGCDTLQGFLLGKPLPPERISELPDFVKDKPAALTAE

SEQ ID NO: 147102 - protein, 368 aa, Glycine max
  Coding DNA Sequence Number=SeqID_30324
  Gene Ontology: Mol. function=calcium ion binding; Cellular component =extracellular region; Biological process=pathogenesis
  Homolog annotation: Hit_ID=Q8XQP2; Match level="QueryCoverage=96%, HitCoverage=85%, E-value=3e-44, Identity=33%"; Hit description =Probable hemagglutinin/hemolysin-related protein
MSTALTNAKQLWTTDPQRTFSGSAPTEAGGIMEIVMDSTVYTVSIAANGSWSWQPPFPLAEGPHNLSVRTIDRAGNVGAPSLFIVNVDLTAPDQPLIIGVDDNAGNKTGPVSSGQQTDDRTPTLKGVAEPDSIVRLYNAQNQLIGSVKASSNGYWEITPTLADGEHSLYVTATDGRGYESEASNKFILNIADEYRAPDKVEIIQAVDDAGNSKGELKSGDVTDDTTPILRGTGIPGAIIEIQYRTSGGNWKAAGNATVDANGQWQIESPQLESNITISYQAREINSIEHGEWSEVFTLNIQPEVPVIVGALDDLSPSGGLIQHGGFTDDLTPILKGTGSPGQIITIEYGQFGDPWIAGGTAVVDKDGN

SEQ ID NO: 147103 - protein, 252 aa, Glycine max
  Coding DNA Sequence Number=SeqID_30325
MEWQRTNQLGSMTNGIHNEYNGEVAYRTIIVEKGKTYEVSFDALQHTSGGNYKSKLGMSIDGKSVIPETLQKTSWTHYTGYYTATETTKVKVAITNGTASTNGNDFAIDNIGIKPVEEKTDNHLTDMKTSNEVISLGDEQSSFDLANLLTEKGSVNTSNMSDKIDNDLLVDVKTILQHGEMNLFIENGNTQMKVNGDIGDVVKLKDLMPDSQDSVSWIQQNGNVTLAGIHYSVYNHGDAELLVQEGVKVELV

SEQ ID NO: 147104 - protein, 424 aa, Glycine max
  Coding DNA Sequence Number=SeqID_30326
  Gene Ontology: Mol. function=transferase activity, transferring nitrogenous groups; Cellular component=intracellular; Biological process=regulation of transcription, DNA-dependent
  Homolog annotation: Hit_ID=Q6D2U1; Match level="QueryCoverage=99%, HitCoverage=89%, E-value=1e-158, Identity=62%"; Hit description =Putative bifunctional protein, includes [GntR-family transcriptional regulator and aminotransferase]
  Pfam annotation: Domain name=Aminotran_1_2; Domain location=104-424; Score=-3.3; E_value=3.3e-07; Accession=PF00155.11; Description =Aminotransferase class I and II
  Pfam annotation: Domain name=GntR; Domain location=3-66; Score=63.5; E_value=6.6e-16; Accession=PF00392.11; Description=Bacterial regulatory proteins, gntR f
  Pfam module annotation: Pfam domain module=Aminotran_1_2::GntR; Domain location=104-424::3-66
MAKYQQLVDQLRTQIEARIWPPGEKLPSLRQQAEQSGFSLMTVMHAYEVLESQGWIVSKPQSGYYVAPRAAESRPRLPTQAIAKTDQADTNSFVFDVLQATRDPAIMPFGSAFPDPELFPQRQLMRSLVKVSHNLKPTDALNNLPPGNEALRKILAQRYAQQGITLSPDDIVITNGAMEALNLSLQAVTEPGDWVVIENPSFYGALQAIERLKLNAIAIASDVEQGIDLDELEQALQRWPVKACWLMTNRQNPLGFTLSAERKQQLVALLTRYQVAMIEDDVYSDLYHGHDKPLPARAFDREGYVLHCGSFSKNLVAGFRVGWVAAGRYAQRVQRIQMMSTLSTSAPMQLALADFLSTRSYDTHLKKLRQTLAKRKQLAQQALRRVLPAEAHISDTPGGYFLWITLPEQINATQLYHLALQQGI

SEQ ID NO: 147105 - protein, 228 aa, Glycine max
  Coding DNA Sequence Number=SeqID_30327
  Homolog annotation: Hit_ID=Q6SEZ1; Match level="QueryCoverage=84%, HitCoverage=85%, E-value=3e-57, Identity=58%"; Hit description =Oxidoreductase, 2OG-Fe(II) oxygenase family
MSALIRFDLHPLADADWRRHCRQQLEQHGALVLRQFLQPAALQAIVADGLAQRHLAYHTVSKHNVYLLKPDEAYRADHPRNRDVISTKGCITDDVIAAESPLRQLYNDELFKRFLCDVLDEDALYPYADPLSSINLHYAPDGQELGWHFDNSSFAITLLVQKPRGGGVFEYVKDMRDADAGEMNYDGVAAVLDQRQPVEALEIDAGELVLFRGRNSLHRVTPNEGDVT

SEQ ID NO: 147106 - protein, 79 aa, Glycine max
  Coding DNA Sequence Number=SeqID_30328
  Homolog annotation: Hit_ID=P16181; Match level="QueryCoverage=47%, HitCoverage=23%, E-value=4e-09, Identity=71%"; Hit description=40S ribosomal protein S11-1
  Subcellular localization annotation: CTP_CleavageSite=31; ConfidenceScore=5.18e-01
MSSKKTRKGKSPGKGGNRFWKSIMVGFKTPREAMKGDFFVFFSRYQGSLLIVFCVLLLFTSWKGDGLSVHHLFDSWFIY

SEQ ID NO: 147107 - protein, 76 aa, Glycine max
  Coding DNA Sequence Number=SeqID_30329
MALTELLYQELLVGGTYPVLPNSSFIYRHWVAKANSSVSGQQPSHSSLVAASAEAYAFSSVPFLGSPVDCPARVTP

SEQ ID NO: 147108 - protein, 136 aa, Glycine max
  Coding DNA Sequence Number=SeqID_30330
  Subcellular localization annotation: CTP_CleavageSite=98; ConfidenceScore=5.61e-01
MLGAPSNIAGAPSNLLKGQFCPSFKNIKSFFPLSEAFCLLHFLSSAKASFLFSLPQKLHWWSSSPRDFSASPWTHLHSSLGVLPELPEEGIQEDFRKRGSSESNKRIPEEDVFQKAPGTPLPECFWKNYFFRKFFL

SEQ ID NO: 147109 - protein, 112 aa, Glycine max
  Coding DNA Sequence Number=SeqID_30331
  Homolog annotation: Hit_ID=Q7N499; Match level="QueryCoverage=35%, HitCoverage=2%, E-value=8e-08, Identity=62%"; Hit description =Complete genome; segment 9/17
MMTNLAWLERLKESFASTGLNYEDLYELIKASIARGRASFPALIYDASRGIGFSVSEGFFYSLDQDWDDPKDFNEATNTFAVKAADVGPRTMFRPDPTQHGYPTNQDYFNAQ

SEQ ID NO: 147110 - protein, 96 aa, Glycine max
  Coding DNA Sequence Number=SeqID_30332
RAFAKRDTQWLGMRKNPEEDELLGSLSAPLQVIKRTASAHLLSEISALSQKSLTCAKRRFLDYGKINPLLELPWNWSDSKVLGSTGLNCSAITGDR

SEQ ID NO: 147111 - protein, 78 aa, Glycine max
  Coding DNA Sequence Number=SeqID_30333
  Subcellular localization annotation: CTP_CleavageSite=24; ConfidenceScore=5.01e-01
MYQRLHRMVLPHFASFHDTRPGIRSSARWSCSVAPSGPSVCYGIVERLERHLSLGVVTLGSSIHEVIEECLRMARSVT

SEQ ID NO: 147112 - protein, 106 aa, Glycine max
  Coding DNA Sequence Number=SeqID_30334
MDEDQWMYDNIMSEKVYMNKQNEDEVGVNEEHVDCCDAFNTFQVFATRDDVLHWARSVAYEIGFVAVIMRSGQYRSTKKDFVKIDADNRKCGCSFKLREKPVVGGQ

SEQ ID NO: 147113 - protein, 121 aa, Glycine max
  Coding DNA Sequence Number=SeqID_30335
  Gene Ontology: Mol. function=oxidoreductase activity; Cellular component=cytosol; Biological process=electron transport
  Homolog annotation: Hit_ID=Q6DAB8; Match level="QueryCoverage=91%, HitCoverage=58%, E-value=2e-47, Identity=76%"; Hit description =Putative modulator of drug activity B
AAGAVLLAGVGAGAAIAGVQAAVAGGEHFVDVFFQDPRLAHPPTRHLIDDRVGPQVFLHFGFDIIAVVDHRDLHLVLQIAQEAFRHVAQGLVEFAVGMAELLFSVDNQDIAHLLRLPSELR

SEQ ID NO: 147114 - protein, 345 aa, Glycine max
  Coding DNA Sequence Number=SeqID_30336
  Homolog annotation: Hit_ID=Q6CQF2; Match level="QueryCoverage=21%, HitCoverage=91%, E-value=2e-17, Identity=63%"; Hit description =Kluyveromyces lactis strain NRRL Y-1140 chromosome D of strain NRRL Y- 1140 of Kluyveromyces lactis
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGPGTTGLSPSLAPPSRGLGPGPPLDDAFSQTTIRTPRATDFHGGLFPRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 147115 - protein, 373 aa, Glycine max
  Coding DNA Sequence Number=SeqID_30337
MEELERVQFVVEHATELMSLYAAKRLAEMEVVTMSKDMDLAKQEVLKKAKLQSVIKVFLVEVEDDIVVADLGAEQVYPRPMTEVDEQIIDVAQFDTMDEDKHKRIEEAYGVLEYISIDVMTARLELNQMRKFILTSTTGYIMSSEDIKSWKGLPNIDPFHYPYNYTRDIHPNEEVDVIGRYGQREPVFQEFPIREIVSPNPNSLIFEHRPTTRKMYSPGATVWKSREVKPFEMPFSTPLDLQLFMGLICALYVVLPWDCTKFDKDALPTRYVKAHPRRLFKHELEALKKNTKLTMQPIIEEVDYDVEVVVDPDALAIKVYDPPPLMEAIGYESHRSLTPLGSPIDLSSDSYSSSDEFLRKIDEEFAKQKRENK

SEQ ID NO: 147116 - protein, 77 aa, Glycine max
  Coding DNA Sequence Number=SeqID_30338
  Pfam annotation: Domain name=AP2; Domain location=1-52; Score=-3.7; E_ value=0.0015; Accession=PF00847.10; Description=AP2 domain
MYRGVQRRKWGKYVAEIKDPKEIRKLTATLLGDATQVTGTGSLTYSQHELHCTQWAQQGEGLELGHTRERGESEVQL

SEQ ID NO: 147117 - protein, 71 aa, Glycine max
  Coding DNA Sequence Number=SeqID_30339
MAMCTNLLQGQASERALLRRHSSEDLFGVQRLNWRPPSYYGHDELETLMASDSTADWDADDREMSLVKDED

SEQ ID NO: 147118 - protein, 73 aa, Glycine max
  Coding DNA Sequence Number=SeqID_30340
MAEYDGSDNNSKESTTDEVDVMSRNFKCMFLNLNPFEGGIIAFGGTSKGKITDIGIIGIPSLASIDNVYMLND

SEQ ID NO: 147119 - protein, 122 aa, Glycine max
  Coding DNA Sequence Number=SeqID_30341
  Gene Ontology: Mol. function=RNA-directed DNA polymerase activity; Biological process=DNA integration
MMYGHLFPNLKQEHHWNKMGVQNKLDEQDDIIFRATNESLCKDFSDPMKNEFKMSIMEELQFLLGFQITQDSKGKYTREHLKQFEMEGVRPIKTPKPASNPFSKGESGKKEVELHCSVYNKS

SEQ ID NO: 147120 - protein, 58 aa, Glycine max
  Coding DNA Sequence Number=SeqID_30342
WSLAQQSPTPYVGRRDAITIAKEEHTADIMMADYRWRGGKLQAAQWRTSSSRPGRTDC

SEQ ID NO: 147121 - protein, 176 aa, Glycine max
  Coding DNA Sequence Number=SeqID_30343
  Gene Ontology: Mol. function=RNA-directed DNA polymerase activity; Biological process=RNA-dependent DNA replication
MIPKFPEADKGENFRPIALANFQFKIFADRVSNIAPNIISENQRGFIKGRSIFDCINTTSEWIRNFLWSGDVDIRKHVIVAWSSICKPFEEGGLGLRSMATINKATMLKLGWDMLSTDLQWAKILKAHVFRSREITSSHIGSSIWCGIKKPNCIMSLTAPLGLLVLLRSVFGKIGG

SEQ ID NO: 147122 - protein, 275 aa, Glycine max
  Coding DNA Sequence Number=SeqID_30344
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=6e-29, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Leu_leader; Domain location=194-217; Score=2.5; E_value=8.3; Accession=PF08054.2; Description=Leucine operon leader peptide
  Pfam annotation: Domain name=Leu_leader; Domain location=41-65; Score= 7.5; E_value=1.2; Accession=PF08054.2; Description=Leucine operon leader peptide
  Pfam annotation: Domain name=Leu_leader; Domain location=74-97; Score= 4.9; E_value=3.3; Accession=PF08054.2; Description=Leucine operon leader peptide
  Pfam module annotation: Pfam domain module=Leu_leader::Leu _leader::Leu_leader; Domain location=194-217::41-65::74-97
ELDVLTFRGLHVLAFRGRHAPTIRGPHALTFRGLYVLTFRVLHALAFRGLLVLAFRGLLVLAIRGLHVLTFRGLHVLTFRGLDAFTFRGLEVLAFRGMHALGFRGLDVLAFRGLHAFAFRGLDVLVFRGLDVLAFKGLHVFTFRVLYVLTFRGLDVLAFRGLHALAFKGLRAPTFRGLRALTFRGLHVLTFRGLHVLTFRGLHALAFRGLHVLAIRGQHVLAFRGLHILTFIGLHVLTFRELLVLTFRGLRALTFKGLHVLALRGLHAFTFKGRY

SEQ ID NO: 147123 - protein, 256 aa, Glycine max
  Coding DNA Sequence Number=SeqID_30345
  Gene Ontology: Mol. function=protein binding; Cellular component =cytoskeleton; Biological process=phagocytosis
  Homolog annotation: Hit_ID=O80516; Match level="QueryCoverage=99%, HitCoverage=100%, E-value=1e-105, Identity=71%"; Hit description =Expressed protein
  Pfam annotation: Domain name=ELMO_CED12; Domain location=91-236; Score=287.5; E_value=2.6e-83; Accession=PF04727.4; Description =ELMOCED-12 family
MDDRGSSFITVRRIPHGETCHSNSGILWHVGPHPAEVVVGSAAWLGRGLSCVCVQRRDSDASNTFDLTLAQEECLQRIQRRIDVPYDSSIIEHQDALRALWNAAFPEEELHGLISEQWKEMGWQGKDPSTDFRGGGFISLENFLFFARNFPKSFQDLLRKQEGDRSVWEYPFAVAGVNITYMLIQMLDLEAENESAFDLLYCITFKLMDHQWLSMHASYMDFNAVMKETRRQLEKELLVEDIAQLEDLPSYKLLSR

SEQ ID NO: 147124 - protein, 91 aa, Glycine max
  Coding DNA Sequence Number=SeqID_30346
  Subcellular localization annotation: CTP_CleavageSite=84; ConfidenceScore=5.22e-01
MGKMIFWHLLIFFIPKGITQPKIDSSFPNYIFRNFKRSSSSPTLPQSHYAGKSPNHSDAQQHTTTHNDTWRRTLIQSFPSTMTTTMHTQDV

SEQ ID NO: 147125 - protein, 103 aa, Glycine max
  Coding DNA Sequence Number=SeqID_30347
YTAIFRTVAAWREGVSQEEMAALLMWKASRHWEQRDSMLLASGSSETTSMSAFSPSTMAAPSSLSQVSMLLAIDNGGTLHVTKLLAIDNGGTHFSPLLLAASM

SEQ ID NO: 147126 - protein, 948 aa, Glycine max
  Coding DNA Sequence Number=SeqID_30348
  Gene Ontology: Mol. function=protein serine/threonine kinase activity; Cellular component=cytoplasm; Biological process=protein amino acid phosphorylation
  Homolog annotation: Hit_ID=Q336S1; Match level="QueryCoverage=51%, HitCoverage=48%, E-value=1e-148, Identity=53%"; Hit description =Protein kinase domain containing protein, expressed
  Pfam annotation: Domain name=Pkinase; Domain location=452-918; Score =147.4; E_value=3.7e-41; Accession=PF00069.15; Description=Protein kinase domain
  Pfam annotation: Domain name=Pkinase_Tyr; Domain location=452-918; Score=-124.5; E_value=7.8e-05; Accession=PF07714.7; Description =Protein tyrosine kinase
  Pfam module annotation: Pfam domain module=Pkinase::Pkinase_Tyr; Domain location=452-918::452-918
MAESEFEPNVDLEEKSWHLLALLLRIGHAVYPQRLAAQCRLFAASPNFVCHVGTLPGSPISVTDNGLVTPSVGTVFALGSFFSLHFSPPQPQTYRFRKRKSLFDYGEDGREHKKLAIRDGLREFSFQSFADTTETLMRRNFPVIKFESQNIGSRSFVFPLRIDKNEECSGCPMPNFEHREANNDARTTMSNGEVSESIIKALTKKKSIIKASYLNCLKLVDRNRFMDCNLFVDRALLDPSLCKDGIVNSLGFGKKMDSFGTFMHDYAEQNSIRHVDEDGIGKSNTCKDQPREPNEDDEVESGSQKGLIDSVTNRDKEDVAQRVNAALCREELTNGLEQKNRVHAMNLEKESERNTGTKSTNKIANSSSIPKRLLKSSSILKGGQKNDLHPKSQILKESLASNKFGNVPKNVDQCRNDQKLTARKQNRNENMAGIIATTTKVEKRAYPSFEAFTIEEEEGSGGYGTVYRAQRTTDGKRVAIKCPHSNAHKNHVNNERNMLERFGGKNYIIRYEGSLKNGNSDCFVLEHVDHDRPEVLKKEIDIVQLQWYGYCMFRALYCLHKEGVVHRDVKPGNFLYSRKLSKGYLIDFNLAMDLKQKHNVGSKSKPSLDASSNVISFSSGSAPLVRDKNLGGSKSLPSNKRALADYKNYSELNRNAKEKAYTVHLKNCPDKAGGSFLRAQGTDGSGITSAKDASTRTASAERLREPLPSHGRKELISLVNTMKCANSSTIGPSSQRKRVTAPSSKADDNIFYITPMPLHSSTVGGGLLRSKGDGKKKEGSCVGTKGFRAPEVLLRSQHQGHKIDIWSAGVTLLYLVIGKTPFTGDPEQNIKEIVKLRGSEEFWEVAKLHDRELSFPVELLNDRYLQSWDLEGWCKVHTKRPEFLEQIPKSLFDLIDKCLTVNPRNRLSAEDVLRHEFFDSVNESLRKKRMIHRHRALGSDDTAASRAI

SEQ ID NO: 147127 - protein, 139 aa, Glycine max
  Coding DNA Sequence Number=SeqID_30349
  Gene Ontology: Mol. function=RNA binding; Cellular component=nucleus; Biological process=mRNA processing
  Homolog annotation: Hit_ID=Q0ZCF1; Match level="QueryCoverage=92%, HitCoverage=50%, E-value=6e-67, Identity=92%"; Hit description=Mago nashi-like protein
  Pfam annotation: Domain name=Mago_nashi; Domain location=9-139; Score= 289.6; E_value=6e-84; Accession=PF02792.5; Description=Mago nashi protein
MGSEEENGEFYLRYYVGHKGKFGHEFLEFEFRPDGKLRYANNSNYKNDTIIRKEVYLTPAVLRECRRIISESEIMKEDDNNWPEPDRVGRQELEIVMGNEHISFTTSKIGSLVDVQSSADPEGLRIFYYLVQWWFCRDP

SEQ ID NO: 147128 - protein, 145 aa, Glycine max
  Coding DNA Sequence Number=SeqID_30350
  Gene Ontology: Cellular component=membrane fraction; Biological process=response to stress
  Homolog annotation: Hit_ID=P0AED0; Match level="QueryCoverage=97%, HitCoverage=100%, E-value=4e-71, Identity=92%"; Hit description =Universal stress protein A
  Pfam annotation: Domain name=Usp; Domain location=2-138; Score=66.0; E_value=1.2e-16; Accession=PF00582.16; Description=Universal stress protein family
MAYKHILIAVDLSPESQLLVDKAVSLARPYDAKISLIHVDVNYSDLYTGLIDVNLGDMQKRISEETHTALRELSTNAGYPISETLSGSGDLGQVLVDAIKKYDVDLVVCGHHQDFWSKLMSSARQLINTVHIDMLIVPLRDEEEE

SEQ ID NO: 147129 - protein, 40 aa, Glycine max
  Coding DNA Sequence Number=SeqID_30351
ELACLEYVTGSHWLTMPGLGQDWPSLVLGNNTPPDVPKVS

SEQ ID NO: 147130 - protein, 296 aa, Glycine max
  Coding DNA Sequence Number=SeqID_30352
  Gene Ontology: Mol. function=structural molecule activity; Cellular component=integral to membrane
  Homolog annotation: Hit_ID=Q1QV98; Match level="QueryCoverage=49%, HitCoverage=19%, E-value=4e-15, Identity=38%"; Hit description =OmpA/MotB precursor
  Pfam annotation: Domain name=OmpA; Domain location=178-281; Score =38.1; E_value=2.9e-08; Accession=PF00691.11; Description=OmpA family
MKTFSLTLLAALLAGSVTLSHSALAAKPFGELYQPVSGVPASQTQVVYYRTLAQSGNDAAHVYVDGEFQTALLPGGFSVFCLKPGSHSLDNYMKDAPRYSGKRAQAWRDNFAGGTTYFVRLGNVTTGQPQVVSRQQAERELNGAQQQIHALSRASAVVKCDNLAPRSYKDYVLAGDVLFNFGKSSIGDISAAGRRAVGALIAELQRDRAGLKSLEVIGHTDPIGNASANRQLGQQRAATVRQMLIDGGLPATVIRASSAGSSEPVVEYCEGSRAAQIACNAPNRRVVVRVALNQQP

SEQ ID NO: 147131 - protein, 129 aa, Glycine max
  Coding DNA Sequence Number=SeqID_30353
  Homolog annotation: Hit_ID=Q664F8; Match level="QueryCoverage=33%, HitCoverage=39%, E-value=2e-16, Identity=88%"; Hit description =Universal stress protein B
MSATQANNCYIPSIARVGSKCCKPKPGCESDHGLSLFSLALNENHRWKKFKQISYTENEGHSRPGSALSFSPLQVTSLRLQPGGEHDQHYRAFLGSVCGLSGEYGALLLIVALTAGGAARVRSVAVSVC

SEQ ID NO: 147132 - protein, 770 aa, Glycine max
  Coding DNA Sequence Number=SeqID_30354
  Gene Ontology: Mol. function=calcium ion binding; Cellular component =extracellular region; Biological process=pathogenesis
  Homolog annotation: Hit_ID=Q8XQP2; Match level="QueryCoverage=99%, HitCoverage=89%, E-value=0.0, Identity=45%"; Hit description =Probable hemagglutinin/hemolysin-related protein
  Pfam annotation: Domain name=HYR; Domain location=492-566; Score= -4.9; E_value=0.052; Accession=PF02494.7; Description=HYR domain
MVTADANGNWSYTPASDLRDGVHNISATSTNAAGNVSPETGVYPIEVDTTAPGNIINPVLTDDVGQVQGPIRSGETTDDATPTFSGKTEPGATVIVRDNGKELGRAVADDSGNWTFTPGTPLADGKHSFTAQPVDLAGNQGPIGGAIDFTVDTSAVVVALTRVEDNAGSVTGDLSSGQATDDTTPTLYGTATPNALVKIYDNGKLIGQVSANAQGQWNFTPGTALSEGSHALTVTATTEAHGESEPTSQFDLLIDLTAPNKGVIDSVSDDVGTVQGPIGKGGYTDDTTPTLSGRGTPGDKVTIIDNGTPIGEATVGNDGRWSFTPTTPLNDGTHNFTVVMTDPVGNSSAPSEIWPVIVDTQAPNPVVITSIIDNVGSVTGEIKRDGVTDDKRPTLNGTAEANSIVTIYVSGVLMGSVKADASGNWQHTLTRDLADGRHEISATATDAAGNISAPTPVWSITVDTVAPNLPAIVRVYDDAGSITGDVLNNGITDDKRPTISGTAEVNSIVTVYIDGTPAGTVRTDGSGNWSFTPGSDLADGLHRITATATDTAGNTSGQTAAWNITVDTVAPNAPVIVTIEDDVGSIKGNIDKNGVTDDKRPTLNGTAEANSLVTVYIDGIAMGSTRANGSGNWSFIPASDLTDGLHHISAKASDSAGNSSGEAQTWDITVDTVISTPTIDTVYDNAGSKTGNVANGGKTDDTTPTLSGKAEANSVVTIYDGSTKLGSVTAGADGKWTFTPSPALSNGDHHFNVQASDRAGNISAKSSNWM

SEQ ID NO: 147133 - protein, 39 aa, Glycine max
  Coding DNA Sequence Number=SeqID_30355
MTPLIKKIKGLQGPHEATSCGIRAKVLRKKVQSFYNLEI

SEQ ID NO: 147134 - protein, 144 aa, Glycine max
  Coding DNA Sequence Number=SeqID_30356
  Homolog annotation: Hit_ID=Q09JM0; Match level="QueryCoverage=39%, HitCoverage=98%, E-value=1e-10, Identity=63%"; Hit description=10 kDa putative secreted protein
MPSGAKPEETLVEARSDTDVQIVRLTWVGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHVNGTCTW

SEQ ID NO: 147135 - protein, 120 aa, Glycine max
  Coding DNA Sequence Number=SeqID_30357
  Gene Ontology: Mol. function=protein binding; Cellular component =integral to membrane; Biological process=xylan catabolic process
  Homolog annotation: Hit_ID=Q1SWI7; Match level="QueryCoverage=96%, HitCoverage=18%, E-value=7e-43, Identity=69%"; Hit description =Leucine-rich repeat
  Pfam annotation: Domain name=LRR_1; Domain location=27-48; Score=8.5; E_value=7.5; Accession=PF00560.23; Description=Leucine Rich Repeat
  Pfam annotation: Domain name=LRR_1; Domain location=3-25; Score=16.6; E_value=0.091; Accession=PF00560.23; Description=Leucine Rich Repeat
  Pfam module annotation: Pfam domain module=LRR_1::LRR_1; Domain location=27-48::3-25
MGSLQSIDFSRNQLSGEIPPTIANLSFLSMLDLSYNHLKGNIPTGTQLQTFDASSFIGNNLCGPPLPINCSSNGKTHSYEGSDGHGVNWFFVSMAIGFIVGFWIVIAPLLICRSWRLINL

SEQ ID NO: 147136 - protein, 351 aa, Glycine max
  Coding DNA Sequence Number=SeqID_30358
MEEVVVLGQWLVVEIQEVEVQLEVEENDTKIGELSGDGILHGEPKLLIFLFKGVGPETVEYTMMTSSSPLSLEVASFKVIDCLDVGSRVSCSTSSAMAALHASRVSSRTLVLANSLLSAKCKPIWWHLDNIWLHWTSPLWEWKMNYDICWYNLKGLRRRVLIVILHLCRCLDIDGFLLKRFNKDEFRGSLGLAFQNLSRWMKDEGGVDCEIAHPFSPILGLTFVVFVLMRLGIKEGMIDSLGSGGVLGITVYLVEDMIHVLIPQHLVYERNIIDVVQTTRSFQVSQDVDVDGVWQNTLVQNVGPNFVLLAHECSTWMDGSLSVWMVVISRVGIVSVTGELELTIVESLRVR

SEQ ID NO: 147137 - protein, 70 aa, Glycine max
  Coding DNA Sequence Number=SeqID_30359
MDARAQFAALKKGKVGKGKTDQGKADKKRKALISKTTLGEEKDTKDHTKKVQVEITYPFENVDDVNAQKV

SEQ ID NO: 147138 - protein, 51 aa, Glycine max
  Coding DNA Sequence Number=SeqID_30360
  Gene Ontology: Mol. function=phospholipase A2 activity; Biological process=lipid metabolic process
  Homolog annotation: Hit_ID=O23180; Match level="QueryCoverage=90%, HitCoverage=12%, E-value=1e-12, Identity=67%"; Hit description =Patatin-like protein
LKTVPSFDAKLSDICIGTSAAPTYLPPYYFENDGTEFNLVDGGVAATNPVN

SEQ ID NO: 147139 - protein, 117 aa, Glycine max
  Coding DNA Sequence Number=SeqID_30361
MAAVNEVIKQQKLEKNLDISYKKSNEYTKILLLSIGCGTAKAVGYDAQVADQFSATVWAGSGLATNAYDYASKDMTEFYLTTVYPGLQSSDYYLRIQIIVIRIFIDFLTINLGLRID

SEQ ID NO: 147140 - protein, 165 aa, Glycine max
  Coding DNA Sequence Number=SeqID_30362
MTTYYDIGLGTSIWSQGEEKKERDVPSGVGAQLGTCKSQSKLQWGSLFNGHPEKPMTLHTSMLCEENSEVKHPKVGVAPLCQNPIPTVSIEQPHIDSLSLNSPQGLKKEDVQWCLYHTLYVLDKVVLFLGLKTKPIIAPANSWVIGKNQIAKVPELVCKYQFKVC

SEQ ID NO: 147141 - protein, 102 aa, Glycine max
  Coding DNA Sequence Number=SeqID_30363
  Homolog annotation: Hit_ID=Q9FZ09; Match level="QueryCoverage=72%, HitCoverage=17%, E-value=3e-07, Identity=42%"; Hit description =Patatin-like protein 1
MRNLNAQEYNLDPSMDALDNATAMNLENLEKVGQNLLKQPVYSMNVTTFQPEEEKEWGTNAKALKRLAEVLYTEKQLRLRNKSKEKRGRPFIKAVTDLFDRS

SEQ ID NO: 147142 - protein, 270 aa, Glycine max
  Coding DNA Sequence Number=SeqID_30364
MTTYHHPHYSSYGTSMAALHSCKTTLYYPPQHHLKFSSATEDCLEAALAKLTLSQHNLAASIDTLATTIDNLLQRLPRNPTPHFSSSILAQAPTPAAIILTPLMSSPWLMPTPSQTSSSPPPPPPLLKLTPSPTLTAFTTEPPPPATTPPPATTPPLPHSPPLLSLVPIQPWPTTWSGSLPMFVLHLSDLVCTIIPFIKLFSIVPPCGTAMAAYTLPTMTVAFCTTTKPGAIPRNKPWDPGITFGSDVLIPQHLEDKVFLMRAGMIGIIL

SEQ ID NO: 147143 - protein, 33 aa, Glycine max
  Coding DNA Sequence Number=SeqID_30365
MARLQQGLKGVSLLSRNCHALLLDDFCVQASYF

SEQ ID NO: 147144 - protein, 40 aa, Glycine max
  Coding DNA Sequence Number=SeqID_30366
FGTRLTIEDSRIENFFNMTLVDVEMLEHEEVMREECAFTS

SEQ ID NO: 147145 - protein, 53 aa, Glycine max
  Coding DNA Sequence Number=SeqID_30367
MEALKMKLFFVVMAMLIMAASAADSPAPSPTSDATTLFVPTALFLRLISIKFA

SEQ ID NO: 147146 - protein, 444 aa, Glycine max
  Coding DNA Sequence Number=SeqID_30368
  Gene Ontology: Mol. function=structural molecule activity; Cellular component=protein complex; Biological process=microtubule-based movement
  Homolog annotation: Hit_ID=Q1RTP0; Match level="QueryCoverage=96%, HitCoverage=96%, E-value=0.0, Identity=84%"; Hit description=Cell division protein FtsZ
  Pfam annotation: Domain name=Tubulin; Domain location=48-245; Score =317.7; E_value=2.1e-92; Accession=PF00091.15; Description =TubulinFtsZ family, GTPase domain
  Pfam annotation: Domain name=Tubulin_C; Domain location=247-392; Score=260.6; E_value=3.1e-75; Accession=PF03953.7; Description =TubulinFtsZ family, C-terminal domain
  Pfam module annotation: Pfam domain module=Tubulin::Tubulin_C; Domain location=48-245::247-392
MREIISIHIGQAGIQVGNSCWELYCLEHGIQPDGTMPSDGSNDAHDAFNTFFSEIGTGQYVPRALFVDLEPSVIDEIRCGPYKQLFHPEQLMSGKEDAANNFARGHYTVGKEIEELCLDRIRKLADNCTGLQGFLVFNAVGGGTGSGLGSLLLERLSVDYGKKSKLGFIIYPSPQVSTAVVEPYNTVLSNHSLIEHSDVVVLLDNEAIYDICRRSLELERPNYTNLNRLISQIISSLTTSLRFDGAINVDISEFQTNLVPYPRIHFMLSSYAPVISAAKAYHEQLSVPEITRAVFEPSSMMVKCDPRHGKYMACCLMYRGDVFPKDVNLAVSNIKTKRQVQFVDWCPTGFKCGINYQAPTVVPEGDLAKVQRAVCMISNNTAVAEVFSRIDHKFDLMFAKRAFVHWYVSEGMEEGEFSEAREDLAALEKDYEEVGDEGVDEDDV

SEQ ID NO: 147147 - protein, 345 aa, Glycine max
  Coding DNA Sequence Number=SeqID_30369
  Gene Ontology: Mol. function=transcription factor activity; Cellular component=nucleus; Biological process=regulation of transcription, DNA-dependent
  Homolog annotation: Hit_ID=Q1RTN9; Match level="QueryCoverage=95%, HitCoverage=100%, E-value=9e-45, Identity=41%"; Hit description =Pathogenesis-related transcriptional factor and ERF
  Pfam annotation: Domain name=AP2; Domain location=41-105; Score =136.3; E_value=8.2e-38; Accession=PF00847.10; Description=AP2 domain
LRKFFCYFVMEIQFQHPKQHLRANTSKGGKVFKGRNNNKTKSKYVGVRQRASGKWVAEIKDTTQKIRMWLGTYETAEEAARAYDEAACLLRGSNTRTNFITRVSLDSPLASRIQNLLNSRNGTKTKHQEQDVETCHTRIKSNRQESSVALAEGTCPPQHDELRFESSLEDMSTFSIQPYIDQDCLQKKILVENEKKRRVNSTTSTASASTSNSTNSSNNSDTCENSLSSETTQNTQQFDDDDDAYRPDLSNFIGSESGSQNNPSWGFEPSSFVHFPFSQVMDVANLPDIAGLELPDFERMKVERQISASLYAINGVQEYMDTVTVQDSNNNVAIWDFPPLCSFLC

SEQ ID NO: 147148 - protein, 327 aa, Glycine max
  Coding DNA Sequence Number=SeqID_30370
  Pfam annotation: Domain name=Transposase_23; Domain location=143-208; Score=-1.9; E_value=0.0018; Accession=PF03017.5; Description =TNP1ENSPM transposase
QKLLAEKTKKKLEEAAQSGSVDGVIDPPSPVRCHVKWKMTSTKKTGEMMTEAAKEIAEKIDSFEEQATQGSFVPHGCQDVLTAAIGHPEHPGRVRAAGAGVTIKQYFGSAPQTKSDAAAHGIIQPDAVPDLVPDAISGTCTASRASGWSLRSCPLVAMGRVYEGSTVVHNTPLLPGQVKVSVEEVTDTDAPVPVPTDEVSLVGQALHRFLAWPTHLVKSLSQQVAVSPTKLPPKPDPEVDDPLYLMTLTIPEIFLRPYQVRWDATVFGVFNPDFPLYIKHKDLSEISHSGQCLSISVLQLWILHLTETCMRVGNSDIYGFLEPQSIQ

SEQ ID NO: 147149 - protein, 142 aa, Glycine max
  Coding DNA Sequence Number=SeqID_30371
  Gene Ontology: Mol. function=protein transporter activity; Cellular component=membrane; Biological process=intracellular protein transport
  Homolog annotation: Hit_ID=A0F0A7; Match level="QueryCoverage=90%, HitCoverage=46%, E-value=3e-34, Identity=62%"; Hit description =Syntaxin
  Pfam annotation: Domain name=Syntaxin; Domain location=35-140; Score =81.4; E_value=2.9e-21; Accession=PF00804.15; Description=Syntaxin
MHLRSESFEIPRGQGHGGGGDIELGEYARNSGDLGLDSFFKKVQELDKQYAKLDKLLKKLQDAHEESKAVTKAPSMKAIKQRMEKDVDEVKKTAHYLKTKIEELDKENLANRQKPGCGKGSGVDRSRTATTMSVIIQLFNSL

SEQ ID NO: 147150 - protein, 186 aa, Glycine max
  Coding DNA Sequence Number=SeqID_30372
  Gene Ontology: Mol. function=shikimate kinase activity; Cellular component=plastid; Biological process=aromatic amino acid family biosynthetic process
  Homolog annotation: Hit_ID=Q9LW20; Match level="QueryCoverage=65%, HitCoverage=43%, E-value=1e-34, Identity=60%"; Hit description =Similarity to shikimate kinase
  Subcellular localization annotation: CTP_CleavageSite=81; ConfidenceScore=5.60e-01
MEKVSPCHTNTPLPLPNRPSNFLQFKHQTFFFKFPNPNPNPNPNPNPNLVRLRRLNCSVSDGTVPSSVGATDSSSLAVKKKAAEVSSELKGTSIFLVGLKSSFKTSLGKLLADALRYYYFDSDNLVEEAVGGALAAKSFRESDEKGFYECETEVLKQLSSMGRLVVCAGNGAVTSSTNLYGFITAS

SEQ ID NO: 147151 - protein, 641 aa, Glycine max
  Coding DNA Sequence Number=SeqID_30373
  Gene Ontology: Mol. function=nucleic acid binding; Cellular component= intracellular; Biological process=extracellular matrix organization and biogenesis
  Homolog annotation: Hit_ID=Q9SHG6; Match level="QueryCoverage=100%, HitCoverage=75%, E-value=0.0, Identity=56%"; Hit description=Similar to tuftelin-interacting protein
  Pfam annotation: Domain name=G-patch; Domain location=197-240; Score =69.9; E_value=8.4e-18; Accession=PF01585.13; Description=G-patch domain
  Pfam annotation: Domain name=TFP11; Domain location=411-641; Score =377.2; E_value=2.5e-110; Accession=PF08697.1; Description=Tuftelin interacting protein 11
  Pfam module annotation: Pfam domain module=G-patch::TFP11; Domain location=197-240::411-641
MDEDQEMERFGMENDYEGGQWIGGEFYYKNRKEKRTQTKDDVLYGVFADSDDNDDDDYPSRKRRKDFSKKPDLTKPVNFVSTGTFMPNQEIDNKSKEQDEKDGYVSEDRPGLGLGFGMGSGLGFNSGNAANGSNRNDDSDENDDNSFLPTAFGKKIKEGAMRRERERERERLEKKRGKHQSAGQDVSGDVGKFEKHTKGIGLKLLEKMGYKGGGLGKNEQGILAPIEAKLRAKNSGIGFNESKETMPLPVLQQEKKNVPEITQPVVGRMKERLWSKQARSKKKKEEQYITAEELLASKQEQELEVVQKVYDMRGPQVRVLTNLSDLNAEEKAKENDVPMPELQHNVALIVRLAEADIQEIDRDLRRERETALSLKNEKEKLETETVFQKKQLDNMEEIMSVLDRVGEENTLGTLTLDSLAQYFRDLLKRSADNYKLCNLSCIACSYALPLFIRVFQGWDPLRNPSHGLELVSQWKALLEGEDYFDIWDVSSPYTQLVSEVVLPAVRISGINTWQARDPEPMLWFLESWEKLLPSSVLATILDNIVMPKLSSAVDTWEPHRETIPIHTWVHPWLPLLGNKLEGIYQVIRFKLSTVLGAWHPSDGSAYAILSPWKTVFDSASWEQLMLRFIVPKLQLVLQEFQ

SEQ ID NO: 147152 - protein, 482 aa, Glycine max
  Coding DNA Sequence Number=SeqID_30374
  Gene Ontology: Mol. function=nucleic acid binding; Cellular component= intracellular; Biological process=extracellular matrix organization and biogenesis
  Homolog annotation: Hit_ID=Q9SHG6; Match level="QueryCoverage=93%, HitCoverage=50%, E-value=1e-161, Identity=62%"; Hit description =Similar to tuftelin-interacting protein
  Pfam annotation: Domain name=TFP11; Domain location=17-249; Score =400.5; E_value=2.4e-117; Accession=PF08697.1; Description=Tuftelin interacting protein 11
MEEIMSVLDNVGEENTLGTLTLDSLAQYFRDLRKRSADNYKLCNLSCIACSYALPLLIRVFQGWDPLRNPSHGLELVSQWKALLEGEDYVDIWDVSSPYTQLVSEVVLPAVRISGINTWQARDPEPMLWFLESWEKLLPSSVLATILDNIVMPKLSSAVDTWEPHRETIPIHTWVHPWLPLLGHKLEGIYQVIRFKLSTVLGAWHPSDGSAYAILSPWKTVFDSASWEQLMLRFIVPKLQLVLQEFQVNPASQNLDQFYWVTNWASAIPIHLMVDMMDKFFFAKWLQVLYHWLCSNPNFEEVTKWYLGWKELIPKELLANESIRYQLNRGLDMMNQAVEGMEVVQPGLKENISYLRVLEQRQFEAQQKAAAYTQQQAAASLGGAVNADGAHELSLKEVIEAHAQQHGLLFKIKPGRMHNGHQIYGFGNVSIIIDSLNQKVYAQNEEMWSLESLHGVYKPWYFSCCINESFSQSDDGPANYSK

SEQ ID NO: 147153 - protein, 47 aa, Glycine max
  Coding DNA Sequence Number=SeqID_30375
FPEDACKGSKGSECSMGQAFLLQILYPELPGGRSCGSHVSLIFVLNP

SEQ ID NO: 147154 - protein, 449 aa, Glycine max
  Coding DNA Sequence Number=SeqID_30376
  Gene Ontology: Mol. function=transferase activity, transferring glycosyl groups; Cellular component=integral to membrane; Biological process=protein amino acid glycosylation
  Homolog annotation: Hit_ID=Q5DTC7; Match level="QueryCoverage=83%, HitCoverage=91%, E-value=1e-150, Identity=65%"; Hit description =Alpha 1,4 fucosyltransferase
  Pfam annotation: Domain name=Glyco_transf_10; Domain location=86-449; Score=-124.0; E_value=3.7e-06; Accession=PF00852.10; Description =Glycosyltransferase family 10 (fucosyltransferase)
  Subcellular localization annotation: CTP_CleavageSite=41; ConfidenceScore=5.13e-01
MTFSDFYTIPITRYFPPFKVLSTIHFTFFTLHSEERMRVPNCSSFFTLPLRHFITLANTLGFILLILFISGIIEFPSFSLLSQFSTQPIKDQSKAFTDVVGAFKKWDSEVGCARFKKEINQQRNGSNYGFSTSLQDQFGGQLECGVLKMKHVSILVKGWTWIPDNLNNMYICPCGLSCLWTKSLVLADNPDAFLFETTKPPAQRSIGQPLRVYMDLEPKRKRSGREEIFISYHAKDDLQSTYASSLFHNGRNYHISSHKNNVPLVYWSSFPCTTQRNKLAHKILSLLPHHSLGKCLNNVGGKNKAPRLYPECVDNAAKLTKWWNHLHCVMSHYKFVLVIEGTWTESYITEKIFYALDSGAIPIYFGAPNIMDFVPPHSIIEGVKFKSMEELASYVKAIADDPIAYGEFHAWRRCGVLGNYAKTRALSLDTLPCRLCHAISKKGGRNADA

SEQ ID NO: 147155 - protein, 290 aa, Glycine max
  Coding DNA Sequence Number=SeqID_30377
  Gene Ontology: Mol. function=amino acid-polyamine transporter activity; Cellular component=membrane; Biological process=amino acid transport
  Homolog annotation: Hit_ID=Q10NY9; Match level="QueryCoverage=95%, HitCoverage=52%, E-value=1e-56, Identity=44%"; Hit description =Tryptophan/tyrosine permease family protein, expressed
  Pfam annotation: Domain name=Trp_Tyr_perm; Domain location=6-273; Score=-104.3; E_value=1.4e-09; Accession=PF03222.4; Description =Tryptophantyrosine permease family
MRNKGKKQEDNELDVISIRTMAQETLGDWGGTIATIAYVFLGYSSMVAYSSKSGEILFQLINLPAPVSGSLFTALFTMLVSIWGTRATDRVNQYLTASMIGLLLAIEVLAVVFGGWSGVGGISDWTKIPPTIPVIIFSLVFHDLTPFICSYLEGDIRRIKTSVFLGALVPLVAVLVWDAVALGLAAEAEQVVDPVQLLYRLRWNGVSIMVAAFSLLAVGTSLIGTLLAFSEFFKEQLKNGTWHSLPTKKENWWGRNKINVIAATMVVAPSLFVSTTFPDAFSAATDIAVS

SEQ ID NO: 147156 - protein, 90 aa, Glycine max
  Coding DNA Sequence Number=SeqID_30378
  Subcellular localization annotation: CTP_CleavageSite=51; ConfidenceScore=5.27e-01
MDSRCITSSPSLHLRLKIQRNAKQKPVIRRKHFARKAQKFSTGLSKRTSKVAEKKEGTVAGAVALIIGTSIGTGILALPEKAFPAVLPFL

SEQ ID NO: 147157 - protein, 38 aa, Glycine max
  Coding DNA Sequence Number=SeqID_30379
MTESESETVSDTEDSGFNATKVRVTTGLRETIHEGDEE

SEQ ID NO: 147158 - protein, 128 aa, Glycine max
  Coding DNA Sequence Number=SeqID_30380
MGKVEEAQEQVKADMEAMKEQMATIMEAMMSMKKIMEANAVTVAATNAIAKVNPMPPSGLNQMNHPTSDMVGKDLGSTAQIQNKHAFPPYGLPPNYTPPNVAYIPNEDVNNSAPILIESRQPHHAHVS

SEQ ID NO: 147159 - protein, 471 aa, Glycine max
  Coding DNA Sequence Number=SeqID_30381
  Homolog annotation: Hit_ID=Q4UXG6; Match level="QueryCoverage=23%, HitCoverage=5%, E-value=2e-32, Identity=64%"; Hit description=PilL protein
MLDLGTAADYLRGVQQYIEAELIGRQRVPSGRQLDTLADAMASLEYYLEALRDRRPGREDILDITRSSLEALRYWPLPDRNAVEPVAAAPIPFASLLIEREPVALQAEPLQPERIEIPVQPAAPAAGTVPVPLPDFTFDPPPATPAPEVVDNSLMFGALGSAASAPLSLQDDADAPLVFAASSAPAPDVPQWDLAPFHSDSDPAASAEDERSPTFASFDPVSFERAETGVGSAPQWTLSEATPPAVADVAVMAVEDDVEASVPFDTADFAAPVFDPVAAEHDAVAAGEDVVFRFDADALDNADDVLSLHAMETLSLDDDAGLHPSLEIVDAATPLRVDESPVVAGVDAVPADVPEDVPAPMAEVLAPASDAPAPAVSVSVSVIDIDTIAPIDFSEADAQFFAELSAAAADFNPQAMAAPPAADIPVVAGTEAGFEAGFDDDAENIDEDIREVFLEEFDDELANLGTLLPAW

SEQ ID NO: 147160 - protein, 108 aa, Glycine max
  Coding DNA Sequence Number=SeqID_30382
  Subcellular localization annotation: CTP_CleavageSite=37; ConfidenceScore=5.10e-01
MGERMNGKGGSSSSSSSPSVNHPGRRFWKCPHWNESSSSKKFEWIGDIETGKNVFVKGSELVRYVQENEESKLKLASLREEATTNAEEITYLRKKNCCTRGIMLCILN

SEQ ID NO: 147161 - protein, 216 aa, Glycine max
  Coding DNA Sequence Number=SeqID_30383
  Pfam annotation: Domain name=zf-CCHC; Domain location=153-170; Score =16.6; E_value=0.0018; Accession=PF00098.13; Description=Zinc knuckle
LKFNDDAYVSIVFESKPSKTVLTINFKDGAYVNTVLEGWRFSKMVAFDPSLKGLAFDNVGFYDGQRPSLALLGMRSFRVDWIPVVLNIEGWRQLKARLLRLWNPNSGMKVVDGDGPLPSYSKVASWIQPSKNELKKVPVWIRVFPMEYEGLNLVCFGCGQFEHKKEQCKAFDKGPEIVGVGLLLMQSYPARALDRRLQEDWAKDAREGPRVLMSLR

SEQ ID NO: 147162 - protein, 148 aa, Glycine max
  Coding DNA Sequence Number=SeqID_30384
  Gene Ontology: Mol. function=RNA-directed DNA polymerase activity; Cellular component=extracellular region; Biological process=RNA -dependent DNA replication
  Homolog annotation: Hit_ID=Q1S4V6; Match level="QueryCoverage=91%, HitCoverage=18%, E-value=2e-26, Identity=42%"; Hit description =Ribonuclease H
MEVIQDCLEEFSNASGQYLGFPLLHRKEKNEQYHHILQKANQRLASWKAKYLAFVRRITLAQSVIQVIHAYTMQSITIPNTTCDELEKVQSKFIRNDGEAGKGWHTISWKVFGKSKKDSGMGFKKLHSFNKAFMMKLAWEIIDKPNDL

SEQ ID NO: 147163 - protein, 103 aa, Glycine max
  Coding DNA Sequence Number=SeqID_30385
MSVVYGAPKQTNRDDSFKNIVQGVWEGDRQWDQATSNFKEQAGHWNQHHFGSIFHLKGRPVARMEEVDKSMMLRTSQGLVKLKEYLWKKYQKILHHEDAFWYQ

SEQ ID NO: 147164 - protein, 141 aa, Glycine max
  Coding DNA Sequence Number=SeqID_30386
KPEVGPSAARVSIKGSCVDPSSTDPDTGDSDKCRLYIKENPSHLVALGRVLKVGVEEVKDAEALIPVPTDDVILVGQAINTFLAWPTHLVKRLSEQLCLQQNLQIGWIMRSRIPYICDIDHPIAFFEASLGYVGCYRVHGV

SEQ ID NO: 147165 - protein, 109 aa, Glycine max
  Coding DNA Sequence Number=SeqID_30387
  Subcellular localization annotation: CTP_CleavageSite=76; ConfidenceScore=5.20e-01
MCPPTIESGAPRIYCLALFANSPFSTFIRSPMNLLPSAVHVSSTIESGAPRIYCQALFANSPFSTFFRRPMNSLPSAVHVSSTIESGAPRIYCLALFANSPFSTFFGAP

SEQ ID NO: 147166 - protein, 136 aa, Glycine max
  Coding DNA Sequence Number=SeqID_30388
MACNLRLTASRNLTPIVKQSVKFRDMSGVERKHYYAIHKQFESRPFSNILEVGLLKGGSNWAASSSTFLKNGFRGFRGFRNDSVKFSENLGKIESKYFRNASVSDYVGNFSSFFVVLHRSSSVLCSFFVLQRFSFL

SEQ ID NO: 147167 - protein, 245 aa, Glycine max
  Coding DNA Sequence Number=SeqID_30389
  Subcellular localization annotation: CTP_CleavageSite=87; ConfidenceScore=5.55e-01
VWSVLSYSNLAPTSHTSNLTADRARLIFGLVSQMDMNVRALISGQITSMAQSNSTRLGFPALITALCKSRGVASDSLVFERLSPVINLAYIWKNCWNPDDLTVTIRGARRARTRLAEAPSTSTTPPLAPWPGTQFSLHKEDEGPTAQVPQQMEVESSKTTIPKPLVRRKKADETQEAAATSEKSLEATSEPSEPVADTTSPQQAAESSTPEDQTTPVLSLNTSPTAIPVLYLTDEEDVQTQDTHD

SEQ ID NO: 147168 - protein, 88 aa, Glycine max
  Coding DNA Sequence Number=SeqID_30390
TSALKGLDDTPQPKSKAAARWIVIKCNRQKGITECGYYVMRWMSTIILGSFRNNWETYFNEVRPLEAERFKALRIQWVHYYLKVRNQT

SEQ ID NO: 147169 - protein, 126 aa, Glycine max
  Coding DNA Sequence Number=SeqID_30391
MAYRVKIRTHTLAHTPRSATRQKKEDAEADRVLQDASKEEGEDTKREEDDEGKKKNDEVLIPKTKSQLAREAKREIPPASPKEAPLMAACLRSFYGGWIFELQWGPSMVIFHHGDTMDDKGEEVRG

SEQ ID NO: 147170 - protein, 40 aa, Glycine max
  Coding DNA Sequence Number=SeqID_30392
MEEARGEALAAQQHWFHRSNKPSGNRLQDVVIDYRLPVLV

SEQ ID NO: 147171 - protein, 94 aa, Glycine max
  Coding DNA Sequence Number=SeqID_30393
MTMPRLGRDWSSLVLGNSTPPGIPKVSWPPRHISRKTDSSTLSHFKLVGLWGTHHMWYYVAIGRWCKSTLHIHKSHINPPSPVAHLQLSSRTST

SEQ ID NO: 147172 - protein, 117 aa, Glycine max
  Coding DNA Sequence Number=SeqID_30394
MEMGVKPSEVINNGPQMKLRIPWRWVLHPHFAKYTPTFVFLADFSLKHPGTLRIPRKIVMPPKASGASLQGGRSNRKDFKLALPEPSPKRVLPSKIGSSTQAGSSTQKSKQQDGSFT

SEQ ID NO: 147173 - protein, 238 aa, Glycine max
  Coding DNA Sequence Number=SeqID_30395
  Gene Ontology: Mol. function=nucleic acid binding; Biological process= transport
  Homolog annotation: Hit_ID=Q8H6Q8; Match level="QueryCoverage=79%, HitCoverage=44%, E-value=2e-22, Identity=37%"; Hit description=CTV.20
MVATAYQTSHECPEETIVDILVAGFSGQLKGWWDNYLTNDGKSKIYSAIKMDLNGKVITNDDNEEIPDAVNTLIFTIAKHFIGDPSLWKDRSAELLSNLKCGTLVADFRWYRDTFLTRVYTREDSQHSFWKEKFLSGLPRSLGDKVGDKICSQSTNEDIPYDSDDKIQRQLAKEKAQNKRDLGSFCEQFGLSACPKQKKKQNPKTKFQKKYAPKRRFSKEETGEVSLEENLNQIQQDD

SEQ ID NO: 147174 - protein, 62 aa, Glycine max
  Coding DNA Sequence Number=SeqID_30396
MVNQKVLKGCSCLKVIFHKSVVAWVNVEKVGSLPFKYLGLPTEENPRKKDTLKPTSKVIRKR

SEQ ID NO: 147175 - protein, 248 aa, Glycine max
  Coding DNA Sequence Number=SeqID_30397
MSHELVNDTNIFFKKYVEARYYASLKREVYIEKKVELEEEEFTVIQDTFEERRWNKLKEPCVCSETLTRLVPLPPKPLILNEILEKMHEEMTLKMGVNQTSNLLLFEDLRELMVKDTIGGAKGDVVTNEEPAVRIDEDVTEHMEPIVKVFIKAMTDVDVEPINGELNDSGAMEGDVVMEETSARDVIAEDDEATSKETNELANIIGGVIFVIAEETTIEMEAEKDVEVVGDTTEGVTNAEEMEEEIVP

SEQ ID NO: 147176 - protein, 195 aa, Glycine max
  Coding DNA Sequence Number=SeqID_30398
MVVFNSQSAILLHLLQGISPEFASYIEVKKEISDEKPFKVLKKNSDAFAIPMKELKVLQSYKANWIYRENVKIQTTLEDLKLPHESLHSLNDKCFSGLVLCEPLIPLLMANFVSSRGGKRVEVEPKTDEDSSEEEEEFQQIEKRLENESYLSPDKHAEKENGGNDLIKEKSMNENAPQKDGASDLALTRGIILVE

SEQ ID NO: 147177 - protein, 101 aa, Glycine max
  Coding DNA Sequence Number=SeqID_30399
MAKNEMKITGLMIMFMIVLGFSQANYNPSFVKIGSNRVYDGVYCQDKCSSACAKFLLLPGGVLAYVICLYACTAKCHDNPIDVAHDCITGCALKNSVDANI

SEQ ID NO: 147178 - protein, 104 aa, Glycine max
  Coding DNA Sequence Number=SeqID_30400
MPRSFQLKEVSQRMWIQVINNYFERHKKYLHYYQLMVQESSSAHAVHTIIKIKPSTKHAKSAQTYTMKNKNIKKPKNSLYREQVFSLSKPPNSDSSKQLIGSGG

SEQ ID NO: 147179 - protein, 179 aa, Glycine max
  Coding DNA Sequence Number=SeqID_30401
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=100%, HitCoverage=52%, E-value=3e-36, Identity=43%"; Hit description=E3 ubiquitin ligase PUB14
TLVHTALTPNYVLKSLIALWCESNGIELPKRQGNCRTKKCGGSSLSEDVATALIKLLCEGTPTGKKDVATTIFNLSIYQGNKARAVKAGIVAPLIQFLKDAGGGMVDEALAIMAILASHHEGRNATAVLWSLCTEDPLQLKLAKEHGAEAALQELSENGSDRAKIKAGSILELLQQMEG

SEQ ID NO: 147180 - protein, 129 aa, Glycine max
  Coding DNA Sequence Number=SeqID_30402
  Subcellular localization annotation: CTP_CleavageSite=19; ConfidenceScore=5.17e-01
MASYGGELPLSLPSPFRCHSSSKKQRNPLMKKILGLQAPMELTSPRGWTYSFEFDSMAPPRVPLEGWISRGTLGGAIMSNFKEYLSSPRFRGKELRRVVRGLLLLKFYGSTICGCMCPVASVPEENLEE

SEQ ID NO: 147181 - protein, 37 aa, Glycine max
  Coding DNA Sequence Number=SeqID_30403
MNRGTGGRARMDARPMINRSLSRVQLRTIEKHYWEAA

SEQ ID NO: 147182 - protein, 189 aa, Glycine max
  Coding DNA Sequence Number=SeqID_30404
  Homolog annotation: Hit_ID=Q8P7Y0; Match level="QueryCoverage=22%, HitCoverage=41%, E-value=5e-10, Identity=67%"; Hit description=VirB3 protein
TAKEFQETWRARTAARPDPDLNPFGPACRDHFVTLGHVPHDEDRHRNGEQEPEVRVHAEQQQPTCHHEKWQVGGAGATTALAVAAITQQHARDLAGGADQHATDQDRGDVSDALVREGDLITGEDHRDGDHGNRGDVQQAVDVVEEAADLLVGAAEVGSTVGEDLRGEQCANEERGHQQGFQRALGLDE

SEQ ID NO: 147183 - protein, 195 aa, Glycine max
  Coding DNA Sequence Number=SeqID_30405
  Homolog annotation: Hit_ID=Q8PJC3; Match level="QueryCoverage=72%, HitCoverage=47%, E-value=3e-19, Identity=46%"; Hit description=VirB6 protein
MQVALSSIDGIKIPNDPGLQEDKTRAMWFIGLGTGGPAVTADQAVVPTMVVLWHRNHVLDGGAGGHGLDCAGHGDPLVCVVVGDGAGEQVPADGRIQRRHVQSGDAAGPHGIDPDAPDSDCAPIAAMFFQGNLGSYMAYSQIGGSPAAQPGPQGQPPGSTGGSSYKPSAPSNNHAFEAPAQSSMPRFGSAVDAPV

SEQ ID NO: 147184 - protein, 73 aa, Glycine max
  Coding DNA Sequence Number=SeqID_30406
MSFQVGTTNQKVLHIMYRKSALVYWMQSFYKERPRKSQHREVLVQGLHSLKELVIEGGGFNPLQTVSRCTHPN

SEQ ID NO: 147185 - protein, 44 aa, Glycine max
  Coding DNA Sequence Number=SeqID_30407
MKTVPSKYVVEKGENSLQKCYYKNVTDKATRMGVPHRCRSYVVN

SEQ ID NO: 147186 - protein, 74 aa, Glycine max
  Coding DNA Sequence Number=SeqID_30408
MGAKYLEVVKRGSHPNNGWSPDEIRFGAEVAWPRDWLEAQVGEEPAESPGETEEARMDEDITDLLGFLGGSGAT

SEQ ID NO: 147187 - protein, 66 aa, Glycine max
  Coding DNA Sequence Number=SeqID_30409
MYIEVFKDTRDLVDDEDLMPFEITFYLGICSEGISGEDIVLSNEECESSEDESDPSEGGKILYSVS

SEQ ID NO: 147188 - protein, 88 aa, Glycine max
  Coding DNA Sequence Number=SeqID_30410
  Homolog annotation: Hit_ID=Q1SW35; Match level="QueryCoverage=38%, HitCoverage=6%, E-value=1e-10, Identity=97%"; Hit description=IMP dehydrogenase/GMP reductase
MGLEIYLEVHENPRAFFSSSSPILLEPLAYGSGEIVFELLQHLKGNGARSLLEGIKKSTREMIEEQEPYACDPSSLPKDPSIKEMDAK

SEQ ID NO: 147189 - protein, 78 aa, Glycine max
  Coding DNA Sequence Number=SeqID_30411
MGANNHKVSPRIMGISAYHGCRMTKLGLCVPTDTTVSEWQRGADNRKVSPRIIMTKLGLCVPTDTTVSEWQRGADNRK

SEQ ID NO: 147190 - protein, 342 aa, Glycine max
  Coding DNA Sequence Number=SeqID_30412
  Homolog annotation: Hit_ID=Q8TGM5; Match level="QueryCoverage=12%, HitCoverage=62%, E-value=9e-08, Identity=71%"; Hit description =Uncharacterized protein ART3
GARSCRGTPRARAVRHDRGDGIPRAYQLLGLWPPPQSALVRASSRSADRHSPFHIRPRRIAGPHPLPSRQFQALFDSLFKVLFIFPSRYLFAIGLSPVFSLGRNLPPDWGCIPKQPDSPTAPRGATGSGHNGALTLSGAPFQGTWARSAAEDASPDYNSDDGAVRFSSWAIPGSLAVTRGILRVIPPDLGSQSKAPMWRRWVVVDARADDAVKHRSKRVENSTTTARDVHRRGISFGPAARERTGDQYPPPDPAPTEREGGATQCVTPRQTCPRPSGFGRNLRSKTRWFTGFCNSHQVSHFATFFIDARAEISVAESRFDIQDTSRTPAHVAYEATGGRALR

SEQ ID NO: 147191 - protein, 311 aa, Glycine max
  Coding DNA Sequence Number=SeqID_30413
  Gene Ontology: Mol. function=oxidoreductase activity; Cellular component=membrane; Biological process=metabolic process
  Homolog annotation: Hit_ID=Q9SCU0; Match level="QueryCoverage=90%, HitCoverage=89%, E-value=1e-102, Identity=66%"; Hit description =Short-chain alcohol dehydrogenase-like protein
  Pfam annotation: Domain name=Epimerase; Domain location=36-299; Score= -53.9; E_value=0.013; Accession=PF01370.11; Description=NAD dependent epimerasedehydratase family
  Pfam annotation: Domain name=KR; Domain location=35-197; Score=-56.8; E_value=0.00046; Accession=PF08659.1; Description=KR domain
  Pfam annotation: Domain name=adh_short; Domain location=34-202; Score= 102.3; E_value=1.4e-27; Accession=PF00106.15; Description=short chain dehydrogenase
  Pfam module annotation: Pfam domain module=Epimerase::KR::adh_short; Domain location=36-299::35-197::34-202
MVAAEVMPEKPLHGVPILSRESSFSSSPRRLEGKVAIVTGGARGIGEATVRVFAKNGARVVIADVEDALGTMLAETLAPSATYVHCDVSKEEEVENLVRSTVSRYGQLDIMFNNAGVLGNQSKNKSIINFDPEEFDKVMSVNVKGMALGIKHAARVMIPKGIGCIISTASVAGVMGGLGPHAYTASKHAIVGLTKNTACELGRYGIRVNCISPFGVATNMLVNAWKSGGGDDDDDDQGDEGIINFGLPYQEEVEKMEGFVRGLANLQGATLRAKDIAEAALYLASDESKYVSGHNLVVDGGVTSSRNCIGL

SEQ ID NO: 147192 - protein, 122 aa, Glycine max
  Coding DNA Sequence Number=SeqID_30414
  Gene Ontology: Mol. function=RNA-directed DNA polymerase activity
MTRGVFRVHGGNVIFPFSSNIGSCVMSIPQAELWGILLGMCIAWSRGFRIFEVETDSKLDVNLLHNGCARSHPCYVMLQNIMMMVNLGGSFSWLHLHILREVNQDLSPILTPKRLDGTNYTE

SEQ ID NO: 147193 - protein, 155 aa, Glycine max
  Coding DNA Sequence Number=SeqID_30415
  Gene Ontology: Mol. function=RNA-directed DNA polymerase activity; Cellular component=integral to membrane; Biological process=RNA -dependent DNA replication
  Homolog annotation: Hit_ID=Q1RV13; Match level="QueryCoverage=92%, HitCoverage=33%, E-value=7e-33, Identity=47%"; Hit description=IMP dehydrogenase/GMP reductase
MSSFPKEVSSKGDPIIPFLFNIVAESLSGLMREAQKKNLYDAFEVGSDKVEVSILQYVDDTIFLGDASMANVAAIKAILWSFELVSGLKINFSKSCFGAFGVSEEWVKIAANMLNFRLLLLPFSYLGIPIGAIPRQSETWDPIIVKCEKRLNKWR

SEQ ID NO: 147194 - protein, 135 aa, Glycine max
  Coding DNA Sequence Number=SeqID_30416
MPRPLHPIVVVYHTSLIHPPLPPHSPHGGGPGFGMVVVVPEQQNEHQRLRLWGLQEMRGVLKVREAEGSSIAGATFICHVPPIGIGESLNPVDSSLVLFPLFYKVKLSSPSRSTVPNKSTTSLGLTISVPVPVQY

SEQ ID NO: 147195 - protein, 69 aa, Glycine max
  Coding DNA Sequence Number=SeqID_30417
MRGTLHKPQANLGIDQKFSPAGLTDRPLASLYDLKSGKFHLVTYQSATVHCHPSIGHTIDPKALCFRVV

SEQ ID NO: 147196 - protein, 79 aa, Glycine max
  Coding DNA Sequence Number=SeqID_30418
  Subcellular localization annotation: CTP_CleavageSite=58; ConfidenceScore=5.33e-01
MHLNLISTGKLANVGMINQFGVGKWKLSRGSIVVTRGLGSSSSMDSFASWKMNGSGVKKEEREETPLQGEDESRRSSPP

SEQ ID NO: 147197 - protein, 234 aa, Glycine max
  Coding DNA Sequence Number=SeqID_30419
  Subcellular localization annotation: CTP_CleavageSite=38; ConfidenceScore=5.06e-01
MQALPSHVMQTSFHHRAVCDKVDKKGLGFRSSRLVSTSYMMKVDWLFPQREMIYGNFQENLGLNIGDGAKVEFWNDRWVPGVPPLNSSKGDDQLSCIGSEDDAEVLRGYVFCFGRSWCLISKAIWYMLLPQTMHSEFLVQDSNLWMLSNLKNEESVNGKQWYHIFALAVVQPTGMVSQIWREADHPPNGHFKLNCDGSVNSSMKNVAVGAIKIGLQIAWSRGFKDFTVKSDSLI

SEQ ID NO: 147198 - protein, 230 aa, Glycine max
  Coding DNA Sequence Number=SeqID_30420
MSSSPPLRKFLQNPCLSSGYILSHNASFVPWVWVVLIILEDCISSSWIASISPYHLSQWLPGNFESPLLNLPSSKLDAPSNSSLSGQVILSEEVSLSDWFLSFEWVVPLLEESPPLSFSLWALASQITGYHVYAFLRLSIKLCSFIFRNMDKSLAPKDSQYASNRPLYSPPLFDLKHFSFLLVSRSTEWLPLYDAILPRKGPVTKAISKRLQEDWARAAEEGPRVLMNLR

SEQ ID NO: 147199 - protein, 109 aa, Glycine max
  Coding DNA Sequence Number=SeqID_30421
  Gene Ontology: Mol. function=receptor activity; Biological process =DNA integration
MKKFLNELGHDQDDYVVNCDNQSVIHLAKNPMFHSHSKHIDIRYHLIREMLDEKKQKLEKIHTNFNWSDMMTKTIPTKKVEGCCQGSQIGSPRDPSSIAQSMTRFGHHH

SEQ ID NO: 147200 - protein, 80 aa, Glycine max
  Coding DNA Sequence Number=SeqID_30422
MMIGCGISWMLWKLGRIDGDPVLRGTRIRATWEYVSSVGGGQQGMTGTWRYVAGVRRPWGRQVGCYCPQPSLTNPDPTRA

SEQ ID NO: 147201 - protein, 127 aa, Glycine max
  Coding DNA Sequence Number=SeqID_30423
MTIRYLRMSSGSLPLDDKGAEDDDSIVSGWQKGVQMTIICLRMSSGSPPLDDKRYKMTIICLCVPSDSIVSGWRKDSIISRWRKGVRMTIICLRMSSGLPPLDDKRYKMTIICLCVPSDSIISGWPK

SEQ ID NO: 147202 - protein, 150 aa, Glycine max
  Coding DNA Sequence Number=SeqID_30424
  Subcellular localization annotation: CTP_CleavageSite=41; ConfidenceScore=5.17e-01
MAVGTTSNSTSPKRIKLYMRLHYYKVSRRPNMTTDRPPFPTAHTDPGFMCARSNLRINPPYRPSKQKIPRCRNLPFGGMATRGLAGASSMEGKRALSPPTFIRGKRRKNWKRRGLRTLSVKGSGVVFTHGEGGFPCSYIFLNCDKEIRPM

SEQ ID NO: 147203 - protein, 65 aa, Glycine max
  Coding DNA Sequence Number=SeqID_30425
MTLQLVDHSIARPYGVIEDVLEIDKVATTMALHSPLEKTLINQMEYLTKEEEHEVQTCLKELYGA

SEQ ID NO: 147204 - protein, 337 aa, Glycine max
  Coding DNA Sequence Number=SeqID_30426
  Gene Ontology: Mol. function=RNA-directed DNA polymerase activity; Cellular component=chromatin; Biological process=chromatin assembly or disassembly
MEETMPLQVMVGNGSVLECRQLCPATTLLIQDHSFMVTLRVLPLSGADIIFGIEWLHTLGPIITNYTSFTMQFTHLGQPISLHADVHTNTDPTSAHQHKHIIHTHSVSGLFHLSLLPVNLPEPNTDPPHPIPSINELLLKFQTIFQQPTTLPSPQQHDHHINLIPSAHPVNVRPYRYPHFQKTEIEKQVAALLDSGLIQPSRSPFSSPVLLVKKKDGMCTAYVRDRFPIPTIEELLDELGRASWFSKIDLRQGFRYILMTDDDISKTAFHTHHGHYEYRVMPFGLCNAPSTFQAAMNSLLSLFLQKFVAVFFDDILIYSGSLPDHLHHLECIFHALS

SEQ ID NO: 147205 - protein, 134 aa, Glycine max
  Coding DNA Sequence Number=SeqID_30427
  Subcellular localization annotation: CTP_CleavageSite=57; ConfidenceScore=5.05e-01
MDHARLIHGLVMKMYMDPGSMISSQITQIAQSNSSRLGFPALITTLCDAKRGSSHSRCSTSHSSANSSSSGLCPAFSSLYSPSQYLLIQSLHHLSLHRLVMSPKAFLESVAWPGDQASSVGGGDTSEAGDHDML

SEQ ID NO: 147206 - protein, 226 aa, Glycine max
  Coding DNA Sequence Number=SeqID_30428
  Subcellular localization annotation: CTP_CleavageSite=32; ConfidenceScore=5.06e-01
MNALSVPICLVCSSQLSKFLDFQMNALSGPCRANKAKRALCANPECYLIKVELSASMMAFKKRKAPSTPTQAIFERSRFTSQEAWERYTDIVFDEFKEELERRHWDEKLTDFSDSSIDIAIVKEFYAHLYGPKDKSPKQVRVRGHFVKFDEDNLNTFLKAPVVLEEGENLCTYSRFALLRPDPQELVAKLCILGRGFKLNVDGQPLKILRKNMTTLAQTWSVLSFF

SEQ ID NO: 147207 - protein, 389 aa, Glycine max
  Coding DNA Sequence Number=SeqID_30429
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-39, Identity=30%"; Hit description= UPI00006A17C9 related cluster
VDSRGSHTIRGGHVLAIRGLHALTFRALYVLTIRGLHALTCRGMHVLTFRGLHALTFRGPYVLDIRGLDALTFRGLHVLAIRGLHALTCRGLHVLTIRGLHALTIRGLHVLAIKGLHALSFGGLHVLAIRGLHTLTFRGLHVLAIRGTHALTFRGLHALTSRGLDIHALRALHVFAIGGLHASTFRGQHVLAIKGLHALTFRGLHIFAIKGLHALTFRVLHILAIRGLHVLAIRGLYSLTFRRLHVLAIRGLHALIFRGLHVLAIRGLHALIFRGLHVLAIRGLHALTFRGLDILAFRGLHVLAMRGLHALTFSGIQVLASRGLDALTFRGLHIFTIKGLHALIFRGLHVPAIRGLHALTFRGLHILAFRGLHVLAMRGLNILTFSGIQ

SEQ ID NO: 147208 - protein, 75 aa, Glycine max
  Coding DNA Sequence Number=SeqID_30430
MAGIFFLLKQRNNLENYERDATASLKSILHLVTVKKTADCPLLVEVGPLLQTLLLAGPVPQWQHPPPQLKRLSFN

SEQ ID NO: 147209 - protein, 369 aa, Glycine max
  Coding DNA Sequence Number=SeqID_30431
  Gene Ontology: Mol. function=transporter activity; Cellular component= integral to membrane; Biological process=transport
  Homolog annotation: Hit_ID=Q8ZNK0; Match level="QueryCoverage=99%, HitCoverage=61%, E-value=0.0, Identity=83%"; Hit description =Putative ABC transporter periplasmic binding protein
  Pfam annotation: Domain name=SBP_bac_5; Domain location=70-369; Score= 103.0; E_value=8.9e-28; Accession=PF00496.12; Description=Bacterial extracellular solute-binding proteins, family 5
FAIIGEPKYAVDFHHFDYVNPDAPKGGSITLAAIGTFDNFNRYALRGNPGVRTDALYDTLFTTSDDEPGSYYPLIADRARFADDFSWMDITINPRARFHDGSPITASDVAFTFHKFMTEGVPQFRLIYKGTTVKAIAPLTVRIELAKPGKENMLSLLSLPVMPESFWRHHKLSDPLSTPPLASGPYRISRWRMGQYIVYSRVENYWAADLPVNRGRWNFDTIRYDYYLDDNVAFEAFKAGAVDMREESSTKNWATRYIGRNFSNGYIVKDDRTNTSAKDTRWLAFNIQRPVFADRQVREAITLAFDFEWMNKALFYGAYSRPNSYFQNTEYAARDYPKADELALLAPMKKELPPEVFTRIYQPPVSSGD

SEQ ID NO: 147210 - protein, 510 aa, Glycine max
  Coding DNA Sequence Number=SeqID_30432
  Gene Ontology: Mol. function=structural molecule activity; Cellular component=intermediate filament; Biological process=nucleosome assembly
  Homolog annotation: Hit_ID=UPI00006A17C9; Match level="QueryCoverage =99%, HitCoverage=100%, E-value=2e-54, Identity=31%"; Hit description= UPI00006A17C9 related cluster
HVLTIRGLYAFALRGLHSLTFRGLHVLALRGLHAFTFRGLHTLTFRGLHVLAFKGLHALTFRGLHVLTIRGLYALAFRGLHAFTFRGLHVLTIRGLYALSFRGLRALAFRGLHVLALSGLHAFALGTSTLTFRGLHDLAFRGLHPLTFRGLHTLTFRGLHAFTFRGLHVLTFRGLHVLGFRGLHVLTFRGLDVLAFRGLDALTFRGLHALAFRGLHAFAFKGLHALTFRGLLVLAFRGLDVLAIRGLHILAFRGLDVLAFRGLHALVFKGLDILAFGGLDVLTLSGLHARALGTSTLTFRGLHTLTFRGLHVLAFKGLHALAFRGLHVFTIRGMYALAFRGLHALAFRGLHVLTIRGLYAFAFRGLHTLAFRGLHVLALRGLHALALGTSALTFRGLHALTFRGLHVLAFRGLHALTFRGLHTFTFRGLHVLTFRGLHVLGFRGLHVLTFRGLDVLAFRELDVLAFKGLNVLTFRGLDVLAFRGLHALAFIGLHALTFRGLHVLAFRGLD

SEQ ID NO: 147211 - protein, 422 aa, Glycine max
  Coding DNA Sequence Number=SeqID_30433
  Gene Ontology: Mol. function=transposase activity; Cellular component= intracellular; Biological process=regulation of transcription, DNA -dependent
  Homolog annotation: Hit_ID=Q30XD0; Match level="QueryCoverage=99%, HitCoverage=100%, E-value=0.0, Identity=94%"; Hit description =Transposase
  Pfam annotation: Domain name=Transposase_12; Domain location=147-242; Score=125.2; E_value=1.8e-34; Accession=PF01610.8; Description =Transposase
MLDLLNLPGIKPVDMRHEGKCLVIVAEPVTVEVPLCGDCNTPMHRHGTRKNKFMDTPLYMEPVRLEVQRPRFRCESCGKMSMPELSFLDDKRRATKRLVDVIRQQCLGTTFHALAEQTGVAVNTVKNIAHDLIEELSQTVRYETPVIMGIDEVNLAGGYRCVITNLATNNVFDMLEHRTQEHLKPFFKDLPDADKVEWVCTDMWRPFKRSFAQHLPNAKLVIDKFHVVKMASEALEAERKNYQAQLSKEDRIYVKKSIRWLTLKRPGNLTPAEQKALEVVKQAIPELAVAYDFKEAFFCIYDEPDKQSAQNAFEAWENSLPPYGMEPFKKLVKTVYNHYDDIFAYWDAPFSITNGYTEGLNGLIKMSNRLGRGYSYDIIRAKTLYSKEARKVGSGIRAGRGKVEYGPHIPTLLKQAEGGELD

SEQ ID NO: 147212 - protein, 125 aa, Glycine max
  Coding DNA Sequence Number=SeqID_30434
MVVHKVEKKNTIPLLLLPSKSTPRRSRITRSYELEQHHFGLLVVLDWFVALTRRQFGIDASHIYTNKSCLGNLGKAKCIGLVTFMVIGKIAGFINFIDNLEAELYAISVVLSWPAWNKGAPKVWY

SEQ ID NO: 147213 - protein, 85 aa, Glycine max
  Coding DNA Sequence Number=SeqID_30435
  Subcellular localization annotation: CTP_CleavageSite=34; ConfidenceScore=5.18e-01
MIFHSPLLQNATQTLTPPPPPPTTTGGRRQPPLLATEPPHQEGHFNQRRILLKDLVEKIPPIIHFIASMSVFLHFLSKTLENETF

SEQ ID NO: 147214 - protein, 91 aa, Glycine max
  Coding DNA Sequence Number=SeqID_30436
MAKPSTNALSELRARLALSSNSLTRAKRDVEIRKPLLSLICTKLKEESLKSVNFREHRAEQWAKFSSFREISEFLRDCEIPRGGGDIPTPL

SEQ ID NO: 147215 - protein, 101 aa, Glycine max
  Coding DNA Sequence Number=SeqID_30437
MLFTMMSFKCYVQLGINYLNEATSKEKVELGVVIIYSTISGPIPLNYAPPNVVIRDQNVQQDQMATLVLVPTPIPSTLAPTPSSIEPTPTPTQPPLPQVQD

SEQ ID NO: 147216 - protein, 187 aa, Glycine max
  Coding DNA Sequence Number=SeqID_30438
MNKKIRHRLQGDKAYSHLNDPWLAILDMLQMGSFAFFKTTKMKGIGFAKNGEALTKKGGRTMTAMCQGSYSRKMLIKLARSKSSLSNLHKFVPFHLMENLPFDLPHTIYINILRILKEVYHVFDKMDDDSNNTIIAKSFVVSKQQKFSKTKLKAMKVAIEQSLKEAPQVDLDAINKRMHNSLAKAIT

SEQ ID NO: 147217 - protein, 121 aa, Glycine max
  Coding DNA Sequence Number=SeqID_30439
MASQGLWHLRIRGITLVTINFRGRAWSIHEGCICGSVATTTTTRWRKRHASIHTLDTSYRNLPFGKRATQGLTGTSSIGGRCAESPPTFIRGKRRKNRKRMWSTNFKCERFGSCIYARGRY

SEQ ID NO: 147218 - protein, 147 aa, Glycine max
  Coding DNA Sequence Number=SeqID_30440
MALAAHALKRAMVAKSTPTPREVVILLIIPRRIKTKATKVNPKIEVEPPKSEFEKKVNLWMPFTKLLSVHAPDLDLSLEDYSSLGKLHARMYVRDQATTYPPGLHISKAIDIKIIANKMCPHPLLWDAAKKMGFKLYYNEEMPSRQI

SEQ ID NO: 147219 - protein, 93 aa, Glycine max
  Coding DNA Sequence Number=SeqID_30441
MCPRRKWPQRSFQPRGLGKMSLESIPVRPHRQMWTLTDTGSKVRNTNDDLRPLKSWKKASATSLARGGFRPPAFTRRLSASCYAFRDKTLPIA

SEQ ID NO: 147220 - protein, 166 aa, Glycine max
  Coding DNA Sequence Number=SeqID_30442
MTQVSVRIAQLISDAIYQFARITPPRHPVDPEKSNRALGFPALIIGLYQSMECRSPPPSSSGLPLVGPSKRSTACPDRCRHVTSQHAANLRGQVQLNESFYWHTQHQQSQDPSPFPWPTPEQFGAMVAWPGDWVDFETRSGPTRAFGDDKRAQEDGDMADLMDFFT

SEQ ID NO: 147221 - protein, 175 aa, Glycine max
  Coding DNA Sequence Number=SeqID_30443
MVNPDAPSPSDPHMKEYLHWTSIPSSPVSNTNPEHLTSSELHPNFLKKALKIAGKTEKLIDSSFDVQENLDDGDCFSLDWVTSPSRASSPRGTVEIVRWWDEQLCLLCAEGSKNVDMVGDGWVGRLGLRNICRLLLWLILEVVRFLWLAMIVMPEAIANVKRIERVAMSRSRLRV

SEQ ID NO: 147222 - protein, 88 aa, Glycine max
  Coding DNA Sequence Number=SeqID_30444
  Gene Ontology: Mol. function=protein binding; Cellular component =nucleus; Biological process=regulation of timing of transition from vegetative to reproductive phase
  Homolog annotation: Hit_ID=Q84XL0; Match level="QueryCoverage=98%, HitCoverage=49%, E-value=4e-29, Identity=62%"; Hit description=SP3D
  Pfam annotation: Domain name=PBP; Domain location=19-88; Score=-41.6; E_value=0.1; Accession=PF01161.10; Description=Phosphatidylethanolamin e-binding protein
MPRSTDPLVIGGVIGDVLEPFTSSVSMGIVYNNCPQVINCCELKPSKILNRPRIEIGGDDLRTFYTLVMVDPDAPSPGNPTQREYLHW

SEQ ID NO: 147223 - protein, 99 aa, Glycine max
  Coding DNA Sequence Number=SeqID_30445
  Homolog annotation: Hit_ID=Q84XL0; Match level="QueryCoverage=56%, HitCoverage=41%, E-value=8e-10, Identity=73%"; Hit description=SP3D
MQLEWNLVFQHTFREANQIADYLAGKLMARLKIFSLAVCFLLSSSSTALIIFSFTVEVHGRYCLEVAELVYAADEITQKLFDESLLLDVDFHRRQSLLL

SEQ ID NO: 147224 - protein, 69 aa, Glycine max
  Coding DNA Sequence Number=SeqID_30446
MLYAERWENTLRLQFYLKNFMGSEKVEKHIKVTIFISKTSWVQRRWKKTLKLPFFTPKSFHFYLIFMSK

SEQ ID NO: 147225 - protein, 115 aa, Glycine max
  Coding DNA Sequence Number=SeqID_30447
MDELMRVHKEDYTELKEFFETISKRSNEMTKARLQRTRKPFQSIVMQVLKPRIVSFVQLIDKFNNLKYNNLKSTMWMILNVVHEMCGCPDLTSSIPSGAIAKREIVFQVVESIVP

SEQ ID NO: 147226 - protein, 255 aa, Glycine max
  Coding DNA Sequence Number=SeqID_30448
EAINVKFDDIKPNTKISELNDFITDLRVDDGIGSSTIGDSLTKVQTRASPRQQGKRIGGSKWVFENKLDEASKVVRSKARQLDVSEKVGPTVRGGKRLMTPKLLELSTKKMQQQLVIMNQSHTTTCVIDRAKILANILNKSILHKDSQKALSSSYDGSDNVDHKDLVQGASSIKGKRVESPPTFIRGKHWKNQKVDGISTLRVRHKGRQPLIKCANHDDGSLLVGLLWRLDLLASMRSFNGYFPPWRCSGRQRRI

SEQ ID NO: 147227 - protein, 174 aa, Glycine max
  Coding DNA Sequence Number=SeqID_30449
MHFLWNLRESELANKCLYHLPQNYSSGYSKDLATYLKYCRDVVFAGSEPSYGNHEEEKMIEYLWRFYQNEELVSTIKIMTYLFMIPDTKPSENVEQSNTSFNQPRSRDKGCIGRTSKEEKIRKKGFKKLFPDDDTSLEDDLPGRVSNNKSHERLSDSPKSTVQENLMSRKPLDR

SEQ ID NO: 147228 - protein, 52 aa, Glycine max
  Coding DNA Sequence Number=SeqID_30450
MVATTVWWWCGDGYNNGVMIVMIEATTTKCGGDSSRIVATVTTTIVTMTMVI

SEQ ID NO: 147229 - protein, 70 aa, Glycine max
  Coding DNA Sequence Number=SeqID_30451
MGCDEVNDVIVVTNLEVTDHISELRLINEAPQGGSGNDDSSSDSGGVDSSDDDGESGMVIATMVVVGVEC

SEQ ID NO: 147230 - protein, 124 aa, Glycine max
  Coding DNA Sequence Number=SeqID_30452
  Homolog annotation: Hit_ID=Q9FIL3; Match level="QueryCoverage=65%, HitCoverage=56%, E-value=4e-14, Identity=48%"; Hit description =Arabidopsis thaliana genomic DNA, chromosome 5, TAC clone:K19M22
  Subcellular localization annotation: CTP_CleavageSite=38; ConfidenceScore=5.71e-01
MASALGSRVESVRNSPLVRFSINFIRSFGSSSSSSAVSSAQNPKKSKRRKKNLLDVAEFLSNWGIGYHMAKTHWNEVSDEITKINLYKILVVEGTGNHAALLFFNDSVGYAKNAFMNSYIGHIG

SEQ ID NO: 147231 - protein, 217 aa, Glycine max
  Coding DNA Sequence Number=SeqID_30453
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P59229; Match level="QueryCoverage=80%, HitCoverage=96%, E-value=1e-51, Identity=67%"; Hit description =Vacuolar ATP synthase 16 kDa proteolipid subunit 4
  Pfam annotation: Domain name=ATP-synt_C; Domain location=145-210; Score=86.1; E_value=1.1e-22; Accession=PF00137.12; Description=ATP synthase subunit C
  Pfam annotation: Domain name=ATP-synt_C; Domain location=52-131; Score=35.6; E_value=1.7e-07; Accession=PF00137.12; Description=ATP synthase subunit C
  Pfam module annotation: Pfam domain module=ATP-synt_C::ATP-synt_C; Domain location=145-210::52-131
MEMVPSPPHCTVTEIGTWNCGNRNISLLRSDQSDVVAVIMAPFSGDETAPFFGFLGAAAALVFSCNSIPNFSIRSMLEGMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 147232 - protein, 925 aa, Glycine max
  Coding DNA Sequence Number=SeqID_30454
  Gene Ontology: Mol. function=microtubule motor activity; Cellular component=microtubule associated complex; Biological process =microtubule-based movement
  Homolog annotation: Hit_ID=Q0WLK7; Match level="QueryCoverage=98%, HitCoverage=99%, E-value=0.0, Identity=56%"; Hit description=Kinesin like protein
  Pfam annotation: Domain name=Kinesin; Domain location=30-363; Score =417.2; E_value=2.4e-122; Accession=PF00225.13; Description=Kinesin motor domain
MGAIAGEELLKWEKMQGVSSREEKILVSIRLRPLNEKEIAANESADWECINDTTILYRNTLREGSTFPSAYTFDRVFRGDCVTRQVYEEGAKEVALSVVSGINSSIFAYGQTSSGKTYTMVGITEYAVADIFDYIKRHEERAFILKFSAIEIYNEIVRDLLSTDNTPLRLRDDPEKGPILEKLTEETLRDWEHLKELLAYSEAQRQVGETYLNEKSSRSHQIIRLVRAFHLTSINGVTIFQTMESSAREFLGKGNSATLVASVNLVDLAGSERASQASSAGMRLKEGCHINRSLLTLGTVIRKLSKGRHGHINYRDSKLTRILQPCLGGNARTAIICTLSPARSHVEQTRNTLLFACCAKEVTTKAQVNVVMSDKALVKHLQKEVARLESELKTPGPATSNCDYAALLRKKDLQIEKMEKEIRELTKQRDLAQSRVEDLLRMVGKDQISGKASINNHLNLQEGEDIWEDDCSVSESSSICGPHRPNTHIREFNNPHYNDGDSDPDDPAIIIHSLAFACTEDPDDYCKEVRCVENGELALPISGDESGISQEISSHLNEDTGDSQIQENSTLLEQRLHVVQSTIDSLVCPSPDEQSPQVMSENNKNLRLTRSWSCTEYHMTGSPESVGGIQRTPANGYEKGFPGRPDGLQKFPPLNYDGSTKLLRNGSQSSMGSLSVDDLRASSIRTSADEDITSIHTFVAGMKEMVKQEYEKHLVDGQDQETGRKNVKDVGVDPMLEAPRSPLDWSLQFKRQQKEIIELWQSCCVPLTHRTYFFLLFRGDPTDSIYMEVELRRLSFLKESFSDGNQSVSDSQTITLASSVKALRRERGMLVKLMQRRLSEKERRRLYEEWGIALDSKRRRVQLGNRLWSENDMNHVMQSATIVAKLVRFWERGKALKEMFGLSFTPQLTGRRSSYPWKNSSTSLL

SEQ ID NO: 147233 - protein, 282 aa, Glycine max
  Coding DNA Sequence Number=SeqID_30455
  Gene Ontology: Cellular component=integral to membrane
  Homolog annotation: Hit_ID=Q1S3A5; Match level="QueryCoverage=83%, HitCoverage=72%, E-value=2e-91, Identity=68%"; Hit description=3-oxo- 5-alpha-steroid 4-dehydrogenase, C-terminal
MKNSGEWCQALGRGSGMSFENRSDGLSQIPNPSLYALETMLFHNQPMELVLLQILRLAWLAATLPIIVASIPTPKLSCLRATLLAFARRGKIMHSSQKFTISQRFFLHFYIVAFIWTTLLLLGTWAYAYNMVPLVVEPFSYSTITSFLTGGSTIKTDTYKLRQGYVAWQAVFLLLMMEVQVLRRLYETRHVFNYSPSARMHVIASFYVGAPLSLCGGCAVEVFNFLANLVTKFIVKGKNQMQVTELEFWQVVNPLFKLGWKHWIGAAVFLWVGFINTSAIRF

SEQ ID NO: 147234 - protein, 77 aa, Glycine max
  Coding DNA Sequence Number=SeqID_30456
MAYNDYEFKEERELMHQKETLEYNASLNKQDVQYLHNHRGHWAYSSQFNKETLIVILQGIFALAMHSTCYSKNSLVK

SEQ ID NO: 147235 - protein, 63 aa, Glycine max
  Coding DNA Sequence Number=SeqID_30457
  Subcellular localization annotation: CTP_CleavageSite=25; ConfidenceScore=5.31e-01
NTGEAKQCTTTPTTSPRHVHKPPVSATAPAPQPLFSLFKLAACDKPTTLVEQLKKESEWLDES

SEQ ID NO: 147236 - protein, 100 aa, Glycine max
  Coding DNA Sequence Number=SeqID_30458
MVGLQPSSWYPTHVTKKVRKMQGSCMSEHDMQMMKIECMQYSKQKSMLNVDVWWLYLSMVSRDIIPFDINVMAIGTTSDSISSKIKTLDEVSLSSSKSGT

SEQ ID NO: 147237 - protein, 142 aa, Glycine max
  Coding DNA Sequence Number=SeqID_30459
MAEKRRLDHIEERLGAVEGGERYAFADLADLCLVPDITIPSKFKVPDFNKYKGTTCPKNHLKMYCRKMGAYTKDEMLLMHFFQESLTRVAVTCISTISIWLQIGCSYRTCAKGSTNLSKGLKWPGANGEKEKEEGTHVEGCC

SEQ ID NO: 147238 - protein, 106 aa, Glycine max
  Coding DNA Sequence Number=SeqID_30460
MECDREALVNDPSLISAIPTSLFQLSSHAKRNLWAQLASITKRNYSMLSVMRKSGRAQESRPCAKQDIRLLPGSAHDWHQAQIHLLALSVTVALSMISRFQSPFKA

SEQ ID NO: 147239 - protein, 124 aa, Glycine max
  Coding DNA Sequence Number=SeqID_30461
  Gene Ontology: Mol. function=protein dimerization activity; Cellular component=nucleus; Biological process=regulation of transcription, DNA-dependent
  Homolog annotation: Hit_ID=Q0GPE9; Match level="QueryCoverage=62%, HitCoverage=14%, E-value=3e-16, Identity=62%"; Hit description=BZIP transcription factor bZIP28
MLTPFLLELSIKDIRHGNGAGTGIASPVPDPDSSTYPRRVLDIPVPALNEALTAEVQRLKLATAELSGDSHGSGCLIPQHSVNPLMFQQQQQPPTASQQNIHLQQQQQQQHQNGNANSNSDLKQ

SEQ ID NO: 147240 - protein, 421 aa, Glycine max
  Coding DNA Sequence Number=SeqID_30462
  Gene Ontology: Mol. function=amidophosphoribosyltransferase activity; Cellular component=chloroplast; Biological process=purine base biosynthetic process
  Homolog annotation: Hit_ID=Q1S399; Match level="QueryCoverage=95%, HitCoverage=70%, E-value=0.0, Identity=92%"; Hit description =Purine/pyrimidine phosphoribosyl transferase
  Pfam annotation: Domain name=GATase_2; Domain location=3-110; Score= -47.0; E_value=1.9e-07; Accession=PF00310.11; Description=Glutamine amidotransferases class-II
  Pfam annotation: Domain name=Pribosyltran; Domain location=159-310; Score=58.0; E_value=3e-14; Accession=PF00156.17; Description =Phosphoribosyl transferase domain
  Pfam module annotation: Pfam domain module=GATase_2::Pribosyltran; Domain location=3-110::159-310
PFVAGYRFGSVGVAHNGNLVNYKTLRTNLEDNGSIFNTTSDTEVVLHLIATSKHRPFILRIVDACEKLEGAYSIVFVTEDKLVAVRDPFGFRPLVMGRRSNGAVVFASETCALDLIEATYEREVYPGEVLVVDKNGIQSLCLMSHPQPKQCIFEHIYFALPNSVVFGRSVYESRRQFGEILATESPVECDVVIAVPDSGVVAALGYAAKAGVPFQQGLIRSHYVGRTFIEPSQKIRDFGVKLKLSPVRAVLEGKRVVVVDDSIVRGTTSSKIVRLLKEAGAKEVHMRIASPPIIGSCYYGVDTPSSEELISNRMSVEEIRDFIGSDSLAFLPFDSLKRLLGSESPNFCYACFSGNYPVEPRELKVKRVGDFVDDGLNGSLESIDGGWVQANRNQIKHKASLSGQKSDAVLQVFLVLFFILN

SEQ ID NO: 147241 - protein, 96 aa, Glycine max
  Coding DNA Sequence Number=SeqID_30463
MASQHSFPIKAYIQVLGARVNTKKNYVEIAVNLSRKKHVVNVIPTMGLYVHHDHSTRLMALRKVEYVRKTLHTFIAWLRHLVRPVSHEDSQMCPKK

SEQ ID NO: 147242 - protein, 136 aa, Glycine max
  Coding DNA Sequence Number=SeqID_30464
MRFFLKFLKNWLLSFGETLHDEINLQQVSFEMMFVWPPIREGTLLKEHLDEINFVLMELHDFDVKREEKEEKGKGGKKSKVDPKDICNYCKELGFVQIKMHHGVNRTLNEVHHVIELKKNLVEGGVMQIRGKEKPM

SEQ ID NO: 147243 - protein, 87 aa, Glycine max
  Coding DNA Sequence Number=SeqID_30465
  Subcellular localization annotation: CTP_CleavageSite=62; ConfidenceScore=5.22e-01
MNEESFWVMVSTTPTWVSLGASGKVIRASHSIFSHLHVNTFIVKALGQVPTGMAPKKLSTKRAKKATAKEGSSAAPRLEIEFDRHHF

SEQ ID NO: 147244 - protein, 180 aa, Glycine max
  Coding DNA Sequence Number=SeqID_30466
  Gene Ontology: Mol. function=DNA binding; Cellular component=oxygen evolving complex; Biological process=DNA integration
  Homolog annotation: Hit_ID=Q1SJY5; Match level="QueryCoverage=98%, HitCoverage=18%, E-value=7e-64, Identity=64%"; Hit description =Integrase, catalytic region
MHEELNQFKRNEVWDLVPKPTSHKSIGTNIIVRNKARLVAKGYNQEEGIDYDETYAPGSRLEAIRLLLAFACIMDFRLFQMDVKSAFLNGLIEEKVYMDQPPGFMDYKYPNHVYRLKKALYDLKQAPRSWYERLSSFLIEQSFTRGLVDKTLFIKKVNSELLIVQIYVDDIIFGATNEIV

SEQ ID NO: 147245 - protein, 462 aa, Glycine max
  Coding DNA Sequence Number=SeqID_30467
  Gene Ontology: Mol. function=nucleic acid binding; Cellular component= intracellular; Biological process=peptidyl-diphthamide biosynthetic process from peptidyl-histidine
  Homolog annotation: Hit_ID=Q6K6C0; Match level="QueryCoverage=89%, HitCoverage=88%, E-value=1e-114, Identity=49%"; Hit description =Diphthamide synthesis DPH2-like
  Pfam annotation: Domain name=Diphthamide_syn; Domain location=78-396; Score=394.4; E_value=1.6e-115; Accession=PF01866.8; Description =Putative diphthamide synthesis protein
MEKLEAENVLVLPSEQPNNNRPKPKPKRFVKNQIPDSILNNPLLSAAISVLPSNYNFEVHKCVWRVLSTGAKRVALQFPEGLLMYSLPLSDIFTTFAGVTHCFVLADVTYGACCVDDLAASALGADLLIHYGHSCLVPIDATTIPCLYVFVDIKIDVPHFVDTLSLNLLAQTKTLVVAGTIQFASAIRAAKPQLEELGFRVLIPQSKPLSAGEVLGCTAPKVSSSKLLGGGGDIGECVLVFVADGRFHLEAFMIANPGIRAFRYDPYMGKLFLEEYDHLGMKRSRKNAIFKAREARSWGLVLGTLGRQGNPRILERLERMMRERGLDYTVVLMSEMSPTRIALFEDSLDAWIQIACPRLSIDWGEAFVKPVLTPFEAEVALGVIPGWWEKNEVCEEGEGCCNKSGSCCEDAKGGEDFGGDYPMDYYAQDGGEWNSSYVKKSTRPARRVSVSSVADTAISQQP

SEQ ID NO: 147246 - protein, 309 aa, Glycine max
  Coding DNA Sequence Number=SeqID_30468
  Gene Ontology: Mol. function=amidophosphoribosyltransferase activity; Cellular component=chloroplast; Biological process=purine base biosynthetic process
  Homolog annotation: Hit_ID=Q1S399; Match level="QueryCoverage=74%, HitCoverage=63%, E-value=3e-49, Identity=71%"; Hit description =Purine/pyrimidine phosphoribosyl transferase
  Subcellular localization annotation: CTP_CleavageSite=48; ConfidenceScore=5.70e-01
MPSPLGHNTNSFTMALAVPPTLSFSLSKPSLFLFHKSKLLPMTTTLTRADVKTPLLVFSKNQISDTIGAYNVDDYDKPRRMRRGGHIRRPRGLAPLLPCPTCPPAPRPRRHRNRHRQQQRPPTHHRHGPRLRSLQPTPRQPLHRPRPLLHCRTTSPSSPPPPTLRLFSTSRAPPNKDPSFYESLTPVKSSKGLILLSSSPRTSLSSFATLSGSGLWLREREATILATKSPGECEVVIALADSGVVVAIGYAAKARVAYELGLIRSHNAVRNFVAPSQELSPVRAVLEGKRVVVVDDSIVRGTTSSKIVN

SEQ ID NO: 147247 - protein, 105 aa, Glycine max
  Coding DNA Sequence Number=SeqID_30469
  Gene Ontology: Mol. function=catalytic activity; Cellular component =chromatin; Biological process=auxin mediated signaling pathway
  Homolog annotation: Hit_ID=Q1S0B8; Match level="QueryCoverage=99%, HitCoverage=100%, E-value=1e-40, Identity=74%"; Hit description =Auxin responsive protein
  Pfam annotation: Domain name=Auxin_inducible; Domain location=5-105; Score=169.0; E_value=1.2e-47; Accession=PF02519.5; Description=Auxin responsive protein
MAIRKSNKLPQHAVVLKQILKRCSSLGKKNGYDDDGHPVDVPKGHFAVYVGENRRRYIVPISFLAHPEFQSLLRQAEEEFGYDHEMGLTIPCDEVVFRSLTSSLR

SEQ ID NO: 147248 - protein, 89 aa, Glycine max
  Coding DNA Sequence Number=SeqID_30470
MNISIYRLRDGLGKPLGTEIIDEEISNKWGLPRDTVTRNNGVPLSRYYRIRLSQFSASQARNLSGIKYQKDTLQTVVYAGDKMTRMPQL

SEQ ID NO: 147249 - protein, 115 aa, Glycine max
  Coding DNA Sequence Number=SeqID_30471
  Homolog annotation: Hit_ID=Q1S9Y0; Match level="QueryCoverage=33%, HitCoverage=41%, E-value=5e-09, Identity=71%"; Hit description=Auxin responsive SAUR protein
  Pfam annotation: Domain name=Auxin_inducible; Domain location=7-103; Score=7.1; E_value=6.7e-06; Accession=PF02519.5; Description=Auxin responsive protein
MAPPSQTTASIKHICTCNRIGLALPKPNVCSSIEYYSIILLTCFRHVSIILKTQLNVELQLQTSFQDMLSLSDEEFGYKRPMGGLMIPCGENVFLDITSRSLELIGSNPTMIRLT

SEQ ID NO: 147250 - protein, 358 aa, Glycine max
  Coding DNA Sequence Number=SeqID_30472
  Gene Ontology: Mol. function=transcription regulator activity; Cellular component=nucleus; Biological process=regulation of transcription
  Homolog annotation: Hit_ID=Q2R581; Match level="QueryCoverage=59%, HitCoverage=79%, E-value=3e-20, Identity=33%"; Hit description =Expressed protein
MEEYLSPLAVTHLLQQTLRSLCIHQNSQWVYVVFWRIVPRNYPPPKWESEAANDKSRGNRRNWILVWEDGFCNFATSSAPEINSGDYPPLSVYGNYECQPYQGLQPELFFKMSHEIYNYGEGLIGKVAEDQSHKWIDINFLSSCNNPADLVRGKKWHLACTYTYPRTWEAQFQSGIKTIALIAVREGVIQLGGVHKVIEDQNYVFLLRKKFSYIESIPGVLLPHPSSFSAYQCCKVEDYGASEQRHFQDNYNNVKAPNELYHDQWGHYYSINSLEALLFNLPSVESPPPPTQSHLFPSQRDLEFMGLQNEVAEKKLDDVVHWTELDVGESSNFMSRYHHRYQDQNVISGSGANNGFWY

SEQ ID NO: 147251 - protein, 134 aa, Glycine max
  Coding DNA Sequence Number=SeqID_30473
  Gene Ontology: Biological process=auxin mediated signaling pathway
  Homolog annotation: Hit_ID=Q1S9X2; Match level="QueryCoverage=66%, HitCoverage=97%, E-value=2e-29, Identity=68%"; Hit description=Auxin responsive SAUR protein
  Pfam annotation: Domain name=Auxin_inducible; Domain location=43-132; Score=179.2; E_value=9.8e-51; Accession=PF02519.5; Description=Auxin responsive protein
  Subcellular localization annotation: CTP_CleavageSite=38; ConfidenceScore=5.17e-01
MAVSILDSNNHSHPKAFEVQKLASYLRLFLHKFSLQVSAHTTMGFRLPGIRKASFAANKASSKSVDVPKGYLAVYVGEKIKRFVIPISYLNQLSFQDLLSQAEEEFGYDHPMGGLTIPCGEDVFLDTVSRLNMF

SEQ ID NO: 147252 - protein, 98 aa, Glycine max
  Coding DNA Sequence Number=SeqID_30474
  Gene Ontology: Mol. function=catalytic activity; Biological process =auxin mediated signaling pathway
  Homolog annotation: Hit_ID=P33083; Match level="QueryCoverage=65%, HitCoverage=88%, E-value=1e-22, Identity=70%"; Hit description=Auxin- induced protein 6B
  Pfam annotation: Domain name=Auxin_inducible; Domain location=1-76; Score=82.8; E_value=1e-21; Accession=PF02519.5; Description=Auxin responsive protein
MGFRLPGIRKALFAANQASSKAVDAPKGYVLYLNQPSFQDLLSHAEEEFGYEHPMGGLTIPCSEDASSKLVKISLSQEIWKRKTIRLTKLQYVVVNVQ

SEQ ID NO: 147253 - protein, 163 aa, Glycine max
  Coding DNA Sequence Number=SeqID_30475
  Gene Ontology: Mol. function=catalytic activity; Biological process =auxin mediated signaling pathway
  Homolog annotation: Hit_ID=P33079; Match level="QueryCoverage=99%, HitCoverage=100%, E-value=1e-27, Identity=66%"; Hit description =Auxin-induced protein 10A5
  Pfam annotation: Domain name=Auxin_inducible; Domain location=1-71; Score=113.2; E_value=7.6e-31; Accession=PF02519.5; Description=Auxin responsive protein
  Pfam annotation: Domain name=Auxin_inducible; Domain location=74-161; Score=137.7; E_value=3.1e-38; Accession=PF02519.5; Description=Auxin responsive protein
  Pfam module annotation: Pfam domain module=Auxin_inducible::Auxin _inducible; Domain location=1-71::74-161
MGFRLPSIRRASFKASQAASKSAEVPKGYLAVYVGEKQKRFVIPVSYLNQPSFQNLLSQAEEEFGYDHPMAKTMGFRLLGRRTSFTSLAASKVVEVPKGYVAVYVGEKMKRFTIPIAFLNQPLFQELLKQAEDEFSYYHPMGGLTIPIKEYVFLDIASRLNLL

SEQ ID NO: 147254 - protein, 96 aa, Glycine max
  Coding DNA Sequence Number=SeqID_30476
  Gene Ontology: Mol. function=catalytic activity; Biological process =auxin mediated signaling pathway
  Homolog annotation: Hit_ID=P33080; Match level="QueryCoverage=82%, HitCoverage=86%, E-value=9e-33, Identity=80%"; Hit description=Auxin- induced protein X10A
  Pfam annotation: Domain name=Auxin_inducible; Domain location=1-87; Score=158.4; E_value=1.9e-44; Accession=PF02519.5; Description=Auxin responsive protein
MGFRLPGIRRASFAENQASSKAVEVPKGYLAVYVGERMKRFVIPISYLTQSSFQDLLSRAEEEFGYDHPMGGLTIPCREDVACHSIRKTRLGCPDD

SEQ ID NO: 147255 - protein, 146 aa, Glycine max
  Coding DNA Sequence Number=SeqID_30477
MAAEWRRKRERRRHFKEKISLEEAHHHRRPWIRAWRKKEMNEGRGREEHEILCSKRALKSEIIGPNLGPWAQKSTLRFMRTLGPSSAALAQSSWSLLLMVLVIGPFLGRIASEDYKIRVMGPTGRQGHMALPWRTFSRMNLASYSL

SEQ ID NO: 147256 - protein, 73 aa, Glycine max
  Coding DNA Sequence Number=SeqID_30478
MAFHIPGKNHGTKYLSTSSNKDDLQFVSTLTKCGVNYNSLTQDQSESGVGVCHHKARTSGSVVPRSELTLIPS

SEQ ID NO: 147257 - protein, 96 aa, Glycine max
  Coding DNA Sequence Number=SeqID_30479
MQLLPKLELASTGNTLENASQSVTVKCEHRPSHGSKEFPLASSLPELTYAKIMVSQDNVFVGNFVKHLVCYGTYLDGLAMGYFEAKQSEGVQPLHS

SEQ ID NO: 147258 - protein, 120 aa, Glycine max
  Coding DNA Sequence Number=SeqID_30480
MAKFRRYALEIEGLVVASGLSPLITCSLNTGDRRLIFEQFYVDDAINMLVELLEVNATEARAETIQYHDSYVRLSWLRDVYQMKIEMGSLDGHSSTEEGCTTVWIHPDYSAIFCCIFALC

SEQ ID NO: 147259 - protein, 82 aa, Glycine max
  Coding DNA Sequence Number=SeqID_30481
MGSAWKTLNINRRILNRCFLLSFLVVQFLYSRKRILKNTLLLLLPASRCGDDKKLKGQSKNEFKMFKIESRTLQHFKIQEES

SEQ ID NO: 147260 - protein, 254 aa, Glycine max
  Coding DNA Sequence Number=SeqID_30482
  Subcellular localization annotation: CTP_CleavageSite=21; ConfidenceScore=5.12e-01
MGLMRRPSPSCCVYRGRIFARTAARRRVRIMRTNMTTLTQIWMTLLLSNIQPSDHNSDLPLPKCQLVYAVLTRMSIHVAQLIADDIYLFAGMAPTRHPLDPDKSNRALGFPALITGLCHSFGVPIAPSKVIRPPITRAFIEKYCTQRPAQGDAPQAANAPPPHQAGPAGSFDSEQYLRHLVCQQAANHRAHSQGFTSFPCPTPDQFRAEIAWPGDWLEAQAGEAPAEAPGEADEAHEDEEMTDLLDFLGGSGAT

SEQ ID NO: 147261 - protein, 260 aa, Glycine max
  Coding DNA Sequence Number=SeqID_30483
  Gene Ontology: Mol. function=phosphotransferase activity, for other substituted phosphate groups; Cellular component=integral to membrane; Biological process=phospholipid biosynthetic process
  Homolog annotation: Hit_ID=Q8GUK6; Match level="QueryCoverage=88%, HitCoverage=68%, E-value=8e-45, Identity=74%"; Hit description =Probable CDP-diacylglycerol--inositol 3-phosphatidyltransferase 2
  Pfam annotation: Domain name=CDP-OH_P_transf; Domain location=144 -260; Score=-4.4; E_value=0.027; Accession=PF01066.11; Description =CDP-alcohol phosphatidyltransferase
MEILLNFWLIVFCEYIVLTPDHVHGDAGYMRVLLNCFAFSQCLSNKILFSILYFLRWDTILWTFFGIELFCHLCLWNAGHNLAEFTLPALYVMLLMAGVPANSIKSILIMISLLIFFVPLASFCFVTTVANLDEDIKCPPNVDSSCADCQVSTFGAVLDMVTDRISTACLLVVLSQLYKPSLIFLSLLALDIASHWLQMYSTFLTGKTSHKDVKDSSSWLFRAYYGNRMFMAYCCVSCSLLNPVLSCGESNTETGGRYIK

SEQ ID NO: 147262 - protein, 416 aa, Glycine max
  Coding DNA Sequence Number=SeqID_30484
  Gene Ontology: Mol. function=metal ion binding; Cellular component =integral to membrane; Biological process=metal ion transport
  Homolog annotation: Hit_ID=Q8H658; Match level="QueryCoverage=50%, HitCoverage=56%, E-value=3e-84, Identity=75%"; Hit description=High -affinity nickel-transport protein-like
  Pfam annotation: Domain name=NicO; Domain location=144-363; Score =117.9; E_value=3e-32; Accession=PF03824.6; Description=High-affinity nickel-transport protein
  Subcellular localization annotation: CTP_CleavageSite=44; ConfidenceScore=5.72e-01
MDRLLSSCSSSLNTNLKPFSLLPRFDSVRFNPFSSTRCSFTSISSKHETPPPLSSSPPKTLPPLSPSPLIHFHASVPPSQPLTPNNFQNPKAITARTFAILSSLVLLLIQPAFAPAAFATFQNAAKTGGPAAAAVGGKLIRTELLTSAWTGFFAGCLHTLSGPDHLAALAPLSIGRTRMESAAVGALWGCGHDAGQVIFGLIFLLLKDRLHIEIIRTWGTRVVGLTLLVIGAMGIKEASEVPTPCVALENGECDVSVYESRDSNPVVGKKKIGFATFATGIVHGLQPDALMMVLPALALPSRLAGAAFLIMFLLGTVVAMGSYTVFIGSCSEALKDRVPRITEKLTWASSLIAIALGFAIIISQDVREKFDCLEQGHYLCKILIVYYLTTFVNVYIGVPDEAQCSQKAGVYSWRVK

SEQ ID NO: 147263 - protein, 91 aa, Glycine max
  Coding DNA Sequence Number=SeqID_30485
MKTTITEWEWKEALKTKRGEWKRRRPKLLLLRLFLERREGGVGGGGRRVWVEPRKCVRRVEREGVGEVRVRERWWLRERLTSMDEQERERL

SEQ ID NO: 147264 - protein, 70 aa, Glycine max
  Coding DNA Sequence Number=SeqID_30486
MSLRIKAVVDKFVQELQEALDADIQDRIMKDREMQSYIEEREREVAEREAAWKADLSRREGKVMNKMQKL

SEQ ID NO: 147265 - protein, 237 aa, Glycine max
  Coding DNA Sequence Number=SeqID_30487
MVYRETIEAGGKPTSEILPQILGCLQLPYDTSVKNRLVENLGVRAETSRSSNLCSLMDGFGEYDPRAFSILEESASHGVVPSVSFKVSPIVIDAKELHASTAEVYIITVLKGLKYRLAAGARLPNIIILLPVEETEVVSPKGKKIINLGGRAGQAVGALLRRLQIPHQGSESNGKLRIGGLALKKWFQPKLASPFSVNMGSPTFSGKPGDWNSSLSRLGKNISNQQRNIRIGNLSLD

SEQ ID NO: 147266 - protein, 236 aa, Glycine max
  Coding DNA Sequence Number=SeqID_30488
  Gene Ontology: Mol. function=shikimate kinase activity; Cellular component=cytosol; Biological process=carbohydrate metabolic process
  Homolog annotation: Hit_ID=Q9SLE0; Match level="QueryCoverage=72%, HitCoverage=92%, E-value=9e-47, Identity=54%"; Hit description =Putative gluconokinase
  Pfam annotation: Domain name=SKI; Domain location=58-223; Score=34.1; E_value=6.4e-08; Accession=PF01202.12; Description=Shikimate kinase
  Subcellular localization annotation: CTP_CleavageSite=53; ConfidenceScore=5.50e-01
MTITVHSSQFNSDLNSDNTRKVNRGSKVNIQFLISASQSNRSNMPSNDGIVIVVMGVSGAGKTTIGQMLEKELKYKYLDADDFHLESNKEKMRMGIPLTDEDRMPWLESLCYAIKEYLNNKKGLVLGCSALKKEYREILRSGDTSYNWGTYASAVNFILLDAPAEVLSVRVNKRAAEGKHYMPASLLQSQLDLLKIDEPEGVLRVDATLRPQDIVNTILNMDQFQGCFNHDFVESL

SEQ ID NO: 147267 - protein, 115 aa, Glycine max
  Coding DNA Sequence Number=SeqID_30489
  Homolog annotation: Hit_ID=Q8GVW4; Match level="QueryCoverage=70%, HitCoverage=11%, E-value=4e-07, Identity=36%"; Hit description =Selenium-binding protein-like
MKLLPELELASTGNTLENAPKCAAFKCKCRPSHGTEDFPCGVPVTGAYISRNYGVPRHGISVAHFVKHVANLIAWQWVALRPSKVRECNLFIQRDDGVVLNFKIHKILMHKMEFE

SEQ ID NO: 147268 - protein, 298 aa, Glycine max
  Coding DNA Sequence Number=SeqID_30490
  Gene Ontology: Mol. function=binding; Cellular component =intracellular; Biological process=metabolic process
  Homolog annotation: Hit_ID=Q8GVW4; Match level="QueryCoverage=99%, HitCoverage=73%, E-value=2e-70, Identity=35%"; Hit description =Selenium-binding protein-like
  Pfam annotation: Domain name=PPR; Domain location=128-162; Score =26.8; E_value=7.8e-05; Accession=PF01535.11; Description=PPR repeat
  Pfam annotation: Domain name=PPR; Domain location=229-263; Score =38.3; E_value=2.6e-08; Accession=PF01535.11; Description=PPR repeat
  Pfam annotation: Domain name=PPR; Domain location=26-60; Score=37.7; E_value=4e-08; Accession=PF01535.11; Description=PPR repeat
  Pfam annotation: Domain name=PPR; Domain location=264-298; Score =13.3; E_value=0.2; Accession=PF01535.11; Description=PPR repeat
  Pfam module annotation: Pfam domain module=PPR::PPR::PPR::PPR; Domain location=128-162::229-263::26-60::264-298
MAYSECCSFEDAERVFDGAVQCRDLVAWNSMLGAYLMHEKEDLAFKVFVDMQNFGFEPDPYTYTGIVSACSVQENKTCGKCLQGLVIKSSLDYSVPVSNALITLYIRFNDSMEDAFRIFFSMDLKDCCTWNSILVGCVQGGLSEDALRLFLLMRCLVIEIDHYTFSAVIRSCSDLATLQLGQQVQVLALKVGFDTNNYVGSSLIFMYSKFGIIEDARKYFEATSKDAAIVWNPIIFGYAQHGQGNIALDLFYLMKERKVKPDHIAFVAVLTACSHNGLVEEGCNFIESMESDFGIPSR

SEQ ID NO: 147269 - protein, 177 aa, Glycine max
  Coding DNA Sequence Number=SeqID_30491
  Gene Ontology: Mol. function=binding; Biological process=mRNA editing
  Homolog annotation: Hit_ID=Q8GVW4; Match level="QueryCoverage=59%, HitCoverage=15%, E-value=1e-27, Identity=53%"; Hit description =Selenium-binding protein-like
MPFEADEMVLKNLLGACRFCVDIELASQIAKNLLEPEPEEPCTYVILSEMYGCFKMWDEKASVTRMIRDRGVKKVPGWSWIEAKNKVHAFNAEDHSHPQCSQSQNMHFLISASQSNRSIWLQTTHNRLERLEKEMKYKYLHADDSHSESNKEKMCMGIPLTDEDRCHGLNHYIYVIP

SEQ ID NO: 147270 - protein, 352 aa, Glycine max
  Coding DNA Sequence Number=SeqID_30492
  Gene Ontology: Mol. function=metal ion binding
  Homolog annotation: Hit_ID=Q9LDD1; Match level="QueryCoverage=58%, HitCoverage=59%, E-value=2e-19, Identity=29%"; Hit description =Arabidopsis thaliana genomic DNA, chromosome 3, P1 clone: MGH6
MHVHHQPSQYCHNAICHALYPAVRTWKKKNYFQFFHPWNIQLSADIISSACVTEGDLRVEKVQVMAIQAQWYPNNSASPFCNNGFCAGGLIDSHINFQPKNHLQQQQLQLSEQHLKELYNASHGTVDPNLHVYNSKAVNSHMFAVQLEKQREEIDQYMKSEDEKLRYMLREHGKQVMALLKKLESRSLHVLREKDEEIAQAIKKRVELEEYLRKLEAENMKWQKVAQEKENMALSLYKTLEEMTESGNFLNNGMVANDAVSFCGETGGKEEMDEEEATAEKEKKRIECCGGVSEFEQNTRRGVMVCKSCHSRSSSFLFLPCRHLSCCKVCNTFLEACPVCSTPKKATIELRL

SEQ ID NO: 147271 - protein, 58 aa, Glycine max
  Coding DNA Sequence Number=SeqID_30493
MGVKFLEAVKRRLHAIKQWSSNEIGIRDKGGTRKRVWLRSVTGFIGIYRGGQDVIDYK

SEQ ID NO: 147272 - protein, 134 aa, Glycine max
  Coding DNA Sequence Number=SeqID_30494
MSGFTRDTPQISASPHQLDLAPYASEPYNAQWNAPRILRDKHTLRSSRILGEMEVDEPWLGLWLPLNYRVDMGANPKVFCCKIPFWLVLRWVLWFDLGMAFVHNWVVGMAVTAWASPSFSPSSFALVVLAFIKA

SEQ ID NO: 147273 - protein, 219 aa, Glycine max
  Coding DNA Sequence Number=SeqID_30495
  Homolog annotation: Hit_ID=Q69LD2; Match level="QueryCoverage=27%, HitCoverage=16%, E-value=2e-18, Identity=73%"; Hit description =Putative branched-chain alpha-keto acid decarboxylase E1 beta subunit
  Pfam annotation: Domain name=Transketolase_C; Domain location=78-177; Score=10.0; E_value=0.00049; Accession=PF02780.10; Description =Transketolase, C-terminal domain
MSSPNNSVPQPHVSLLLLRLDVIARLLVLELLLGCHDHSVVIQETDTCELEEHCTKWTYSKSVVALDMTWNMAFMVVLAIMVDEDDVGTFESSSSSGFEGISCELIYLKTLIPWDKETIEASVNKTRRLLVSHEAPITRGFGAKISASIVECCFSRYHVPIKMGLQERTSVSLAHRIILVYRFSFLILPTKKGDVHLCELIDMQKLCMWEKTLYHGVNV

SEQ ID NO: 147274 - protein, 68 aa, Glycine max
  Coding DNA Sequence Number=SeqID_30496
MGSELRVQNLGSGNGSGIWRGCNIVMEVRWWSSQWLVRGSQQWHWRDQEHSEIKDGTWKGIINIVDLE

SEQ ID NO: 147275 - protein, 1104 aa, Glycine max
  Coding DNA Sequence Number=SeqID_30497
  Homolog annotation: Hit_ID=Q1SKA4; Match level="QueryCoverage=79%, HitCoverage=100%, E-value=0.0, Identity=79%"; Hit description =Calcium-binding EF-hand
MDILFAQIQADLRSNDALRQSGALLQALQQSAAGRDIAVIAKTAVEEIVAAPASAVCKKLAFDLIRSTRLTPDLWDTVCGGIRTDLHFPDPDVAAAAVSILAAIPSYRLSKLISDCNKEISDCFDSPSDSLRFSATETLGCVLARDDLVTLCENNVNLLDRVSAWWARVGSNMLDRSDAVSKVAFESVGRLFQEFSSKRMSKLAGDKLVDSENSLAIRSNWVSSMVDFVWRKRRALMARSLILPVENFRATVFPVVYSVKAVASGGVEVIRKLSKASSTSASNADAEVDSHAEKLVGVSDVLTHLAPFLVSSLEPALIYEVGINMLYLADVPGGKPEWASQSIIAILTLWDRQEFASARESIVRAVVTNLHLLDLHMQLVVLDIAVLIMYKWLLVGITVQEESVRRGQKPLPGTDIASLFEDARVNDDLNSITSKSIFREELVASLVESCFQLSLPLPEQKNTGMESRVIGALAYGTGYGALNWTEPALEVVEVCRPCVKWDCDGRTYAIDCYLKLLVRLCYIYDTRGGVKRVKDGASQDQILNETRLQNLQRELVKDLREVNTPRILARLIWAIAEHIDIEGLDPLLADDPDDPLNVIISNIHKVLFNIDSTAETTNRVQDVQAVLISAQRLGSRHPRAGQLLTKELEEFRNNPLADSVSKHQCRLILQRIKYATSHQDSRWAGVTEARGDYPFSHHKLTVQFYEASAAQDRKLEGLVHKAILELWRPDPSELTLLLTKGVDSTLLKVPPNAITLTGSSDPCYVEGYHLADSSDGRITLHLKDPVLCSVTVGVSHFERCALWVQVLYYPFYGSGAVGDYEGDYAEEDPQIMRQKRSLRPELGEPVILRCQPYKIPLTELLLPHQISPVEFFRLWPSLPAIVEYTGTYTYEGSGFKATAAQQYGASPFLSGLKSLSSKPFHIVCSHIIRTVAGFEMCYAAKTWHGGFLGMMIFGASEVSRNVDLGDETTTMLCKFVVRASDPSITKEIGSDLQGWLDDLTDGGVEYMPEDEVKVAAAERLRISMERIALLKAAQPRPKTPKSDNEDEEEEDDKNKEKKDGEDEKKKGPSTLSKLTAEEAEHQALQAAVLQEWHMICKDRTTEVN

SEQ ID NO: 147276 - protein, 754 aa, Glycine max
  Coding DNA Sequence Number=SeqID_30498
  Gene Ontology: Mol. function=structural constituent of cytoskeleton; Cellular component=basolateral plasma membrane; Biological process =cytoskeleton organization and biogenesis
  Homolog annotation: Hit_ID=Q1SKB0; Match level="QueryCoverage=98%, HitCoverage=99%, E-value=0.0, Identity=81%"; Hit description=Ankyrin
  Pfam annotation: Domain name=Ank; Domain location=115-144; Score=0.7; E_value=24; Accession=PF00023.20; Description=Ankyrin repeat
  Pfam annotation: Domain name=Ank; Domain location=171-203; Score =12.3; E_value=0.53; Accession=PF00023.20; Description=Ankyrin repeat
  Pfam annotation: Domain name=Ank; Domain location=217-249; Score =10.3; E_value=1; Accession=PF00023.20; Description=Ankyrin repeat
  Pfam annotation: Domain name=Ank; Domain location=303-335; Score =35.5; E_value=1.9e-07; Accession=PF00023.20; Description=Ankyrin repeat
  Pfam annotation: Domain name=Ank; Domain location=340-372; Score =24.5; E_value=0.00038; Accession=PF00023.20; Description=Ankyrin repeat
  Pfam annotation: Domain name=Ank; Domain location=373-405; Score =21.5; E_value=0.0031; Accession=PF00023.20; Description=Ankyrin repeat
  Pfam annotation: Domain name=Ank; Domain location=443-476; Score=3.2; E_value=11; Accession=PF00023.20; Description=Ankyrin repeat
  Pfam annotation: Domain name=Ank; Domain location=477-509; Score =28.1; E_value=3.2e-05; Accession=PF00023.20; Description=Ankyrin repeat
  Pfam annotation: Domain name=Ank; Domain location=544-576; Score =33.2; E_value=9.2e-07; Accession=PF00023.20; Description=Ankyrin repeat
  Pfam annotation: Domain name=Ank; Domain location=577-609; Score =43.3; E_value=8.1e-10; Accession=PF00023.20; Description=Ankyrin repeat
  Pfam annotation: Domain name=Ank; Domain location=610-652; Score=0.1; E_value=30; Accession=PF00023.20; Description=Ankyrin repeat
  Pfam annotation: Domain name=Ank; Domain location=80-112; Score=18.9; E_value=0.019; Accession=PF00023.20; Description=Ankyrin repeat
  Pfam module annotation: Pfam domain module=Ank::Ank::Ank::Ank::Ank::An k::Ank::Ank::Ank::Ank::Ank::Ank; Domain location=115-144::171 -203::217-249::303-335::340-372::373-405::443-476::477-509::544 -576::577-609::610-652::80-112
MTVFSAKQVFPVDYEETEVSQRLLEASHSGDLSLAFRCIVDPSVDVNFAGAVTLKIASTDLLLLPESPSQVRLDFQEFISDVSPLFLAVHAAHAALVRKLLSVGADVNQRLFRGFATTAAVREGHFNILEILLKAGASQPACEEALIEASCHGQAGCLELLMSSDFIRPHVAVHALVTASCRGFVDVVETLIKCGVDSSATDRVLLQSLKPSLHINVDCTALVAAVIHRQVPVVDLLLQNGVRLDFEVRLGAWSWDTSTGEELRVGAGLGEPYGITWCAVEYFEKSGAILRLLLQHASSKPHSGRTLLHHAILCGNVEAVKVLLECGADVESPVKTTSKTRFLPIHMASRIGLPTIIQCLIDFGCDLNSTTDSGDSALMICAKYKQEECLKVLTRAGADFGLVNIAGQSASSIAKSDNWSLGFQQAVLDTIRRGKIPKSSNATTFSPLIFVAQAGDTEALKIVIESGAFDVDYQDDSGFSAVMHAASKGHVDSFRLLVYAGADVKLCNKSGETAITLSEMNLNCDLFEKVMLEFELEKGNINAGGFYALHRAARRGDLDAVTLLTSKGYDVNAPDGEDYTPLMLAAREGHASICELLISYGAHCNAKNARGETALLLARKVTGGKSDAEAVILNELARKLVLGGAYVLKHTKGGKGSPHGKQMQMLGSAGVLCWGKSSRRNVVCCEAELGPSSTLRRNRYKKGDAEEPGMFRVLTSKSREVHFVCDGGLEVAELWVRGIKLVTKEAIFHKQRSV

SEQ ID NO: 147277 - protein, 55 aa, Glycine max
  Coding DNA Sequence Number=SeqID_30499
MSDSNGGCSTSRWSQTPMAVVNGDDGNEEIAVTGHKWRSQVLQLGGHSSIQLMAL

SEQ ID NO: 147278 - protein, 53 aa, Glycine max
  Coding DNA Sequence Number=SeqID_30500
MVEIISDANLKDEGNIDKMSELKNLSELKQCCLKKQFDPSPKTAILEAKSKEL

SEQ ID NO: 147279 - protein, 100 aa, Glycine max
  Coding DNA Sequence Number=SeqID_30501
  Gene Ontology: Mol. function=transporter activity; Cellular component= membrane; Biological process=oligopeptide transport
  Homolog annotation: Hit_ID=Q6J933; Match level="QueryCoverage=84%, HitCoverage=30%, E-value=1e-15, Identity=44%"; Hit description =Nitrate transporter
MFYITESLDKMKSIGNSLQYLVVAFSIYVGTLLVNVVHQLTRKHGGIDWLNDDINAGRLDYYYFLMAGLALINLVYILFCVKHYCYKVNVEEKVVEKLEP

SEQ ID NO: 147280 - protein, 87 aa, Glycine max
  Coding DNA Sequence Number=SeqID_30502
MWYHVNEKPRWALKIHDKTNHTLGDQSGSRYFARMLQPCGIGTSLKEHSNRVYLPPRPTLRRVHQGLSLLIQFYLVALVIKLVESPQ

SEQ ID NO: 147281 - protein, 66 aa, Glycine max
  Coding DNA Sequence Number=SeqID_30503
MWEDFNPWSHLHKYRPRWFMWVANTDAKAIDSAEIYSSQVLHAEKRTPGKMIEEIKGEKGSSVDDA

SEQ ID NO: 147282 - protein, 128 aa, Glycine max
  Coding DNA Sequence Number=SeqID_30504
MEAIASHDPQATTLLLTRPVEPQITETLFKLVYMSSQMMLRKKKKKKTTKQHILPQERCHDLCGKSESEYPSLVLAVASNCASSESETRTRESVEAEEGSSVEDARYQSRQMEKARTMNRMIIIHRDE

SEQ ID NO: 147283 - protein, 39 aa, Glycine max
  Coding DNA Sequence Number=SeqID_30505
MNIVTDDASNQMINVSELMLQQTRVQSIVAKLSLILYLP

SEQ ID NO: 147284 - protein, 661 aa, Glycine max
  Coding DNA Sequence Number=SeqID_30506
  Gene Ontology: Mol. function=protein serine/threonine kinase activity; Biological process=protein amino acid phosphorylation
  Homolog annotation: Hit_ID=Q10PA1; Match level="QueryCoverage=99%, HitCoverage=98%, E-value=1e-128, Identity=41%"; Hit description =Protein kinase family protein, putative, expressed
  Pfam annotation: Domain name=APH; Domain location=316-487; Score= -14.7; E_value=0.064; Accession=PF01636.13; Description =Phosphotransferase enzyme family
  Pfam annotation: Domain name=Pkinase; Domain location=314-584; Score =92.9; E_value=9.5e-25; Accession=PF00069.15; Description=Protein kinase domain
  Pfam annotation: Domain name=Pkinase_Tyr; Domain location=314-584; Score=38.1; E_value=8.3e-15; Accession=PF07714.7; Description =Protein tyrosine kinase
  Pfam module annotation: Pfam domain module=APH::Pkinase::Pkinase_Tyr; Domain location=316-487::314-584::314-584
MTVEKRIVLVGIRIDGYSRQLLNWALAKVAEPGDCVIAVHVVKSSDYVSKNKTLIDGYLEVYEGLCGVKKVGLTGQIFTGSSIKNILVREAKKHAALALVVGGRAATAKYCAKRLQPTTNVLAIQDSRIVFRSCTNKQLPGGLILDPRPSLTIIKENLRDRAIHSSICDSIVEIEESTRKNSLESKEEAFNGSEKSKSRSISMFAGDSAEQKLGWPLLRRANSGMSQTLHARDMSVVQWVMTLPDRSPNKGSSSSSTEENPFERSISDVEYESSSNSSPSSVDIPNGLEEMLNLNSLNCKRFSLEVLKSCTSQFSSEKLVGKGGSNRVYKGVLTDGKSIAVKVMQSSKEAWKDFALEVEIISSLEHKSIAPLLGICIENNTLISVYDYFPNGSLEENLHGKNKDESILSWEVRFNVAIRIAEALDYLHREALKPVIHKDVKSSNILLSQGFEPQLSDFGLAVWGPTTSSFLTQDVVGTFGYLAPEYFMYGKVSDKIDVYAFGVVLLELISGREPINSAACKGQESLVVWAKPIIESGNVKGLLDPNLEGKFDEAQLQRMVLAASLCITRAARLRPKLSQILKILKGEEKVEYFLNSQGDNDQEDSENQENIDDEVYPNSSAELHLSLALLGVDDDSTSHSSTDHSYSEDLKEQWSRSSSFN

SEQ ID NO: 147285 - protein, 68 aa, Glycine max
  Coding DNA Sequence Number=SeqID_30507
MSKHKFIAYVLSGLREPCYQWRKAKIPPYNMSLQPMVPPERASLHKLPMAVGNNSTTPFCHGSSGGTI

SEQ ID NO: 147286 - protein, 231 aa, Glycine max
  Coding DNA Sequence Number=SeqID_30508
  Gene Ontology: Mol. function=nucleotide binding; Cellular component =intracellular; Biological process=small GTPase mediated signal transduction
  Homolog annotation: Hit_ID=Q6KCN0; Match level="QueryCoverage=99%, HitCoverage=100%, E-value=2e-89, Identity=74%"; Hit description =Small GTPase Rac4
  Pfam annotation: Domain name=Miro; Domain location=8-140; Score=50.3; E_value=6.4e-12; Accession=PF08477.3; Description=Miro-like protein
  Pfam annotation: Domain name=Ras; Domain location=8-213; Score=195.1; E_value=1.7e-55; Accession=PF00071.12; Description=Ras family
  Pfam module annotation: Pfam domain module=Miro::Ras; Domain location= 8-140::8-213
  Subcellular localization annotation: CTP_CleavageSite=8; ConfidenceScore=5.07e-01
MSASRFIKCVTVGDGAVGKTCMLISYTSNTFPTVFLGSVVLTFLLELLMLAKDYVPTVFDNFSANVVVDGSTVNLGLWDTAGQEDYNRLRPLSYRGADVFLLAFSLISRASYENVAKKWIPELRHYAPGVPIILVGTKLDLRDDKQFFQDHPGAVPITTAQGEELRKLIGAPVYIECSSKTQQVKGSHDLIDVSLCIQNVKAVFDAAIKVVLQPPKQKKKKRKGQKACSIL

SEQ ID NO: 147287 - protein, 75 aa, Glycine max
  Coding DNA Sequence Number=SeqID_30509
MGLARTTERSMDLCEEWKGTLRTKRTTRIKMHEVVKIHRKMKRERERERETAEEVGFEKRLRIQMRIESARVLIV

SEQ ID NO: 147288 - protein, 83 aa, Glycine max
  Coding DNA Sequence Number=SeqID_30510
MKDKEFAYDMFRRLKSKAQINLKVLDNFPKVWEPKNKAIQEARDMKNLGWDELLGILRFHEVQIMFVAAILGRKKSGLKLIPV

SEQ ID NO: 147289 - protein, 279 aa, Glycine max
  Coding DNA Sequence Number=SeqID_30511
MRRFYEGSTIVHNTPLLSGQVKVSVEEVTDADAPVPVPIDEVSLVGQALHTFLAWPTHLVVVSPAKPPPKPDPEVDDLLYLMTLTIPELFLRPYQVRWDATVFGVFNPDFPLYIKHEDLSEIAHGGQCLSISVLQLWILHLTETCMRAGNSDIYGFLEPQSIQRWGQSLLESESYIKTWMQSSKRDVYLGAYLNGPDNYLKGIINSLNQRLLLGGLSSRQKGSTECGYYVMHWMSTIILGTFRNNWEAYFNDPRPLELERLKALRIQWAQFYIRVRDQA

SEQ ID NO: 147290 - protein, 1524 aa, Glycine max
  Coding DNA Sequence Number=SeqID_30512
  Gene Ontology: Mol. function=ubiquitin-protein ligase activity; Cellular component=intracellular; Biological process=protein modification process
  Homolog annotation: Hit_ID=Q1T683; Match level="QueryCoverage=92%, HitCoverage=74%, E-value=0.0, Identity=74%"; Hit description=HECT
  Pfam annotation: Domain name=Arm; Domain location=209-249; Score =10.2; E_value=0.65; Accession=PF00514.13; Description=Armadillobeta -catenin-like repeat
  Pfam annotation: Domain name=Arm; Domain location=291-331; Score =12.1; E_value=0.38; Accession=PF00514.13; Description=Armadillobeta -catenin-like repeat
  Pfam annotation: Domain name=Arm; Domain location=334-372; Score =20.1; E_value=0.0078; Accession=PF00514.13; Description =Armadillobeta-catenin-like repeat
  Pfam annotation: Domain name=HEAT; Domain location=214-251; Score =19.6; E_value=0.012; Accession=PF02985.12; Description=HEAT repeat
  Pfam annotation: Domain name=HEAT; Domain location=339-374; Score =17.1; E_value=0.063; Accession=PF02985.12; Description=HEAT repeat
  Pfam annotation: Domain name=HEAT; Domain location=541-577; Score =6.0; E_value=8; Accession=PF02985.12; Description=HEAT repeat
  Pfam module annotation: Pfam domain module=Arm::Arm::Arm::HEAT::HEAT:: HEAT; Domain location=209-249::291-331::334-372::214-251::339 -374::541-577
  Subcellular localization annotation: CTP_CleavageSite=56; ConfidenceScore=5.95e-01
METRSRKRAEASSAAPSSPSSGPTTRSSKRARLSSSSSASAAAAAASVSSVNTRSRSSRTKEPLPPKNPPPMDSANESSGSRRDRRNKDNSDKGKEKEHDVRIRDRDADRGLALNMDGGGDDDDNDSEGGVGILHQNLTSASSALQGLLRKLGAGLDDLLPSSAMGSASSSHQSGRLKKILFGLRADGEEGRQVEALTQLCEMLSIGTEESLSTFSVDSFVPVLVGLLNHESNPDIMLLAARALTHLCDVLPSSCAAVVHYGAVSIFCARLLTIEYMDLAEQSLQALKKISQEHPTACLRAGALMAVLSYLDFFSTGVQRVALSTAANMCKKLPSDAADFVMEAVPLLTNLLQYHDSKVLEHASVCLTRIAEAFASSPDKLDELCNHGLVTQAASLISNSSSGGGQASLSTPTYTGLIRLLSTCASGSPLGAKTLLLLGISGILKDILSGSGVSSKASVSPALSRPPEQIFEIVNLTNELLPPLPHGTISLPIISNMFLKGPIVKKSPAGSSGKQEDTNGNVPEISAREKLLNDQPELLKQFAMDLLPVLIQIYGSSVNGPVRHKCLSVIGKLMYFSTAEMIQSLLSVTNISSFLAGVLAWKDPHVLLPALKIAEILMEKLPGTFSKMFIREGVVHAVDQLILTGNSTNISTQASSAEKDNDSISGASSRSRRYRRRSGNSNPDGNPLDDLKTPVSVNVGSPPNSVDMPTVNSSIRLSVSTAAKAFKDKYFPSDPGAAEVGITDDLLHLKNLCMKLNAGADEQRTNGKGKSKTSGFGLEEYLIGIIADMLKELGKGDGVSTFEFIGSGVVAALLNYFSCGYFSKDRPLETHLPKLRQQALTRFKLFIAVALPSTTEDGTVAPMTVLVQKLQNALSSLERFPVVLSHSSRSSSGSARLSSGLSALSQPFKLRLCRAQGERSLRDYSSNVVLVDPLASLAAIEEFVWPRIQRSELGQKSTVPAGNSESGTTPTGAGVSSPTTHRHSTRSRSSVNIGDTSRKEISQDKSTSSSKGKGKAVLKPAQEEARGPQTRNATRRREALDKDAQIKPVNGDSTSEVNARALVEEVKRGMRKNDEDLDISPVEIDEALVIEDDDISDDEDDDHDDVLRDDSLPVCSPDKVHDVKLGDIVEESNVAPATSDGGQTNAASGSSSKAGTVRGSDSADFRSGYTSSSRGAMSFAAAAMAGLGSANSRGIRGGRDRLGRPLFGSSNDPPKLIFTAGGKQLNRHLTIYQAIQRQLVLDEDDEERFAGSSDYVSSDGSRLWGDIYTITYQRAENQTDRTPPGGSTSNASKSGKSGSVLNSSSEDKLNQTSVLDSILQGELPCELEKSNPTYNILALLRVLEGLNQLASRLRAQVVTDSFAEGKILDLVELSFTSGARVPTEEFISSKLTPKLARQIQDALALCSGSLPSWCYQLSKACPFLFPFETRRQYFYSTAFGLSRALYRLQQQQGADGHGSTNEREVRVGRLQRQKVRVSRNRILDSAAKVMELYSSQKAVLEVEYFGEVGTGLGSHSGVLHTSQS

SEQ ID NO: 147291 - protein, 888 aa, Glycine max
  Coding DNA Sequence Number=SeqID_30513
  Gene Ontology: Mol. function=beta-galactosidase activity; Cellular component=beta-galactosidase complex; Biological process =carbohydrate metabolic process
  Homolog annotation: Hit_ID=Q1T694; Match level="QueryCoverage=89%, HitCoverage=96%, E-value=0.0, Identity=74%"; Hit description=D -galactoside/L-rhamnose binding SUEL lectin; Galactose-binding like
  Pfam annotation: Domain name=Gal_Lectin; Domain location=807-886; Score=117.3; E_value=4.3e-32; Accession=PF02140.8; Description =Galactose binding lectin domain
  Pfam annotation: Domain name=Glyco_hydro_2_N; Domain location=489 -627; Score=-56.1; E_value=0.039; Accession=PF02837.8; Description =Glycosyl hydrolases family 2, sugar binding domain
  Pfam annotation: Domain name=Glyco_hydro_35; Domain location=96-403; Score=549.4; E_value=3.7e-162; Accession=PF01301.10; Description =Glycosyl hydrolases family 35
  Pfam annotation: Domain name=Glyco_hydro_42; Domain location=117-469; Score=-240.9; E_value=0.012; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=807-886::489 -627::96-403::117-469
MLLVTNGIAETVSEQLLHLIRRRVTSIKPHFTSFSFSPFCTYNLNMSILKVLLITIIVSLVISASSAHDEDNKKMTSESDDNDKDKKKTVTYDGRSLIINGRRELLFSGSIHYPRSTPEMWADILEKAKHGGIKVVQTYIFWNIHEPEKGKFSIEPQYDYIKFMKLVQKKGMYVTLRVGPFIQAEWNHGGLPYWLREIPDIIFRSNNEPFKKHMKEYVSTVVKTLKEAKLFGPQGGPIILAQIENEYNHIQRAFREEGDNYVQWAAKMAVSLDVGVPWIMCKQRDAPDPVINACNGRHCGDTFAGPNKPYKPSLWTENWTVQYRVFGDPPSRRSAEDIAFSVARFFSKNGSLVNYYMYHGGTNFGRTSSAFTTTQYYDEAPLDEYGMQREPKWSHLRDVHKALSLCKKALFNGESTVTKLSQHHETIVFEKPGSDLCAAFLTNNHTLTPATIKFRGTDYYMPPRSISILPDCKTVVFNTQFIASQHNSRNFKRSMAANNHKWEVYSENIPTTKQIPTNEKIPTELYSLLKDTSDYAWYTTSVELGPEDLPKKNDISPVLRIMSLGHSLVAFVNGEFIGSNHGSHEEKSFEFQKPVTLKVGVNQIAILACTVGLPDSGAYMEHRFAGPKSIFILGLNSGKIDLASNGWGHKVGIKGEELGIFTEEGSKKVQWKEAKGSGPALSWYKTNFETPEGTDPVAIRMTGMGKGMIWINGKSIGRHWMSYLSPLGMPTQSEYHIPRAFFNPKDNLIVVFEEEIANPEKVEILTVDRDTICSFITENHPPNVKSWAVKSEKFQALSNNLVPTATLKCPNRRTIKAVEFASFGDPAGVCGAYTLGKCNAPSTKQIVEKHCLGKQSCNVPIDKDAFTKGQDACRNMVKALAIQVKCEA

SEQ ID NO: 147292 - protein, 117 aa, Glycine max
  Coding DNA Sequence Number=SeqID_30514
  Gene Ontology: Mol. function=oxidoreductase activity; Cellular component=integral to membrane; Biological process=response to oxidative stress
  Homolog annotation: Hit_ID=Q5QIA9; Match level="QueryCoverage=83%, HitCoverage=34%, E-value=5e-50, Identity=95%"; Hit description =Peroxisomal ascorbate peroxidase
  Pfam annotation: Domain name=peroxidase; Domain location=18-116; Score=-91.4; E_value=0.026; Accession=PF00141.13; Description =Peroxidase
MALPVVVDAEYLKEVDKARRDLRALIANRNCAPLMLRLAWHDAGTYDAKTKTGGPNGSIRNEEEYSHGANNGLKKAIDFCEEVKEKHPKITYADLYQVKIVEWGQWTFKLVWHVHDS

SEQ ID NO: 147293 - protein, 221 aa, Glycine max
  Coding DNA Sequence Number=SeqID_30515
  Gene Ontology: Mol. function=oxidoreductase activity; Cellular component=integral to membrane; Biological process=response to oxidative stress
  Homolog annotation: Hit_ID=Q5QIA9; Match level="QueryCoverage=99%, HitCoverage=67%, E-value=3e-82, Identity=71%"; Hit description =Peroxisomal ascorbate peroxidase
  Pfam annotation: Domain name=peroxidase; Domain location=1-159; Score= 10.7; E_value=2e-09; Accession=PF00141.13; Description=Peroxidase
MLKLAGVVAVEVTGGPTIDFAPGRRDSKISPNEGRLPDAKKGVSHLHDIFYRMGLTDRDIVALSGGHTLGRAHPERSGFDGPWTEDPLKFDNSYFVHFVELHFCLAIPKEFDFYLQLNIIVNIRELLKEDSAGLLKLPTDKALLEDAEFRRYVELYAKDEDAFFRDYAESHKKLSELGFVPSSKPISIKDGTILAQGAVGVVVTAAVVIISYLYEVRKRGK

SEQ ID NO: 147294 - protein, 69 aa, Glycine max
  Coding DNA Sequence Number=SeqID_30516
  Gene Ontology: Mol. function=cysteine-type peptidase activity; Cellular component=cytoplasm; Biological process=fucose metabolic process
MLPKSYNEAKKILRPMDMEYQKIHACPNDFLMYRDKYEEMHKCLNCGVSRYKVNDDDECSSDESTNKGP

SEQ ID NO: 147295 - protein, 83 aa, Glycine max
  Coding DNA Sequence Number=SeqID_30517
MTSVAVIKAQRKASQRRHMVETNMRVGNASMYGFLEPQSIHRSEQSQFELEDYIKKWIRNSQSDVYLGACLNGAILANDSYMS

SEQ ID NO: 147296 - protein, 87 aa, Glycine max
  Coding DNA Sequence Number=SeqID_30518
MNPLLVDSSTITSDQEVDLLQWSIKKVKMKEPEVATDMDQDCNGGKVEPCPYKDNLLGHEGLILLEDIMEEQDEEKKLLEDKFYRET

SEQ ID NO: 147297 - protein, 147 aa, Glycine max
  Coding DNA Sequence Number=SeqID_30519
  Gene Ontology: Mol. function=oxidoreductase activity; Cellular component=chloroplast; Biological process=cell redox homeostasis
  Homolog annotation: Hit_ID=Q1T4N5; Match level="QueryCoverage=60%, HitCoverage=54%, E-value=4e-34, Identity=79%"; Hit description =Thioredoxin fold
  Pfam annotation: Domain name=Redoxin; Domain location=14-147; Score =20.3; E_value=0.00013; Accession=PF08534.1; Description=Redoxin
MDGFGMFNEFVLTATGSESEQEISFQKHRWRAARVEKLQIFYVADKVCFFLVFPLTTSVLFILVNDPFVMNSWAKTFLENKHVKFLADGAAKYTNALGLQVDLTDKGHGIRSKRFALMVEDLKVKVAHVESGGEFTISSAEEIIQAL

SEQ ID NO: 147298 - protein, 820 aa, Glycine max
  Coding DNA Sequence Number=SeqID_30520
  Gene Ontology: Mol. function=RNA-directed DNA polymerase activity; Cellular component=chromatin; Biological process=chromatin assembly or disassembly
  Pfam annotation: Domain name=RVP; Domain location=381-487; Score= -12.0; E_value=0.058; Accession=PF00077.10; Description=Retroviral aspartyl protease
  Pfam annotation: Domain name=RVP_2; Domain location=370-501; Score= -34.8; E_value=0.00052; Accession=PF08284.2; Description=Retroviral aspartyl protease
  Pfam module annotation: Pfam domain module=RVP::RVP_2::RVT _1::Retrotrans_gag; Domain location=381-487::370-501::624-791::124-214
MGLIRVQGMKKKMLRKKKIRVQLKRRKKGANTGAFIVLPAPMAESSNDRVEAALARLTSRIEDLLQHVTPSASPSFPPRSPIPAHSHRMKLDVPRFDGTDPLGWIFKITQFFEYHGTPDHDRITIAAFYMEGRALAWFQWMSSNGQFTSWPVFLQALQNRFAPSQYEDPSGSLFKLTQRTTVTEYLSEFEELANRVVGLPAPFLLSCFVFGLVPEIRREVMVNQPLIVAQAAGLARLHEEKLRDFRFDFRQIPRPRAPPPPPLAPTQPPPLTPFASPRFSPLPPLLPSPPRPFPSPPPTVRRLTPEELASRLERGLCFSCDEKFHKGHRCTPRVHLLIADEDDPLEHVGSNIDPADPGDPTPGPIELPETPAHISLNSLAGHLAPETLRLVGHISSHPILVLIDSGSTHNFIQDQLVAQLGLPCRPTTPLKVLVGNGQHLQCHTTCDSTTIDLQQHSFAVDLYVLPIAGANVILGVQWLQSLGPILTDYTKLSMQFFHDGRIVELQGDPVAQRDLLSSPQFRRVCRNQPNSICFHITVLPEDSELALTIPVDPQVQHLLHQFSVLFQDPTTLPPARDTDHQIHLRPDATPVNVRPYKYPYYQKREIETQVEAMLQRGIIQPSKSPFSSSVLLVKKSDNTWRFCVDYRALNALTIKDHFPIPTIDELLDELGGASCFSKLDLLQGYHQIHMQSEDIPKTTFRTHHGHFEFKVMPFGLCNAPSSFQATMNTLFRPYLQRFIIVFFDDILIYSVSLSDHLRHLQTTFQVLYDNHFVLKLSKCLFAQPQWLQRLQPLRSGPFHAPFVLYAVSWDLPVFIADSSV

SEQ ID NO: 147299 - protein, 81 aa, Glycine max
  Coding DNA Sequence Number=SeqID_30521
MGFFSKFFLAGALLELPRGEGRASCSCGLTFCLRGVGRARCTGALCMETRGASQNGVLGLQQAQQLWQTRSREEAQMVLAF

SEQ ID NO: 147300 - protein, 155 aa, Glycine max
  Coding DNA Sequence Number=SeqID_30522
MALDRMQLHNMCKRDNESFKEYAQRWRDLAAPVVPLMMETEMITMIMDTLLVFYYEKMVVFVGERIKVGLRRGKFDYAASAGSSNEGPGRSDERKKEGETHVVAALPVWPNFPLTPYNPCTNILPNKITTQPISVLPITHHPTNQEHPISHKGHS

SEQ ID NO: 147301 - protein, 103 aa, Glycine max
  Coding DNA Sequence Number=SeqID_30523
  Homolog annotation: Hit_ID=Q9FGE5; Match level="QueryCoverage=79%, HitCoverage=14%, E-value=2e-18, Identity=54%"; Hit description =Similarity to general transcription factor IIIC
MADYQHVIPVHADVARRKKRNWSELEELHFDKGGFMDLDHEDVMIIVPPIFAPKDVPENLVLRPATMSSSKKKPEEVVQPHFEGRKINYINEKRGKIQLERGE

SEQ ID NO: 147302 - protein, 33 aa, Glycine max
  Coding DNA Sequence Number=SeqID_30524
MALYGLAFAYSNPLKDTRLPCSGTFRLSRAGKG

SEQ ID NO: 147303 - protein, 67 aa, Glycine max
  Coding DNA Sequence Number=SeqID_30525
MAKWVGLDKLACQPIINLADGSLQSHKCSTSIPHIVVTKPPHQGSTPSHRIALPSLNSYTVATGASR

SEQ ID NO: 147304 - protein, 80 aa, Glycine max
  Coding DNA Sequence Number=SeqID_30526
MKAKEKTSWKRTLDGVRARELTYDLGKVLCCQRLRWFRREWKRCRCHQGERMEKISIMFKTMEEVWQRREVRDVWAHEME

SEQ ID NO: 147305 - protein, 87 aa, Glycine max
  Coding DNA Sequence Number=SeqID_30527
MTHTKNIGQMTSEATKEIAGKIGSFVTHGCQDVLNVAIRRPEYLGCVRAARAGVTIKQYFGPTPRTSRASAPMGPEDLEQLTQKLRD

SEQ ID NO: 147306 - protein, 167 aa, Glycine max
  Coding DNA Sequence Number=SeqID_30528
MLLLQSGTGWFSQHMINCIRQRLMVRYLSVFPKPGAENLLRAATLKFEKLKRECYRHAMKLDGEECQQANLGLEENEELDNGEDEEEAAEGNDSDEEWEEEHDLAGDNEMPLPSDSCILFYSNSKFSHDLFVNFPPNEIDCDNVQANGSEEEYQIYGEDSEDNYSDE

SEQ ID NO: 147307 - protein, 182 aa, Glycine max
  Coding DNA Sequence Number=SeqID_30529
MQSQFQLQMQSQGLALPLKPEVGPSAARVSTKESCVDPSGNDPDMCDSEKCWLYIEENPSCLVAIGRLYEGSIIVHNIPLRHDQVKVGVEEVRDVDVHIPVPIEEEAVGPTKPVNRPDHDVDDPLYRMTFTIPQLFLKSLKVMWDATVFGVFNDNFPLYIKHEDLSKIARSGQYLNIFVIQL

SEQ ID NO: 147308 - protein, 69 aa, Glycine max
  Coding DNA Sequence Number=SeqID_30530
MPESKGLEIRHVEEIVSMKIKGLGSFVTLSNIYVADGECLVLVGLKKSGEILEGDKDKEWNNMASELDM

SEQ ID NO: 147309 - protein, 103 aa, Glycine max
  Coding DNA Sequence Number=SeqID_30531
  Gene Ontology: Mol. function=transition metal ion binding; Cellular component=cytoplasm; Biological process=cytoskeleton organization and biogenesis
LFDVEMGDCLEDMIHDLGQESFQQAYAPMYDTLQTDSKKPLYSGCNNSFTLLSAVLNLVNVKARYGWSDKSFSSLLQVVHDMLPEGNTLPKSYYQAKKILCPM

SEQ ID NO: 147310 - protein, 120 aa, Glycine max
  Coding DNA Sequence Number=SeqID_30532
MHKKRVISCDEESQNVNELQCVEASLSTLLSEGTNVSKLQGVRDRLEALENAIESLENGLERMFKRQEFEGKKVVKHHNYVRDFQTNRSPKTLKKDTNERGHNFKAGKTLQQVAEQRKGC

SEQ ID NO: 147311 - protein, 309 aa, Glycine max
  Coding DNA Sequence Number=SeqID_30533
  Homolog annotation: Hit_ID=Q1S062; Match level="QueryCoverage=94%, HitCoverage=94%, E-value=1e-38, Identity=34%"; Hit description =Arabidopsis conserved protein
  Pfam annotation: Domain name=DUF241; Domain location=54-305; Score =204.4; E_value=2.6e-58; Accession=PF03087.5; Description=Arabidopsis protein of unknown function
MASTFSPKHSRGYAIRSISLPTRSHPSTVPIEEELNKLKSWETSSSSEVERIFFGLSGLANLYECMEDLLKLPLTQQALSHHHNQKWVDELLDCPVRFLDILGETRDAIMLMKGNVRDLQSALRRRKVGDLVIESHVSSYWSLRRNTRKQCTKSLVLLKHSTEGSSFGASSPLDLNHHLSAVVRVLREASLITSSIFQSLVAFLSSPILRSKINNKWTFVSKVMRKGVLQLQCNNQEENVNELEKVDLALCRMVMDNATKDFEAENIQFAHKELEAVVVVIEGLENGLDCLFKHLINTRVSFLNIVSPS

SEQ ID NO: 147312 - protein, 317 aa, Glycine max
  Coding DNA Sequence Number=SeqID_30534
  Homolog annotation: Hit_ID=Q1S066; Match level="QueryCoverage=86%, HitCoverage=92%, E-value=2e-31, Identity=28%"; Hit description =Arabidopsis conserved protein
  Pfam annotation: Domain name=DUF241; Domain location=46-280; Score =175.2; E_value=1.6e-49; Accession=PF03087.5; Description=Arabidopsis protein of unknown function
MANKFHVRSNSFPTGSHPSTITVEEELSKLKTWEATSTSTSKSIGTGLSLLQDLHIDLEDLLNMASTQKLISNHQGEKCMEELLDGSVRILDICGITRDTILQTKENVQSLHSALRRRKGDSSIEKIVAEYNFFSKKMKKNAKKMISTLKQTESKFVASPLLNQDQQLVALVRVLREVIVMNMSIFQSLLTFLAAPASKSKATKWLFVAKLMHKGVIACEEKQENSNELQCVEASLSTLLSDGTNVEKMQAARERLEKLENAIESIENALEIVFRRMNNMAGGLKRIEELEQHAQRVNNRSTRRANWEVRLRIHMTA

SEQ ID NO: 147313 - protein, 177 aa, Glycine max
  Coding DNA Sequence Number=SeqID_30535
  Homolog annotation: Hit_ID=Q1S066; Match level="QueryCoverage=64%, HitCoverage=38%, E-value=3e-13, Identity=33%"; Hit description =Arabidopsis conserved protein
  Pfam annotation: Domain name=DUF241; Domain location=46-177; Score =0.6; E_value=6.8e-06; Accession=PF03087.5; Description=Arabidopsis protein of unknown function
MANMYHVRSNSFPSGSHPCSIRIEEELSKMKTWEATSTSTSESIGTGLSLLEDLYICLEDLLNVASTQKVISNHKGEKCMEELFDGSVGILDICGITRNTMSQVKENVQALHSSLRRRKGDSSIEKSVAEYNFLTKKMKKNAKKLMASLKQMESKFGVSPILNQDQDLASVIKVLRE

SEQ ID NO: 147314 - protein, 397 aa, Glycine max
  Coding DNA Sequence Number=SeqID_30536
  Homolog annotation: Hit_ID=Q1S066; Match level="QueryCoverage=71%, HitCoverage=96%, E-value=6e-30, Identity=29%"; Hit description =Arabidopsis conserved protein
  Pfam annotation: Domain name=DUF241; Domain location=46-285; Score =144.4; E_value=3.1e-40; Accession=PF03087.5; Description=Arabidopsis protein of unknown function
MANKFHVRSNSFPTGSHPSTITVEEQLNKLKTWETTSTSTSKSIFTGLSLLQDLHIRLEDLLNMASTQKMISNHQGEECIEELLDGSVRILDICGITRDTMLQTKENVQALHSALRRRKGDSNIEKIVAEYNCFSKKMKKNVKKLMTSLKQMVESKFGVSPLLNQDQQLASLIKVLREVIVMNMSIFQSLLAFLAFPTSKSKATKWLMVAKLMHKGVIACAENQKNINELQCVEASLSSLVSAGTNVAKMQAAHERLEALENAIESIENVLPIKAERTIACVCNIFDRLEVRVCDRASNQNNKFSCQMHFVRILQLACSSDQVKAFFDARTFLHFIKIQIKLRTPLPRGSSLCEGMGEGCCTQPYPCICKETVSGFEPMTNKSPRHNFTAAPGLALL

SEQ ID NO: 147315 - protein, 126 aa, Glycine max
  Coding DNA Sequence Number=SeqID_30537
MNGSRALLFLVLRWLLTFETAVQLEFHFAFLDVFFLQFDQVNENTSMNDALGYCAFPQEAYFGITIMYSRGDEYEMLEIGKSGKYEKTKLLIQGNCVGCDTMFRCCQCQELTAGVRMRDEHVTHKF

SEQ ID NO: 147316 - protein, 204 aa, Glycine max
  Coding DNA Sequence Number=SeqID_30538
MAFLGETSSQTIVNSRLAFIYPNGSIIHNDTGVYFQTSTPMPIRVPNRCDFASLKTRIHNTLQLSDKQFLDEIHYRKPFTDTGNQIRFECIKLINDDDVNTMLMCNDQFSCVGPIELLCTVGRTPDGIINLLERTMPRIHDAILYYNGKWNMPPQNKFVGCAFRGKNPKKFQIPSTCTIDELKNLIKQVAPKGIPPLGIHESQT

SEQ ID NO: 147317 - protein, 49 aa, Glycine max
  Coding DNA Sequence Number=SeqID_30539
MASSKLTPIPEIEEFKAMNMRNRQFYKAVSLKRGIGLSSQLRRGINRET

SEQ ID NO: 147318 - protein, 158 aa, Glycine max
  Coding DNA Sequence Number=SeqID_30540
  Gene Ontology: Mol. function=oxidoreductase activity, acting on the CH-OH group of donors, NAD or NADP as acceptor; Cellular component =mitochondrion; Biological process=tricarboxylic acid cycle
  Homolog annotation: Hit_ID=Q1RVD4; Match level="QueryCoverage=69%, HitCoverage=29%, E-value=1e-47, Identity=85%"; Hit description =Isocitrate dehydrogenase, NAD-dependent
  Pfam annotation: Domain name=Iso_dh; Domain location=1-156; Score= -147.1; E_value=5.4e-05; Accession=PF00180.10; Description =Isocitrateisopropylmalate dehydrogenase
MGRTDKGACSLLGSFWVPSLAMIITSKTILENTIWGCGLRQVITKFCSERIAKYAFEYAYLNNRKKVTAVHKANIMKLADGLFLESCREVATRYPGIKYNEIIVDNCCMQLVSKPEQFDVMVTPNLYGNLVANTAAGIAGGTGVMPGGIVLISNILKL

SEQ ID NO: 147319 - protein, 515 aa, Glycine max
  Coding DNA Sequence Number=SeqID_30541
  Gene Ontology: Mol. function=catalytic activity; Cellular component =nucleus; Biological process=metabolic process
  Homolog annotation: Hit_ID=Q10S60; Match level="QueryCoverage=91%, HitCoverage=85%, E-value=1e-118, Identity=48%"; Hit description=AMP -dependent synthetase and ligase family protein, putative, expressed
  Pfam annotation: Domain name=AMP-binding; Domain location=17-437; Score=190.6; E_value=3.8e-54; Accession=PF00501.18; Description=AMP -binding enzyme
MTEFSCHPILRRKSLISTLLFDVQRVTTTPLENLKVTALAPNIPALYELHFGVPMAGGVLSALNTQLDVTTLALLLEQLEPCKIMFVDYQLIDSALKACEILSHRKCKPPIIVLIPNYDQEQSFLAKNIPPGTLNYNELIAIGKKDFEALKPNNECNPISVNYTSGSTGILPKGVVYSHRSAYLNSLAAIARFEMKQLPVFLWTVDMFRCNGWCFPWAMSAIGGTNICLRNVSAKGIYDAIYLYKVTQFCGAPTLLDMIANASPSDQRPLPHRVNVTVAGVLPPFHVLNKVSQLGFDVNIGYGMTETLGPVIVRPWNPNSDGEHTKLNYGVSEFRQDVDVKDPETGESTPHDGKTIGEIMFKGNALMLGYLKNSQANDKAFRGGWYRTGDLAVREPNGSITMKDRAKDVIYSKGEVVSSLEVEAVLLNHPKVLKAAVVGRCDECLVESLCAIVKLKDGCSATVEEIIKFCEDHLATHMVPSTVVFGDLPVNSTGKVQKFRIREKIKGSEWYDSKN

SEQ ID NO: 147320 - protein, 521 aa, Glycine max
  Coding DNA Sequence Number=SeqID_30542
  Gene Ontology: Mol. function=DNA (cytosine-5-)-methyltransferase activity; Cellular component=chromatin; Biological process =regulation of transcription, DNA-dependent
  Homolog annotation: Hit_ID=O49139; Match level="QueryCoverage=94%, HitCoverage=64%, E-value=1e-138, Identity=48%"; Hit description=DNA (cytosine-5)-methyltransferase CMT1
  Pfam annotation: Domain name=BAH; Domain location=94-186; Score=23.2; E_value=0.00037; Accession=PF01426.8; Description=BAH domain
  Pfam annotation: Domain name=Chromo; Domain location=349-396; Score =42.4; E_value=1.5e-09; Accession=PF00385.14; Description='chromo' (CHRromatin Organisation MOdifier
  Pfam module annotation: Pfam domain module=BAH::Chromo; Domain location=94-186::349-396
MAKRKTSDASDAQDDTVSLLPSQRNKAKHPNSNSNACFAGKPIPPAEALAKWPHRYPSEGKKKGSARTSKEATSENSEVMPARCHYRQAKVDGVVYNLYDDAYVKAEDGKPDYIARIVEMFETVDKEQCFTAQWFYRAEDTVIKNHGDLVDKKRIFISDVKDVDLTSKKGKLPSCDYYYDMKYTVPYLTFSNIVNETVKTESDASSTISSESGSNGCVSNANLANGKTTQNNSSGSSEWTLLDLYSGCGAMSTGLCFGASLAGIKLVTRWAVDINAHACESLKLNHPETQVRNEPAEDFLNLIKSWAKLCEEFALLGSERLDSDPDMDEDENEAVRKEESGNQSDSEEFEVEKLLAVCYGDPNDVRWLGYASSYDTWEPIEGLSDCKEAMKDFVTKGYKKRLLPLPGDANFICGGPPCQGVSGFNRFRNAAAPLEDTKNKQLLVYMDIIDFLKPKYVLMENVVDILRFSGGYLGRYAICRLVAMNYQARMGMMAAGSYGLPQFRMRVFLWGARPTERRQQG

SEQ ID NO: 147321 - protein, 109 aa, Glycine max
  Coding DNA Sequence Number=SeqID_30543
  Gene Ontology: Mol. function=DNA binding; Cellular component=nucleus
  Homolog annotation: Hit_ID=Q5U8L4; Match level="QueryCoverage=57%, HitCoverage=44%, E-value=1e-08, Identity=58%"; Hit description=SBP transcription factor
  Pfam annotation: Domain name=SBP; Domain location=22-89; Score=37.3; E_value=5.1e-08; Accession=PF03110.5; Description=SBP domain
MKVVSGKCSGSRTASSSSSHSFCRAKECGEGLEHGQELQPPSEVSSIRQRFCQQCSKFHELVEFEDTKRSCRKHWLSIMNVEEKLVETYQHQSHPSQVTNSSLPLLELF

SEQ ID NO: 147322 - protein, 146 aa, Glycine max
  Coding DNA Sequence Number=SeqID_30544
  Gene Ontology: Mol. function=DNA binding; Cellular component=nucleus; Biological process=regulation of transcription, DNA-dependent
  Homolog annotation: Hit_ID=Q5U8L4; Match level="QueryCoverage=54%, HitCoverage=47%, E-value=5e-28, Identity=68%"; Hit description=SBP transcription factor
  Pfam annotation: Domain name=SBP; Domain location=55-133; Score =162.7; E_value=9.1e-46; Accession=PF03110.5; Description=SBP domain
MAKTPSEEEREMDNGNDEEGGEGEVGAKMVQNIKIKLVCGKDSGSRTASSSSHSFCQADECGVNLSMAKSYNRRHKVCERHAKAPVVLVSSIRQRFCQQCSKFHELAEFDDTKRSCRKTLAGHNERRRKARIDVSLGGGEQHQSHF

SEQ ID NO: 147323 - protein, 442 aa, Glycine max
  Coding DNA Sequence Number=SeqID_30545
  Homolog annotation: Hit_ID=Q1S065; Match level="QueryCoverage=61%, HitCoverage=89%, E-value=1e-18, Identity=30%"; Hit description =Arabidopsis conserved protein
  Pfam annotation: Domain name=DUF241; Domain location=58-290; Score =127.5; E_value=3.7e-35; Accession=PF03087.5; Description=Arabidopsis protein of unknown function
METISKFPCSHQPVRSISFPPRVHPVSQRVEALLNHLKPHHSQPISITTCLEAETIQSDLVVLAELYNCMEELFHSPQTKQTLLRYQDGKLVEEALRGSVTLLDACESARDLLLVLKEHMQTLHSAVRRRKGDSNIESIISAYESFKKKAKKTIAKQLGQLKRMKNKANSFSLLDQDQQLVFLARVIKEASTITISILHSLLVFMSMPTFGTKGSSLISKLKPTVLFSSLKEQKNTNGVADLNNVLCSLLRREKNGDSSGEFQRALTVLETLNVNIGGLEVEEELSKLKTWEATSTSTSKSIFTGLSLLQDLHIGLEDLLIVASTQKLISNYQGEKCIEELLDVLREVIVMNMSIFQSLLTFLAVPASKSKPTKWLFVAKLMHKGVIACEEKQENSNELQCVEASLSTLLSEGTNVAKMQAARERLETLENAIESIKNALEI

SEQ ID NO: 147324 - protein, 300 aa, Glycine max
  Coding DNA Sequence Number=SeqID_30546
  Homolog annotation: Hit_ID=Q1S060; Match level="QueryCoverage=97%, HitCoverage=97%, E-value=4e-24, Identity=29%"; Hit description =Arabidopsis conserved protein
  Pfam annotation: Domain name=DUF241; Domain location=54-297; Score =197.7; E_value=2.7e-56; Accession=PF03087.5; Description=Arabidopsis protein of unknown function
MAGSHTAKEFHYHVRSISLPCRLHPSLPKIEKELKRLKTWELASSHSQSEDIKAGLTWLAELYNCVEELVGCPLTQQALLRHEGKHVEKPLDMSVCLLDMCGSARELLSLVKEHVLDLQSALRRKGVDSSVNSQICAYICFRKKAKKDITKKLKALKTMENGFKSYSSFPLLDLDHHLLMVINVLREISKITISFFRKFLLYICAQVLKKNTGGWSLFTRIVSTGSDKQKRIISEMGDIDNVLCTFHRCFKKIDTKTDLQIMKRKLGELEGSVRELEAGLDCLFRCLIQQRVSLLNLFTS

SEQ ID NO: 147325 - protein, 73 aa, Glycine max
  Coding DNA Sequence Number=SeqID_30547
MVRGIVIISLDVLGSISRASNNAGFRERKIEKMEQDAGMNQALDLLLPYWYSGTALFTKNSPTVFNNDGTSKA

SEQ ID NO: 147326 - protein, 51 aa, Glycine max
  Coding DNA Sequence Number=SeqID_30548
MRPTTTSVGTGRAHSEPFIMPHLFQGVVAFLSSLTSPLLSFSDFFNPSQNE

SEQ ID NO: 147327 - protein, 115 aa, Glycine max
  Coding DNA Sequence Number=SeqID_30549
MEMKYYLDCDGMQEEARKKQGRCRKYLRHNSEMYTHRRLSVTGALRALPSIPKTVRDWHLVHPAAKPNYESSIPEWIWGLAQDIALSAATINFSREEVALSTSSPLSPLLEVYFQ

SEQ ID NO: 147328 - protein, 43 aa, Glycine max
  Coding DNA Sequence Number=SeqID_30550
  Homolog annotation: Hit_ID=Q1T6I7; Match level="QueryCoverage=88%, HitCoverage=14%, E-value=2e-07, Identity=74%"; Hit description=No apical meristem (NAM) protein
MKKTLVFCSGGEPKGNMTIRVMHEYDLTLKELGGTNPGQEALD

SEQ ID NO: 147329 - protein, 221 aa, Glycine max
  Coding DNA Sequence Number=SeqID_30551
  Gene Ontology: Mol. function=serine O-acetyltransferase activity; Cellular component=cytoplasm; Biological process=cysteine biosynthetic process from serine
  Homolog annotation: Hit_ID=Q8S895; Match level="QueryCoverage=87%, HitCoverage=60%, E-value=1e-83, Identity=75%"; Hit description =Serine acetyltransferase 2
  Pfam annotation: Domain name=Hexapep; Domain location=109-126; Score =14.9; E_value=0.28; Accession=PF00132.14; Description=Bacterial transferase hexapeptide (three rep
  Pfam annotation: Domain name=Hexapep; Domain location=135-152; Score =7.9; E_value=16; Accession=PF00132.14; Description=Bacterial transferase hexapeptide (three rep
  Pfam annotation: Domain name=Hexapep; Domain location=153-170; Score =7.6; E_value=18; Accession=PF00132.14; Description=Bacterial transferase hexapeptide (three rep
  Pfam annotation: Domain name=SATase_N; Domain location=8-55; Score= -40.5; E_value=0.031; Accession=PF06426.4; Description=Serine acetyltransferase, N-terminal
  Pfam module annotation: Pfam domain module=Hexapep::Hexapep::Hexapep:: SATase_N; Domain location=109-126::135-152::153-170::8-55
MDPSVYGSLRNSISTVFNLSLLVLGWCQAFKDRDPACLSYCSALLYMKGYHALQVHRVAHTLWHQGRKVLALALQSRVSEVFGVDIHPAAKIGEGILLDHGTGVVIGETAIVGNRVSLMHGVTLGGTGKEIGDRHPKVGEGALIGASATILGNIKIGEGAMIAAGSLVLKDVPPHCIAAGIPAKVISGLQEHDPSLTMKHDATKDFFTHVATNFRDEKPNG

SEQ ID NO: 147330 - protein, 500 aa, Glycine max
  Coding DNA Sequence Number=SeqID_30552
  Gene Ontology: Mol. function=binding; Cellular component=thylakoid; Biological process=photosynthesis
  Homolog annotation: Hit_ID=Q8VYL2; Match level="QueryCoverage=90%, HitCoverage=43%, E-value=4e-70, Identity=81%"; Hit description =Putative TPR repeat nuclear phosphoprotein
  Pfam annotation: Domain name=TPR_1; Domain location=325-358; Score =34.3; E_value=4.2e-07; Accession=PF00515.18; Description =Tetratricopeptide repeat
  Pfam annotation: Domain name=TPR_2; Domain location=325-358; Score =32.1; E_value=1.9e-06; Accession=PF07719.7; Description =Tetratricopeptide repeat
  Pfam module annotation: Pfam domain module=TPR_1::TPR_2; Domain location=325-358::325-358
MASVYIPVQNSEEEVRVALDQLPRDASDILDILKAEQAPLDLWLIIAREYFKQGKIDQYRQILEEGSSPEIDEYYADVRYERIAILNALGAYYSYLGKIETKQREKEEHFILATQYYNKASRIDMHEPSTWVGKGSLPETCHVHGLNVPGPAWGRVSSDEKVSGSLPKEGRAAVQYCSPQRGEEPAEAMINENRNKKRSLALEMEAGNMAGCAATPRNSWAQMLSGVQRKGVAGALAAASRKGEKSRERGTVIRKVHWNAETVTGKDGRQGEVEQASAAFKIVLDGDHDNVPALLGQACVEFNRGRFSDSLELYKVGSIAIFFAAAVRLGIGLCRYKLGQFEKAQQAFERVLQANPENVESLIALAIMDLRTNEATGIRTGMVKMQRAFEIYPYCAMALNYLANHFFFTGQHFLVEQLTETALAVTNHGPTKSHSYYNLARSYHSKVEGMFEFQDDGFVGDQLLGSGPRKPTHMEGGNHVEEYYGCLAECSLRGALALVV

SEQ ID NO: 147331 - protein, 78 aa, Glycine max
  Coding DNA Sequence Number=SeqID_30553
MDWFDRRSTLSTPSPESIHDRRQSQLDAASGYNADEQWVGGVAADKITVDCGVGGCRSLCRRGVSRGMTCGVGEDKAE

SEQ ID NO: 147332 - protein, 559 aa, Glycine max
  Coding DNA Sequence Number=SeqID_30554
  Gene Ontology: Mol. function=oxidoreductase activity; Cellular component=nucleus; Biological process=protein modification process
  Homolog annotation: Hit_ID=Q1RVE5; Match level="QueryCoverage=99%, HitCoverage=100%, E-value=1e-144, Identity=69%"; Hit description =Ubiquitin family, putative
  Pfam annotation: Domain name=UBA; Domain location=516-556; Score =44.4; E_value=3.9e-10; Accession=PF00627.21; Description=UBATS-N domain
  Pfam annotation: Domain name=ubiquitin; Domain location=26-94; Score =78.3; E_value=2.4e-20; Accession=PF00240.13; Description=Ubiquitin family
  Pfam module annotation: Pfam domain module=UBA::ubiquitin; Domain location=516-556::26-94
MGGDDAAAESATTERNAANEVNINIRCSNGSKFSVQIGLDSTVRSFKEAVAHNCDISSDQQRLIYKGRILKDDQPLQSYGLEADHTVHLVRGFSPSNTTGGTNSGGGGGGNTTTANTRGAGANEGGGLGGPGFGASPFPGLGGNNGMGGGGLNGLFGAGFPDLEQMQQPFLSNPNLMRDIMNTPAMQNLINNPDIVRNLIMNNPQMQELMDRNPELAHILNDPSTLRQTLEATRNPEIMREMMRNTDRAMSNIESSPEGFNMLRRMYENVQEPFLNATTMAGNTGNDAAAVRNQSTNPSTTNSEATSPVPNTNPLPNPWSSTGTGGGGQTNTRRSTTTGGDARQPAPTGLGGLGLPDLEGMMGGMPDTAMLTQLMQNPAISQMMQSILSNPQTMNQILGVNNEQRGMPDLNSLREVMQNPEFLRLFSSPETLQQLLSFQQTLLSQLGQQQSAHYGTKSNNNDYDVLGIRNWEPGQTGGGTGPLNNMGLEMLSSMFGGLGAGSLAVPNRSNEPPEQLYATQLSQLQEMGFFDTQENIRALIATSGNVHAAVERLLGNPGQ

SEQ ID NO: 147333 - protein, 342 aa, Glycine max
  Coding DNA Sequence Number=SeqID_30555
  Gene Ontology: Mol. function=nucleotidyltransferase activity; Biological process=RNA processing
  Homolog annotation: Hit_ID=Q8LSQ0; Match level="QueryCoverage=53%, HitCoverage=29%, E-value=2e-24, Identity=37%"; Hit description =Putative poly(A) polymerase
  Pfam annotation: Domain name=PolyA_pol; Domain location=40-151; Score= -10.7; E_value=1.9e-05; Accession=PF01743.10; Description=Poly A polymerase family
MGEGCCTQPYPCICKEAVSGFEPMTNKSPRHNFTAAPGLALLHTHKYSGEKAVSWFSRAEVVGRCFPICLVHIKGSVVEVTSFETVARTSNRKEQFLHSLLPKCSNKKDLFRCKNSLRRDFTINSLFYDPFANKIYHYTDGMADLRSLKLETVIPAQMSFKEDPGRENFVWLPNCSSAWFIIYQGRLRLQCGNILHLLRAWTSFSLITHLAAVLYIFQNKIMIELNYMLSYGASEPSLRLLWKLKLLEFLLPVHHILMNKRSKKMCSGFQYVDGCRSEWEQISDGDGTYKEAELNSETLLAAFIRELTWHLTRPISRSTFKKCHQLWQIETTNKDWKHFTWH

SEQ ID NO: 147334 - protein, 182 aa, Glycine max
  Coding DNA Sequence Number=SeqID_30556
  Subcellular localization annotation: CTP_CleavageSite=40; ConfidenceScore=5.11e-01
MAYAERSKPPRHSFRVSRLKMNQRTTLLPGDVFKFSIRVRLNTTPDPTLLLYSPSQTVPCHSFLQEGQLLKTMLSRIHFFIDSIEEVTEGVISCVQELFQVDDVASTLPLEFQHGEIPLWFEMTIFDAALLAVIEESKPCFGTIPASEEAIHTSMEECTDIEESEWCPICMEELDLINCECS

SEQ ID NO: 147335 - protein, 188 aa, Glycine max
  Coding DNA Sequence Number=SeqID_30557
  Gene Ontology: Mol. function=structural constituent of ribosome; Cellular component=intracellular; Biological process=translation
  Homolog annotation: Hit_ID=Q1SEG3; Match level="QueryCoverage=80%, HitCoverage=39%, E-value=1e-36, Identity=58%"; Hit description =Ribosomal protein L4/L1e
MCFYDVDLTSVDQNNLKNKRGDILKEGLMEGFRRSLPCRDECCGALLPSRHLGMLRYASFVFLTPLVESLMIRGSSGTDSVWWLWARMKEGMVEAVMAEAIVHHFWFTFVPATLDLGHGEHAVVAAHVSEGSLVGVVGSVVGIMEDMRDGLAGSLRLNRGLVAGTTINGIWLAAILGDVRVYKIDEIL

SEQ ID NO: 147336 - protein, 121 aa, Glycine max
  Coding DNA Sequence Number=SeqID_30558
  Gene Ontology: Mol. function=GPI anchor binding; Cellular component =membrane
  Homolog annotation: Hit_ID=Q69F99; Match level="QueryCoverage=84%, HitCoverage=24%, E-value=4e-33, Identity=69%"; Hit description =Phytochelatin synthetase-like protein
  Subcellular localization annotation: CTP_CleavageSite=67; ConfidenceScore=5.04e-01
MEHDGRADHFTRRLLKIQGKCSTFMQERSKNCGFASQNTLQSTSSKLLQRWGAQFMVAGSIQCCCIISSHVGNVRNTDKIVKLPKNFTLKAPNHVILVGQLRLDMEGGNGVDEKGIKREKS

SEQ ID NO: 147337 - protein, 559 aa, Glycine max
  Coding DNA Sequence Number=SeqID_30559
MKNSESVKMDAAATTMTTASSPIQGGEGSHGDGEKALSLSPQLEIKSGGDDAVAPKGNDEVGQKPTLVGVSHKRKASTETNPFCESDPNSSNDSKRFKSSSVSTPNVEQQKVDEEMRPQEGGDVESEKVEGDKGVPDGGLVEMDSDQNKGEGLTVKSPNDNVETEATESMNMEPEGDNKGINKEGTVNSPSNVEEEKVETEAIESMNVEPEGDDKGMPHGGVSELDSNLIKGEGIVILDNNVEEEKVEIDGAVESMNVEPEGDKGTSHGGRFELDLNRRVDEIVDSPSNVETEMKVESDTIKNMGVEPQGNNDMPRAVRLLGIDLNLEADQEMVLHSPSDAERETTRVEPVVGDKGMPHEGFSLFDLNKEVEEMVEHDDSVDQKIKVVPYIAEENTEMNCAIDKMVQIGGELLCELNKEAELSSDEKEVEAEPAAANAEEKKKKTEVESSAEVEQCAEENNEEDDDDDVVEVEKREVVLALPAIAENLEEDDDVVEVESSQVVLALPAVVEIEEDDDDDVVEVEKREVMLALPAIVENDEVETSPPPGNFVIDLNKPPP

SEQ ID NO: 147338 - protein, 95 aa, Glycine max
  Coding DNA Sequence Number=SeqID_30560
  Subcellular localization annotation: CTP_CleavageSite=73; ConfidenceScore=5.18e-01
MNPLICVHIRLGFHYLWALYLGLHSVGKLSLAHHWAKRASTSKRSFSTLSATEESSRASIPRPRAKREISALSAAVVSSQAPRTTGTKLKSTYSR

SEQ ID NO: 147339 - protein, 79 aa, Glycine max
  Coding DNA Sequence Number=SeqID_30561
MENAWSRHQRLFKENIGKTKMEEVKSLRILKMRVRELFMHREVDKGVSLAPTYSSIAMRKSDLRSSLRTERWLSCFYLF

SEQ ID NO: 147340 - protein, 93 aa, Glycine max
  Coding DNA Sequence Number=SeqID_30562
MTDLVSAEDDVNLRVSTGLSAAIDEGRRMTIICLCVPSDTTVPEWQKGADNRKVSPRATSSWVMVTKSGVVDKSKAFAPTYPQMRNSDLRSSR

SEQ ID NO: 147341 - protein, 44 aa, Glycine max
  Coding DNA Sequence Number=SeqID_30563
DWPEARAGEAPAEASAEAPDEADEAREDEEMTDLLDFLGGSGAT

SEQ ID NO: 147342 - protein, 60 aa, Glycine max
  Coding DNA Sequence Number=SeqID_30564
MRIPFLQAKVEKARWALKHPVYGIVILRLGIYTYRPNVSKLCSFISSMNSSILISVYSGK

SEQ ID NO: 147343 - protein, 298 aa, Glycine max
  Coding DNA Sequence Number=SeqID_30565
  Homolog annotation: Hit_ID=Q6ZGD1; Match level="QueryCoverage=97%, HitCoverage=35%, E-value=3e-82, Identity=55%"; Hit description=DENN (AEX-3) domain-containing protein-like
MAGVTKEDESGSPSWGASFFTQTTEDVARAVAAAMNSPRPSVVYSSKNDHGGSQLQKLQYQVTKMIKGFSRPTEVKYTNYNPEILTTQKRQWAANFQLQYMDHKSWKEPTRLFESMVVVGLHPNCDIQALQRQYFLRKSEGPGKLRSALGYQNQSRVEAEPNLEPQVLFVYPPEKQMPLKDKDLLSFCFPGGLEVNAVERTPSMSELNEILFGQEHLKQRDLSFVFRLQGADNSTLYGCCVLVEELVQKPSGFLSLISDKQATYSPLKRQRHILTTQRCYCILSRLPFFELHFGVLNR

SEQ ID NO: 147344 - protein, 391 aa, Glycine max
  Coding DNA Sequence Number=SeqID_30566
  Homolog annotation: Hit_ID=Q6ZGD1; Match level="QueryCoverage=57%, HitCoverage=28%, E-value=1e-45, Identity=44%"; Hit description=DENN (AEX-3) domain-containing protein-like
MQERLERLTRIGGDLNLEYAEDSCEEENLEEKSECMLVNDRLEDRHDDNPMISQSSLRNSSPENIENDSNYPKKQMVNGDLHTFKERVNDDNAVPSDPETDRKTVREESGPTNAEESDLYGDAFVTNKQSEDRRLPNAILPLLRYCQYESSESSCSFQGSPCDDRNFRSDADDTETEDASFSGQEDLNDLQDILEWAKANNCGPLQIISEYYRLTCPARGSALRFHPLEHLHPLEYHRPDETILHLAGSTVDLKSCSTGLEFAEAHNSLLAEEEATALSIWAVACMCGTLRLENVLAFFAGALLEKQIVFVCSNLKLKVVRWRCVTRQGPAWVHVQQCFELAVHVYGMAVFNGDDGHCSPMKKTEMSTRDAFLVEGREDQCDAGWRCVMRR

SEQ ID NO: 147345 - protein, 107 aa, Glycine max
  Coding DNA Sequence Number=SeqID_30567
MVGDLVAGSTARTEAARAGDVSSAEVVWRVFMMCVREPPCRSAKGSSNGGVAGRKGRQKSDDGRKVIGAGERVVGRRAVSKRAHRNAETSHWKKGIGARFSLFLYQE

SEQ ID NO: 147346 - protein, 201 aa, Glycine max
  Coding DNA Sequence Number=SeqID_30568
  Homolog annotation: Hit_ID=Q6ZGD1; Match level="QueryCoverage=76%, HitCoverage=18%, E-value=2e-61, Identity=74%"; Hit description=DENN (AEX-3) domain-containing protein-like
MAKLAYAVFDKSILFQVLPNGMLEFLDAPVPYIVGIKNKTNEVQSKLTNNVILIDANRNQVKSSTVPQLPRQKELMSSLRPYHETLVGESYLGRRRPVYECTEVQTEAAKGFLSVLRSYLDSLCYNIRSHTITNVQSNDDKVSLLLKESFIDSFPYRDRPFMKLLSPIPNLYLCEYHWNLLIVILESHLGHCVSSFLRQFF

SEQ ID NO: 147347 - protein, 48 aa, Glycine max
  Coding DNA Sequence Number=SeqID_30569
MAGSGKQNAPPSPLEFTSAHPQKRTHLVAHDPGDLNKTSASSEGRKIP

SEQ ID NO: 147348 - protein, 111 aa, Glycine max
  Coding DNA Sequence Number=SeqID_30570
MINDGTYEFGDPTVMWLHMPLDSWVTVTKSGVVDKSRAFAPTCPQFVMRNSDLVVLDNYEIMLMKFSHNQEALGPTKIGENHSKCINLTQCVARKSLAHRILSAIKGRGPL

SEQ ID NO: 147349 - protein, 110 aa, Glycine max
  Coding DNA Sequence Number=SeqID_30571
  Subcellular localization annotation: CTP_CleavageSite=25; ConfidenceScore=5.05e-01
MSSRTKRNLWAQLASIAKHSYNTLSVMRGTGRTQESRPGAKLDVRLLPGSTNDWRQAQIHLLGLSVTGHNTFTRDAYFCIEFERSALEAAERQQLSKEARVLHFDRLESV

SEQ ID NO: 147350 - protein, 230 aa, Glycine max
  Coding DNA Sequence Number=SeqID_30572
  Gene Ontology: Mol. function=electron carrier activity; Cellular component=anchored to membrane; Biological process=electron transport
  Homolog annotation: Hit_ID=Q8VY59; Match level="QueryCoverage=58%, HitCoverage=78%, E-value=2e-21, Identity=30%"; Hit description=Blue copper protein, putative
  Pfam annotation: Domain name=Cu_bind_like; Domain location=39-119; Score=85.8; E_value=1.3e-22; Accession=PF02298.8; Description =Plastocyanin-like domain
MEKLRPAWAVKAIIVIVFTSILFRCVCGENHTVGGASGWDLRSNIQAWSSTTTFNIGDDLVFSYTPVHDVVEVNQLGYNTCTIANALATYDNGETVIHLSDAKTRYFVCGRMRHCQQGLKLQVQILAQSNNGTSDDQNQSPGAGTGTVGSPPSPSPPPPPPPPPPPPPPPVSPPPHGDEQPPADEPVPCDCNRAEERHGVVPLITLVIVVALAHAPFFIAFPHLRFHLMR

SEQ ID NO: 147351 - protein, 101 aa, Glycine max
  Coding DNA Sequence Number=SeqID_30573
MQIARRNGDFVVDATAGTGVAIFNGVLHQAWTRQFDWRVEGRGLQFLGAAISDAAVCNLQWAVPRCRVSPAPMAFWLAKIASTSSDLPCLGFLNPPSPVDH

SEQ ID NO: 147352 - protein, 817 aa, Glycine max
  Coding DNA Sequence Number=SeqID_30574
  Homolog annotation: Hit_ID=Q9LJL2; Match level="QueryCoverage=90%, HitCoverage=89%, E-value=0.0, Identity=48%"; Hit description =Arabidopsis thaliana genomic DNA, chromosome 3, P1 clone: MVI11
MAFTYAAPIAPSLYGIARIGYCDQKVSLAGSPGEVNTSLFCVSSHAGKSDVLFERRKLKSADTRIAENTQMKSSVEIEIPVSCYQLIGVPDRAEKDEIVKAVMGLKNAEIDEGYTIDVVTARQVQADKDLLMDVRDKLLFEPEYAGNLREKIPPKSSLQIRWSWLPGALCLLQEVGESKLVLEIGQTSLQHQNAKPYTDDLILSMALAECAVAKIGFEKKKVSQGFEALARAQCLLRSKPSLAKMTLLSQIEESLEELAPACTLELLSMPHAPENVDRRRGAILALRELLRQGLDVETSCQVQDWPSFLSQAFDSLLAKEIVDLLPWDNLAVMRKNKKTIESQNLRAVIDSNCFYRVFKAHMAIGFSSKQKELINKAKGICECLIASEGIDLKFEEAFCLFLLGQGTEAEVVEKLKQLELNSNPKHNSVLGKAIIDASTVNPSLEMWLKDSVLALYPDTKDCSPALANFFNAQQKFSGSKNSKGAQQMLPTICHRPLSSSGSLERREVEESRSYMSSSPSLGFAVKQLTPTDLRSSLLSGRNETGSNTIESPVQVKRNLGSHRNSGIWHGYFPQGHIFKRITYLTVLGCIAFASIKLSGIGLSKTLTASHWASTKANDNIAWTADSADYPVGPAYIRQSTMTNKLKRILSMFKIQRLHQSGAGNHSDLHTTLTSSSSPINVSRRPMPVEEAETIVRQWQTIKAEALGPCHEVNCLAQVLDESMLAQWKGLANAAKERSCYWRFLLLKLSIIRADILSDGNGDDMAEIEALLEEASELVDGSQQKNPNYYLTYKVKYVMKRQDDGSWKFCENDIIESP

SEQ ID NO: 147353 - protein, 386 aa, Glycine max
  Coding DNA Sequence Number=SeqID_30575
  Homolog annotation: Hit_ID=Q9SBG7; Match level="QueryCoverage=64%, HitCoverage=65%, E-value=3e-41, Identity=39%"; Hit description=ROOT HAIRLESS 1
MKLFGTIVYPKNRYLTLQFPKGGKSVMCEDYFDNMIVFSDAWWIGRKDENPEESKLEFPNELYEGHQAEYDFKGGAGAGAASVVNQGVPRTNIQRVEQESPKTPTEDDLSDNEINLKDTKELVPVRHSTRTAKKSYKFAEISSGDDSGENSPELSDDEEKVVEVDTAVNDHNSSNILIIQKKTVVFDLDDEDDAPVDQPAKINTESASRSKSKEVSQSASASASTEVKSSNRGSLVQATISTLFKKVEEKLEFRALVEPQAFATYVALGKLPILSHPIFCKATRLHQLRNACDYDPRFTMVLPSFTNGSESSYGQKSQPAGSKRKIDLDEGSKKRARKTTDKDPGKKIKAKSKEDDVEDGDDDGDDIEEFSNASEDANESDEDWTA

SEQ ID NO: 147354 - protein, 105 aa, Glycine max
  Coding DNA Sequence Number=SeqID_30576
  Gene Ontology: Mol. function=cytidine deaminase activity; Biological process=cytidine metabolic process
  Homolog annotation: Hit_ID=Q1SMB5; Match level="QueryCoverage=51%, HitCoverage=22%, E-value=8e-10, Identity=65%"; Hit description =CMP/dCMP deaminase, zinc-binding
MCEMHTSVLDVGNDTTFVTNNKDKGKGTTYLQGLGTSRSSEREWPQGAAETARETKWGFAFRERLVEGEPRELQVHAHQDVVGGGQALNNDGELRNGGRPGAGRR

SEQ ID NO: 147355 - protein, 509 aa, Glycine max
  Coding DNA Sequence Number=SeqID_30577
  Gene Ontology: Mol. function=nucleotidyltransferase activity; Biological process=aromatic amino acid family biosynthetic process
  Homolog annotation: Hit_ID=Q2XPY5; Match level="QueryCoverage=99%, HitCoverage=80%, E-value=1e-168, Identity=54%"; Hit description=YSL transporter 1
  Pfam annotation: Domain name=OPT; Domain location=1-482; Score=260.4; E_value=3.6e-75; Accession=PF03169.6; Description=OPT oligopeptide transporter protein
MGGFGSYLFGMSEEIAKQSSDTGHFKDPKLGWIIGFLFVVSFLGLFSVVPLRKINFSINTFNKIMVIDFKLTYPSGTATAHLINSFHTPQGAKLAKKQVKMLGKFFSFSFLWGFFQWFYTATDQCGFQAFPSLGLKAYNNKFFFDFAAIYVGVGMICPYIINISVLLGGILSWGIMWPLIKTKEGDWYDKGLGEGNLHGIQGYRVFIAIALILGDGLYNFIKVLTHTLWGLYHQVRIKTPPQTLTYLMMTSAAPNSSLKIKFPHDWSLASTYGKLAIFTIGAWAGSSHGGVLAGLAACGVMMNIVSTASDLMQDFKTGYLTLASPRSMFVSQIIGTTMGCVISPSVFWIFYKAFPDLGRSTSEYPAPYAIIYRNMAILGVQGFGNLPKNCLLLCYIFFAAAVAINLIKDFIGNKGRFIPLPMAMAIPFYIGPYFAIDMCVGSLILYVWERINKAKADAFAPAVASGLICGDGIWTLPASILALAGVKPPICMKFLSRAANARVDTFLGN

SEQ ID NO: 147356 - protein, 156 aa, Glycine max
  Coding DNA Sequence Number=SeqID_30578
  Gene Ontology: Mol. function=nucleotidyltransferase activity; Biological process=aromatic amino acid family biosynthetic process
  Homolog annotation: Hit_ID=Q6R3K4; Match level="QueryCoverage=68%, HitCoverage=14%, E-value=9e-44, Identity=81%"; Hit description=Metal- nicotianamine transporter YSL8
MALNGSGDRVAVDNGFESIDDAYDDHEHKLSQKGSIKLKEEEVSVERVFQHLLVPSWRNQLTVRAFVVSFALSILFSFIVMKLNLTTGIIPSLNVSAGLLGFFFVKTWTKFLEKSNMLRQPFTRQENTVIQTCVVASSGIAFSGTFFLPFTYSVPF

SEQ ID NO: 147357 - protein, 238 aa, Glycine max
  Coding DNA Sequence Number=SeqID_30579
  Gene Ontology: Mol. function=translation initiation factor activity
  Homolog annotation: Hit_ID=Q6Z730; Match level="QueryCoverage=92%, HitCoverage=92%, E-value=3e-39, Identity=43%"; Hit description =Putative eukaryotic translation initiation factor 3, subunit 1 alpha, 35kDa
  Pfam annotation: Domain name=eIF3_subunit; Domain location=1-238; Score=216.2; E_value=7.3e-62; Accession=PF08597.1; Description =Translation initiation factor eIF3 su
MTVAEDEHIAPIDLTLKDPVKTNWDDEDVDENDVKESWEDEDEPAPAPAAPAVKTTVKAPKKSSDKDNDKKGKTVEPIKEEPLDPVAEKLRQQRLIEEADYKATKELFSGGNEKDEKNLDTFIPKSESDFLEYAELISHKLRAFEKSYHYIGLLKAVMRLSTTSLKGADAKDIASSVTAIANEKIKAEKEANAGKKKIVFKVFAVTAGGKKKQLNVDKPDEDFIPADRYDALDDYDFM

SEQ ID NO: 147358 - protein, 125 aa, Glycine max
  Coding DNA Sequence Number=SeqID_30580
  Gene Ontology: Mol. function=heat shock protein binding; Cellular component=integral to membrane; Biological process=protein folding
  Homolog annotation: Hit_ID=Q5QMD6; Match level="QueryCoverage=94%, HitCoverage=19%, E-value=3e-12, Identity=40%"; Hit description=DNAJ heat shock N-terminal domain-containing protein-like
MIDDGEAVDIKGTSEKSLTKHLKKLFLSLNLEDGNRVFLLHSKAHLNLDVVGPLIQSYMNMNPMNEQVETSTLVPESSSIPIDTGNEQMIDDHATTGPEDHSVGPRRRMIGPAMPSAELPLLLQN

SEQ ID NO: 147359 - protein, 182 aa, Glycine max
  Coding DNA Sequence Number=SeqID_30581
  Homolog annotation: Hit_ID=Q10PW0; Match level="QueryCoverage=32%, HitCoverage=57%, E-value=9e-20, Identity=76%"; Hit description=BolA -like protein, expressed
MAEEGVSVTEEATSTQPRERQLQNRRSDMQEEKKLSPNRVREDMRELSPNCLGPATTQHSFAVHLRFGDDREGVEAALELLGEEVVDETVSFDEALALELGRYDLHVEVGFFVGTSLHGGVARVLRILLARDSSALAPLELIGSDEWWRRVRVLRTEEFPQMKTWTEIGEGKFIFPPLATDG

SEQ ID NO: 147360 - protein, 64 aa, Glycine max
  Coding DNA Sequence Number=SeqID_30582
MEVVSNANEYKRSSMLPSLEFFFLPVQSTTVHGKVTIAIDERFSCFDQAINKSPVMHPNDVETM

SEQ ID NO: 147361 - protein, 201 aa, Glycine max
  Coding DNA Sequence Number=SeqID_30583
  Gene Ontology: Mol. function=transmembrane receptor activity; Cellular component=membrane; Biological process=defense response
  Homolog annotation: Hit_ID=Q5JBT4; Match level="QueryCoverage=89%, HitCoverage=21%, E-value=9e-30, Identity=40%"; Hit description =Candidate disease-resistance protein SR1
MLANLDSICIKTSFCLRQIRDGYEYKFIEKIVEQVSREINPVCLHVADYPVGLESQVLQNTSKASFLRKYMEMEKDINITSCQERATMIHDRLQQLKVLLVLDDVDRLKQLQEPVGRPDWFGPASHKVKRRYKVKELNEKDALQLLTQKAFENEKADPRYKLRGLKSCSKVCFRPSIGFGSDRLQLGWKKYGRLETCYRKI

SEQ ID NO: 147362 - protein, 218 aa, Glycine max
  Coding DNA Sequence Number=SeqID_30584
  Gene Ontology: Mol. function=metal ion binding
  Homolog annotation: Hit_ID=Q9LT14; Match level="QueryCoverage=73%, HitCoverage=41%, E-value=2e-25, Identity=43%"; Hit description =Genomic DNA, chromosome 3, P1 clone: MPN9
LQLVIESGDPGGVFRFPGVTHGDYFFGPGLEELIQHLAENDPNRYGTPPASKSAVEGLPDVSVTEELLASDSSQCAVCKDTFELGETAKQIPYDPDYEQRARRGGGGGSGGDGAGSGAAPQVNWNMALGPAGGSADSSGGGGSGGDSSQRRRFRVSLPWPFRQFAETSNVGSANNDSNNNNNNSNSNSGSSGNNGGQSNSGNRGNQNFDSETRQEDLD

SEQ ID NO: 147363 - protein, 68 aa, Glycine max
  Coding DNA Sequence Number=SeqID_30585
MEARGSLQSCAESVGSGHDMLPLEVIEKSTMASPRSSPRSAPLCRNSNCSATATTFSAGLPLVGICRF

SEQ ID NO: 147364 - protein, 85 aa, Glycine max
  Coding DNA Sequence Number=SeqID_30586
MGEVEEVQERIKADMKAMKEKVATMMEAIMSMKEIMEPTSSLASDVPLKGKQFVVYPCKHFGRPSFSPTTATIAFCDGKSPSCYG

SEQ ID NO: 147365 - protein, 70 aa, Glycine max
  Coding DNA Sequence Number=SeqID_30587
  Gene Ontology: Mol. function=nucleic acid binding; Biological process= RNA-dependent DNA replication
MACPERQKVAFGTYTLVEEAEYWWENTRQCLEAEGQDVTWDVFKRVFLEKYFPEDVRNKKEMEFLELKQG

SEQ ID NO: 147366 - protein, 91 aa, Glycine max
  Coding DNA Sequence Number=SeqID_30588
MNLYLTTCHSVEEYTRVEIMDLYHLLSRKHKDGPRGRLHQVSTKEGKETFIESKEGNPLNGENGTEVELLTGRRKRDLTEGVAGKWGAGFW

SEQ ID NO: 147367 - protein, 62 aa, Glycine max
  Coding DNA Sequence Number=SeqID_30589
MCGGWWSSDNNDDNDNGGGGDDDCSGMMMVIVMITMMNDGSSNDNGGGASKARYDGGGCASG

SEQ ID NO: 147368 - protein, 128 aa, Glycine max
  Coding DNA Sequence Number=SeqID_30590
  Gene Ontology: Mol. function=transferase activity; Cellular component= chloroplast; Biological process=metabolic process
  Homolog annotation: Hit_ID=Q9C5W3; Match level="QueryCoverage=99%, HitCoverage=16%, E-value=2e-62, Identity=75%"; Hit description=NAD kinase 2, chloroplast precursor
MPGKVFDILNEVVVDRGSNPYLSKIECYEHDRLITKVQGDGVIVATPTGSTAYSTAAGGSMIPDDARSNAWVSFDGKRRQQLSRGDSVRISMSQHPLPTVNKFDQTGDWFSSLIRCLNWNERLDQKAL

SEQ ID NO: 147369 - protein, 99 aa, Glycine max
  Coding DNA Sequence Number=SeqID_30591
MATPTTPRADAPIFSNLLLSIKKLDGCKRCGMEKEQLPEGFQRKGYMNESNTHPNERDPEVVLACNIQMLMKAGSDRQCTRDVAGTRSDLWKASNGSDT

SEQ ID NO: 147370 - protein, 87 aa, Glycine max
  Coding DNA Sequence Number=SeqID_30592
MCKGDNESFKEYGQRWRDLVTQVVPLTVEREMITMIMDTLLGFYYEKMIGYMPSSFVDLVFPSERIEVGQRRGKFDYVASVSSDVVK

SEQ ID NO: 147371 - protein, 54 aa, Glycine max
  Coding DNA Sequence Number=SeqID_30593
MTKMLENGVRTEALSPIVGMVPKTWGRVNVVWHKEVGHVRGHGWSFGDAVTTVE

SEQ ID NO: 147372 - protein, 653 aa, Glycine max
  Coding DNA Sequence Number=SeqID_30594
  Gene Ontology: Mol. function=transferase activity; Cellular component= chloroplast; Biological process=metabolic process
  Homolog annotation: Hit_ID=Q9C5W3; Match level="QueryCoverage=97%, HitCoverage=60%, E-value=1e-160, Identity=49%"; Hit description=NAD kinase 2, chloroplast precursor
SNDPSQLSWMGPVPGDIAEVEAFCRIFRNSERLHSALMDALCNPLTGECSVSYEVPSDEKPQLEDKIVSVLGCMISLVNKGREDILSGRSSIINSFRAAEVSTTDDKLPPLALFRSEMKRCSESLHVALENYLIPDDDRSLNVWRKLQRLKNVCYDSGFPRGEGCPCHTLFANWNPVYLSAASKDDSESKDTEPAFWTGGQVTEEGLKWLLDKGYKTIIDLRAETVKDNFCQAALQDAISSGRIELVKIPVEVRTAPTMEQVVQFASFVSDCSKRPIYLHSKEGVLRTSAMVSRWRQYMARSSSQIVSNPPVTPYDMLLCNTNGSAKSWDSSMTAERSSLEKDINSLQESLNSTHNSVGTFDRSTSQKKYNGKPQGTTAMSKVSTDNRELSEATAAKEERSFPRNFSKINPLKAQVPPCDIFSKREMSKFLGSQKISPPSYVNYQSRRSECSPQPRNMNVTRLQGGVTVSTSDNLIPKIVGSESSNGSARVDHPSRETQITVSDNWEVVNGSISSSVWTTVNGFSEQEMHYMTNANASNIVKDDFDNVTTNSQRIEDRMVKDRLALNDDDMGSVEGDMCASSTGVVRVQSRKKAEMFLVRTDGFSCTREKVTESSLAFTHPSTQQQMLMWKSMPKNVLLLKKLGEELMEEAKM

SEQ ID NO: 147373 - protein, 81 aa, Glycine max
  Coding DNA Sequence Number=SeqID_30595
MEENNKRVAKSDEKTYMPKNVIKHDDAILPRKGPFTRAMSNRLQEDWARAAEEGPKVLMNLRVRYPRNIGFFSPCILRHLD

SEQ ID NO: 147374 - protein, 157 aa, Glycine max
  Coding DNA Sequence Number=SeqID_30596
  Gene Ontology: Mol. function=nucleic acid binding; Cellular component= nucleus; Biological process=DNA integration
MTEENNLNPMYKAQIVVKGCDQKKNIDFEEIFLPMMKMTSIRAILGLPAKLDLEIEQLNKNLYGLNQVARQWYKKLNLFMTQHNFKKTYANHCVFVKNYKNGESIMLLLYVDCWENKTRIDALKKIEQVFCHVALGAVKKILGMKITRDCSEVIKTS

SEQ ID NO: 147375 - protein, 39 aa, Glycine max
  Coding DNA Sequence Number=SeqID_30597
MNSDGSMYRHGILGGHDRSSVTLVPVFLQAPSLGLGLGL

SEQ ID NO: 147376 - protein, 105 aa, Glycine max
  Coding DNA Sequence Number=SeqID_30598
  Gene Ontology: Mol. function=nucleic acid binding; Biological process= DNA integration
MLWISQEAYIEKIFESLMYAMVRTRPNIDYVVGFVSKFLLNPGKEHWEVEKWILRYLRGTTNRCLCFGNGNLMLIGYSNIDIAGDVNSRKFTLRYLITFVGRAIY

SEQ ID NO: 147377 - protein, 56 aa, Glycine max
  Coding DNA Sequence Number=SeqID_30599
MVVLEHNRSLEGPLARRGGILAIGGIVEHQSEALLSWRVRCTRWRMAVHLAVGGSG

SEQ ID NO: 147378 - protein, 161 aa, Glycine max
  Coding DNA Sequence Number=SeqID_30600
MALRKRARAEDIPSSSNPPPLTTTMEPDGLQAQPIVPMLQSLFRGQLIIVYNQQQLAHNRPIVSMEQFLDKVAWPKAQLPLGRSPEVVPSSPIPTRTEPAPAESQPPVVDLPASPEVEILPPPLAPPLILILDDLDNEVAAPPDSPAYYLEDGSDFSDWMD

SEQ ID NO: 147379 - protein, 162 aa, Glycine max
  Coding DNA Sequence Number=SeqID_30601
  Gene Ontology: Mol. function=transferase activity; Biological process= RNA-dependent DNA replication
  Homolog annotation: Hit_ID=Q1T4N4; Match level="QueryCoverage=93%, HitCoverage=33%, E-value=1e-18, Identity=30%"; Hit description =Polynucleotidyl transferase, Ribonuclease H fold
MWSVWSRRKELVWEGARSEAAFFPTVGVFGFDACIRDDTGSVVRAFSDYKQCLPKVHEGEALRDAIFWLRHLDIEDVTIEMDCQSIVNNIYNGQSDFSEFGATIKQCRDLLQSLPNFKVCFVRIQTNFLAHSIARAASSYAGPHFFSEFHSCIATNSDLAVI

SEQ ID NO: 147380 - protein, 384 aa, Glycine max
  Coding DNA Sequence Number=SeqID_30602
  Homolog annotation: Hit_ID=Q940E4; Match level="QueryCoverage=23%, HitCoverage=73%, E-value=6e-24, Identity=68%"; Hit description=Wound- responsive protein 14.05
GKTATGKTASLPVKNTISSSHNLGVPGEHYEDMKFRNQLDVSGISSKRKTTDTRPMSDPPVCSKVSTDDAPAAAEDAEKKKTRVLQSKNTSDKYKDASGLLDTSHQKYHEKSASAHSKSHSGKTSSSVDNLEKTGRLKDKNGIRELPDLNLSVGKSAIQAPKSENVLKKDGSTARPKITTLEKAIRELEKIVAESRPPTMENQEPDTTPQGVKRRLPREIKLKLAKVARLAASQGKVSKELLNRLMSILGHLIQLRTLKRQTQPGRCSGDGGRLGVVSAVEVDEEGEDSVVAVRQSLRNQTRAVQQHWRGEMVIERRAIIGQGDLGLDEGGTDGESEATANGGFVVERGMKDLFALDFGDSTVTYGLPELILSQDWYSLFWEKY

SEQ ID NO: 147381 - protein, 114 aa, Glycine max
  Coding DNA Sequence Number=SeqID_30603
  Homolog annotation: Hit_ID=Q60EP7; Match level="QueryCoverage=91%, HitCoverage=14%, E-value=7e-12, Identity=41%"; Hit description =Unknow protein
MGLSAKQEKDVRFQQKKNEVIEMIKMQAPTMESKLQKQAGVSGEQELGPDGKPITTRNFSMDTALEDKICDLYDLFVDVQKFEPKGLDENAGPQIRKLYAEVVQIFYAFLSIYV

SEQ ID NO: 147382 - protein, 202 aa, Glycine max
  Coding DNA Sequence Number=SeqID_30604
  Gene Ontology: Cellular component=intracellular
  Homolog annotation: Hit_ID=Q70X85; Match level="QueryCoverage=67%, HitCoverage=9%, E-value=1e-10, Identity=31%"; Hit description=MEI1 protein
MISELLFSNLKSLETKKLVNPTSKENTIGTHKREQHQKYHLIRIKARREYFDVIHGKATSEALFRQRPSSFDTQNNNEENKSEIRVFQSTIRRNKRLPSNLQPMDVRSSKFTYKTERGIRRRKNEQKRENENEVKLRKLGTVKYMFVGRNDVVIVGALTGRVVAEVDLGVVIFDGVVCSRVVLPSKRRRFEGTAREQLQKGQ

SEQ ID NO: 147383 - protein, 132 aa, Glycine max
  Coding DNA Sequence Number=SeqID_30605
MRERLATDSSSHTHTSVNKTVSNTITAARVHNPSENGPKQERAKGSSSGSLDDVKGADGVLIKKKVKRKPDQGLEGTHFRPEKSAASLQGEEKPRSLKQSADLLVVKSYWQLESGLTVLLAVSGASAARSQF

SEQ ID NO: 147384 - protein, 79 aa, Glycine max
  Coding DNA Sequence Number=SeqID_30606
MQFLKMINNHGHAWRSSALIPTFEVKETGLGLGLGRVDGSVNARVRDWSRKGSPSSSQLRGSMQGFGMGLGRVPQVVVN

SEQ ID NO: 147385 - protein, 115 aa, Glycine max
  Coding DNA Sequence Number=SeqID_30607
MPLSLSEVVIAVGRHVSPLRDVYCVVSYELCNHTDVRLFKGDEFCAMSIVMGSIVGTQQEGEALTDSSECRPWGSPGLSDLLSLCRSHMVGAFSQNTVTLTGLPMILPSESDLTC

SEQ ID NO: 147386 - protein, 226 aa, Glycine max
  Coding DNA Sequence Number=SeqID_30608
MEINEESSALYKNGNIVVELPVFKLVVVIIWHIESKRSSSGTSSSSAINKKSSGEHLWSLVNFLSHLKHSPFSHRVVIFSGNNHLKGIGGCLVGVGSRGEEGWIVEVVPELMLVLTLMVALEPSQRRSNSARKVLSASGVLVSRQSGLPMPKGVVILEELGYLEDPTHRIQAIESQNLQLHAIFVDMEFWVAVSWIWVENVWIPPWKLNESTKMLGIRRGILEFED

SEQ ID NO: 147387 - protein, 211 aa, Glycine max
  Coding DNA Sequence Number=SeqID_30609
  Homolog annotation: Hit_ID=Q60EP7; Match level="QueryCoverage=71%, HitCoverage=21%, E-value=8e-40, Identity=57%"; Hit description =Unknow protein
MAAEEMAPLVGGGDSSSATARAQSSFVKKGDRQMFTVELRPGETTIVSWKKLMKDANKVNNGSASAPEHRAPNANPALESRIAPGQPKEIEEEGAPQTNRFSAVIEKIERLYMGKDSSDEEDALDVPDDQYDTEDSFIDDAELDEYFEVDNSAIKHDGFFVNRGKLERMASLGAKLRLLPCGLDISSLNPRNSLLTCGVMSVYIFPPQIPL

SEQ ID NO: 147388 - protein, 77 aa, Glycine max
  Coding DNA Sequence Number=SeqID_30610
MALKTKARPKIIIVTSDIKLFITVKTQCFLSMLVLGTNVAMGRHTSVIWWMECCEDCKSKGAVVLVFCCGGYGVCRR

SEQ ID NO: 147389 - protein, 246 aa, Glycine max
  Coding DNA Sequence Number=SeqID_30611
MGAKYLEVVKRGSHPNNGWSPDWRPHVTTLRDIKNLDSILEELLRIFKVHEQELALDEGIKNGKSQAHTVQRPKCNFASKAFAVNNPWNDDKKIFNFVINKLWPIMPFPSKAKPTLDASSDEDDSHPEDTVNSYDEEPPCPIVYKMPLFVRKSKHYWMKKVSSGRKTLRKDFQDLEERLKECEALKELPPEIVQRNPKDKFGHGFKGKKMVHGEEVIVCYFYGKMGHETHKCEDLLEKGNPSRGFI

SEQ ID NO: 147390 - protein, 66 aa, Glycine max
  Coding DNA Sequence Number=SeqID_30612
MDFNSEVRKKEFNFPQAYAAKSSRKDLSNKALVFKNSILVFSETYVSQLFKYAGICKSSIYARKLL

SEQ ID NO: 147391 - protein, 394 aa, Glycine max
  Coding DNA Sequence Number=SeqID_30613
  Gene Ontology: Mol. function=nucleic acid binding; Cellular component= chromatin; Biological process=DNA integration
MASNNVPLLAPPVFTGKNDEIWVVKMRRQLKAFDLWKAMETTEPPALEENPTVAQIRFHSKQVAKRAKALTILHLVVDDDVLNLKREFEALKMNEAKNIKDFMTRPMKPKDLNLMSNEKASKFEQWNHSMKEMTTIEDNNTWQLVDKLEDKNSIGVKWVYKVKLNLNGSINKYKTKLVVKGYAQQPGIDYVETFSPVTKMNTIRILVALAAEMKWKIWHLDVYKLHKASYGQKQAPRAWYNNIDAYFSSQGFRSENDATLYVKRLLDVHQSEVGIFLNQEKYAYEILKKFRIKSCKFVPTPSVQNLKLSKDDGAEKMGDSLYRNVIGTKRALKYLKLNLESGLNPMKMEDIVTQSTAEAEYVAAAAATNQAIWLKKIMFDLGVEKMDATEIYCD

SEQ ID NO: 147392 - protein, 500 aa, Glycine max
  Coding DNA Sequence Number=SeqID_30614
  Gene Ontology: Mol. function=transaldolase activity; Cellular component=cytoplasm; Biological process=carbohydrate metabolic process
  Homolog annotation: Hit_ID=Q5JK10; Match level="QueryCoverage=59%, HitCoverage=68%, E-value=1e-112, Identity=66%"; Hit description =Putative transaldolase
  Pfam annotation: Domain name=STAS; Domain location=33-146; Score =67.4; E_value=4.7e-17; Accession=PF01740.11; Description=STAS domain
  Pfam annotation: Domain name=Transaldolase; Domain location=176-486; Score=55.5; E_value=1.8e-13; Accession=PF00923.9; Description =Transaldolase
  Pfam module annotation: Pfam domain module=STAS::Transaldolase; Domain location=33-146::176-486
MGREVLLPSDTSQYRAYLQDSVIELLGTEKSNNVVIEHTKDGSGIGAAVLAASNSMLREYEVDVDRSKRRGPEVERIYSVILEMASVTYIDSSAVQALKDLYQEYKLRDIQIAISNPSPEVLLTLSRSGLVELIGKEWYFVRVHDAVQVCLQHVQSLKGASNNPQAPFSSVENKPSLFARLSKERVEKLSITDMESGAGKDIESAYWELVVKDIQDTCKLLEPIYNETDGEDGHVSLAVSPKLANDTKGTIEAAKWLHNMVGSPCVYMKIPATDESISSMKEVISLGISVNATLIFCLPKYEAVIDAYLDGLESCGMTDLSKVSSAAAFYISRVDVTLDKKLEQIGTAEALDLKGKGAVAQAVLAYQLYQKKFSGPRWERLENRGAKKQRLMWASTNVKNPSYPDTFYVNSVIGPDTISTFLVQALQAFMDHGILSRTLDAKVSEAQDMYNAIEKLGIDWSSVGSELEHEVLDSFTKSFDNVLECMQKKAMSIYSFQKHV

SEQ ID NO: 147393 - protein, 200 aa, Glycine max
  Coding DNA Sequence Number=SeqID_30615
  Gene Ontology: Mol. function=metallopeptidase activity; Cellular component=mitochondrion; Biological process=protein maturation via proteolysis
  Homolog annotation: Hit_ID=Q8VY06; Match level="QueryCoverage=80%, HitCoverage=20%, E-value=5e-49, Identity=48%"; Hit description =Presequence protease 2, chloroplast/mitochondrial precursor
MDNSRFNTMINANCSQESLYSISNGNLRIFRQRDSSLASDESRIEPQTLFSKPIRIVETYPSSERGDLKKKHMPLDLETELTLGFLNHFLMGIPASPLRKKLLESRPGDAIVGGGVEDELLQPQFSIGRKGDFEDDIHKGQWIYDMNPFEPLKYQKHLQDLKSRIAKKGSRSMFSPLIEKFILNNPHQLTMEMQLLYYLS

SEQ ID NO: 147394 - protein, 105 aa, Glycine max
  Coding DNA Sequence Number=SeqID_30616
MDQLLYRRLKLWGQKLIDLTNPKSNQKPQIDKGQSNQTRSHAKQEQKQQHIERRTTTPQQDLTIRLDRQWDLFDLEMPKEDRFQQYKCYQWHITQNDKPITQYII

SEQ ID NO: 147395 - protein, 85 aa, Glycine max
  Coding DNA Sequence Number=SeqID_30617
MESKYIEDYMSLDKMMKEIEKKRDLLHQTRAEDDHVNCAPVLKSMVMRGREITYKAMEKNKKLQQEIDTMNDELDHWCQQLTRRC

SEQ ID NO: 147396 - protein, 162 aa, Glycine max
  Coding DNA Sequence Number=SeqID_30618
  Homolog annotation: Hit_ID=Q9C911; Match level="QueryCoverage=47%, HitCoverage=13%, E-value=4e-21, Identity=65%"; Hit description =Putative heat shock protein; 32627-30541
MELQAMASTSESCSPSTNPFIKVLAYALLGARNGTFPDLKISISRTGIDGVGKEGEEVRDEGVGDSFVVGEKDLGVVGVIPDAFLGVGEDFVGVLEFLGLRGGFFLGETRFHELVQVALGNQMRNWSKSGGSKVQFCLSYFILLSLTFALLSFLMVCLVVEK

SEQ ID NO: 147397 - protein, 211 aa, Glycine max
  Coding DNA Sequence Number=SeqID_30619
MVEILSPNLAKGLGNKLGYWLYCEGSCGLGFGDESEFQGSGIANARCFKAEGATIWGLRASVMKENEGELALFLKMKKHEKECNDLLLNCSEEFNAPLGSILRNYIGLVIFFVKFRLSKCIKLEAYADAIRHMEILHFGIGKLFSDFESIQVRAYATVLLKQLDFSLSLNSSSSTFTLYKDCSKSLALVFKGDEAMVTAISEDPLSFKDQP

SEQ ID NO: 147398 - protein, 63 aa, Glycine max
  Coding DNA Sequence Number=SeqID_30620
  Subcellular localization annotation: CTP_CleavageSite=28; ConfidenceScore=5.39e-01
MNVNKKTNVILTDVKSKFSSSAILSSCNASYDVASFTSVSRNGGHPVPQRKRSAERIKRTVKK

SEQ ID NO: 147399 - protein, 174 aa, Glycine max
  Coding DNA Sequence Number=SeqID_30621
  Homolog annotation: Hit_ID=Q8H6Q8; Match level="QueryCoverage=73%, HitCoverage=4%, E-value=4e-07, Identity=28%"; Hit description=CTV.20
MILKFYDDPTVNRLEIVVFLRLWWDFFGPIPKIFPEQVQQGFAQFNKHFNSQESQILADLKYFSSFTLSWIFSWQYRYSKIENNKQFSSLQRHGFVKWWNQFDTSKAQLDKVKIWFKTHLEFLKAPDPETSLFLNQKSQLAAFLARSNSKEHLTKKLKEVLQLLQSQEEGSSQA

SEQ ID NO: 147400 - protein, 212 aa, Glycine max
  Coding DNA Sequence Number=SeqID_30622
  Homolog annotation: Hit_ID=O48878; Match level="QueryCoverage=60%, HitCoverage=14%, E-value=1e-17, Identity=35%"; Hit description=Gene X-like protein
  Pfam annotation: Domain name=XS; Domain location=23-134; Score=38.7; E_value=8.9e-10; Accession=PF03468.5; Description=XS domain
EENQQDTSHLRARRVREGRRAKEHLKYKGIVAYIFGKPKHEPVECDSMYWLRKFEQYKPEGAYVLHCAEDPTGYVVLEFGTEWTGFMQMMKLDRDFLVDHHGKKDYYESRKMGYSSGLFGWCAQAEDYNSEGLVGNFLRQKAELKTTLMVAQESLNEKTETLDHLYGEIGSVNKKISEMESKYIKDYMSLDKMMKEIEKKRDLLHQTRAEGL

SEQ ID NO: 147401 - protein, 36 aa, Glycine max
  Coding DNA Sequence Number=SeqID_30623
MCFGIPVVEMDHNNDRFKIQLKVSDDTGVTIFTMFD

SEQ ID NO: 147402 - protein, 152 aa, Glycine max
  Coding DNA Sequence Number=SeqID_30624
  Homolog annotation: Hit_ID=Q5ZDL5; Match level="QueryCoverage=50%, HitCoverage=9%, E-value=3e-07, Identity=37%"; Hit description =Putative transcription factor X1
  Pfam annotation: Domain name=XH; Domain location=39-152; Score=0.7; E_ value=2.2e-06; Accession=PF03469.5; Description=XH domain
MIFDMSVKDDENQALEKKVQEAKTELEDARQQVIKLLAIGTVLSQLMFSVQKLIECICLTIQELPRSLKGEVIDENDPKLLSLKNDLEEEAYVAVVTAPKELHEYHNSDDAENTHNSSEKQVIPEIWDYQNGRRATVTEALKYISNRVIKMR

SEQ ID NO: 147403 - protein, 165 aa, Glycine max
  Coding DNA Sequence Number=SeqID_30625
  Gene Ontology: Mol. function=cysteine-type peptidase activity; Cellular component=cytoplasm; Biological process=proteolysis
  Pfam annotation: Domain name=Transposase_21; Domain location=98-165; Score=-81.2; E_value=1.1e-07; Accession=PF02992.5; Description =Transposase family tnp2
MGDRLEDMIRDFGQEFFHQAYAPLYDTLESDSKKSLYPGCKKSLALLSPVLSLVNVKAKYGWSNKSFTSLLKVVQGMLLEENMSKSYYEVKKILCPMDGRNYDGMLYHPADSSQWKKINRLYPDFEKEARNLRFGPVTNGMNPFDNLSTKHSSWPVLLVIYNLPS

SEQ ID NO: 147404 - protein, 92 aa, Glycine max
  Coding DNA Sequence Number=SeqID_30626
  Subcellular localization annotation: CTP_CleavageSite=31; ConfidenceScore=5.02e-01
MPTINGEEEVDNVHMATPLSSPPPESAPLPSTSKRTRKVTRLRSLFARLVGVERPVVHIDLTTGKTDGPHKKKLRTYLGVIARDKVNVTYVN

SEQ ID NO: 147405 - protein, 76 aa, Glycine max
  Coding DNA Sequence Number=SeqID_30627
MNCSTWEKWSSMGDPSDTTRTKKARDWKYSAKASSVIFGKMGCVKANNCPKVIVGTEGMAKDSKGTLEGSSTETDS

SEQ ID NO: 147406 - protein, 77 aa, Glycine max
  Coding DNA Sequence Number=SeqID_30628
MDAHEKIDQVPKDKEKGSVAQEESIEQELKQTEDSLLEAWLNDDDLLRVKIDAISLIPSEFWANTSQNESLDGDVCS

SEQ ID NO: 147407 - protein, 298 aa, Glycine max
  Coding DNA Sequence Number=SeqID_30629
  Gene Ontology: Mol. function=oxidoreductase activity; Cellular component=membrane; Biological process=metabolic process
  Homolog annotation: Hit_ID=Q9SCU0; Match level="QueryCoverage=93%, HitCoverage=93%, E-value=1e-106, Identity=68%"; Hit description =Short-chain alcohol dehydrogenase-like protein
  Pfam annotation: Domain name=KR; Domain location=32-190; Score=-58.7; E_value=0.0006; Accession=PF08659.1; Description=KR domain
  Pfam annotation: Domain name=adh_short; Domain location=31-199; Score= 94.7; E_value=2.8e-25; Accession=PF00106.15; Description=short chain dehydrogenase
  Pfam module annotation: Pfam domain module=KR::adh_short; Domain location=32-190::31-199
MIVMSEKPLQGVPPQITDTTFSSSSKRLEGKVAIVTGGAKGIGEATVRVFVKHGAKVMIADVEDAAGAMLAETLSPSATYVHCDVSIEKEVEKLVSSTISRYGHLDIMFNNAGVLGNQSKNKSIVNFDPDEFDKVMCVNVKGVALGIKHAARVMIPRGIGCIISTSSVAGVMGGLGPHAYTASKHAIVGITKNTACELGRYGIRVNCISPFGVATSMLVNAWRPCDDEGTNFGVPFPEEVEKIEEFVRGLANLRGPTLRALDIAEAALYLASDESKYVSGHNLVVDGGVTSSRNCIGL

SEQ ID NO: 147408 - protein, 186 aa, Glycine max
  Coding DNA Sequence Number=SeqID_30630
  Gene Ontology: Mol. function=RNA-directed DNA polymerase activity; Biological process=RNA-dependent DNA replication
  Homolog annotation: Hit_ID=Q1SQU8; Match level="QueryCoverage=69%, HitCoverage=32%, E-value=7e-16, Identity=41%"; Hit description =Polynucleotidyl transferase, Ribonuclease H fold
MGKDGFSSCIIRPSSSNTLGLETRQSHMPQVFLLLARKISWNDHYSVKSAYYQLLENLIDNSALKYGNSMSPRKLNIFFGEFLEDVSLVEPISKPKECHALYAAHFANPMSKMSGISSLNAIKPIKSGYGIGKTTKYGRSLPLSSPFLVNCSINGPMHINNILITNTDRYLPHNHLPLGRNLLLAP

SEQ ID NO: 147409 - protein, 56 aa, Glycine max
  Coding DNA Sequence Number=SeqID_30631
MAKNLKSRWTNELSRVLDECRIVLLLVDHLSVCHQEKDECPLVVVVVALCGHLSGG

SEQ ID NO: 147410 - protein, 1263 aa, Glycine max
  Coding DNA Sequence Number=SeqID_30632
  Gene Ontology: Mol. function=actin binding; Cellular component =cytoskeleton
  Homolog annotation: Hit_ID=Q5XPJ9; Match level="QueryCoverage=100%, HitCoverage=92%, E-value=1e-72, Identity=32%"; Hit description =Protein SCAR2
MFHDLHEEVLATAARGHNLVSRVQQLEAEVPALEKVFLSQTHHSSFFTKGGIEWHPNLRSEQNLVTRGDLPRFIMDSYEECRGPPRLFLLDKYLKLFFSLGSERFDVAGAGACLKRYTDPSFFIVESASSGKVTVEVQREKKIHKVKQKKGTRLRNGETPEVVPSHAKLHQLLLQERIENACGDPARLVKLKKKQLNGSAVEAKTWKSYMEKILEIPSPDHKMVCETSIPQPGKLVSDDSSESGIKILEISSITPMNRSLGNENTWSSPNEQELEVNSYAEMDREMDGYIVEVNEQISGGVTEEMSSDYLKVLDEAGLVFDEQNKREFNLDSYHSDDVISEVDDYMDALATIESELDTDNECGPTKKLLNIQNLTDSNGKGEPQLRAQFSDSQSFGDSLTSAEEISSFEQDRNGEHNEVQGQLSDSLSTGTSWASDDNSPFRRDISEEHSQLQQFSDFQYIRNSTSRIEDMSSDQLPPTFEFQRTYCREFVVDDDEHAQGEVISDSRPVSSGSCLMDSEHLMLYSDLGAASPVSLSAGTGRQSDETPSGPVELHLRIEDDEEKKCLVESIVARSDACYPIRDDAFPVVSFDNNSLNNLDVCDPYVHSNDLLQTSNELNLAHEGESGGHSGIEVFQAESLNECSSEILVSGDVGLQGEDPICPSMEVDLNPDTKLLLDVQNLKSEDDIIATQLNSEDLFPVAETTSKSSITQELCFDFTSGNKPDLAEVEFLPPDHQVNFEEVPRILPGDEISGSTCSLDLVEDDVHIKHSSSDIISSPMSNLTKLEETLSIFADPCEKEMIVSEADSRESLTELAAQKVVDQPEITSIDVQLSMSRSVPCDPSDSGIRNNMQHSSIKEKIHYSSSINGLKTVPVCSELDTQRLSGQGINPTKRVMNPLKPLIPDFLPKASKNSLEEMPPMPPLPPMQWRTGKVQHASLFTQREDIEVNLASLQPIQPNKLDDKSQFGLPTSEKETLPYQNLFLPVMAVESNIHQYSSGFSVGMSEQPVSIPFQFPVMVNEANGQYNFLVPEQSQIQNPFLTLQDRSPLGYAVALEGEINPSPCPPSLLAECVVSRADPILQQEKPTQSPSELTEGTSLEVTKDRPGELHLVLPAECPDSGDDPISPKEKPTQSPSQLMEETSLEVKTLEQSSINLEREQEDPSTSPMSPPSLEIKETNHSLLPSEGEMAFPLDTSSQTSKRDNTETPNGKPKNKRPLPQEDPVIDPVAALDKSRLRKVTERVMPPRAPKEDGRESLLEMIRSK

SEQ ID NO: 147411 - protein, 432 aa, Glycine max
  Coding DNA Sequence Number=SeqID_30633
  Gene Ontology: Mol. function=GDP-L-fucose synthase activity; Cellular component=cytoplasm; Biological process=cellular metabolic process
  Homolog annotation: Hit_ID=Q9LMU0; Match level="QueryCoverage=73%, HitCoverage=96%, E-value=1e-155, Identity=84%"; Hit description =Putative GDP-L-fucose synthase 2
  Pfam annotation: Domain name=Epimerase; Domain location=65-296; Score= 332.8; E_value=5.9e-97; Accession=PF01370.11; Description=NAD dependent epimerasedehydratase family
  Pfam annotation: Domain name=RmlD_sub_bind; Domain location=64-364; Score=-163.6; E_value=0.002; Accession=PF04321.7; Description=RmlD substrate binding domain
  Pfam module annotation: Pfam domain module=Epimerase::RmlD_sub_bind; Domain location=65-296::64-364
MVKNEMNSIIESELTVAGIQLNLGRILGYHRIAIRFSLSIRDFSSLQIRVELSSNSFLAYKSAKVFVAGHRGLVGSAIGRKLTQLGFTNLVLRSHAELDLTRQSDVEAFFAYEKPEFVIVAAAKVGGIHANNTYPADFIAINLQIQTNVIDSAYRNGAKKLLFLGSSCIYPKFAPQPIPEDALLTGPLEPTNEWYAIAKIAGIKMCQAYRIQHKWDAISGMPTNLYGPYDNFHPENSHVLPALMRRFHEAKVNGAKEVVVWGTGSPLREFLHVDDLADAVVFMMEKYSGLEHLNVGSGKEVTIKELAELMKEVVGFEGDLVWDSTKPDGTPRKLMDSSKLASLGWTPKVSLKDGLADTYKWYLENEVLASNHRPSITMLWAFIFITTSHHPRKNTIKVKHLVMGELRATVYCITTNHHSHHQPPSWWESFKR

SEQ ID NO: 147412 - protein, 166 aa, Glycine max
  Coding DNA Sequence Number=SeqID_30634
MVSVSIPYAVKSHPVFLFMKEEALVKAAQANEALLQSAEESHKSFVDTKTKLKEVESREEALKTKLTTIEDSTKTLQEEIEYPNKEFALFKVNVEKVKEKLKIDLGEVEAEILKTYEAEFNKALCQVKYFFKDVDTSLFDVDKDITRHGELVGETDMHVEKVPDLA

SEQ ID NO: 147413 - protein, 227 aa, Glycine max
  Coding DNA Sequence Number=SeqID_30635
MRIHLLGDCYTENKRGYISCGSVQVEGTSTWFFKENKGWYIPCGSLACKGFYKVEKKSQEPQVAWGLDVGTMGSSNEKGSRTGVILESPNEIILEQSLRFKFGTMNNQVKYEVRLADIRLAKEVRAKYLKCWSNSKLVIGKNGHPRNNLRTKPRQGCGECNSPWLRMDDRDLGLPGERLTPIKSKNNKKAQEKCQLLCDRGIRHVLMRLHDPHVEVFDSGSIQIRNE

SEQ ID NO: 147414 - protein, 170 aa, Glycine max
  Coding DNA Sequence Number=SeqID_30636
MAKRSQRFPVNYEKDQSGCMWGFISIFDFRHACFTRKLIVDRTHGNKHVVGAALIKNKFEVLSNLDKNMKAILLNGKDLPEDGQFLSSRELMKALQGQHQRGTTNNIAMSGMSAFKTIGLASVGALLFSPLFMHEFRLETPHMPPKLLNPECKSSKQLKALVCKIEVKTQ

SEQ ID NO: 147415 - protein, 733 aa, Glycine max
  Coding DNA Sequence Number=SeqID_30637
  Gene Ontology: Mol. function=protein serine/threonine kinase activity; Cellular component=integral to membrane; Biological process=protein amino acid phosphorylation
  Homolog annotation: Hit_ID=UPI000034F553; Match level="QueryCoverage =97%, HitCoverage=94%, E-value=0.0, Identity=56%"; Hit description =ATP binding / kinase/ protein kinase/ protein serine/threonine kinase/ protein-tyrosine kinase
  Pfam annotation: Domain name=APH; Domain location=389-573; Score= -13.7; E_value=0.054; Accession=PF01636.13; Description =Phosphotransferase enzyme family
  Pfam annotation: Domain name=Pkinase; Domain location=387-658; Score =119.1; E_value=1.3e-32; Accession=PF00069.15; Description=Protein kinase domain
  Pfam annotation: Domain name=Pkinase_Tyr; Domain location=387-658; Score=61.5; E_value=3e-16; Accession=PF07714.7; Description=Protein tyrosine kinase
  Pfam annotation: Domain name=Usp; Domain location=17-152; Score=30.5; E_value=5.7e-06; Accession=PF00582.16; Description=Universal stress protein family
  Pfam module annotation: Pfam domain module=APH::Pkinase::Pkinase _Tyr::Usp; Domain location=389-573::387-658::387-658::17-152
MLPSATAGDAGHGSAGDRIVVVGMKMDSHSTELLTWALFKVAQPGDVVLALHVLGNDEIVNREGKSSLFSLVKAFDSILAVYEGFCNLKQVDLKFKICRGSSVTRILVREANAYSATHIIVGSSQGLHITRPCISVARYCAKKLPKDCWVFAVDNGKIVFKREGSAATRSDLKGLDRDHKTGLLGSIHRTISKSSKVLDDDGTGMHEKGSGEYSDHSLAKAFLDSKEFIEKKRCSTSASEEEESCADACDEMNPLAIVPVQTNDAASKPGWPLLRKTIVSDRKCSQRSLLCQISVVQWAMQLPSRDLSYAAHQDHKTNNCGPNKDQFLALDSKSGALVPVDAEIGTAPSTEHNSRSIPKELEGLHEKYSSTCRLFKYQELVLATSNFLPENLIGKGGSSQVYRGCLPDGKELAVKILKPSDDVLKEFVLEIEIITTLNHKSLISLLGFCFEDGNLLLVYDFLSRGSLEENLHGNKKNPLMFGWTERYKVAIGVAEALEYLHNNDGQSVIHRDVKSSNVLLSEDFEPQLSDFGLAKWASTTSSHIICTDVAGTFGYMAPEYFMYGKVNDKIDVYAFGVVLLELLSGRKPISGDYPKGQESLVMWASPILNSGKVLQLLDPSLGDNYNHEEMERMVLAATLCTRRAPRARPQMSLISKLLGGDPDVIKWARLEVNALEAPEMLDDEACPPSNLQSHLNLALLDVEDDSLSMCSVEQNVSLEDYLRGRWSRSSSFD

SEQ ID NO: 147416 - protein, 317 aa, Glycine max
  Coding DNA Sequence Number=SeqID_30638
MVSFKNSSREFEESSSNVRAPTKEVFVVPSDDFSRVANNITPSAYKVVDDTTVTVNVMVGPLNHPTRLGNLAFLESPPRLLLAKAIVNLFKSPNPIRILKVWVASIVQHLQGSLVVSKLKDDLKKAEDSLASMLSANIALARDNSELKAHVAALELKSKGENKEAETSLALAEKEKDVEKEEKAQIEHEAYYDVYEAMHLALIIASATSFFIDDAPIGKKLATPSRAKCWLSEPSVERNTPSTEREEESGRRMSCACLLSEGSSSEAHRFSPFAEQEKHMLSRNPLMRAERSIVALKVLLCEDLQRTELEEEAVLRA

SEQ ID NO: 147417 - protein, 498 aa, Glycine max
  Coding DNA Sequence Number=SeqID_30639
  Gene Ontology: Mol. function=transferase activity, transferring hexosyl groups; Cellular component=integral to membrane; Biological process=metabolic process
  Homolog annotation: Hit_ID=Q1S2D1; Match level="QueryCoverage=99%, HitCoverage=99%, E-value=0.0, Identity=70%"; Hit description=UDP -glucose glucosyltransferase
  Pfam annotation: Domain name=UDPGT; Domain location=11-489; Score= -67.8; E_value=3.3e-07; Accession=PF00201.9; Description=UDP -glucoronosyl and UDP-glucosyl transferase
MKTESQPQQLNVIFLPYPAPGHMNPMVDTARLFAKHGVGVTIITTPANDLTFQKAIYSDFSCGNCIKTRVIQFPASQVGLPDGVENVKNVTSREMLDKISLGLLILKDPIELLFQEMQPDCIVTDMLYPWTVESAAKLGIPRLYFYSSSYFTSCAGHFVRKHKPHERMDSDNQKFSIPCLPHNIVITTLQVEEWVRTKNDFTDHLNAIYESESRSYGTLYNSFHELEGDYEQLYQSTKGVKCWSVGPVSAWVNQRDEEKANRGHKEELVLESEWLNWLNSKQNDSVLYVSFGSLIRLPHAQLVEIAHGLESSGHDFIWVIRKRCGDGDEDGGDNFLQDFEQRMNERKKGYIVWNWVPQLLILNHPAIGGIVTHCGWNSVLESLSAGLPMVTWPVFADQFYNEKLVVDVLKIGVPVGSKENKFWTRIGEDAAVRREVIAKAAILLMGKEEGGEMRRRARKLSDAAKKTIEEGGSSYNNLMQLLDELKSLKMSRELEKTN

SEQ ID NO: 147418 - protein, 131 aa, Glycine max
  Coding DNA Sequence Number=SeqID_30640
  Subcellular localization annotation: CTP_CleavageSite=53; ConfidenceScore=5.72e-01
MGQGKTYPSTNFNGNNNEKTPAANQKRSSQGKASTIFGMPTMGTPKNKSPTTVVNILRKVPNNHALIGGIDDTNRTWRKGTMLDTQSTQIVANAENQLHPFIDGIMEAQPPPEWKMLTIDHYEELLDQDEH

SEQ ID NO: 147419 - protein, 139 aa, Glycine max
  Coding DNA Sequence Number=SeqID_30641
  Gene Ontology: Mol. function=transferase activity, transferring hexosyl groups; Biological process=metabolic process
  Homolog annotation: Hit_ID=Q1S3H7; Match level="QueryCoverage=99%, HitCoverage=40%, E-value=6e-30, Identity=41%"; Hit description=UDP -glucose glucosyltransferase
MSTLQGQIEFLFQDLHPDCLVTDVLYPWTVESAEKLGIARLYFYSSSYFASCATHFIRKHKPRESDYEQLYHSTKAVKCWSVGPVSASANKSDEEKANRGHKEELALESEWLNWLNSKQIESVLYEFWKLHQALSFSDC

SEQ ID NO: 147420 - protein, 78 aa, Glycine max
  Coding DNA Sequence Number=SeqID_30642
MSPPPLEPHNHSQTHLKLSGRLPLQAQFSAANGLKRCASLDDPSLSKHAQLILLPDSSSRSVEGVLRSTDGSLSQHLA

SEQ ID NO: 147421 - protein, 499 aa, Glycine max
  Coding DNA Sequence Number=SeqID_30643
  Gene Ontology: Mol. function=transferase activity, transferring hexosyl groups; Cellular component=integral to membrane; Biological process=metabolic process
  Homolog annotation: Hit_ID=Q1S2F8; Match level="QueryCoverage=97%, HitCoverage=98%, E-value=0.0, Identity=70%"; Hit description=UDP -glucuronosyl/UDP-glucosyltransferase
  Pfam annotation: Domain name=UDPGT; Domain location=10-487; Score= -52.8; E_value=5.8e-08; Accession=PF00201.9; Description=UDP -glucoronosyl and UDP-glucosyl transferase
MEAQSHHQLNVLFLPYPTPGHMIPMVDTARVFAKHGVSVTIITTPANALTFQKAIDSDLSCGYRIRTQVVPFPSAQVGLPDGLENIKDSTTPEMLGQISHGISMLKDQIELLFRDLQPDCIVTDFCYPWTVESAQKLSIPRICFYSSSYFSNCVSHSIRKHRPHESFASDTDKFIIPGLPQRIEMTPLQIAEWERTKNETTGYFDAMFESETRSYGALYNSFHELENDYEQLHKSTLGIKSWNIGPVSAWVNKDDERKANRGQKEELAQEPEWLKWLNSKQNESVLYVSFGSLVWLPRAQLVELAHGLEHSGHSFIWLIRKKDENENKGDRFLLEFEQKMKEIKKGYIIWNWAPQLLILDHPAIGGIVTHCGWNSILESVSAGLPMIAWPVFAEQFYNEKLLVDVLKIGVPVGVKENTFWMSLDDEAMVRREEIAKAVVLLMGSSQENKEMRKRARKLGEAAKRTIEVGGHSYNNLIQLIDELKSLKISKALSRSMLDK

SEQ ID NO: 147422 - protein, 136 aa, Glycine max
  Coding DNA Sequence Number=SeqID_30644
  Gene Ontology: Mol. function=mismatched DNA binding; Cellular component=cytoplasm; Biological process=mismatch repair
  Homolog annotation: Hit_ID=Q9LVW1; Match level="QueryCoverage=97%, HitCoverage=15%, E-value=3e-12, Identity=36%"; Hit description=DNA mismatch repair protein MutS2-like
MEYSTNLRFKKMRDVSEAAVMAGSVLHKKVRELDASAKQPSQINKTISSSNLSATNKSLTVAENKKPTIADKSASSVKAFNQSRSDKSGPPKVGDMVHVSSLGKKVTVLKVDLSKGEIVVQAGNMKLKLKLTDIQR

SEQ ID NO: 147423 - protein, 250 aa, Glycine max
  Coding DNA Sequence Number=SeqID_30645
  Homolog annotation: Hit_ID=Q9FLU4; Match level="QueryCoverage=87%, HitCoverage=90%, E-value=1e-77, Identity=66%"; Hit description =Arabidopsis thaliana genomic DNA, chromosome 5, TAC clone:K18P6
  Pfam annotation: Domain name=DUF599; Domain location=8-228; Score =329.0; E_value=8.1e-96; Accession=PF04654.3; Description=Protein of unknown function, DUF599
MEKKVLDLILVPSGFLVMLAYHFWLLHQIMKHPTKTVIGVNAINRRLWVQAMMEDVSKNGVLAVQSLRNNIMASTLLASTAIMLSSLIAVLMSSGNERKTVVYEVFGDRSELGLSIKFFSILVCFSLASLLNVQSIRYYSHASILINVPFKKVSPNLRHQMLTAEYVANTVNRGSYFWSLGLRAFYFSFPLFMWLFGPIPVFFSCVALVFMLYFLDVTFECGCAGVSDTHSVESAELNKHNVDVEIGKAN

SEQ ID NO: 147424 - protein, 1822 aa, Glycine max
  Coding DNA Sequence Number=SeqID_30646
  Gene Ontology: Mol. function=nucleic acid binding; Cellular component= membrane; Biological process=homophilic cell adhesion
  Homolog annotation: Hit_ID=Q67WF0; Match level="QueryCoverage=50%, HitCoverage=41%, E-value=1e-124, Identity=34%"; Hit description=Zinc finger (CCCH-type) protein-like
  Pfam annotation: Domain name=zf-CCCH; Domain location=1569-1596; Score=17.8; E_value=0.0059; Accession=PF00642.15; Description=Zinc finger C-x8-C-x5-C-x3-H type (and similar)
  Pfam annotation: Domain name=zf-CCCH; Domain location=1597-1621; Score=1.1; E_value=0.95; Accession=PF00642.15; Description=Zinc finger C-x8-C-x5-C-x3-H type (and similar)
  Pfam annotation: Domain name=zf-CCCH; Domain location=1624-1648; Score=9.8; E_value=0.068; Accession=PF00642.15; Description=Zinc finger C-x8-C-x5-C-x3-H type (and similar)
  Pfam annotation: Domain name=zf-CCCH; Domain location=1651-1676; Score=16.0; E_value=0.01; Accession=PF00642.15; Description=Zinc finger C-x8-C-x5-C-x3-H type (and similar)
  Pfam annotation: Domain name=zf-CCCH; Domain location=1677-1699; Score=17.2; E_value=0.0071; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH::zf-CCCH; Domain location=1569-1596::1597-1621::1624 -1648::1651-1676::1677-1699
MESDADAAGRTTSKRWVMSDRDRGREMLESSSSLVSNSVNNEKYYHGSESNMMGRYSRGNSRECGHTHEFARTPPKKQVQKKSALLRIQTVKPNNNHRNRDNREVEPLRYPGYGSECSNGFYRGKEQYLGHGVKGDEREEREGSPVEIDISFESNSLVAKAKAIVAPPSSLVSVPDLNVMPIADSDLVYGGRSKRVSGTDGDYSGLQLQQPVRMSSVVVVDLNRSPCKGNDSLGSRKEVMGSKKKNVDDGSSRSSAREADGSRGKKEVPNSVKVGNVGSGKLTLKVVKKKKIVKRVVKKGTASSKSSVSNSLPAKTLPGTVKAESVACISLTASGPEKIEANLDEKSNTVDEVAKPDCLHPLPKEGNVLKEEAEVGLLQPSLGPHSGSQECKSDKDSDIGKVSRFEKDGNISNSLSCASSSEDKKSDSDCLDANDSVHDNANTSDCLDANNSVPNTVKVTKSLSGSNISVVTNMDYGNKQLCQNEVSLSPGKYSNAGSPQNRNLVDAGDELLKSSVISCSGKTRIQDGLDCLQHASALKHSSDNGSSNLEDSTSVDFSGIMHDAGKQVSPGHVIISPENCETEKAFPNYNVSAGSGEGDTNMIKKRKDRTHLKYLSSEMECLSPDYVNSDRLANNVDGGSSLLLKDPSPSEVLAQPVQSLDFNSLSGLDGVTALHVVNNDNDNANEVSPASKRKKVTANPYFTKCQSEFCAVIVPSPTSEAPVSFSDNQEHQKEVVFASMGMSILSTAQSILYSENITKMSENILAGGSFESIDADKETMSSEHLELQHSDIVSFSPSEDVAFPNVQLSSLEGECKENITPIVPTSNIQTDVLAVGIIAGQKTDLQAVEENYQYREHVQRSPRADMEPNDHNMKNDLLARQNLMSCPASSDEVTTSNLNNEVIEDVPDALSDMFSQGMASEVPDQRVLEFTAINDENICGVEENPDNNISIVGHGSDLNTSSIQQTRKNMKSGHAIEHSNLITKKTMSEPSQVSSRVTTQALNSYRFGLSGTKNQSGSVIPKTFPGHSFTFSKASASSPHVSKPRTWLRTGNIPPTSVLRIKPSVETVPPKRPILETKGNFQNTSYVRKGNSLVRKPTPVSTLPQISSVNQTSSLGIDEIPKSIKSGRRADGTDKPMYLKTGAINAPQQRTPPLPIDTKLEENRSSSLVEPPSGGCCENASDVRKFIETDNIAPNSSEDALKHCETPENQSGPSDNGESQGEANDGNVFPLNTKRIVYIKPKTNQLVATSNSYDVSVSTDDNLQTAFSDGYYKRRKNQLVRTTIESHINQTVAMPNNTANSDGQGTSNALCNRRFSKKRTHKVGRSSFKRSRASLVWTLCSKNSSENDRDSRHYQRALPLLFPWKRAAFASSLNNSSLSAISKKLLQLRKRDTVYTRSIHGFSLRKSRVLGVGGCSLKWSKSIEKNSKLANEEATLAVAAVERKKREQKNAVCISSLSKSRKHSFHELAVDCAGERIFRIGSVRYRMDPSRRTLQRISGDDESLSSASTCSGLASKRAYIPRRLVIGNDEYVRIGNGNQLIRDPKKRTRKLANEKVRWSLHTARQRLARKQKYCQFFTRFGKCNKDGGKCPYIHDPSKIAVCTKFLNGLCSTPNCKLTHKVIPERMPDCSYFLQGLCSNRNCPYRHVNVNPKASICEGFLKGYCADGNECRKKHSYVCPTFEETGTCTQGTKCKLHHPKKQSKGKKRKRTAYQNNSRGRYFGSIPANVSESGMMLAPKRHRQSGELEEELSDYISLDDVNEEVLDTVDQSFEPATFCDNDSLDLQLDDFDELIKPVLLLKTKFTMQSPQFSSLQAFRQVAES

SEQ ID NO: 147425 - protein, 379 aa, Glycine max
  Coding DNA Sequence Number=SeqID_30647
  Gene Ontology: Mol. function=mismatched DNA binding; Cellular component=cytoplasm; Biological process=maintenance of fidelity during DNA-dependent DNA replication
  Homolog annotation: Hit_ID=Q9LVW1; Match level="QueryCoverage=92%, HitCoverage=48%, E-value=1e-62, Identity=38%"; Hit description=DNA mismatch repair protein MutS2-like
MQRQRQRVSLSLSASIHHDSLRVLEWDKLCDLVASFACTSLGRQALKDQLWSLNQTFEESLALLEETNAAVEMNKHGSLRLHLGHLDAMLVKTAIQQARRSIPVSGYEAWAIVALLQCAETLPGDLKAAIKEDKDWHNRFMPLTEVIMEFVINRSLIKAIEQVVDEDGSIKDSAVQQLIESIIRSEKSETSILVGIEFLFLMMVFIGSGSGVGSTIEPLSAVPLNDELQRARSLVVKAEADVLLTLTKKMQLDLEDIENTLNSLVELDVMVSNVVPMQINARATYGLSFGWSSPHIFLPDRGSSSTAEAFLPRKENPYGPLPSKREWMLYLLKAYPPLLLQRHKEKLRKAKKDVNIAASVKSQMTCVEFEGGGRWIKRK

SEQ ID NO: 147426 - protein, 215 aa, Glycine max
  Coding DNA Sequence Number=SeqID_30648
MRSRGGNTTTVGASKITSTVLVYNRHHHQAFPVIVGTLLGVGAGLLWAEQGAIMTSYPPTNGKASSTWVESLVHGLIPFILNYHRSEAASVNIGTYIGFMCFILLGTLLSLAILPACKVLRDDGSRCTNMLYSNVSTECVEVLKLFSNWKVLLMVPAAWVWGMVGVVVVGVLGTVIWGGGLANQLSFGLLDAMFQSLVYWVIGALADDSKQVMMR

SEQ ID NO: 147427 - protein, 202 aa, Glycine max
  Coding DNA Sequence Number=SeqID_30649
  Gene Ontology: Mol. function=isomerase activity; Cellular component =intracellular; Biological process=proteolysis
  Homolog annotation: Hit_ID=Q1RTJ9; Match level="QueryCoverage=94%, HitCoverage=57%, E-value=2e-19, Identity=36%"; Hit description =Cyclin-like F-box; F-box protein interaction domain
MSGYHLVGSCNGLHCGVSEIPEGYCVCFLNKATRVISRESPMLSFSPGIGRRTMFGFGYDPSSDKYKVVAIALTMLSLDVSEKTEKKVYGAGDSSWRNLKGFPVLWTLPKVGGVYLSGTLNWVVIMGKETIHSEIVIISVDLEKETCISLFLPDDFCIFDTNIGVFRDSLCVWQDSNTNLGLWQMRKFGDDKKIDDFTIVHV

SEQ ID NO: 147428 - protein, 351 aa, Glycine max
  Coding DNA Sequence Number=SeqID_30650
  Gene Ontology: Mol. function=sugar porter activity; Cellular component=integral to membrane; Biological process=transport
  Homolog annotation: Hit_ID=Q7WKN2; Match level="QueryCoverage=84%, HitCoverage=53%, E-value=1e-106, Identity=64%"; Hit description =Putative sugar transport protein
DPPADTVGQPAEEDEERHAQRQRGRDQQVGGGGIDLQHAAEEEQRVELAAVPDHRLAGCSAEQDQQHQLQVAALQAVTERGLGTLALGLHLLEQRRFAQLQADPHGHAQQQDRDQERNAPAPGFEGFVAEEIAAGQDDQQRHEQAERGRALDEAGVQAALVVRRMLGHVGGGTAVLAAHRQALGQAQDDQDHRRGEADRGVVGQHADQEGRDAHDQDGDQEGVLAADAVAEAAEEGRAERTHEEAGGKRQQGEDHACGFIDATEELLGDDGRERAVQEEVVPLEHRAEARGEDDLLVTLGQGARFVCGTGCAGHGAFSLGRCRPWSVLNSVGTGRGPARNLYRCRPWSALL

SEQ ID NO: 147429 - protein, 54 aa, Glycine max
  Coding DNA Sequence Number=SeqID_30651
  Subcellular localization annotation: CTP_CleavageSite=16; ConfidenceScore=5.41e-01
MAESSKKRKGSSASVSASRAHRSGATSASTVPIPPSLSSSTLFSSEEHQKRTAP

SEQ ID NO: 147430 - protein, 312 aa, Glycine max
  Coding DNA Sequence Number=SeqID_30652
  Gene Ontology: Mol. function=transporter activity; Cellular component= outer membrane; Biological process=nutrient import
  Homolog annotation: Hit_ID=Q1H1L8; Match level="QueryCoverage=90%, HitCoverage=24%, E-value=1e-113, Identity=71%"; Hit description=TonB- dependent receptor
  Pfam annotation: Domain name=Plug; Domain location=154-268; Score =58.4; E_value=2.4e-14; Accession=PF07715.5; Description=TonB -dependent Receptor Plug Domain
  Pfam annotation: Domain name=STN; Domain location=72-122; Score=36.1; E_value=1.2e-07; Accession=PF07660.4; Description=Secretin and TonB N terminus short do
  Pfam module annotation: Pfam domain module=Plug::STN; Domain location= 154-268::72-122
MAQKIINKHSLLAWAVLSTLGSSEAVLHQLQAAELNTNVPTVSETGGFPVQINLPAQPLNQSIRQLANQTGLSISFDSELTKNKTAPAVKGFLSPQAALKKVLQGSGLQLNISGDSAVIKPEPEKTSQSLKLDAVEVRAKRFYEVGPLPGLGLTKEEIPGNVQSISAKEIKEAHSLSITDLMNRKLQSVTVNDYQGNPFQMDVQYRGFTAGPQIGTPQGLSVFIDGIRVNEPFGDVVNWDMLPMNALASVDVFPGSNPIFGLNTLGGAFSLKTKDGFNNAGADVDILTGSFGRKQLQLEGGWNNGTVGLFAA

SEQ ID NO: 147431 - protein, 144 aa, Glycine max
  Coding DNA Sequence Number=SeqID_30653
MWMDRFALTLNGSQELPRLLAKAKAVANTYSAPEEIHRLLSYLRIKSLPHFISSMHCMLVSSFVTGSRKNCHSLDYRVEPSSCFYKKVHQVKLKYGSKRLAKLGQKMNRVTSLLRLLPKIFRIVDVLVTSSFTLTKMSWTMLKI

SEQ ID NO: 147432 - protein, 249 aa, Glycine max
  Coding DNA Sequence Number=SeqID_30654
  Gene Ontology: Mol. function=structural constituent of cell wall; Cellular component=cellulose and pectin-containing cell wall; Biological process=protein amino acid phosphorylation
  Homolog annotation: Hit_ID=Q9T0K5; Match level="QueryCoverage=84%, HitCoverage=27%, E-value=7e-84, Identity=70%"; Hit description =Extensin-like protein
  Pfam annotation: Domain name=LRR_1; Domain location=105-127; Score =8.7; E_value=6.9; Accession=PF00560.23; Description=Leucine Rich Repeat
  Pfam annotation: Domain name=LRR_1; Domain location=11-30; Score=7.4; E_value=12; Accession=PF00560.23; Description=Leucine Rich Repeat
  Pfam annotation: Domain name=LRR_1; Domain location=129-151; Score =14.1; E_value=0.52; Accession=PF00560.23; Description=Leucine Rich Repeat
  Pfam annotation: Domain name=LRR_1; Domain location=153-174; Score =1.8; E_value=1.3e+02; Accession=PF00560.23; Description=Leucine Rich Repeat
  Pfam annotation: Domain name=LRR_1; Domain location=34-56; Score=4.1; E_value=49; Accession=PF00560.23; Description=Leucine Rich Repeat
  Pfam annotation: Domain name=LRR_1; Domain location=57-79; Score=1.8; E_value=1.3e+02; Accession=PF00560.23; Description=Leucine Rich Repeat
  Pfam annotation: Domain name=LRR_1; Domain location=81-103; Score =2.4; E_value=1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=105-127::11-30::129-151::153- 174::34-56::57-79::81-103
KFPDVVLRLPLLKFLDLRFNEFEGTVPKELFDKDLDAIFINDNRFVFDLPENFGNSPVSVIVLANNRFHGCVPAGIGKMKGLNEIILMNNAFKSCFPAEIGLLQNLTVFDVSFNQLLGPLPDAIGGAVSLEQLNVAHNLLSGKIPESICKLPNLQNFTYSYNFFTGEPPRCLALPAFDDRRNCLPARPAQRSAGQCKSFLSHPVDCNSFRCKPFVPSLPPPPPPSPPLPSPPPPSPVYIPHSPPPPPPP

SEQ ID NO: 147433 - protein, 96 aa, Glycine max
  Coding DNA Sequence Number=SeqID_30655
MDMLVDAEVYLIQTSSKMNISVSDSNHSAQHESQSLSVTADHDPLLGLPLTPTKRQTFQDCDDEAGTSQISPAQLSSKKLKKTWRNLVHLVVFKLC

SEQ ID NO: 147434 - protein, 92 aa, Glycine max
  Coding DNA Sequence Number=SeqID_30656
MECPGLLHDKHTLRSSRILRKMEVEEPWLGLFAAKFLFVGVFLVCAKGGLRHWNNDIVGFGGKLGRIGMAVTAWVSPSFSPSSFAPVFSVVL

SEQ ID NO: 147435 - protein, 132 aa, Glycine max
  Coding DNA Sequence Number=SeqID_30657
MAEKTNKILEEAAQSGSTEGIIDPPSPIRRHVKWKLARTKKTGQMTILWMSRRHRDRSSPHGCQDVLTAAIGQPEHPGRVRAAGAGVTIKQYFGSAPRMSCSSSSMLPEDLQQLTQEIRDLLDESITKNVTR

SEQ ID NO: 147436 - protein, 73 aa, Glycine max
  Coding DNA Sequence Number=SeqID_30658
MVVILPKEHLVVWFCSLHNRPDNYLKGIINSAIKGLDDAPQPKSKAPARWIVVKYFNDPRPLEPERLKALWIQ

SEQ ID NO: 147437 - protein, 176 aa, Glycine max
  Coding DNA Sequence Number=SeqID_30659
  Homolog annotation: Hit_ID=Q1SDS1; Match level="QueryCoverage=95%, HitCoverage=37%, E-value=3e-07, Identity=27%"; Hit description=IMP dehydrogenase/GMP reductase
MGTRGCISYNPVLAIRQLGYPMRGAPLEDELAPVISRGFNKTNVETLQKVRKAWEVLQKKDKELRGSNNGPIGGYRKWLKAHVQGLDWLPSLRTAKREEVEAPEEDEEVQALRAELEQAQTVKERFKSAALKIQKENTELRDINVATTKALERETKRACREEHGRNKFRGALWGSN

SEQ ID NO: 147438 - protein, 92 aa, Glycine max
  Coding DNA Sequence Number=SeqID_30660
MASYGGIAPPRHPVDLEKSNRALVPVSPSKVIRPPINKDFIKKYCAPRQAKGEAPQQPGDGQQWATNAPPPPPVSTSAHLQRLERCLRHMAN

SEQ ID NO: 147439 - protein, 226 aa, Glycine max
  Coding DNA Sequence Number=SeqID_30661
MASTTCLFRHLLFTMLQGCYCLTVGTVDEIIIDAPWSYDSCPNCKTTFDPSKGGSACRSCHTSVVDTVPRLAMIIFCTDYLFTRFAVLANFPEISMDVKDATCIKLFGKTVGECRDELIAAGDDIKVFPTCVDEILLKTWAVRFKFRSQLRQSSVLDVSEELHHIQSLITTLGLKPSLSQSSDYDPGNSTCLTPTKMISCQQTNSDFDSDEHAQYQLSTNKHIKAE

SEQ ID NO: 147440 - protein, 150 aa, Glycine max
  Coding DNA Sequence Number=SeqID_30662
  Homolog annotation: Hit_ID=Q9AVH2; Match level="QueryCoverage=31%, HitCoverage=16%, E-value=3e-19, Identity=93%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASNPDSDLEAFSHNPTHGSFAPLAFQPSAMTNCANHRFLSY

SEQ ID NO: 147441 - protein, 83 aa, Glycine max
  Coding DNA Sequence Number=SeqID_30663
  Subcellular localization annotation: CTP_CleavageSite=36; ConfidenceScore=5.19e-01
MEELITKHNSLSLNNANVITSAPHQNLTPCTLLLSLCSHEQGSRSSQETMQSSSRPPGCARNCPPIGDQPGDQRSSLPGDTPP

SEQ ID NO: 147442 - protein, 77 aa, Glycine max
  Coding DNA Sequence Number=SeqID_30664
  Homolog annotation: Hit_ID=Q2HRX8; Match level="QueryCoverage=93%, HitCoverage=9%, E-value=1e-07, Identity=40%"; Hit description=IMP dehydrogenase/GMP reductase
  Subcellular localization annotation: CTP_CleavageSite=36; ConfidenceScore=5.26e-01
MKSYGSPGPVDAPHMGSNRHPESGVDPGAPCTSVYVCSSRSSSWQFTYRHAVNPRRSPDQQWTLRLRESARISNTTK

SEQ ID NO: 147443 - protein, 83 aa, Glycine max
  Coding DNA Sequence Number=SeqID_30665
MEVDEPWLGLWLPLNYQADMGASQHRTLKLGAVGRLWLILGMAIVDDWVVGNEKGIFYLGTTVAAWVSPSFSPSSFAPVFSFV

SEQ ID NO: 147444 - protein, 52 aa, Glycine max
  Coding DNA Sequence Number=SeqID_30666
MAYTAILLVGLGPAHTTEKTVGSAISETGNLTACLGASNLNAMREGVSGSMK

SEQ ID NO: 147445 - protein, 68 aa, Glycine max
  Coding DNA Sequence Number=SeqID_30667
  Gene Ontology: Mol. function=catalytic activity; Biological process =metabolic process
  Homolog annotation: Hit_ID=Q1SI48; Match level="QueryCoverage=70%, HitCoverage=12%, E-value=3e-10, Identity=75%"; Hit description=AMP -dependent synthetase and ligase
MWYLWCQFCRMDYEHAGVGAIEFIICHSEVSIALAEEKKIPEVLLSKPSFFYSSLIVRKDLRVVYNLL

SEQ ID NO: 147446 - protein, 129 aa, Glycine max
  Coding DNA Sequence Number=SeqID_30668
MSEIEEVQEQMKADIEAMKEQMTTMMEGMMSMRKMMEVNMATVITASTTTKVDPTLPSGLNQAQVPQPMGETHEVPRDHPLADSEPSLGYATEGQSFSGIPLPNTLGAFSIAHNHNPYILWYKDCLLPW

SEQ ID NO: 147447 - protein, 65 aa, Glycine max
  Coding DNA Sequence Number=SeqID_30669
MAKLCLVLDMVIPLKCKVPDFDKYKGTTCPKNHLKMYCRKMGAYTKDENFLMLVNSDICQVTSQC

SEQ ID NO: 147448 - protein, 102 aa, Glycine max
  Coding DNA Sequence Number=SeqID_30670
MKVPQPKYHSMWRISHLRPPFQSHSLEGRRKVEATLEPPAPVEDLSSPQHATDPSTPILDIPEDPTTPVLTLNTSPPATLVLHLTNEEDVQTHDIQDQSQEF

SEQ ID NO: 147449 - protein, 110 aa, Glycine max
  Coding DNA Sequence Number=SeqID_30671
MDIVEQENQSLREEVATLREGMDRLTTMMSALLSAQNSQAAAVAVEQPLVSTTPLSTVTSPPLFLPPGCTWGMPSPVCGSPQPAVSEVPPPFAQQSAPIPQPNTSFPQAA

SEQ ID NO: 147450 - protein, 107 aa, Glycine max
  Coding DNA Sequence Number=SeqID_30672
EKYQHRQDEILQHSTKEGTSTRDSPNTATFVNDNEIYLNADGGPNYKGNVYELGTLSKRFSCSKSAPSTSIAPVEDQIEKMRETINKLNVELLAKANKEKILEEKML

SEQ ID NO: 147451 - protein, 212 aa, Glycine max
  Coding DNA Sequence Number=SeqID_30673
  Subcellular localization annotation: CTP_CleavageSite=43; ConfidenceScore=5.68e-01
ATPPASPPPPLPPPPVDADASPSTLKRTRKATRLRSLATRPPRAERPVVNVDPTTGKVDGPHKKKLRTYLGIVARDKVDVTYDTWKEVATAQKDLIWEDIQYDKEEILQIVGERWRQFKSDLTRKWALAVDKDGVDDIVCEKYGISKEKWTQFCQTRRDPSWEDVRKKAQASQKQNTAPHVLSRGGYEYLEEKLMAEKDKEKTGRSCPVWKH

SEQ ID NO: 147452 - protein, 75 aa, Glycine max
  Coding DNA Sequence Number=SeqID_30674
MCNRILMIFTVVGTRPRLEPSNTEERDREDLDFRLMHPFLTVTREAKAREIITPCKRVQVSETLQECPRGSICGT

SEQ ID NO: 147453 - protein, 118 aa, Glycine max
  Coding DNA Sequence Number=SeqID_30675
MAEQAKQVFYVQDPCDERWQMTTPPRSPPFSPPPPIDATSHSPPTLKRTRKAIGLRSLAATRPVGAERPLVHVDPTIGKADGPHRKKLRTYLGIIARDKVDVTYENWKQVPIAQKDLI

SEQ ID NO: 147454 - protein, 152 aa, Glycine max
  Coding DNA Sequence Number=SeqID_30676
  Homolog annotation: Hit_ID=UPI000044A8F0; Match level="QueryCoverage =88%, HitCoverage=99%, E-value=2e-08, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=12; ConfidenceScore=5.01e-01
MLVRMMRTRLFTAARVKSCLGIHSSCMIASLSGCARTVGRPPISGGSPRTDKRKRTLNFLKAQMWSPLKVRMRSPLKARACSPLKVKACSPLMVRACSPLMARTTRTCSPLKVRACIPLKVRTCSPLMARTCSPLKVRACSPLKARACNPLK

SEQ ID NO: 147455 - protein, 132 aa, Glycine max
  Coding DNA Sequence Number=SeqID_30677
  Gene Ontology: Mol. function=structural constituent of ribosome; Cellular component=ribonucleoprotein complex; Biological process =translation
  Homolog annotation: Hit_ID=P34788; Match level="QueryCoverage=87%, HitCoverage=76%, E-value=2e-55, Identity=90%"; Hit description=40S ribosomal protein S18
  Pfam annotation: Domain name=Ribosomal_S13; Domain location=29-132; Score=159.9; E_value=6.7e-45; Accession=PF00416.12; Description =Ribosomal protein S13S18
MEKKVEKSYYGNGFKQSLVANEDFQHILRVLNTNVDGKQKIMFAMTSIKGIGRRFANIACKKADVDMNKRAGELTAAELDSVMTVVANPRQFKIPNWFLNRKKDYKDGKYSQVVSNALDMKLRDDLERLKKI

SEQ ID NO: 147456 - protein, 152 aa, Glycine max
  Coding DNA Sequence Number=SeqID_30678
MSASQFGGECAYCNSLAVEESEYAFMDVVESDSLEIGSTNVDSDSFEMELDMDDEMTTLSMMKNKQEKQQKMQQTRNVIHTELCSKGEREKNKKEHTQDYVVHLEKGYIHGREKQKAFIIVAVYKWKLILSLKYRTSLPYIGRRQNKKKITE

SEQ ID NO: 147457 - protein, 90 aa, Glycine max
  Coding DNA Sequence Number=SeqID_30679
MQKSKRDVYLAAYLNGASWQMITILPKENVLIRFCSLHNRPDNYLKGIINSALKGLDDTAQSKSKAAARWIVVKCNRQKGSIECGYYVMH

SEQ ID NO: 147458 - protein, 164 aa, Glycine max
  Coding DNA Sequence Number=SeqID_30680
  Gene Ontology: Mol. function=transferase activity, transferring hexosyl groups; Biological process=carbohydrate metabolic process
  Homolog annotation: Hit_ID=Q1T0K0; Match level="QueryCoverage=76%, HitCoverage=69%, E-value=1e-40, Identity=57%"; Hit description =Glycosyl transferase, family 28
MSCLSNSVREGLEHCITSPVGTERNPLIVGDEIFLSRSMTGKREFPRQDTILDRLSERAKQLITNLVKIQNDGTVEVDIEMSAYVAPELLELQSFVESTEYGHHVRLATHDNFKTFVKSAGVDFYPLGGDPRVLAGFFWYFVLNLTIAGCKRFLYIGSPIKNGI

SEQ ID NO: 147459 - protein, 338 aa, Glycine max
  Coding DNA Sequence Number=SeqID_30681
  Gene Ontology: Mol. function=transferase activity, transferring hexosyl groups; Cellular component=membrane; Biological process =carbohydrate metabolic process
  Homolog annotation: Hit_ID=Q1T0K1; Match level="QueryCoverage=99%, HitCoverage=99%, E-value=1e-160, Identity=71%"; Hit description =Probable UDP-glucose,sterol glucosyltransferase [imported] -Arabidopsis thaliana-related
MARNKGLIPSGPAEISVQRKQLKAIIDSLLPACTAPDMETGVPFKAQAIIANPPAYGHVHVAEALGVPLHIFFTMPWTKTTLKLAPIAYFSMYRGSISHLPTSYMWSPHVVPKPSDWGPLVDVVGYCFLSLASKYQPQEDFVQWIQKGPPPLYFGFGSMPLEDPKGTTDVILEALKDTEQRGIIDRGWGNLGNLAELSDNVFLLEECPHDWLFPQCSAVVHHGGAGTTATGLKAGFFWGDRIYEKELGPAPIPISQLNVENLSNAIRFMLQPEVKSLAMEIAKLIENEDGVAAAVDAFHRHLPDELPLPTPIPVEEDHLNPLQWFFLQLGRFCCAPCG

SEQ ID NO: 147460 - protein, 86 aa, Glycine max
  Coding DNA Sequence Number=SeqID_30682
MRAGPIAFDQDRRSKARIEKLIGFFVTKKELAQRPTNHESTVRTFGKPKVQTIFPIQFMGVVHVAHEKLTHLYCNYILSFTGKAQI

SEQ ID NO: 147461 - protein, 356 aa, Glycine max
  Coding DNA Sequence Number=SeqID_30683
  Homolog annotation: Hit_ID=Q10RR9; Match level="QueryCoverage=91%, HitCoverage=89%, E-value=9e-32, Identity=30%"; Hit description =Expressed protein
  Pfam annotation: Domain name=DUF677; Domain location=29-352; Score= -37.9; E_value=1.4e-08; Accession=PF05055.3; Description=Protein of unknown function (DUF677)
MLAKLRAWKTSSQDVKERRDDPKSINFHEEYNSVLRTKSYVNFFNKVQLLANQPSSNDNHNKFSEILLEPCQETITSILDSATLSMTPELKNLMLSYFDISAEASQICCHLLKSINQLHSNYQFIQRALDIMDGDSLETFDLITFGLNSFNYSNNPFSNLKNHDFKLITDKLSSILHHLKSMRKKVGRKIKLMKYLKNTSEVCVTAACGIVAITAMVIAAHTLTAVIMGPAILSFPFKHFKRKLRAYEFSGKGSQSKVYDQLGIAAKGTYILNRDFDTMSRLVARLHDEIEHSRAMVQLCLDRKEDKFSLQVVKELKKSDVRFRKQVEELEEHACLCLVAINQARTLVVKEIKRSM

SEQ ID NO: 147462 - protein, 159 aa, Glycine max
  Coding DNA Sequence Number=SeqID_30684
  Homolog annotation: Hit_ID=Q1T0J6; Match level="QueryCoverage=61%, HitCoverage=44%, E-value=1e-39, Identity=78%"; Hit description =Cupredoxin
MHFPILFLFLLPSLFKFSYSATILVDGSSEWKNPTVSIGDSIIFKHKQHYNLYIFKNEKAFKLCNITQATLLTNPYTWHPSRPGFFYFTFHNGSLKACQDSQKLAIEVTSSAMAPEVSPAPSSGGEVPSSPSFPWPFHPGQEASSPGPAPQAQAQASSP

SEQ ID NO: 147463 - protein, 93 aa, Glycine max
  Coding DNA Sequence Number=SeqID_30685
  Homolog annotation: Hit_ID=Q1T0J7; Match level="QueryCoverage=38%, HitCoverage=14%, E-value=6e-08, Identity=66%"; Hit description=CAMP response element binding (CREB) protein
  Subcellular localization annotation: CTP_CleavageSite=17; ConfidenceScore=5.08e-01
MGIGIQSLNLSFPISIVSTHATVLVFIASMLAFGMFLRPFWVAKNPHFLLNVPKTGDAERKKKRYKQLMEKVLPIAQKQKPPCILRRARSLQW

SEQ ID NO: 147464 - protein, 88 aa, Glycine max
  Coding DNA Sequence Number=SeqID_30686
  Homolog annotation: Hit_ID=Q1SL66; Match level="QueryCoverage=87%, HitCoverage=13%, E-value=1e-16, Identity=56%"; Hit description =Aldehyde oxidase and xanthine dehydrogenase, a/b hammerhead; Membrane attack complex ...
  Homolog annotation: Hit description=component/perforin/complement C9
MEEHVPALHTAINAVKALGRGFDVNCDTRLLYCKGVAGSRVVHVDEEHVRDLWLYDDVVVPNVSMDIVKNSQEHVGRRSSGVCSYQEG

SEQ ID NO: 147465 - protein, 48 aa, Glycine max
  Coding DNA Sequence Number=SeqID_30687
MARNLYGLAATWAQVRLTVEEEHYDLTNIFLTQHLASTVQQGSYWMMM

SEQ ID NO: 147466 - protein, 1548 aa, Glycine max
  Coding DNA Sequence Number=SeqID_30688
  Gene Ontology: Mol. function=cellulose synthase (UDP-forming) activity; Cellular component=membrane; Biological process=cellulose biosynthetic process
  Homolog annotation: Hit_ID=Q1T0J4; Match level="QueryCoverage=69%, HitCoverage=97%, E-value=0.0, Identity=83%"; Hit description=Zinc finger, RING-type; Cellulose synthase; Zinc finger, FYVE/PHD- type
  Pfam annotation: Domain name=Cellulose_synt; Domain location=273 -1103; Score=2054.3; E_value=0; Accession=PF03552.5; Description =Cellulose synthase
  Pfam annotation: Domain name=PHD; Domain location=42-91; Score=3.2; E_ value=0.027; Accession=PF00628.19; Description=PHD-finger
  Pfam annotation: Domain name=Ribosomal_L3; Domain location=1209-1502; Score=669.2; E_value=3.2e-198; Accession=PF00297.12; Description =Ribosomal protein L3
  Pfam annotation: Domain name=zf-C3HC4; Domain location=43-88; Score =4.3; E_value=0.056; Accession=PF00097.15; Description=Zinc finger, C3HC4 type (RING finger)
  Pfam module annotation: Pfam domain module=Cellulose_synt::PHD::Riboso mal_L3::zf-C3HC4; Domain location=273-1103::42-91::1209-1502::43-88
MGVPCECDGYPRGHITGMSLFSSMLMKLQEWVNAVTELSGQICQICGDEIEVTVDGEPFVACNECAFPVCRPCYEYERREGNKICPQCKTIYKRLKGEGDEEEEDIDDLENEFDIGSNIRHDPHHVAEALLSARLNAARGSQMNAPGITTPSEFDAASVAADIPLLTYDHEDVGISADKHALIIPPFMHHGKRVHPMPPDSSVPVQPRPMDPKKDLAVYGYGSVAWKERMEEWKKRQNEKIEVVKHEGGNDGGKNGDELDDPDLPKMDEGRQPLWRKLPISPSKINPYRIIIVLRIAVLGLFFHYRILHPVNDAYALWLTSVICEIWFAVSWILDQFPKWCPIERETYLDRLSSRYEKEGKPSELADIDVFVSTVDPMKEPPLITANTVLSILAVDYPVEKVSCYVSDDGAAMLTFEAISETSEFARKWVPFCKKFNIEPRAPEWYFAQKVDYLKDKVDATFIRERRAIKREYEEFKVRINALVAMAQKVPEDGWTMQDGTPWPGNSVRDHPGMIQVFLGQNGIHNIEGNELPRLVYVSREKRPGYEHHKKAGAMNALVRVSAVISNAPYLLNVDCDHYINNSKALREAMCFMMDPTSGKKICYVQFPQRFDGIDRHDRYSNRNVVFFDINMKGLDGIQGPIYVGTGCVFRRQALYGYDAPATKKPPRKTCNCWPKWCCLCCGSRNKNRKVKSGPRKKIKNKDATKQIHALENIEEGIEGETYCVPLEIPITGIDSEKSWLMSQLKFEKKFGQSAVFIASTLMEDGGILKGATSASLLKEAIHVISCGYEDKTEWGKEVGWIYGSVTEDILTGFKMHCHGWRSVYCMPKRPAFKGSAPINLSDRLHQVLRWALGSVEILLSKHCPIWYGYGCGLKWLERFSYINSVIYPLTSLPLIAYCTLPAVCLLTGKFIVPEISNYASIIFMALFISIAVTSILEMQWGGVGIHDWWRNEQFWVIGGASSHLFALFQGLLKVLAGVNTNFTVTSKAADGGDFAELYLFKWTSLLIPPLTLLIINIIGVIVGVSDAINNGYDSWGPLFGKLFFALWVIVHLYPFLKGVMGKQEGVPTIILVWAILLASIFSLLWVRINPFLSKGGIVLELCGLNYIRACSRVSIGDRHCCQKGNCSVEGRKLEILKIEKREKIAAGIHGTWRIRRRRMSHRKFEHPRHGSLGFLPRKRAARHRGKVKAFPKDDPSKAPKLTAFLGYKAGMTHIVREVEKPGSKLHKKETCEPVTIIETPPMVIVGVVGYVKTPRGLRTLNTVWAQHLSEELKRRFYKNWCKSKKKAFTKYSKQYETEEGKKNIEAQLEKLKKYATVVRVLAHTQIRKMKGLKQKKAHIMEIQVNGGSIAQKVDFAYSFFEKQVPIDAVFQKDEMIDIIGVTKGKGYEGVVTRWGVTRLPRKTHRGLRKVACIGAWHPARVSFTVARAGQNGYHHRTELNKKVYKLGKAGDESHSALTEFDRTEKDITPMGGFPHYGVVKDDFIMVKGCCVGPKKRVITLRQSLLKQTSRVALEEIKLKFIDTSSKFGHGRFQTTQEKQKFFGRLKA

SEQ ID NO: 147467 - protein, 319 aa, Glycine max
  Coding DNA Sequence Number=SeqID_30689
  Gene Ontology: Mol. function=nucleic acid binding; Cellular component= nucleus; Biological process=mRNA processing
  Homolog annotation: Hit_ID=Q1RYN5; Match level="QueryCoverage=89%, HitCoverage=71%, E-value=1e-130, Identity=81%"; Hit description=RNA -binding region RNP-1
  Pfam annotation: Domain name=RRM_1; Domain location=134-201; Score =26.3; E_value=0.00011; Accession=PF00076.12; Description=RNA recognition motif. (a.k.a. RRM, R
  Pfam annotation: Domain name=RRM_1; Domain location=244-311; Score =35.7; E_value=1.6e-07; Accession=PF00076.12; Description=RNA recognition motif. (a.k.a. RRM, R
  Pfam module annotation: Pfam domain module=RRM_1::RRM_1; Domain location=134-201::244-311
MVYRPLQAYAQVDLSVLPFCTSSPVIVFLCPWVKKFWFGGQGQAFRLSSSINHVRVLLQQEVHFRDFTNPNLPTEQKGRPSQPGYGDAGNMYAAQGSGARAVGFPQMANAAAIAAAFGGGLPPGITGTNDRCTVLVSNLNPDRIDEDKLFNLFSIYGNIMRIKLLRNKPDHALIQMGDGFQAKLAVHFLRGAMLFEKRLEVNFSKHPKITPGADTHEYISSNLNRFNRNAAKNYRYCCPPTKMIHLSTLPLDITEEEIVSLVEEHGIIVNSKVFEMNGKKQALVQFENEEQATEALVCKHASTLSGSVIRISFSQLQNI

SEQ ID NO: 147468 - protein, 60 aa, Glycine max
  Coding DNA Sequence Number=SeqID_30690
MALLFSVEGLLKSDELGIYIDVTKTQFYNSTWILMLVLSCMGGGQIISMIDEFHAGKRNS

SEQ ID NO: 147469 - protein, 149 aa, Glycine max
  Coding DNA Sequence Number=SeqID_30691
MDPEKEYDVLGLLFSFGYSKGRKQDKPRGNYTTARRSRKYQKGIAGSKSHIFFEKRIYQLSYRKLKPNEWQTPIEPLNGLFSNLWVTYRKEEPSSSEEATGRSSSGNFSGRRFFWMNNLFYRKNLLPVASPKESSSDRTNCLSRRTFFR

SEQ ID NO: 147470 - protein, 281 aa, Glycine max
  Coding DNA Sequence Number=SeqID_30692
  Homolog annotation: Hit_ID=Q8W239; Match level="QueryCoverage=33%, HitCoverage=36%, E-value=4e-44, Identity=90%"; Hit description=GT-2 factor
MELGDTTTVMETSSGEAVAAHGGGEVIMMDANSGEEENNNHNNKGKLEEGGGEEEEGDNKINNSCGGNRWPRQETLALLKIRSDMDVVFRDSSLKGPLWEEVARKLSELGYHRSAKKCKEKFENVYKYHKRTKEGRSGKHEGKTYKFFDQLQALENQFTVSSYSPKPQPTLATATTTTNTITLPPPTRPSAITPISYVTTTVPSTNPTIISPSPPQPPTNATTTTTITSPTVVTNPRNPPQPNNNNNSNNIPYSLPNMNNLFSTTSTSSSTASDEDLEEKY

SEQ ID NO: 147471 - protein, 65 aa, Glycine max
  Coding DNA Sequence Number=SeqID_30693
MIVTVTATITTIVVTTITTIVVTTITIVALPPLSCGHVDGDDGGHDGDHDSGGDNNTVVVMMILT

SEQ ID NO: 147472 - protein, 130 aa, Glycine max
  Coding DNA Sequence Number=SeqID_30694
MGAMDDSNPFLIQPSDNPGLSLVTHPLSDENYNSWKKAIKMALLGKNKFGFVDDSFYGPFPPYYSHFFSSGSRRKTERIGASISAFNSTNDVSQSHAFAVKDSKYQSDHKFNANSKNRPLCAHCGRLCHT

SEQ ID NO: 147473 - protein, 191 aa, Glycine max
  Coding DNA Sequence Number=SeqID_30695
  Homolog annotation: Hit_ID=Q8SB36; Match level="QueryCoverage=91%, HitCoverage=42%, E-value=4e-59, Identity=63%"; Hit description =Putative senescence-associated protein
  Pfam annotation: Domain name=Senescence; Domain location=1-179; Score= 141.3; E_value=2.6e-39; Accession=PF06911.3; Description=Senescence -associated protein
MRLVTRDVSGWHPYVTVERLKWGNDFLKKRLESGSHSQVSPQALESMKRVKKLTMMSEKVATGVLSGVVKVSGFFTSSVVNSKAGKKFFSLLPGEIVLATMDGFNKVLDAAEVAGRNVMSTSSVVTTGLVSDKYGEEAAQVTNEGLDAAGHAIGTAWAVFKLRKALNPKSAIKPTTLAKAAAEATSTKLKK

SEQ ID NO: 147474 - protein, 429 aa, Glycine max
  Coding DNA Sequence Number=SeqID_30696
  Gene Ontology: Mol. function=DNA binding; Cellular component=beta -galactosidase complex; Biological process=DNA integration
  Homolog annotation: Hit_ID=Q1S3I6; Match level="QueryCoverage=86%, HitCoverage=27%, E-value=2e-65, Identity=38%"; Hit description =Integrase, catalytic region
  Pfam annotation: Domain name=rve; Domain location=101-246; Score =89.9; E_value=8e-24; Accession=PF00665.16; Description=Integrase core domain
MPHCKKIGRGDLLQGLYVLNLKDTHSTCNVFVSNSYINFVSNTYTQAINWHNHFGHVSDSVLKVLSNKIPFSIPNEFSTKSCCVCPVAKFRRLSFPSVNNVFDKSLDLIHCDIWGPYKHSTYDNNRYFLTIVDDCSRFTWIFLLKNKFEAPTMIMRFFAMVKTQFAASIKCLRSDNAKELALIDFLAFQGTLHQFSCVERPQQSFVVERKHQHLLNVARALFFQSKIAFTVAETKYSISGSSWFFTIAPDYSIWRSFGCLAFGATLASERKKFSPRAVPSVFVGYPQGVKGYRLYNLHTRKFYVSRDLVFHESIFPFQTLPNSYQEPDFLSELVISLPIPEPITSNIQPRAIEPNTSEPDHPIPPDISDLPIQLSDSTIDTTIGASSTLSSPPLRRSIRTSNPPPYLSNYIKPQPRQRSHPIQDHFSPQ

SEQ ID NO: 147475 - protein, 154 aa, Glycine max
  Coding DNA Sequence Number=SeqID_30697
  Gene Ontology: Mol. function=unspecific monooxygenase activity
  Homolog annotation: Hit_ID=O04892; Match level="QueryCoverage=80%, HitCoverage=31%, E-value=7e-15, Identity=37%"; Hit description =Cytochrome P450 like_TBP
DGGHGSRNPLRRRGGRCKTQGASPGGAVVGADLGGTGEARLIALCARTPKGNRPAHPGNGSAGVPNPSAVGGLLELLPAARAGRRVPVGGRIGNGPFGASSPGVEQSTQNCALNVKVKKFNQARVNGGSNYDSLKRNHSQGNGLGGISGERRPC

SEQ ID NO: 147476 - protein, 89 aa, Glycine max
  Coding DNA Sequence Number=SeqID_30698
MEESSGFPVLFGGENSNPPDDGGKDKILGLQLSARLQNNGLKDKIFLGLELIARLQHRTRGLRHLTRIHGVDLTNETQDTYLYLFHSPL

SEQ ID NO: 147477 - protein, 147 aa, Glycine max
  Coding DNA Sequence Number=SeqID_30699
MGEVEEIQEKMKADMEAIKEKMATMMEAMMSMKKIMEANAVIVAATSAVAKVNPMLPSGLKQMNHPTSNMVGKDLGSTDDPMMCKFKTSTPSHHMACLPTIHHPMWHTLLMKISITPLRYSLRTNNLIRHISLKPWGRHMNSPPQSS

SEQ ID NO: 147478 - protein, 205 aa, Glycine max
  Coding DNA Sequence Number=SeqID_30700
  Gene Ontology: Mol. function=nucleic acid binding; Cellular component= chromatin; Biological process=RNA-dependent DNA replication
  Homolog annotation: Hit_ID=Q1SY57; Match level="QueryCoverage=55%, HitCoverage=25%, E-value=5e-17, Identity=35%"; Hit description=Zinc finger, CCHC-type; Peptidase aspartic, active site
  Pfam annotation: Domain name=RVP_2; Domain location=68-163; Score= -60.2; E_value=0.049; Accession=PF08284.2; Description=Retroviral aspartyl protease
MEPKFGGQQRSDKKHHGHHKKPYQRPNQAQGGGSGPHYLRDCWSASKRNDNNGSEVKANYKSNNGLKPKMAGKVFAMSRSEVATSNDFIQVVVSIPTNKPITTSSACLDYSVMVDGKTFSVNLICLPPSHLDVVLGMDWLSSNHILLNFCEFPKVFLEDMIELPLEKELEFGIDLVLESSPVSITQYQVYPVELAKVKEQVEDLL

SEQ ID NO: 147479 - protein, 65 aa, Glycine max
  Coding DNA Sequence Number=SeqID_30701
MKGNNGVGERKRRRGGHEREGRALREERVGRNESGKLKGREEEGTLRCVGIEKTKKRREKKEKRL

SEQ ID NO: 147480 - protein, 590 aa, Glycine max
  Coding DNA Sequence Number=SeqID_30702
  Homolog annotation: Hit_ID=Q10Q34; Match level="QueryCoverage=9%, HitCoverage=7%, E-value=1e-10, Identity=61%"; Hit description =Expressed protein
  Pfam annotation: Domain name=CaM_binding; Domain location=474-577; Score=51.6; E_value=2.7e-12; Accession=PF07839.2; Description=Plant calmodulin-binding domain
MAKESVDLPLIPKVTMSSGVALRRHSAGIANSGNNEKKVVVPLYLRASTGSCHDFCKYGRKNVEEGREKLSMIKRAGRKSLSRSSEGIIGGIITSVANQKASLDSKPTKMLTVKHNESVDSKIQISDASDTDKMELPTKSSGSQKQMGNKVLVNTSKASLVRVKPSFLPKSHISSIPEARRGGIFSSFEVEALSKPASKRVEASPTATSERVKTHPKSTSQMVKTSPKSMFKMKQTSSKLSPFEDKEMELSDKHVTSLNPDFVTMQTISSVNYSDVFGGQKNSKIKMNKKEASPKSSSRGIGSVSARKHKGLKIVPHLMNQPKPIKVELEEDNNEAQEKTLYVIKMESANQSSLSDQNESQAIELPLSNSLSSPKFSPPSKSQSSSQEDQEESEYANSEFEEDACPENHEIDYMANVETLEVEENGKPQNDGIVCSENIECQNLGRKLVETQIEYTAYVDTLEAEENGKPQKDGIVCSEAKECKKLGGELVETQIEKGSLRSLKIQKGKVLGASVTNVKAVAITAPEKVVLRRQNVQVKKDGQGLYNNVIEETATKLVETQKGKVKALIDAFEAVISLEEKRTSAANIVN

SEQ ID NO: 147481 - protein, 889 aa, Glycine max
  Coding DNA Sequence Number=SeqID_30703
  Gene Ontology: Mol. function=nucleoside-triphosphatase activity; Cellular component=mitochondrion; Biological process=protein metabolic process
  Homolog annotation: Hit_ID=Q4LDR0; Match level="QueryCoverage=99%, HitCoverage=90%, E-value=0.0, Identity=88%"; Hit description=Heat shock protein
  Pfam annotation: Domain name=AAA; Domain location=193-388; Score =51.4; E_value=2.9e-12; Accession=PF00004.19; Description=ATPase family associated with various cellular activities (AAA)
  Pfam annotation: Domain name=AAA_2; Domain location=593-762; Score =365.9; E_value=6.2e-107; Accession=PF07724.4; Description=ATPase family associated with various
  Pfam annotation: Domain name=AAA_5; Domain location=597-742; Score =23.7; E_value=2.8e-05; Accession=PF07728.4; Description=ATPase family associated with various
  Pfam annotation: Domain name=Clp_N; Domain location=86-137; Score =51.4; E_value=3e-12; Accession=PF02861.11; Description=Clp amino terminal domain
  Pfam annotation: Domain name=Clp_N; Domain location=9-61; Score=64.2; E_value=4.2e-16; Accession=PF02861.11; Description=Clp amino terminal domain
  Pfam annotation: Domain name=Torsin; Domain location=551-795; Score= -164.5; E_value=0.004; Accession=PF06309.2; Description=Torsin
  Pfam module annotation: Pfam domain module=AAA::AAA_2::AAA_5::Clp _N::Clp_N::Torsin; Domain location=193-388::593-762::597-742::86 -137::9-61::551-795
MAWQAIVSSPEVAKENKHQIVETEHLMKALLEQKNGLARRIFSKVGVDNTRLLEATDKYIQRQPKVLGESSGSMLGRDLEALIQRARDHKKKYGDSFVSVEHLVLAFTQDQRFGKQFFRDFQISEPALKSAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMDRRLISLDMGALIAGAKYRGEFEDRLKAVLKEVTESDGQTILFIDEIHTVVGAGRATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLEAELSLLKEKQAELTEQWEHEKSVMTRIQSIKEEIDRVNLEIQQAEREYDLNRAAELKYGSLNSLQRQLESAEKELDEYMNSGKSMLREEVTGNDIAEIVSKWTGIPVSKLQQSEREKLLHLEEVLHKRVVGQDPAVKAIAEAIQRSRAGLSDPHRPIASFMFMGPTGVGKTELAKALAAYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTDDDTTPKELAYETIKQRVMDAARSIFRPEFMNRVDEYIVFQPLDREQISSIVRLQLERVQKRIADRKMKIQVTDAAVQLLGSLGYDPNYGARPVKRVIQQNVENELAKGILRGEFKEEDAIIIDTELTAFTNGQLPQQKLVFKKLAADSESTPQDTLEPFPQAP

SEQ ID NO: 147482 - protein, 408 aa, Glycine max
  Coding DNA Sequence Number=SeqID_30704
  Pfam annotation: Domain name=DUF677; Domain location=44-401; Score= -184.7; E_value=0.073; Accession=PF05055.3; Description=Protein of unknown function (DUF677)
  Pfam annotation: Domain name=DUF793; Domain location=1-401; Score =786.1; E_value=2e-233; Accession=PF05633.2; Description=Protein of unknown function (DUF793)
  Pfam module annotation: Pfam domain module=DUF677::DUF793; Domain location=44-401::1-401
MPATDYQGSSSPSSLIHFGRSILSLRREQVHSISMEGSSLEAELESFQQHVTNRFLELTSVVHDDLLSLSWVGKLLHCFLCCQEEFKAILHSHRAQVLRPPLDRMVSDYFERSVKALDVCNAIRDGIEQIRQWQKLLEIVPYALGHQRSIGEGQFRRAKKALIDLHIGMLDDKDPNASIAHRNRSFGRSTGSRDHHSHGHSHGHNNSSNNTYHHRSLGHFRSLSWSVSRTWSAARQLQAIGNNIYPPKANELMASGGLAMPVFIMNSILLFVMWALVAAIPCQDRGLHVHFTIPRNYSWAAAILSLHERIMEESKKRERKNSCGLLKEIHQIEKCARVMNDLADSVHFPLTEEKEREVRQIVQEVSLVCDALKGGLDPLERQVRDVFHIIVRSRTEGLDSIGRPSNAE

SEQ ID NO: 147483 - protein, 392 aa, Glycine max
  Coding DNA Sequence Number=SeqID_30705
  Gene Ontology: Mol. function=transferase activity, transferring hexosyl groups; Cellular component=integral to membrane; Biological process=carbohydrate biosynthetic process
  Homolog annotation: Hit_ID=Q10Q30; Match level="QueryCoverage=99%, HitCoverage=67%, E-value=1e-168, Identity=70%"; Hit description =Glycosyl transferase family 8 protein, expressed
  Pfam annotation: Domain name=Glyco_transf_8; Domain location=32-365; Score=396.2; E_value=4.7e-116; Accession=PF01501.10; Description =Glycosyl transferase family 8
MEKHEREIRESKFAELMNKHFAASSIPKGIHCLSLRLTDEYSSNAHARKQLPPPELLPLLSDNSYHHFILSTDNILAASVVVASTVQSSLKPEKIVFHVITDKKTYAGMHSWFALNPVTPAVVEIKSIHQFDWLTRENVPVLEAVENQNGIRNYYHGNHIAGANLSDISPRKFASKLQARSPKYISLLNHLRIYLPELFPNLDKVVFLDDDVVIQRDLSPLWEIDLEGKVNGAVETCRGEDEWVMSKHFRNYFNFSHPLIARNLDPDECAWAYGMNIFDLHAWRRTNIREIYHSWLKENLKSNLTMWKLGTLPPALIAFKGLVHPIDPSWHMLGLGYQNNTNIESVKKAAVIHYNGQSKPWLQIGFEHLRPFWTKYVNYSNDFLRNCHILEA

SEQ ID NO: 147484 - protein, 105 aa, Glycine max
  Coding DNA Sequence Number=SeqID_30706
MKGKPLCLILLLALSLFASHSNSLLLSTSKRWIVDEAWKRVKMHCVNWSSHLNSMLGEGLDLISLKDLIGEIKKLDFNSIVFATHGQHTCSNAIVATKLVKLWTH

SEQ ID NO: 147485 - protein, 210 aa, Glycine max
  Coding DNA Sequence Number=SeqID_30707
  Homolog annotation: Hit_ID=Q1T0K7; Match level="QueryCoverage=99%, HitCoverage=99%, E-value=3e-66, Identity=62%"; Hit description=Heat shock protein Hsp20
  Pfam annotation: Domain name=HSP20; Domain location=34-138; Score =12.8; E_value=2.9e-05; Accession=PF00011.11; Description=Hsp20alpha crystallin family
MEVELGLKITTTRDDTTSVSDFQFAKDRSGPVFLSKETDAKLILTAHLKGYKKENIDININKDGSEISVSGEKEVQEMQMIPFKKVLKTIGFEKKFSIPDGVVLDQIKAKYNEGDEVLTIVMPKTEVGKGSREIEEVKEEVPESSVQENVVDSVTPEPQESVPEKIEEETPAVKKPQKPWTPCPPLVFGGSTLLVTLIFLVINYIRARKR

SEQ ID NO: 147486 - protein, 144 aa, Glycine max
  Coding DNA Sequence Number=SeqID_30708
MEYSNWAESLQTETPLPSFPQPSSSYPPTYYPSYPQNPNPNPSSSLPLNPPGVDPQTPLNPISYAAHEPVPGLVYAQSLVGDDSSSGYCLDHNWVAREAVRQFGTDPTLYAPGWAYNCACEIGSLDSSILFTSWLKDCGKLICC

SEQ ID NO: 147487 - protein, 452 aa, Glycine max
  Coding DNA Sequence Number=SeqID_30709
  Homolog annotation: Hit_ID=Q9LIB3; Match level="QueryCoverage=63%, HitCoverage=60%, E-value=2e-31, Identity=34%"; Hit description =Arabidopsis thaliana genomic DNA, chromosome 3, P1 clone:MUO10
  Subcellular localization annotation: CTP_CleavageSite=19; ConfidenceScore=5.16e-01
MASHHHHQPPPPTTHSCCSCHNFSSYTCCTPPPPYRPSHTCCTPPPPQHHHLLQAISSLLSQPQPHLIPIPSQQHYTKSYTHQNLKLPTQNHHLQHPHQHQTHSTISSLLDRIESLESSFNHYTHHSLRHAAARVIQTHFRSFLARRSRTLAQLKHLASIKSTFNALKSSFSNHTHVDFAAISLKAMNLLLELDSIQGCDPMIVDGKRSISRDLVQFLDSIEEVALKKHVLHVKAGKTVGSVKKVQKNRNSDDDERRKLLQNLRCRVEKLSRLCKVSANDEEDSESGESIHDDGVTNVLIGGRNEVSPNKNGVCLLRRGEPGVKKSVRFAENRNICEVYSGDVACSDGSCSSSDEQGEVSENVSGAVEDNGVDSSQGAEDHEEVLVFDSGGLPHSSDDGERNTRRLFVKVGRNVVKEQLQAHQEKLLFSAPLPLKMENRSGSKNSKGVKILT

SEQ ID NO: 147488 - protein, 168 aa, Glycine max
  Coding DNA Sequence Number=SeqID_30710
  Homolog annotation: Hit_ID=Q2QN55; Match level="QueryCoverage=46%, HitCoverage=16%, E-value=1e-19, Identity=58%"; Hit description =Glycosyl transferase family 8 protein, expressed
MRFESTEGGAVVDTFEGDEGGEDENKGKEKSEDEDGVEEGSIGNVASCDLDLHQVNKAIVVVAVAAARYGDASHARREVKLHRRSRRSPTAATTLPPPRQNDNDTHHAHTITFSFLTISKRQQSCACHKSESNQSNNRSRKMIWPLPHLLRGACVGRKETSVPGADSH

SEQ ID NO: 147489 - protein, 140 aa, Glycine max
  Coding DNA Sequence Number=SeqID_30711
  Pfam annotation: Domain name=Complex1_LYR; Domain location=11-75; Score=55.5; E_value=1.8e-13; Accession=PF05347.5; Description =Complex 1 protein (LYR family)
  Subcellular localization annotation: CTP_CleavageSite=25; ConfidenceScore=5.03e-01
MSALAASSATPSAAQALSLFRSLLRAAREFPDYNIREYTKLRTTDAFRHNATLSDPNSISTAFAHGKSQLAVVKRQAVVYSLYAPPLRNEREVKDIVGEVEESKAEVEVGARELVVCEGRGWKGMEVSDGVRMCKVGGVQ

SEQ ID NO: 147490 - protein, 94 aa, Glycine max
  Coding DNA Sequence Number=SeqID_30712
  Homolog annotation: Hit_ID=Q2QN55; Match level="QueryCoverage=56%, HitCoverage=9%, E-value=2e-11, Identity=53%"; Hit description =Glycosyl transferase family 8 protein, expressed
MSSDCLGRRLGPRLLGRADDSGRLVRDFYKILNEVKAGEIPPDLKLPDSFDQLVSDMKNNQYDAKTFAFMLRGMEHTNNILSLTTYITKAQYSV

SEQ ID NO: 147491 - protein, 276 aa, Glycine max
  Coding DNA Sequence Number=SeqID_30713
  Homolog annotation: Hit_ID=Q9C7U3; Match level="QueryCoverage=70%, HitCoverage=39%, E-value=2e-16, Identity=33%"; Hit description =Hypothetical protein TEL3N.1
  Subcellular localization annotation: CTP_CleavageSite=76; ConfidenceScore=5.35e-01
MAAVASSPTPLGSRSKAQQEPSKNIENFDPNKQQQSPVSKPSCSSPSSSPLVKSKNPNKVDYFSPKNKIRQRKFLVAKKKKEKKAEEEGSGAAADSCKCKASGANANENNKCVCVAYNNLRKSQEEFFKNNDDGVVDDGEEEGFESVVVEEEKGESLLGNGEVSGLVVKRRRERLMEEARKSVLPQSGSGKVMHLVKAFEKLLSIPKTKEEEDEEGSQDQERVGKWALPGLQQQQVSEISFCPPNCVLTSQNLGLDPGASVSSSWDSSRARFGFTF

SEQ ID NO: 147492 - protein, 48 aa, Glycine max
  Coding DNA Sequence Number=SeqID_30714
MARSHCLFPLAFLMVLFVPALAHGRRRGWHLAHATFYGDMQGGDTMHH

SEQ ID NO: 147493 - protein, 49 aa, Glycine max
  Coding DNA Sequence Number=SeqID_30715
MTLITDKHTLTIPAESQCSHIWKWKFTFAVECDDHSPENDGLKSKRGRK

SEQ ID NO: 147494 - protein, 109 aa, Glycine max
  Coding DNA Sequence Number=SeqID_30716
CEASGDWEARYSVVFQIGFFAKRKKEEVEMRVVIAKRAGWTKSVSYLCFPLISDERLVQSVKFRNVAEVEKRPTWAFQKLPPEGCCFWRKQPGLPGRAGRQAPPLFCYK

SEQ ID NO: 147495 - protein, 46 aa, Glycine max
  Coding DNA Sequence Number=SeqID_30717
MGTTTELWEFYRSITGVPEAPESHLLTKRERWLPPSSPRRARLLPL

SEQ ID NO: 147496 - protein, 99 aa, Glycine max
  Coding DNA Sequence Number=SeqID_30718
  Subcellular localization annotation: CTP_CleavageSite=65; ConfidenceScore=5.42e-01
MLSRYSPHGINANFTSISTRLTSKRNLEGNLPCKHMLSTLSARLASHLSLLALSAPGLQSQSSLTCAKRENGAKRAFDDRKPFLKPEVENKKIKKECRA

SEQ ID NO: 147497 - protein, 155 aa, Glycine max
  Coding DNA Sequence Number=SeqID_30719
  Subcellular localization annotation: CTP_CleavageSite=78; ConfidenceScore=5.03e-01
MKESFFTLFYSTLQLGPTFCADNTTYHADAKSFKKSFNKFHIFAKIFRTRSEKFQSNPSCEQALYASSSWFSAMCLSLAMSEVAKSFDFKLTEFGRIGEDCVGEPEKEAGGEGWVVEEAVCRICDVIFGGQEAVAVAVGFAAERDVFRHSERVRE

SEQ ID NO: 147498 - protein, 829 aa, Glycine max
  Coding DNA Sequence Number=SeqID_30720
  Gene Ontology: Mol. function=binding; Cellular component=plastid chromosome; Biological process=positive regulation of transcription, DNA-dependent
  Homolog annotation: Hit_ID=O64624; Match level="QueryCoverage=99%, HitCoverage=100%, E-value=0.0, Identity=59%"; Hit description =Putative salt-inducible protein
  Pfam annotation: Domain name=PPR; Domain location=181-215; Score=0.7; E_value=6.1; Accession=PF01535.11; Description=PPR repeat
  Pfam annotation: Domain name=PPR; Domain location=216-250; Score =38.5; E_value=2.3e-08; Accession=PF01535.11; Description=PPR repeat
  Pfam annotation: Domain name=PPR; Domain location=251-286; Score =20.3; E_value=0.007; Accession=PF01535.11; Description=PPR repeat
  Pfam annotation: Domain name=PPR; Domain location=287-321; Score =35.1; E_value=2.5e-07; Accession=PF01535.11; Description=PPR repeat
  Pfam annotation: Domain name=PPR; Domain location=322-356; Score =44.7; E_value=3.1e-10; Accession=PF01535.11; Description=PPR repeat
  Pfam annotation: Domain name=PPR; Domain location=357-391; Score =29.4; E_value=1.3e-05; Accession=PF01535.11; Description=PPR repeat
  Pfam annotation: Domain name=PPR; Domain location=392-426; Score =50.6; E_value=5.2e-12; Accession=PF01535.11; Description=PPR repeat
  Pfam annotation: Domain name=PPR; Domain location=427-461; Score =35.8; E_value=1.5e-07; Accession=PF01535.11; Description=PPR repeat
  Pfam annotation: Domain name=PPR; Domain location=462-496; Score =35.5; E_value=1.8e-07; Accession=PF01535.11; Description=PPR repeat
  Pfam annotation: Domain name=PPR; Domain location=497-531; Score =32.9; E_value=1.1e-06; Accession=PF01535.11; Description=PPR repeat
  Pfam annotation: Domain name=PPR; Domain location=532-566; Score =45.5; E_value=1.8e-10; Accession=PF01535.11; Description=PPR repeat
  Pfam annotation: Domain name=PPR; Domain location=567-601; Score =11.3; E_value=0.34; Accession=PF01535.11; Description=PPR repeat
  Pfam annotation: Domain name=PPR; Domain location=602-636; Score=0.7; E_value=6.2; Accession=PF01535.11; Description=PPR repeat
  Pfam annotation: Domain name=PPR; Domain location=637-671; Score =26.7; E_value=8.5e-05; Accession=PF01535.11; Description=PPR repeat
  Pfam annotation: Domain name=PPR; Domain location=672-706; Score =37.3; E_value=5.5e-08; Accession=PF01535.11; Description=PPR repeat
  Pfam annotation: Domain name=PPR; Domain location=707-741; Score =49.1; E_value=1.4e-11; Accession=PF01535.11; Description=PPR repeat
  Pfam annotation: Domain name=PPR; Domain location=742-776; Score =35.4; E_value=2e-07; Accession=PF01535.11; Description=PPR repeat
  Pfam annotation: Domain name=PPR; Domain location=777-811; Score =38.3; E_value=2.6e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR; Domain location=181-215::216-250::251-286::287-321::322-356::357-391::392 -426::427-461:...
  Pfam module annotation: Domain location=:462-496::497-531::532 -566::567-601::602-636::637-671::672-706::707-741::742-776::777-811
  Subcellular localization annotation: CTP_CleavageSite=71; ConfidenceScore=5.39e-01
MEGTLFPNRPVLPAPSHKPTQQPLKFKPTFLPPQSPPPPPPSFQLDSLLQHLQHLSSVPITTHTLTLVPPSHDNTKDFNNSVHSKHPTLGSGSIIDEDKFDDAKFGFLSDKGKLLFSSIVGSPLHELNDFFNSVKFELLEADFPSLLKALDLSGNWERALLLFEWGWLHFGSDQNLRLDNQVVELMVRILGRESQHSIASKLFDLIPVEKYSLDVRAYTTILHSYARTGKYKRAIDLFGKMKEIGLDPTLVTYNVMLDVYGKMGRSWDRILELLDEMRSKGLELDEFTCSTVISACGREGMLDEARKFLAELKFNGYKPGTVTYNSMLQVFGKAGIYTEALSILKEMEDNNCPPDSVTYNELAATYVRAGFLDEGMAVIDTMTSKGVMPNAITYTTVIDAYGKAGREDDALRLFSLMKDLGCAPNVYTYNSVLAMLGKKSRTEDVIKVLCEMKLNGCAPNRATWNTMLAVCSEEGKHNYVNKVLREMKNCGFEPDKDTFNTLISAYARCGSEVDSAKMYGEMVKSGFTPCVTTYNALLNALARRGDWKAAESVIQDMRTKGFKPNENSYSLLLHCYSKAGNVKGIEKVEKEIYDGHVFPSWILLRTLVLTNHKCRHLRGMERAFDQLQKYGYKPDLVVINSMLSMFARNKMFSKAREMLHFIHECGLQPNLFTYNCLMDLYVREGECWKAEEVLKGIQNSGPEPDVVSYNTVIKGFCRKGLMQEAIGVLSEMTTKGIQPTIVTYNTFLSGYAGMELFDEANEVIRFMIEHNCRPSELTYKILVDGYCKAGKYEEAMDFVSKIKELDISFDDQSVKRLGSCIRERVGSTL

SEQ ID NO: 147499 - protein, 187 aa, Glycine max
  Coding DNA Sequence Number=SeqID_30721
MAENHDDDAYKACSHDGFDWNFSDLVLKIFANMWNLLKLFLNDFASAKDNKNTSDGCNDNGDRGGGGGSSSGNVSGVDDDGGGFSSNVGGGSNSGGGRGNVGGGNDKDGIGGVDGSSNVGGDGGGDDGGGIGGGGSDSGIDDSDGGDGDSDSDVGGSGGVKLSTPPRLAIKLKLSAKKAHEKAQRHA

SEQ ID NO: 147500 - protein, 63 aa, Glycine max
  Coding DNA Sequence Number=SeqID_30722
MAKECLAYDLRISIMLKKCLVEAKGCPTTIRGWISIYMATHAPEALSPIEYEESYLWIKKPMF

SEQ ID NO: 147501 - protein, 321 aa, Glycine max
  Coding DNA Sequence Number=SeqID_30723
MQNQNPSEDDSTNKAPSDDTPHPTNNDNNNPPGESLIMKTVRQVLEELGGSRDDNDGGVGDGTPVAVALEVGGGGDGSGGDGGGVGGGPPVAMEASDGGDEDNDNEHSDSIGDSVPVAVAVKVGGRGGDNSGGGATVTVSVALSDGDYGGSNGSGGSPVAVAVAVGGGSTVMESVVVGTEGVQGRKRKTPLVRDPPTGRPTCPLCQKEFQTWKGAFGHMRAHPDRDYRGFFKPPVFGSPSSTQDQPPSDGKGDDSAKKSTGEDNTAEKGSASLPVRVPMFDLNELIEEDGSSHAAEPAEDMSTGEGKGSGFDLNEMPPAED

SEQ ID NO: 147502 - protein, 101 aa, Glycine max
  Coding DNA Sequence Number=SeqID_30724
MAEGFIPRGILFRLESVHAVRNGHCFEDLTVRGNRQTGGIVFTYASAATGTSSSPEGQMIQEFRLPFSFFGLASPDRGGREITEKDIEEAIRTMPRSLYVP

SEQ ID NO: 147503 - protein, 85 aa, Glycine max
  Coding DNA Sequence Number=SeqID_30725
IAPTRHPADPEKSNRALGFLALVMGLCQPYRVLVPPSKFYGVSVAPNKVIRPPINRAFIKKYCVPQAGAGRDTTFDAILPRKGIG

SEQ ID NO: 147504 - protein, 74 aa, Glycine max
  Coding DNA Sequence Number=SeqID_30726
MAGVLWVRARTMWVSRERFPAVFRQEEKEKSDFRQEDDKEKREGKVFERARLVKSQFLTYKHNNIGFLWITDVN

SEQ ID NO: 147505 - protein, 166 aa, Glycine max
  Coding DNA Sequence Number=SeqID_30727
  Gene Ontology: Mol. function=protein serine/threonine kinase activity; Cellular component=integral to membrane; Biological process=protein amino acid phosphorylation
  Homolog annotation: Hit_ID=O65440; Match level="QueryCoverage=65%, HitCoverage=10%, E-value=2e-41, Identity=73%"; Hit description=CLV1 receptor kinase like protein
  Pfam annotation: Domain name=Pkinase_Tyr; Domain location=13-154; Score=-168.5; E_value=0.039; Accession=PF07714.7; Description =Protein tyrosine kinase
MGSFSQGQWSWDLKWRRSLFDHEQDIAVAFMEAINTTQIQRHLQDTMLWKADSSEYAYTLKVDEESDVYSFGVVLLELLTGRKPVGNFGEEGLDIVQWTKLQTNWSNDKVVKILDERLCHIPLDEAKQVYFVAKLCVQEQSVERPTMREVVEMLAQAMKPNTFQKQ

SEQ ID NO: 147506 - protein, 66 aa, Glycine max
  Coding DNA Sequence Number=SeqID_30728
MQDSPILIGINASRRRPGKMIDQGRLGFFVRAQPKLFFGRHRHVFICLARKTLANLGKNTCRIHRY

SEQ ID NO: 147507 - protein, 202 aa, Glycine max
  Coding DNA Sequence Number=SeqID_30729
  Gene Ontology: Mol. function=cysteine-type peptidase activity; Biological process=proteolysis
  Subcellular localization annotation: CTP_CleavageSite=31; ConfidenceScore=5.50e-01
MGSPPTSPPPPPPSDASASLSAVKQTCKVVRSLSTRPPGAERPVVHVDPAIGKANDPHRKKLRTYLGIVARDKVDITYENWKEVPTAQKDLIWEDIQAEFDIPEASDSRTKRKLLQTVEERWRQFKSDLTRKWALAADQNGVEDTVYEKYDISKEKWAQFCQTRRDPSWEDVRKKAQAIQKQNTAPHILSCGGYDYLEQKLL

SEQ ID NO: 147508 - protein, 80 aa, Glycine max
  Coding DNA Sequence Number=SeqID_30730
MGSSLAMGCSSRFDVCVCGSFEGGVKGDEGWFCWSKEGSCDSRLLYKDTGLLRSMLLYGNCCGCGSCSCGHEGCGDDSCG

SEQ ID NO: 147509 - protein, 138 aa, Glycine max
  Coding DNA Sequence Number=SeqID_30731
MTSQKMIEIFLGRYPCSLILGSVFISLGLYGTCTPLKIRPVPRPCNSGFEHAALGTAGAVYTDRSYHSTIPSPCGLPPAGQPNAACMRTFGAPSSAYELRWALGTVADVEPMVGCLLSAVATGLAPTVVFTLASNTSQ

SEQ ID NO: 147510 - protein, 104 aa, Glycine max
  Coding DNA Sequence Number=SeqID_30732
  Gene Ontology: Mol. function=protein kinase activity; Cellular component=chloroplast; Biological process=protein amino acid phosphorylation
  Homolog annotation: Hit_ID=Q1RVG1; Match level="QueryCoverage=74%, HitCoverage=72%, E-value=2e-23, Identity=69%"; Hit description =Protein kinase
  Subcellular localization annotation: CTP_CleavageSite=40; ConfidenceScore=5.17e-01
MGITESTSVNGGSSSINSNNMVFPSVETRNLKQFNFADLKAATKSFKSDALLGEGGFGKVYKGWLHEKTLTPTKAGSGMVVAVKKLNSESLQGFREWQLASSIY

SEQ ID NO: 147511 - protein, 150 aa, Glycine max
  Coding DNA Sequence Number=SeqID_30733
  Homolog annotation: Hit_ID=Q1T2D5; Match level="QueryCoverage=68%, HitCoverage=6%, E-value=7e-30, Identity=58%"; Hit description=Chromo
MVDNTRMKELTGDVKRILEMMENRNKEYAARFETLETTLEYITGYEQSPFSGGSDVLQWIFKAEQFFNYHKTPGEQRLIIASIHLDKEVVPCYQMMTRENSFKTWIAFTRALETEFGPSPYECPRSQLFKLAKIGSVQSYYVQFTALANR

SEQ ID NO: 147512 - protein, 309 aa, Glycine max
  Coding DNA Sequence Number=SeqID_30734
MVRWRTYNFKVDGEQREQESLDGEEDREKEKTMRRRRNIPRYGGEGEEAETCDDARVRRTRCSDADRDGFARRRLEEEESVILLVASPGTVGLFMQIASMNSATLRHATRGCVASATGDSSDVATCNGALAMQGRVAGQTSASLCVAGAAFAGLVKVQCSRENARAFGDLGMNSVITVLYFNGRVYEDNDGVIFEGSKKAIQIKRGISFNALKKKIGDKDVAGGSMFHSANSLTSCGNYLSNDETQPATNMSNLHIDEDDDDDDDDDYLVSNSYVEESVDEDDSVDGISETDDEVTDIPQPVRIVHPAE

SEQ ID NO: 147513 - protein, 84 aa, Glycine max
  Coding DNA Sequence Number=SeqID_30735
  Gene Ontology: Mol. function=nucleic acid binding
  Homolog annotation: Hit_ID=Q1SIQ0; Match level="QueryCoverage=55%, HitCoverage=13%, E-value=2e-12, Identity=70%"; Hit description=Zinc finger, CCHC-type
MVIHTLNGFGAEYREVFAALRTQKNSIGFEDFYDLHADFENYLKRDKPRPNSIATAHIKHKYIHHLKMSKIWEFCKIHSDIQSK

SEQ ID NO: 147514 - protein, 102 aa, Glycine max
  Coding DNA Sequence Number=SeqID_30736
  Gene Ontology: Mol. function=nucleic acid binding; Biological process= DNA integration
  Homolog annotation: Hit_ID=Q1SB98; Match level="QueryCoverage=72%, HitCoverage=14%, E-value=2e-21, Identity=62%"; Hit description=Zinc finger, CCHC-type; Peptidase aspartic, catalytic
MEDVPSFLQGFDISQHNDNTRVKREENCMQDQLILSFPIMIVPVRWGNAHDCAVSKNYEIIPHKKSIELNSPCRKNGDGTTHPLCSDVIQQETQSLLANLIE

SEQ ID NO: 147515 - protein, 123 aa, Glycine max
  Coding DNA Sequence Number=SeqID_30737
MSLGNYFLKIPSGNQLQDLCNRLQESFDLIHQLKDPSTISRPWKILFARINCFFHSSSLRGRETRQHLVPLSPTLGQRKAPCKTQATRGRLEVSPNSSLHKVMTKDNDWYLKALHWGNERPHA

SEQ ID NO: 147516 - protein, 132 aa, Glycine max
  Coding DNA Sequence Number=SeqID_30738
MESPTIKTFPSARVQCGTRWCIFHGRKKHAESPPTFESCLRVGKGIALAPTYPRARLTGASSKGGKCAESPPMFICGKCQKNRRKPVMKNIPDSGVVFTFEEGISTSHVDKSGALAPTYPPSKRKSDLRSSF

SEQ ID NO: 147517 - protein, 159 aa, Glycine max
  Coding DNA Sequence Number=SeqID_30739
EELATQLAQASKVASSRSNSLLEEESGRPNKKGADDHVLSLRATGLACLWIAKDAMTIICLRVPTNSLVSERKKGPMDSSLEGKKGADDHNFSPHANRLACKKGANGHNFSSHANRLACLWKAKGADDHNLSPHSLVSGKAKGENDHNLSPRADRLACL

SEQ ID NO: 147518 - protein, 364 aa, Glycine max
  Coding DNA Sequence Number=SeqID_30740
MARIAKVVKISAQELDRVKQNRNGIVGIPRKHLEEKVKALGDQGEWASFIDVLALLIFGIILFPNLDGLVDLAAIDAFLAYHHSKESPIVAILADVYDTPACPLQGHRICTEKGKANWEQLLASVVGASISWFPRWKEGKGAPLEESITPFIAWGFSDPNVKILQGVRKAWELDWLPKLKVLGKEEAETPEESKEVQALKVELERVQSVKEKFNTMTIKVWKECNKLRDINVATAKALERETKRVRKEEYGRNKHDIGRQVEDLCLVPDVVIPPKFKVPYFDRYKGTTCPKNHLKMYCRKMGMYSRDKKLLMHFFQYSLARAVVIWNHLRSMPNDGGTWQCKWRPHGRKRDDHNDSGHVVGVLL

SEQ ID NO: 147519 - protein, 319 aa, Glycine max
  Coding DNA Sequence Number=SeqID_30741
MGEVNEVQERIKADIEALKEKMATMMEAMMSMKKMMEVNAAVVAATGVVAEGGKELGSAGGPHFGQVQNKHAFPPYSLPPNYTPPNVVHTPDENVNNSNPILIESQQPQSDHAHVSQPMREPHHNLADFEPCLGYATEGQAAEGEPLPNTLEEPQFRTQPQPLHFVAGRVHPAMTEKRKLDHMEERLRAIEGGGDHAFANTIELYLVLDVVIPPHTGAAVTWYTNLEPSRVHSWKDLMVAFIRKYQYNSDMAQVAPPMMEKEMITMIVDMLPVFYYEKMVGCMPSNFANLVFAGVRIEMGLRRGKIDYPALMDEKAGAN

SEQ ID NO: 147520 - protein, 95 aa, Glycine max
  Coding DNA Sequence Number=SeqID_30742
  Subcellular localization annotation: CTP_CleavageSite=67; ConfidenceScore=5.11e-01
MIIIKTSKPIASTDPRPTCSTWSYINFTKTNAFIHYSTGPPPFLINMDKFKSTQKMKVIFRTYKALVMFSKWCNGSPFIENPFLLLLLSGRDMNK

SEQ ID NO: 147521 - protein, 190 aa, Glycine max
  Coding DNA Sequence Number=SeqID_30743
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=O22613; Match level="QueryCoverage=99%, HitCoverage=17%, E-value=2e-50, Identity=58%"; Hit description =Plasma membrane proton ATPase
  Pfam annotation: Domain name=Cation_ATPase_N; Domain location=42-118; Score=104.4; E_value=3.3e-28; Accession=PF00690.16; Description =Cation transporterATPase, N-terminus
MAGDKGTITLEEIKNETVDLEVGSYSEHCVLVEACAVFGYNWAYSRERIPIEEVFEQLKCTREGLSSTEGENRLQIFGPNKLEEKKESKFLKFLGFMWNPLSWVMEAAAIMAIALANGEGKPPDWQDFVGIVCLLLINSTISFIEENNAGNAAAALMAGLAPKTKVLRDGKWSEQEAAILVPGDIISIKL

SEQ ID NO: 147522 - protein, 173 aa, Glycine max
  Coding DNA Sequence Number=SeqID_30744
  Gene Ontology: Mol. function=nucleic acid binding; Cellular component= oxygen evolving complex; Biological process=DNA integration
MEDAKDMKTPMHPTTCLGLDEKSNKVDNSQYKAMIGSLLYLIASRPNILFGVGLCARFEQDPREVHLTSLKRIFRYLNGTPNLGLYFKYSKEFRLISYCDADYACEKIERRSTSESYHIIGGNLVTWINQKQGLVTLFTAKAEYISVASCCTQLIWIKNQLEDYNLMTKSNSR

SEQ ID NO: 147523 - protein, 465 aa, Glycine max
  Coding DNA Sequence Number=SeqID_30745
  Gene Ontology: Mol. function=protein serine/threonine kinase activity; Cellular component=cell surface; Biological process =protein amino acid phosphorylation
  Homolog annotation: Hit_ID=Q1SYX6; Match level="QueryCoverage=98%, HitCoverage=97%, E-value=1e-170, Identity=66%"; Hit description =Protein kinase
  Pfam annotation: Domain name=Pkinase; Domain location=132-402; Score =150.7; E_value=3.9e-42; Accession=PF00069.15; Description=Protein kinase domain
  Pfam annotation: Domain name=Pkinase_Tyr; Domain location=130-402; Score=87.1; E_value=5.3e-23; Accession=PF07714.7; Description =Protein tyrosine kinase
  Pfam module annotation: Pfam domain module=Pkinase::Pkinase_Tyr; Domain location=132-402::130-402
MNFGLSPPSFYSSHDEFQDQAQGIFDNVMKMAVIASIVSGVVTIVVIIAIVYAIIECLKKAIPAYAQLPSSDNDHKASLSFPSTSEIEVVIPSDSRVQGSKPEFATMERFLSNINKEKPIRFSPKELDIITWNYSTILGSGAFGVVYKGELSNGEHVAVKVIKSLDMGMEEQFKAEVGTIGRTYHVNLVRLYGFCFHHEKRALVYECVENGSLDMYLFGSQNRHVEFGKLHEIAIGTAKGIAYLHEECQKRIIHYDIKPENVLLDINLEPKVADFGMAKLCSRENNVSVNTHFKGTRGYAAPEMWKPYPVTEKCDVYSFGILLFEIVGRRRHFDDAYSESQEWFPKWTWNMFENNELFVMLSHCGIENKDREIAERMSKVALWCVQYSPDDRPLMSNVVKMLEGEIEISPPPFPFQNLMNDKPKLTPNGSTVDSGSGTTTSWETESLLESGSKIKNNAFQIEKPT

SEQ ID NO: 147524 - protein, 170 aa, Glycine max
  Coding DNA Sequence Number=SeqID_30746
MECYEVALVTLQKQKWSTSSIATEEKLKILNSFKNEGILKFPATFTEGLCGAMSAIRGGGTGAEHEAKEGGSVECVVDLGDRDSEEAEAVGVEAVKLAFIAEARDDGLGAREKRECVLVRELKDQATEAGGVREVRGVGEKLVIAGSEEVVAVARWKGESEGFFPLEQGS

SEQ ID NO: 147525 - protein, 109 aa, Glycine max
  Coding DNA Sequence Number=SeqID_30747
MVKSEKDYEDYMEWAKQNKCKECVVGRSCHRKIRVFNDRIFPNADNSHNKQQHNDHIRTGDGILESSSEIRQNPWICGMEKFHRVLVFVIKLPSCCIFTHSLSSIPWRK

SEQ ID NO: 147526 - protein, 113 aa, Glycine max
  Coding DNA Sequence Number=SeqID_30748
  Gene Ontology: Mol. function=kinase activity; Biological process=DNA integration
  Homolog annotation: Hit_ID=Q1SEZ6; Match level="QueryCoverage=86%, HitCoverage=47%, E-value=8e-29, Identity=57%"; Hit description =Protein kinase
MEMTRWMLYEKELPKKLWAEVASTAAVNQAIWLRRILPDLHMEQKEPTQILVDNQAAISISNNHVFHGRTKHFKIKLFFLREAHREGEVKLIYYRTEDQSADVLTKVLPKARF

SEQ ID NO: 147527 - protein, 153 aa, Glycine max
  Coding DNA Sequence Number=SeqID_30749
  Gene Ontology: Mol. function=protein kinase activity; Cellular component=cell surface; Biological process=protein amino acid phosphorylation
  Homolog annotation: Hit_ID=Q1SYX5; Match level="QueryCoverage=99%, HitCoverage=42%, E-value=7e-68, Identity=80%"; Hit description =Protein kinase
  Pfam annotation: Domain name=Pkinase_Tyr; Domain location=31-151; Score=-100.8; E_value=2.8e-06; Accession=PF07714.7; Description =Protein tyrosine kinase
MDKFLNEMEKERPIRFTDQHLRIATDNYSYLLGSGDFGKVYKGIFSDGTIVAVKVLHGLYDKKMEEQFMAEVVTIGKTHHFNLVRLYGFCLERNLIALVYEYMGNGSLDKYLFHENKTIGFERLHEIAIETAKGIAYLHEECQLKIIHYDIKP

SEQ ID NO: 147528 - protein, 124 aa, Glycine max
  Coding DNA Sequence Number=SeqID_30750
  Gene Ontology: Mol. function=protein-tyrosine kinase activity; Cellular component=chloroplast; Biological process=protein amino acid phosphorylation
  Homolog annotation: Hit_ID=Q1RVG1; Match level="QueryCoverage=64%, HitCoverage=74%, E-value=2e-22, Identity=66%"; Hit description =Protein kinase
MPSNTANDIIKGSGRESLGSKDENMGITESTSSVNGGSCSSHSSKNIVFPSVEVRNLKEFSFANLKAATKSFKSDALLGEGGFGKVYKGWLDEKTLAPTKAGSGIMVAIKKLNPESMQGLREWQ

SEQ ID NO: 147529 - protein, 219 aa, Glycine max
  Coding DNA Sequence Number=SeqID_30751
  Gene Ontology: Biological process=regulation of transcription
  Homolog annotation: Hit_ID=Q6Z2T5; Match level="QueryCoverage=92%, HitCoverage=87%, E-value=1e-17, Identity=31%"; Hit description=RWP -RK domain-containing protein-like
  Pfam annotation: Domain name=RWP-RK; Domain location=90-141; Score =101.4; E_value=2.7e-27; Accession=PF02042.6; Description=RWP-RK domain
MIPNLLDDLHMIYKLNRKEEDRDIAQDSTGEERQGHSNNFQPSRKVFPVLDQDLNFLPYEDYESESPDNETDVESSPGFLVKKKRAPSDLVAKISLSDLVKYFGMPIVEASRNLNVGLTVLKRKCREFGIPRWPHRKIKSLDSLIHDLQEEAKNQELEDREAAMAVAKRQRMLESEKENIEKKPFMDIKIETKRFRQDVFKRRHRARAVEKHNSTVSST

SEQ ID NO: 147530 - protein, 63 aa, Glycine max
  Coding DNA Sequence Number=SeqID_30752
MTRETESGSRERCMVTYIPGWRVLLKTSRGHEKEKETGSNSMKRGLNRRKRMRQKPAFKCKFA

SEQ ID NO: 147531 - protein, 442 aa, Glycine max
  Coding DNA Sequence Number=SeqID_30753
  Gene Ontology: Mol. function=protein kinase activity; Cellular component=intracellular; Biological process=protein amino acid phosphorylation
  Homolog annotation: Hit_ID=Q6Z0F9; Match level="QueryCoverage=88%, HitCoverage=81%, E-value=4e-36, Identity=26%"; Hit description=PPR -repeat protein-like
  Pfam annotation: Domain name=PPR; Domain location=123-157; Score=4.9; E_value=2; Accession=PF01535.11; Description=PPR repeat
  Pfam annotation: Domain name=PPR; Domain location=190-224; Score =24.3; E_value=0.00043; Accession=PF01535.11; Description=PPR repeat
  Pfam annotation: Domain name=PPR; Domain location=258-292; Score=7.7; E_value=0.91; Accession=PF01535.11; Description=PPR repeat
  Pfam annotation: Domain name=PPR; Domain location=88-122; Score=29.1; E_value=1.6e-05; Accession=PF01535.11; Description=PPR repeat
  Pfam module annotation: Pfam domain module=PPR::PPR::PPR::PPR; Domain location=123-157::190-224::258-292::88-122
MIRRHAAFDPEVASKVCGTVIEPFLLSLAKTSNLVTLRHCNQIHAKLIASQCISQTHLTNNLLSLYAKFGHFRHAHLLFDQMPQRNVFTWTTLISSHFRTGSLPKAFEMFNHICALNERPNEYTFSVLLRACATPSLWNVGLQIHGLLVRSGLERNKFSGSSIVYMYFNSGSNLGDACCAFHDLLERDLVAWNVMISGFARVGDFSMVHRLFSEMWGVEGLKPDDCTFVSLLKCCSSLKELKQIHGLASKFGAEVDVVVGNALVDLYGKHGDVSSCRKVFDSKKEKYNFVWSLIISGYSMNKGVGELVDVEKLFRRIDDKDIVTWNSMILAHARLTQGSGSSMKLLQELHGTTSLQIQGASLVAVLKFCENKSDLPGRQIHSLVVKSSVSHHTFVGNALVHMYSECGQIGDAFKAFVDIGKMMVLGVLLLEIIDKMGWNQKL

SEQ ID NO: 147532 - protein, 62 aa, Glycine max
  Coding DNA Sequence Number=SeqID_30754
MAKVAKFGVQAQECLRVTRFEVFASDSKNGSITVPHTLLATSGSNAACRRIIPITPSSSLNA

SEQ ID NO: 147533 - protein, 570 aa, Glycine max
  Coding DNA Sequence Number=SeqID_30755
  Gene Ontology: Mol. function=Rab escort protein activity; Cellular component=Rab-protein geranylgeranyltransferase complex; Biological process=intracellular protein transport
  Homolog annotation: Hit_ID=Q8LLD4; Match level="QueryCoverage=97%, HitCoverage=97%, E-value=1e-146, Identity=49%"; Hit description=Rab escort protein
  Pfam annotation: Domain name=GDI; Domain location=15-482; Score=7.2; E_value=6.9e-17; Accession=PF00996.9; Description=GDP dissociation inhibitor
MTQPQDPFSYPPIDPVNFDLIIVGTALSESVIAAAASAVGKTILHLDPNSFYGSHFASLSLHDLTSYLSSPHSLPSAAATTTDSDDVVVIDFVQQPLCSDAEIATYDESAFLSENSRKFSIDLGGPKALFCADKTIDLLMKSGAAQYLEFKGIDESFVYEANAGLANVPDSRGSIFRDKKLSLKEKNQLMRFFKLVQQHLDDTQEEKIPEEDLEIAFVSFLEKMKLPPKIKSYSPFPFPTMLDYDQDNNEVCIELLKTKDGIDSLALYSSSVGRFPNAPGALLYPIYGEGELPQAFCRRAAVKGCIYVLRMSVVSLLMDKVTGSYKGVRLASGQDLYSHQLILDPSFMIPSPLSSSPRDFPSEKLQMLGQRDIKGMVARGICITRSSIKPDVSNCSVVYPPRSLYPEQLTSIKALQIGSNLAVCPAGTLQDSDNYSHDLPLEFCFIFILYFSTMCNDADEGKKLLKAAMNALLTLPVSGNSESIPSVQSDSEDIKPIVLWSAFYIQKLIMCKLEFISSTPTPDGNLNYDDLLDATRKLFNQMYPDEEFFPKSTSPEDPTDEDDNGLTLDS

SEQ ID NO: 147534 - protein, 99 aa, Glycine max
  Coding DNA Sequence Number=SeqID_30756
  Gene Ontology: Mol. function=nucleoside-triphosphatase activity; Cellular component=membrane
  Pfam annotation: Domain name=DUF265; Domain location=2-98; Score= -26.3; E_value=0.00086; Accession=PF03266.5; Description=Protein of unknown function, DUF265
MVSHLMALALTMAALSLSDGLTLANLPLRMLKVREDTDLFIIDEVVLASIPVPKFGRDIPEVARLRNHAGATCFTLSVSNRDAVREKIRSQLEDLLTKH

SEQ ID NO: 147535 - protein, 873 aa, Glycine max
  Coding DNA Sequence Number=SeqID_30757
  Homolog annotation: Hit_ID=Q10S87; Match level="QueryCoverage=98%, HitCoverage=96%, E-value=4e-87, Identity=29%"; Hit description =Expressed protein
MAKKVLARKRHHGGLEAPRNSLDLQVQTPQNYCPEGELPYNYQVKEEGRSEKNRYSNVGSMKKLINEELSKQSSTRQNAPSLVARLMGIDTMPLDTKYVVPSDRKISENMGKRSSVKGVNRRGSVSWGSSNFNSSSQMDFDSLYKDIGDDDDGWNQSFGELRPREHPQEEELQKFKKEFEAYQAARFLECSKVAEIGSAPRQLLAQENLNKEKMMHNDSVLHRAAAGKLADLDRHAFKTPPESYGSEYHGKVMELIPAMQRKTIPPRSRTLSRDFEESLMMKSCNKLDTSSSPTRIVILKPGPDSICNHEENLTISSGTIQGRNSIEDFLEEVKERLKCELQGKIVKKGSVVRGNGIETPYNEKPSDPKLIARHIVKQVRESVSRDTGTNLLHSESIGSYKSEMEFNGPSSPEFISRDTRRFLSERLRNVGRSEAHADIPEGKSSSLSLDNHKARLKQVGDANNWEISKEDTAIQTGSFRHELDENIFLHKELSPRNLVRSLSAPVSRSGTSFGKLLLEDRHILTGAQIRRKLEAVETMSVDVKKRKKDRFNIKERVSNFRYNLALRGRLFGRRVQSMVESHGNEFGPFVRDVTSGPTVLMNCGVRHENSTEVPPSPASVCSSVHEDFWRQTEYLSPISTPDVSSRDDNVVPQVFRDISSGLSELRRQLNQLESDGPEDLTMKQEPAESELDQLEDPAESYVRDLLVSSGLYFGSWDKSLLRGDTFAKPIGNSVYEEVEESHKKLVKENDEICIKDQNESKLDHKVLLDLLNEALSVVLGPPLTLSRFRRKLRNSSILPPSGKELLSLVWDVIRVSLYPPSDISTYSLDTLVAQHLGSIPWSGLINDEINILERDIECLITDDLVEELTKDMF

SEQ ID NO: 147536 - protein, 90 aa, Glycine max
  Coding DNA Sequence Number=SeqID_30758
  Gene Ontology: Mol. function=RNA binding; Cellular component =ribonucleoprotein complex; Biological process=mRNA metabolic process
  Homolog annotation: Hit_ID=Q2HTF4; Match level="QueryCoverage=98%, HitCoverage=98%, E-value=5e-34, Identity=84%"; Hit description=TonB box, N-terminal; Like-Sm ribonucleoprotein-related, core
  Pfam annotation: Domain name=LSM; Domain location=8-83; Score=73.0; E_ value=9.4e-19; Accession=PF01423.12; Description=LSM domain
MSRSGQPPDLKKYMDKKLQIKLNGNRMIVGTLRGFDQFMNLVVDNTVEVNGNEKNDIGMVVSPLLIFFVVKVIRGNSVVTVEALEPVNRA

SEQ ID NO: 147537 - protein, 823 aa, Glycine max
  Coding DNA Sequence Number=SeqID_30759
  Gene Ontology: Mol. function=mismatched DNA binding; Cellular component=chromosome; Biological process=response to DNA damage stimulus
  Homolog annotation: Hit_ID=Q69MM0; Match level="QueryCoverage=97%, HitCoverage=91%, E-value=4e-41, Identity=40%"; Hit description=DNA mismatch repair protein-like
  Pfam annotation: Domain name=DNA_mis_repair; Domain location=173-288; Score=-14.4; E_value=0.054; Accession=PF01119.9; Description=DNA mismatch repair protein, C-terminal domain
  Pfam annotation: Domain name=HATPase_c; Domain location=40-121; Score= 10.8; E_value=0.0057; Accession=PF02518.16; Description=Histidine kinase-, DNA gyrase B-, and HSP90-like ATPase
  Pfam module annotation: Pfam domain module=DNA_mis_repair::HATPase_c; Domain location=173-288::40-121
SRRGEEPIGHVHPNRSGGGGLMASIKLLSEAVRSSLRSGIFLVDFTRVVEELVFNSLDARATKGETEKLKVSVFVSTGSCYLKVVDDGSGIPRDGMEMVGERYVLASISEVSLLEIVTKTYGRPNGYRKVLKGCKCLYLGIDDDRKEMGTTEDELFCTHSASSPLSLVTSGFGVEVTSSLHNLEVENDIIKLSGYISGPCNTVDTKGPVHKLMRQLANRFEHLNSWNTDEEFQNKKRTRCQPCPAYLLNLSCPRSLYDLAFEPSKTVKFKDWAPILNFIVKAIKQFWEENVACDPSNGATYMVEDQHHFSSIREDVDYLGVTIFKEKQSKGDFLLQTGYSGNLLDGSYAKCTSTVMRKHNSLLMHNSNSLLEGDNFFDGEIPAVESFNIDVPFDAPSSSHGRRFHKVEADVINESFEDDLLYNSCSGYGYDVKINEDLQQPFLKRCSTLGSILHEKALFVNDEYELQTDSFWSKQNAEEDYRSGKDLYAHPCPEVTKKLKMSKDSDFLVRALSEENCLPPDLCYSALQIGSSGSDDQLLNFEWHPDYQKPSSQASALEMIGNRQIGRVSNPAFNHQEASNFKYPQQSPVGLHHSTEEFLLQEFKINVKRTSEVLGDMQVNDITDIDGFESFNIQNSAPFGGKFNVWKNDKLANIQSQNNILDISSGFLHLAGDSLIPETISKKCLEDAKVLHQVDKKFILVVAGRTLAVIDQVADTDGSSTMPPSVLRVLNLKACRGAIMFGDSLLPSECSFIVEELKHTSLCFQCAHGRPATVPLVNLEALHNQIAKLRLMNECSSDECHGLRRHTVRVERAAQRLNSARGI

SEQ ID NO: 147538 - protein, 89 aa, Glycine max
  Coding DNA Sequence Number=SeqID_30760
MARENTSYLNGRDAPKKETATRARQGSTGRPVLVILIVSVLLALVVWAVVEYAVFEPDENLPQNPQTENAPVSQQPSGSESFDNNPANG

SEQ ID NO: 147539 - protein, 134 aa, Glycine max
  Coding DNA Sequence Number=SeqID_30761
MVIHTFCHPEIASLRTCGGTAMYGDTQVVIRTNDFRHPDPQVTCGGYRMVIHTFHQPRANKPVDAQRLTSFSAPFVILTHGVRFYSSRPETCEPDDARDSSLLGGRQSSSMAWGSVVVVPLYRFQDTEVLMTLL

SEQ ID NO: 147540 - protein, 126 aa, Glycine max
  Coding DNA Sequence Number=SeqID_30762
MTEIVCTDNYLGISVHRLTSQVRMTESTEDDINLRVSMSLLALIEKRTTKGADDDVSLCASTGSFPLIDKRRGWAFSPWVKVYGELGFWLNAYRTAGHDICQSVGLASDSGIKGMSHIISMTHMQQ

SEQ ID NO: 147541 - protein, 148 aa, Glycine max
  Coding DNA Sequence Number=SeqID_30763
MCKNCFMLEQSKAILARKNGVKSIKYNEDEFSKVAYFKLLLKKSFNKNKRTLMFHFRLVYPLDQSTWTLWPSIFHSTLSPGLVQKLQAMRAGDENQLCLRHLYQNFKNFFGEGTLLKDLVMGASKAPYEEAWEDKMTQIKEVSEEAYI

SEQ ID NO: 147542 - protein, 432 aa, Glycine max
  Coding DNA Sequence Number=SeqID_30764
  Gene Ontology: Mol. function=protein serine/threonine kinase activity; Cellular component=spindle pole body; Biological process =protein amino acid phosphorylation
  Homolog annotation: Hit_ID=O81783; Match level="QueryCoverage=87%, HitCoverage=85%, E-value=1e-158, Identity=72%"; Hit description =Protein kinase - like protein
  Pfam annotation: Domain name=Pkinase; Domain location=36-400; Score =136.3; E_value=8.3e-38; Accession=PF00069.15; Description=Protein kinase domain
  Pfam annotation: Domain name=Pkinase_Tyr; Domain location=36-398; Score=-128.0; E_value=0.00013; Accession=PF07714.7; Description =Protein tyrosine kinase
  Pfam module annotation: Pfam domain module=Pkinase::Pkinase_Tyr; Domain location=36-400::36-398
MTLSIDTCGVVPHRNDSLPGIDYKNHAQVHPLFMYLCLIQKPSMKVKHSYVALKIQKSSAQFAQAALHEINLLSSIADRDPSNSKFVIQLIDHFKHTGPNGQHLCMVLEFLGDSLLRLIRYNRYKGLPLNKVREICKCVLIGLDYLHTDLGMIHTDLKPENILLCSTIDPAKDPSRSGLSPILERLEGNTNGGVTSLIEKRLKRRARTAIAKISGRRASMGGTGDVAKTGRNIDGIDVRCKIVDFGNACWADKQFAEEIQTRQYRAPEVILKAGYSFSVDMWSLACIAFELATGDMLFTPKGGQGFSEDEDHLALMMELLGKMPRKIATAGAQSKDFFDRHGDLKRIRRLKFCPLDKLLTDKYKFSVNDAQEFSEFLLPLFDFAPEKRPTARQCLQHPWLNCMESPPNEMRNESAVEKVDVVMSKLKIRVGK

SEQ ID NO: 147543 - protein, 115 aa, Glycine max
  Coding DNA Sequence Number=SeqID_30765
  Gene Ontology: Mol. function=signal transducer activity; Cellular component=nucleus; Biological process=regulation of transcription, DNA-dependent
  Homolog annotation: Hit_ID=Q94BT6; Match level="QueryCoverage=66%, HitCoverage=13%, E-value=8e-24, Identity=69%"; Hit description =Adagio protein 1
MEWDSNSDLSDDDAVSYVLNDDDDDAVGPLPFPVLQTAPCGFVVTDALDPDHPIIYVNAVFEMVTGYRAEEVLGRNCFLGILLSVLRGAFLGSMAENSFGCEGIGEINLILHVMS

SEQ ID NO: 147544 - protein, 152 aa, Glycine max
  Coding DNA Sequence Number=SeqID_30766
  Homolog annotation: Hit_ID=Q9AY32; Match level="QueryCoverage=41%, HitCoverage=95%, E-value=6e-27, Identity=96%"; Hit description=RRNA intron-encoded homing endonuclease
  Subcellular localization annotation: CTP_CleavageSite=59; ConfidenceScore=5.21e-01
MVVTGDGELGKKLVVGPWVGSIGPPPVCTRSARPFCRRCAPVLNWPGRASGAVTLKKLECSKQAYALRTTAKAFAKDVFINQERKLGARRRSDTVLVSTINDADQGSADVAFRTPLAPYEKSKSLGSGGSMVARLKLKGIDGRAPPGVEPAA

SEQ ID NO: 147545 - protein, 309 aa, Glycine max
  Coding DNA Sequence Number=SeqID_30767
  Homolog annotation: Hit_ID=Q7CIU7; Match level="QueryCoverage=45%, HitCoverage=75%, E-value=7e-32, Identity=48%"; Hit description =Murein transglycosylase E
MANSTTMYYSGKNPLSKVGYKSEAVVVPRGDRQRRLHKALLRYHDPANWALIRAALEEMGLKHLIGSRRECLVPGAEHRRAARSETPAAPYPAGADQTYRYQSAAHAVQPAAAQTDSQSQAVTATPRAQTKRRTLGFSSLLLLITADRKRLPLSSNGAAPVEQGGAQQRAGAVDVGDDGGVAQRNWIGDPFKLLFLQGGQIGGAEIDIGVGIQQIVIVRATAFAFVAIGVAAGGIGFQLHQADRIGSAHCGGVETGLHLDHGGDQLGVYAVFAGGVFNGAIEGVAIVADALFLAGATRQHQHDAKHAQP

SEQ ID NO: 147546 - protein, 306 aa, Glycine max
  Coding DNA Sequence Number=SeqID_30768
  Gene Ontology: Mol. function=nucleoside transporter activity; Cellular component=integral to membrane; Biological process =nucleoside transport
  Homolog annotation: Hit_ID=Q66D47; Match level="QueryCoverage=92%, HitCoverage=77%, E-value=2e-56, Identity=68%"; Hit description=MFS family xanthosine permease precursor
  Pfam annotation: Domain name=Nuc_H_symport; Domain location=1-306; Score=-51.9; E_value=1e-08; Accession=PF03825.7; Description =Nucleoside H+ symporter
MINTLHFSGMQVGMVYSAKGIAALIMPGLAGIIADRWMKANYLYALCHLLGALALYCAAQVEQPMLMFWVMLFNAMVYMPTIALSNAISYFCLEKHGFDTVKDFPPVRVYGTVGFILAMWLLGERAGAGCAGAVPPAAHGAVFPVRHVAWRGAADNQYLRQPVPARSVAQPAVSGQPQRPVSGGAAVAVADLRSVLYPHHSLLPAPLRHQAGDADQHGGLDAALPVPGLWHAGRLWFRSAAAVDDRLRLRLRLLQYLRRYLRRERGRSPHPRQRAGAVHDHGERLGRLSGGARQRRGWWTSSAMTA

SEQ ID NO: 147547 - protein, 72 aa, Glycine max
  Coding DNA Sequence Number=SeqID_30769
  Homolog annotation: Hit_ID=O65361; Match level="QueryCoverage=58%, HitCoverage=5%, E-value=6e-07, Identity=67%"; Hit description=Delta 1-pyrroline-5-carboxylate synthetase (P5CS) [Includes: Glutamate 5 -kinase (EC ...
  Homolog annotation: Hit description=2.7.2.11) (Gamma-glutamyl kinase) (GK); Gamma-glutamyl phosphate reductase (GPR) (EC 1.2.1.41) (Glutamate-5-semialdehyde dehydrogenase) (Glutamyl-gamma -semialdehyde dehydrogenase)]
MTLSNQYPNTVVGTAVVTRSDGRLALGRLGALCEQLKELNNNDYEVILVTSGAVGLGRQRLRYRRLVNSRFL

SEQ ID NO: 147548 - protein, 113 aa, Glycine max
  Coding DNA Sequence Number=SeqID_30770
MKNHEIHFGTRYSIEKFQGRLELQPYYQNEAERGSNIDKLLMQFMETTKSTQQALQSVEIQVGQLVEAVTQFMSRREKSFVEAEAQEKSPVKEHESREKDEEKDEEQAQQQWE

SEQ ID NO: 147549 - protein, 97 aa, Glycine max
  Coding DNA Sequence Number=SeqID_30771
MSEIEEVQEQMKADMEAMKDQMTSIMKAMMSMRRMMQDNTAADATTSVTAEADPTHPFGINQTSHPVLDVVGDVSSIGACRPRIFFINGFLCFLEDE

SEQ ID NO: 147550 - protein, 116 aa, Glycine max
  Coding DNA Sequence Number=SeqID_30772
  Homolog annotation: Hit_ID=Q42793; Match level="QueryCoverage=88%, HitCoverage=4%, E-value=6e-50, Identity=95%"; Hit description=Acetyl CoA carboxylase
  Pfam annotation: Domain name=Biotin_lipoyl; Domain location=3-52; Score=12.8; E_value=2.9e-05; Accession=PF00364.12; Description =Biotin-requiring enzyme
METVIHVDADTPYAEVEVMKMCMPLLSPASGIIHFKMSEGQAMQAGELIARLHLDDPSTVRKAEPFTGSFPVLGPPTAISGKVHQKCAASLNAARMILSGYDHNIDEVSKFFTLIH

SEQ ID NO: 147551 - protein, 487 aa, Glycine max
  Coding DNA Sequence Number=SeqID_30773
  Homolog annotation: Hit_ID=Q1SR88; Match level="QueryCoverage=67%, HitCoverage=58%, E-value=2e-09, Identity=31%"; Hit description=IMP dehydrogenase/GMP reductase
  Pfam annotation: Domain name=DUF674; Domain location=42-487; Score =160.0; E_value=6.2e-45; Accession=PF05056.3; Description=Protein of unknown function (DUF674)
FAVATMSEQVSLKLMENKESDNVIFAEAGQDFVGVATMPGQVSLKLVVNKETNKVVFAEAGKDFVDVLLSFLTFPLGTIARLVQKDSDVGPVQVGCLSSLYESVANLEKECLWTEACKEMLLQPRNSSEDYCRSLKLNIDDTEPTKHFMCTSNLDCAYSQLSTYPNGRCACGFAMTTLVFVDDKVYKGFVNGGATFIVTDDLVVLPNTMDTGLSFFQSCGVKCLSSVQTITLTVTKKKVLDLLKCSLLSKSTLTDLFLVKKPFLENSSFSPAVVENSSTIQIKIKLVMRKSDGKILFAEGEEDFADFLLSFLTLPLGGVVRMLGGYSSMGSVDGLYKSIADLNENKYLISEKVKNRLVDPGLAPQFQTKIANQMLPICEQISEYYYCYPFDHYTEFIFRNQFYKTDYYEYENYEKFERYTRLVLVDPKSSEGSIEGNGYAKGPAMFMATDDLVVAPMSPISGLSLLSRLNIPLSDLKEKVVVIGIKE

SEQ ID NO: 147552 - protein, 146 aa, Glycine max
  Coding DNA Sequence Number=SeqID_30774
MAAFIRQYQYNSDMALDRMQLQNMCKRDNESFKEYAQSVLLREDGRLHSSFADLVFAGERIKVGLRRGKFDYASTTGSGNMKPGANGAKKKKGETHNVIAAPTWMNSAQTPHNPMYQYPPHQYHYSANIDPPPCPMPLRPRAPNQL

SEQ ID NO: 147553 - protein, 43 aa, Glycine max
  Coding DNA Sequence Number=SeqID_30775
MGSDQAPSFKKRFYHVKVKNLELASLQKLGQRMGQVQRQAFSK

SEQ ID NO: 147554 - protein, 93 aa, Glycine max
  Coding DNA Sequence Number=SeqID_30776
MGCGKVVVQGRGSELCLRLVSGLRKIVDHGCDREWDSSLNKEWVEARGVELESEVTKRESSRVWVYRWCCHVYLGGLVSLPSPPEVQLEWIGS

SEQ ID NO: 147555 - protein, 200 aa, Glycine max
  Coding DNA Sequence Number=SeqID_30777
MGVYSRDEKLLMHFFQESLAEEAVIWYTNLAASRIHSWKDLITAFIRQYQYNTDMAPDRTQLQNMSKREHEFFKHEVQSLIDAGWLTFQEDGPNVITNPLASHGGQAVNTVEEYGLQRPNACRNLPFSGRATWGSWVRLPMEEGTWSHHQRLFEENIGKTRKVWSTNIKCERFRNCFYARGRVFPSLLRILNCDEEIRPT

SEQ ID NO: 147556 - protein, 200 aa, Glycine max
  Coding DNA Sequence Number=SeqID_30778
  Homolog annotation: Hit_ID=Q5G8X8; Match level="QueryCoverage=43%, HitCoverage=65%, E-value=3e-09, Identity=44%"; Hit description=Gp11
MADPITAADVQAYLGELGYTIPMALLDPILCAVNKIIPCLDGAGYDDCTAKLILMYAAALMATSSGARRIKSQGAPSGASRSFDYGADSITWLRDSLARLDTSGCTGELPISAAHPGDRRQGAALEGGLMSSVANWSCTATATIWRKLEGNDEYGDPLGYAEPEQILCDYEGGLSKKLASLGAEIVVKNTVWTEFALAAA

SEQ ID NO: 147557 - protein, 130 aa, Glycine max
  Coding DNA Sequence Number=SeqID_30779
  Gene Ontology: Mol. function=nucleic acid binding; Biological process= DNA integration
MEMSNLTSKLKALKLELGKNLLVHLVLISLPAHFGQCKATYNTQKDKWSLNELISHCVQEEERLQRDRSESAHLSSTSLNKKRKKTKGVAEGSSQQKKLKKDEEFTYYFSKKFGHMKKKFPKYATWRVKK

SEQ ID NO: 147558 - protein, 76 aa, Glycine max
  Coding DNA Sequence Number=SeqID_30780
MGVFASEVLLLLQPQPQLVMKLMIPLQVIIMELMIPQVSSCSHDATGHHGTRETVGHHGDVDFSGGGGDFSGGGGF

SEQ ID NO: 147559 - protein, 117 aa, Glycine max
  Coding DNA Sequence Number=SeqID_30781
VSWKVGAPDFCLHKGSIRNVRHKGTNIEKKANMGSFCFRARKEGDDNKYKPNDIMTAGAAAAAPTKTCDETHGTTTDHNHGTHDTTAHHHGSHDTTGHHLHHHTVGHDGGAHFSGDG

SEQ ID NO: 147560 - protein, 134 aa, Glycine max
  Coding DNA Sequence Number=SeqID_30782
  Gene Ontology: Mol. function=ribonuclease H activity
  Homolog annotation: Hit_ID=Q9FMW4; Match level="QueryCoverage=95%, HitCoverage=66%, E-value=6e-40, Identity=59%"; Hit description =Similarity to ABA-responsive protein
  Pfam annotation: Domain name=GRAM; Domain location=28-107; Score =29.5; E_value=1.2e-05; Accession=PF02893.10; Description=GRAM domain
KLGPKITDTVKGKLSLGARILQVGGVEKVFMQLFSVKDGGEKLLKACQCYISTTSGPLAGLLFISTDKVAFCSDRSIKAYSSKGHLIRIHYKVVIPLEKIRSINQSQHVKKPSQKYIEIKAFKYLKQAISQAQA

SEQ ID NO: 147561 - protein, 139 aa, Glycine max
  Coding DNA Sequence Number=SeqID_30783
  Homolog annotation: Hit_ID=Q1RZJ4; Match level="QueryCoverage=44%, HitCoverage=1%, E-value=1e-18, Identity=67%"; Hit description =Aldo/keto reductase; Sigma-54 factor, interaction region
MYDVLIIFHQVMEDKYEFFANRKLSNTQKFIVPLLRELYLDANTADFNYIIGCAWAHIGALGMHLLLSCNDIDPAMKYYCKYEKSVVIFLGSFWHKRQCRKLQRKCIEFLTSLILYTFNSSKKETIVIGDAIAKRNGYW

SEQ ID NO: 147562 - protein, 79 aa, Glycine max
  Coding DNA Sequence Number=SeqID_30784
METVVHDSYFMSKHILEGSGVEHNRVIGNNELNFQDVDKEPKYHSHTSTPNRKHTTSGGLGEALGAGKDEDDSETNIIT

SEQ ID NO: 147563 - protein, 107 aa, Glycine max
  Coding DNA Sequence Number=SeqID_30785
MSKKEESPEDCDRTFPNRHRPNSGRLCFFVRAQPKLCFGRHWHVLIYSARKTLAHFDKRTLFTDIDKKNGSRCRPGKMTDPGLKRKNHHMTPIEHFLIDIVQILSGD

SEQ ID NO: 147564 - protein, 119 aa, Glycine max
  Coding DNA Sequence Number=SeqID_30786
MAEPSKKRKGTSTRSQRHSGSQEAPIPPSIPFGSLFSSEEQHIRYTNLFSSRSIVDPKFIDMEFFSNENFECFQAFENSNLIPFMSLKLHVYYELVKAFYSNLEIHEGVLMSEIYGIKM

SEQ ID NO: 147565 - protein, 37 aa, Glycine max
  Coding DNA Sequence Number=SeqID_30787
MNETLDVSISFLNDHLEETLGSTKIEEHHSKCINLTQ

SEQ ID NO: 147566 - protein, 43 aa, Glycine max
  Coding DNA Sequence Number=SeqID_30788
KLKKAETLIWVDFVECPKVEVVYGSSWKSGDLEMEDLDIDLME

SEQ ID NO: 147567 - protein, 103 aa, Glycine max
  Coding DNA Sequence Number=SeqID_30789
  Gene Ontology: Mol. function=transporter activity; Cellular component= membrane; Biological process=oligopeptide transport
  Homolog annotation: Hit_ID=Q5N7W6; Match level="QueryCoverage=83%, HitCoverage=14%, E-value=9e-17, Identity=45%"; Hit description =Putative nitrate transporter NRT1-5
MNLIHKGLWKGEEGVHQFVLLGFCEVFTIVGHIEFYNSESPEKMKSVGNSLQYLLVAFSNYAGTLVNIVQKVTRRLGKTDWMNDDINNGRLDYYYFYFLIAGL

SEQ ID NO: 147568 - protein, 167 aa, Glycine max
  Coding DNA Sequence Number=SeqID_30790
  Homolog annotation: Hit_ID=Q10F03; Match level="QueryCoverage=32%, HitCoverage=10%, E-value=7e-09, Identity=51%"; Hit description =Isoamylase N-terminal domain containing protein, expressed
  Subcellular localization annotation: CTP_CleavageSite=35; ConfidenceScore=5.63e-01
MHFLTAPSYLSLLSPHLTPSLAPPLHFPASTGRVRRFAVETGSVLRSSLWKVNRYKGLWLSCTGFLRRCKDWDGEFSSLESQILDFMQNTDKPEVFPTKEELVAAGRVDLVNAIVNEGGWLAFGWDLNGGSSEILGFEDNSGGGIEGNGAQASGVSSSSPSQSDNSV

SEQ ID NO: 147569 - protein, 63 aa, Glycine max
  Coding DNA Sequence Number=SeqID_30791
  Gene Ontology: Mol. function=transporter activity; Cellular component= membrane; Biological process=oligopeptide transport
  Homolog annotation: Hit_ID=Q9CAS0; Match level="QueryCoverage=98%, HitCoverage=13%, E-value=4e-09, Identity=40%"; Hit description =Putative peptide transporter; 37139-33250
MEKKPGWKAIPYILGLYLNVGASNIIGIWSGVSNCIPLIGAAVADSYLRKFRTIAISSFRTLA

SEQ ID NO: 147570 - protein, 223 aa, Glycine max
  Coding DNA Sequence Number=SeqID_30792
MDELDVTSSDKQYPGCYFLVCRGIEAGKSGIEGILSRLEKQRNRSFGLDLDNVSFENNEDKDEWDPRTTTDTMAAGLENGSRASSSSSTSSHLSGSQIKHDPHGSQLGTENLRNSLKPETWRSWIIQRTGFLDTDFEDAEIVPNETEKGGMSDASRQPDILNRRELSSEHINRETGLYSLDGNANHSDIKSRIQNLESELSSILHLLRSSSDNITMQMVSAII

SEQ ID NO: 147571 - protein, 337 aa, Glycine max
  Coding DNA Sequence Number=SeqID_30793
  Gene Ontology: Mol. function=ARF guanyl-nucleotide exchange factor activity; Cellular component=Golgi apparatus; Biological process =protein modification process
  Homolog annotation: Hit_ID=UPI0000162ED7; Match level="QueryCoverage =96%, HitCoverage=85%, E-value=1e-102, Identity=47%"; Hit description= Ran GTPase binding
  Pfam annotation: Domain name=RCC1; Domain location=122-171; Score =17.8; E_value=0.0084; Accession=PF00415.9; Description=Regulator of chromosome condensation (RCC1)
  Pfam annotation: Domain name=RCC1; Domain location=17-66; Score=22.1; E_value=0.0019; Accession=PF00415.9; Description=Regulator of chromosome condensation (RCC1)
  Pfam annotation: Domain name=RCC1; Domain location=176-228; Score =9.9; E_value=0.06; Accession=PF00415.9; Description=Regulator of chromosome condensation (RCC1)
  Pfam annotation: Domain name=RCC1; Domain location=231-272; Score =13.1; E_value=0.027; Accession=PF00415.9; Description=Regulator of chromosome condensation (RCC1)
  Pfam annotation: Domain name=RCC1; Domain location=69-119; Score =19.1; E_value=0.006; Accession=PF00415.9; Description=Regulator of chromosome condensation (RCC1)
  Pfam module annotation: Pfam domain module=RCC1::RCC1::RCC1::RCC1::RCC 1; Domain location=122-171::17-66::176-228::231-272::69-119
MEEPNKTENEDDRDESEQRVWSWGAGTEGQLGTKILQDEHFPQLLHQFSLSSISSLACGGAHVIALTSAGKALSWGRGNSGQLGHGEVVSNTLYPKAVTSLDGYFITHVSAGWSHSGFVSDTGFVFTCGDGSFGQLGHGDNASHCSPVKVSCFVDLHVAQVACGMRHSLVLLKDCSGNQVYGFGSGKRGQLGVSNDRVKSVNVPKVVSGFEGVEIVGTAANGDHSAAVSVDGHVYTWGRGFKGFEDAHVPQCLNSSLNFTKVALGWNHALAMSGEGEVYMLGGNHLGVLSDLQNIGPAKHFPDLREFNLEKVPGLDGTKITDIAAGAEHSVIVTGKL

SEQ ID NO: 147572 - protein, 93 aa, Glycine max
  Coding DNA Sequence Number=SeqID_30794
MEGVEWIKRESTVLIFSVELWNFLYETKLLWNFLYETKLVELGTAKKERERARGESVHVAPLHADTSSPMWLYSNLNLPHCPVIITYFILKAA

SEQ ID NO: 147573 - protein, 255 aa, Glycine max
  Coding DNA Sequence Number=SeqID_30795
  Gene Ontology: Mol. function=protein binding; Cellular component =flagellar basal body, MS ring; Biological process=ciliary or flagellar motility
  Homolog annotation: Hit_ID=P25798; Match level="QueryCoverage=88%, HitCoverage=38%, E-value=5e-59, Identity=53%"; Hit description =Flagellar M-ring protein
  Pfam annotation: Domain name=YscJ_FliF_C; Domain location=1-179; Score=217.7; E_value=2.6e-62; Accession=PF08345.1; Description =Flagellar M-ring protein C-terminal
VTAQINFDRSEQTDEKYQPNANPNNTAIRSRQTSTSDQNGSPYPGGVPGALSNQPAPANTAPVTNPQQQNNNNANGQQNNNAQNAGTSTSTAQSSGPSSSSRNDTVNYELDRTIRHTKLNVGDVQRLSVAVVVNYRDDGKGKAVALNDQQIKQIEDLTREAMGYSQTRGDSVNVVNSQFNTTEPTGGDLPFWQQQSFFDQLMTAGRWLLVALVAFILYRKMVRPQLLRKREAEKAAVEAAAARAAAREEEAAYSV

SEQ ID NO: 147574 - protein, 101 aa, Glycine max
  Coding DNA Sequence Number=SeqID_30796
  Pfam annotation: Domain name=Transposase_23; Domain location=20-86; Score=-2.6; E_value=0.0022; Accession=PF03017.5; Description =TNP1ENSPM transposase
  Subcellular localization annotation: CTP_CleavageSite=34; ConfidenceScore=5.46e-01
MASFNQMQSQLQSQMQSQGLALPPDPLVGPSGPRVSTKVYEGSTVVHNTPLLPGQVKVSVEEVTDADAPVPLPTDEVSLVGQALHTFLDWPTHLVKFLSQQ

SEQ ID NO: 147575 - protein, 241 aa, Glycine max
  Coding DNA Sequence Number=SeqID_30797
  Homolog annotation: Hit_ID=Q9AVH2; Match level="QueryCoverage=19%, HitCoverage=16%, E-value=9e-20, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGFVGDLEGRDESKRQGLNLSGSWQQGHSATYNNPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 147576 - protein, 98 aa, Glycine max
  Coding DNA Sequence Number=SeqID_30798
MFFSIYHHYGPYGQIDVVRIIVCPFEKDECPTHVISAKGFVSEGLTSDVWKYVVEVNSSEMQPEGNLSFDPVCIWLWFRYRLKTFFRALISVEVEYCS

SEQ ID NO: 147577 - protein, 103 aa, Glycine max
  Coding DNA Sequence Number=SeqID_30799
MCPANTHEFMTVFPKDISHEPVATCPITVAGAVSTIHVQQSKHGKGVGSRGPRCFLGGGYVAGTAWCRVQVGTPEGDKSRFPPDKDGLFVGGDVIWGCVRSLS

SEQ ID NO: 147578 - protein, 111 aa, Glycine max
  Coding DNA Sequence Number=SeqID_30800
  Subcellular localization annotation: CTP_CleavageSite=24; ConfidenceScore=5.25e-01
MLMQLASPCLFLLGFMQTSSTIFVQANNWGLSVFGIKELSAVFGPKTLLSCCCFVLKTMSQYQAWCLGGVFGRTSKASYKSSRGSLAHRKPEVSYIDLNEIYPTFYFSFDS

SEQ ID NO: 147579 - protein, 68 aa, Glycine max
  Coding DNA Sequence Number=SeqID_30801
MGTRLLVGWFRLWTLKSKREDQGVEFDLEFMTKEAGDEDYYNVGIVGVRRDHTHHSEELEAELRGCQR

SEQ ID NO: 147580 - protein, 77 aa, Glycine max
  Coding DNA Sequence Number=SeqID_30802
MPEPPTPAPANVDMPRHAVDACQRITDSLEHMINMRMIMTRNEAYTQTKPYLRLARGVTEQHHVYVQSRRRRDTQDK

SEQ ID NO: 147581 - protein, 166 aa, Glycine max
  Coding DNA Sequence Number=SeqID_30803
MGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 147582 - protein, 86 aa, Glycine max
  Coding DNA Sequence Number=SeqID_30804
MARRRMTIICLCVPPDTMASGWQKGVGNGHNLSPRVFGHDQAWVARRRMTIICLCVPPDTIASGWRKGVGNDHNLSPPSSRLIVPE

SEQ ID NO: 147583 - protein, 246 aa, Glycine max
  Coding DNA Sequence Number=SeqID_30805
  Homolog annotation: Hit_ID=O21999; Match level="QueryCoverage=26%, HitCoverage=41%, E-value=6e-25, Identity=87%"; Hit description=LacZ -alpha
MAPKKLFAKRSRRDAAAEGSSAAPEFDSHRFRSVEHQQRFEAIKGWSFHRERRVQLREDEYTDFQEEIARRHWTSLVTPTAKFDPEVVLEFYANAWPTEEGVRDMRSWVKGQWITFDADALSQFLGDPLVLEEGQECEFSQRRNRADGESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 147584 - protein, 162 aa, Glycine max
  Coding DNA Sequence Number=SeqID_30806
  Homolog annotation: Hit_ID=Q1SKD7; Match level="QueryCoverage=98%, HitCoverage=41%, E-value=2e-13, Identity=29%"; Hit description =Ankyrin
MAPKKLSMKRSRRDATGEGSSAAPKFDSHRFRSVDHQQRFEAIRGWLFHRERCVQLREDEYTDFQEEIARRCWTSLVTPMAKFNPEIVLEFYANAWPMKEGVRDMHSWVRGQWIPFDADALSQFLGEPLVLEESEQCEFSQRRNRPDGFDEEAIAQLLCISG

SEQ ID NO: 147585 - protein, 412 aa, Glycine max
  Coding DNA Sequence Number=SeqID_30807
  Gene Ontology: Mol. function=transcription regulator activity; Cellular component=nucleus; Biological process=regulation of transcription
  Homolog annotation: Hit_ID=Q5Z610; Match level="QueryCoverage=98%, HitCoverage=76%, E-value=3e-24, Identity=26%"; Hit description=Basic helix-loop-helix protein-like
  Pfam annotation: Domain name=HLH; Domain location=242-291; Score =34.1; E_value=4.9e-07; Accession=PF00010.16; Description=Helix-loop -helix DNA-binding domain
CVPGVAFRNQLPYIELQLLDLLRLTSTEIQTQFFKKQGLRYSFMIAVFMGCKNGEIELGFSNISQVIKKTILPSSSFCFMSLSTGSPDQCSSSLLLSSIPGTSQSHFPQTLPTQTHQQQSIQEIDLAPVIPSYFPTPDGEHEAIVRALMSVMSPLSSSSSTSQQHQPRQILPNYTSIVHPGATAFNTYRSDTMNPNITPYMGSNFRRQSPQNRSFAFFTNLNLMRMRELVSQPASRPISTQHQQHHMITERRRREKLNESFQALRALLPPGTKKAKGTILTTAKDTMRSLMDEIEKINLRNQQLMAVLSAKETTVSATSTEENKAKPSSSSSNERLNVLVSAVLESSSLSEERMVDVQVTLRGESSRVDVLIRLLEFLERVQNVNLVSMYANNHIIGGTTINQLTFRLRIIE

SEQ ID NO: 147586 - protein, 58 aa, Glycine max
  Coding DNA Sequence Number=SeqID_30808
MPCHISILWLSSQLLQEHGLWEVKHDVASGNTMLQCKKSEDVSVKKEEDIKRHKHFNL

SEQ ID NO: 147587 - protein, 198 aa, Glycine max
  Coding DNA Sequence Number=SeqID_30809
MTFLGETNSQTIVNSRLGFIFPNGSIIHNDSGVYFQTSTPVPIRVPNSCDFATLKTRIHITLNLTYEVFLDEIHYRQPVKETCNYFLFQCMQLKNDDDVNTMLMCNDQFSCVGPIELLCTIGRTLDEILNLLECTMTHTHDALLYYNGRWNMPRQNNFLGYAFTGKNPKKFEILSGCTIDELKDLIKQVAPKRIPVTP

SEQ ID NO: 147588 - protein, 74 aa, Glycine max
  Coding DNA Sequence Number=SeqID_30810
MELVTALPKDNNCLTTTTLEAIKDNGLSNKPLGSDCIILKVRLTIFNVPEQNDFQTRDRHISCGAQKNQVVVDF

SEQ ID NO: 147589 - protein, 419 aa, Glycine max
  Coding DNA Sequence Number=SeqID_30811
  Gene Ontology: Mol. function=hydrolase activity
  Homolog annotation: Hit_ID=UPI00005F9E3C; Match level="QueryCoverage =51%, HitCoverage=82%, E-value=7e-72, Identity=61%"; Hit description =COG3931: Predicted N-formylglutamate amidohydrolase
  Pfam annotation: Domain name=FGase; Domain location=26-226; Score =142.9; E_value=8.6e-40; Accession=PF05013.3; Description=N -formylglutamate amidohydrolase
  Pfam annotation: Domain name=PilZ; Domain location=329-415; Score =21.0; E_value=0.0041; Accession=PF07238.4; Description=PilZ domain
  Pfam annotation: Domain name=YcgR; Domain location=229-328; Score =45.7; E_value=1.6e-10; Accession=PF07317.2; Description=YcgR protein
  Pfam module annotation: Pfam domain module=FGase::PilZ::YcgR; Domain location=26-226::329-415::229-328
MPHSFIPPLLSADEPSAAAVEIPRGKAPFLLLCDHAGKAIPQSLGDLGLPPGEIERHIGWDIGALSVSRHLSRQLDATLIHQRYSRLVIDCNRAPGIASSIPHLSELTPIPGNIGIDAEHALAREREVFLPYHHAIDDHLGQRQLRELPTAVIAMHSFTPVFKGASRPWQVGLLFNRYPEFAHLLAELLREEGDLQVGINEPYAMTDATDYTLPKKSQERRVEHSDNGLFIKRERFEVLAILREICKQRTPLRVENQQHRFQSLLLSVGPDNIVFSGEEAENAIDGACTIVIESNDAKIEFSVGQAELTEHQGVQACSTRLPQELVYIQRRRQFRITTPHWRQFFCTGEYPNGTPYELRIHDLSAGGVGLRFDGPLPDFFQPGLQFKKAELDLGSYGSFKVNMELVVVNDDQETDDNDQ

SEQ ID NO: 147590 - protein, 90 aa, Glycine max
  Coding DNA Sequence Number=SeqID_30812
  Gene Ontology: Mol. function=acyltransferase activity; Biological process=metabolic process
  Homolog annotation: Hit_ID=Q6CZN2; Match level="QueryCoverage=87%, HitCoverage=14%, E-value=3e-31, Identity=78%"; Hit description =Putative acyltransferase
VLAQFAGDNYQEDLVRLKSLLSNIGCSIPTLYKQYTELCEPGGVQFIDFGTDPAFNNCIDGLVLVDTTRLKPSRYQRYIAVHQPQPAETA

SEQ ID NO: 147591 - protein, 111 aa, Glycine max
  Coding DNA Sequence Number=SeqID_30813
  Gene Ontology: Mol. function=serine-type D-Ala-D-Ala carboxypeptidase activity; Cellular component=periplasmic space; Biological process =proteolysis
  Homolog annotation: Hit_ID=Q13WX9; Match level="QueryCoverage=98%, HitCoverage=28%, E-value=3e-28, Identity=51%"; Hit description =Peptidase S11, D-alanyl-D-alanine carboxypeptidase 1
MTPRNVATANDVLKMVNHAYRYQSIRRFSTDKQQIVRPGRGQLVYRSSNGLINNPAWKIQLQKTGFTDEAGHCLVMRTTIKGQPVVMILLGAQSRYGHYRDAIRLKAWLEG

SEQ ID NO: 147592 - protein, 216 aa, Glycine max
  Coding DNA Sequence Number=SeqID_30814
  Gene Ontology: Mol. function=monooxygenase activity
  Homolog annotation: Hit_ID=Q1BW35; Match level="QueryCoverage=100%, HitCoverage=58%, E-value=3e-66, Identity=57%"; Hit description =Luciferase-like
  Pfam annotation: Domain name=Bac_luciferase; Domain location=1-214; Score=-65.1; E_value=0.00018; Accession=PF00296.11; Description =Luciferase-like monooxygenase
MAYALSILEKSPIADGESAAQALARTLHLAQQAERWGYRRFWLAEHHNTPQLACPSPEVLIGYLLGQTSRIRIGSGGVMLQHYSAYKVAENFNLLAALAPGRVDLGVGKAPGGLPLATQALQAAHDRQHKPAFPQQLSQLTAYLNDDAEPGLSATPLPPHGAQRFLLGASKESATLAAESGWIFVFAAHLNGNPQDISAALAHYAAHSGGRKALLA

SEQ ID NO: 147593 - protein, 67 aa, Glycine max
  Coding DNA Sequence Number=SeqID_30815
MSMQVQDMKSDRKKISCADEWWFSVTWMFMNHSDARGWVVRWQRGGEFGAVQRWNVLVMEVCLGEEG

SEQ ID NO: 147594 - protein, 60 aa, Glycine max
  Coding DNA Sequence Number=SeqID_30816
GLCWSFGVPVTPSKVIRLSITRAFIEKYCTPRQAQGNALQATDARDQCWKPQGPVKLIRV

SEQ ID NO: 147595 - protein, 58 aa, Glycine max
  Coding DNA Sequence Number=SeqID_30817
MGSIYCHTPTRKDCTVVWICVTPGQCLADYMEWFYMISHPFMSLTQPGDPPRHPACGA

SEQ ID NO: 147596 - protein, 118 aa, Glycine max
  Coding DNA Sequence Number=SeqID_30818
MALGFDGLQTYVGERFDSLERQVDTRFEEMNSRVAKVEEDVTIIRDCFDLPPPPPSGEIVEASFMMMNQAILMMPKAQVIDSRLQDQASRIQSKIQEKKSRLEVVLIAMPEMIHEYGS

SEQ ID NO: 147597 - protein, 356 aa, Glycine max
  Coding DNA Sequence Number=SeqID_30819
  Gene Ontology: Mol. function=threonine aldolase activity
  Homolog annotation: Hit_ID=UPI00006DC03E; Match level="QueryCoverage =95%, HitCoverage=93%, E-value=5e-36, Identity=31%"; Hit description =COG3616: Predicted amino acid aldolase or racemase
  Pfam annotation: Domain name=Ala_racemase_N; Domain location=1-232; Score=3.7; E_value=5.6e-07; Accession=PF01168.11; Description =Alanine racemase, N-terminal domain
DAARLQRNLQRMQQKADAAGVALRPHIKTHKSVWIAEQQRQLGARGITVSKPSEGVAFVLGGARDVLLAYPVVHAAALTELLQLAAQHQARITCIADCAAGVSAIAAAHQQQPDCALAIAIKVDVGLHRVGVDPHSDSALTLAQQIVASGLPFAGLISHAGHAYAAGHATAIAEVAQQEIALMRDLQRRLLDAGFVPCPISVGSTPTALAAPVAAGSDEIRPGNYALLDLTAWRLGLCEADALALTVVTRVVAVNPYYAIIDAGSKMLSSDKGPHGTNASGFGIAVDEHGHQYEVQKLSEEHGFLTYGEHAPAVGALLRIFPNHSCAVVAQSDRFVLRQADGSAGLHDIQGRGRFI

SEQ ID NO: 147598 - protein, 163 aa, Glycine max
  Coding DNA Sequence Number=SeqID_30820
  Homolog annotation: Hit_ID=Q2K7D9; Match level="QueryCoverage=70%, HitCoverage=86%, E-value=2e-19, Identity=39%"; Hit description =Hypothetical conserved protein
MLPSQTVTLTIPRNWLDLYETIWKPECFAKWASGLSSSTLTQEGQYWKAKGPEGTVKIRFTPYNPFGVMDHWIDTGSGKEIYMPMRVIANEQGAEVVMVVYRQPLMSDEKFAGDVAWNQCIIPPATLYPPLDAIAKKRHFFRAAVFNCFTARKAHFRTIHQSG

SEQ ID NO: 147599 - protein, 331 aa, Glycine max
  Coding DNA Sequence Number=SeqID_30821
  Gene Ontology: Mol. function=pyridoxal phosphate binding; Biological process=Mo-molybdopterin cofactor biosynthetic process
  Homolog annotation: Hit_ID=Q56208; Match level="QueryCoverage=96%, HitCoverage=98%, E-value=6e-57, Identity=40%"; Hit description =Molybdenum cofactor biosynthesis bifunctional protein [Includes: Molybdenum cofactor ...
  Homolog annotation: Hit description=biosynthesis protein C; Molybdenum cofactor biosynthesis protein B]
  Pfam annotation: Domain name=MoCF_biosynth; Domain location=179-321; Score=132.0; E_value=1.6e-36; Accession=PF00994.14; Description =Probable molybdopterin binding domain
  Pfam annotation: Domain name=MoaC; Domain location=11-146; Score =175.7; E_value=1.1e-49; Accession=PF01967.11; Description=MoaC family
  Pfam module annotation: Pfam domain module=MoCF_biosynth::MoaC; Domain location=179-321::11-146
MSGELNAAFHMADVRDKRITRRRAVAVGELHAGPVAYPLIVERRLPKGDALVMAEIAGLQGAKMASMLMPLCHPLPLELVQVFCTPVPERQAIRVWCECASEARTGVEMEALAGVNAALLTLYDLSKPVEPALRIEGIRLLFKEGGKRGVWLHPDGMDDAERTRFKPRAPKGLEGAACAVITLSDRASDGTYEDISGPTLVTGLKKLGGEVVAAEVLPDGIEPLAGRLQALAAEGVRLCLCTGGTGLGPRDLTPEALRSLNARPVHGLAQMVRALSAQHTPMAWLSRAEVVQLGNMLVFALPGSPKAAAQCLDILAPVLGHALAMVEGGGH

SEQ ID NO: 147600 - protein, 294 aa, Glycine max
  Coding DNA Sequence Number=SeqID_30822
  Homolog annotation: Hit_ID=Q0Z180; Match level="QueryCoverage=34%, HitCoverage=80%, E-value=9e-18, Identity=45%"; Hit description =Hypothetical protein precursor
MTATLAAPNPDTQGRPAFGAVGGGPLGPGQPAHPAAAGGICRAAALYRLDHPGGVAGGAHRAQPQPGRGGARADRGLGAEHCAGDLLSDPAAGGSIELNRLAAPVEGGEAADLTVVDGVDHQLQRARGFVAVGCETTSAIQCRHEHQVPVDAGGGRLGRQRLEAGHLVRQLVHAQHRRQGAALAAVMPVALVTGGRFGQLGAHEYEQQALRFSLLAGGMQQLLEIVHHHEGCHTPAARKAACCHNACRAGPKTIDLSHAHGTEGRVLWQSFQQARVSGPFRAQARRWSNKVDQP

SEQ ID NO: 147601 - protein, 616 aa, Glycine max
  Coding DNA Sequence Number=SeqID_30823
  Gene Ontology: Mol. function=4 iron, 4 sulfur cluster binding; Cellular component=molybdopterin synthase complex; Biological process=Mo-molybdopterin cofactor biosynthetic process
  Homolog annotation: Hit_ID=Q0C1X5; Match level="QueryCoverage=49%, HitCoverage=92%, E-value=3e-90, Identity=54%"; Hit description =Molybdenum cofactor biosynthesis protein MoaA
MYRPRVQGTQRLRGQVTRAQPGTTGTQAQAHALGGQGLQAARQWLDAIGQHLSGHHLAAQLFQAGHQGRARDILIGAVAGAIAQRDHRAGRALQALRRTRLETRALGIVHAVGVQPDTALAAFLEQQADAFDAQGRFHRLAQVVQGKQRRVDAGQCLHLHAGARLAGALAPHADRLPFRYRRAEHLHQFQRQRMAQRHQHRGHLGALQAGNLGHHQRIALGQAALDDQRIGHWTGMQLAHRHRTSAGDALVADIGHMEGRIQFPTHRVAHPPMEARCGAKLCGDACQQRVMVVVALQQRAQRHAELAEQAQPQVALGGHPQAVAALAEVARIRGDDADAAAMVRVAELARRTGIGGARPFVPASRQQLLDHHVGAQVVALEIGFVVAGAHQFDEAHAEGTIAQVVHPLRQLVVVQATQQHRVELDRRQAQRLRQGQALFDLRQAVMPGDGPEAFALQAVHAHVQRGQAGAVPPRQAPRQQRAVGGDGHLADARHRRHGGDDLIQVLAQAGLATRQADLAHAQRGKRTHQTRDFIHLQEARAAIGLVTVGQAVAATEVAGFGQRQAQVRKAASETVGELAHGWSTLLLHRLACARNGPDTLACWNDCQSTRPSVPWA

SEQ ID NO: 147602 - protein, 112 aa, Glycine max
  Coding DNA Sequence Number=SeqID_30824
MHEQRLTINSWGYGHDGGGYMNDNQFMGLRIRFDDGGLLGNQFPGFRTQWRRMHERRSIHGTPNKIRWWRMHEQRLTINSWGSGLDGGGFINGNQFMGLRIRFDGGGCTNSA

SEQ ID NO: 147603 - protein, 223 aa, Glycine max
  Coding DNA Sequence Number=SeqID_30825
  Gene Ontology: Mol. function=protein disulfide oxidoreductase activity; Cellular component=chloroplast; Biological process=cell redox homeostasis
  Homolog annotation: Hit_ID=Q7CL11; Match level="QueryCoverage=100%, HitCoverage=91%, E-value=1e-122, Identity=94%"; Hit description =Peroxiredoxin family protein
  Pfam annotation: Domain name=AhpC-TSA; Domain location=6-140; Score =26.2; E_value=3.3e-06; Accession=PF00578.11; Description=AhpCTSA family
  Pfam annotation: Domain name=Glutaredoxin; Domain location=173-223; Score=40.1; E_value=7.7e-09; Accession=PF00462.14; Description =Glutaredoxin
  Pfam annotation: Domain name=Redoxin; Domain location=5-163; Score =156.0; E_value=9.8e-44; Accession=PF08534.1; Description=Redoxin
  Pfam module annotation: Pfam domain module=AhpC-TSA::Glutaredoxin::Red oxin; Domain location=6-140::173-223::5-163
MFTSQEGKKVPQVTFHTRQGDQWIDVTTDDLFKNKTVIVFSLPGAFTPTCSSSHLPRYNELSSVFKQHGVDGILCVSVNDTFVMNAWKADQHAENITFVPDGNGEFTKGMNMLVEKADLGFGPRSWRYSMLVRDGVVEKMFVEPNKPGDPFEVSDADTMLKYLAPEFKVQESVSLFTKPGCPFCAKAKQMLQERGIQYEEIVLGKDATTVSLRAVSGRATVPQ

SEQ ID NO: 147604 - protein, 138 aa, Glycine max
  Coding DNA Sequence Number=SeqID_30826
  Homolog annotation: Hit_ID=Q84VH5; Match level="QueryCoverage=66%, HitCoverage=13%, E-value=2e-34, Identity=81%"; Hit description =Envelope-like protein
MLSQHPNILNYTDSVMKRESPLSLHYKLFEGTHVPDIVSTSGKAAASGAVSKDALIAELKDTCKVLEATIKATTEKKMELERLIKRLSESGVDDGEVAEEEEAAEQEEEEAEEEEEEADEEDAAEDTESNDDDSEATP

SEQ ID NO: 147605 - protein, 111 aa, Glycine max
  Coding DNA Sequence Number=SeqID_30827
  Subcellular localization annotation: CTP_CleavageSite=74; ConfidenceScore=5.48e-01
MSHVNEVIEVENMSSDSLPSSTSSPSTVSIPVRPSNVPPTPSPPLTDVRPSSSHLDACGLSPIPTSTPSSSLIVANMPINEDVSNLAMEDTPNDRPMITLINGVQVLQNLH

SEQ ID NO: 147606 - protein, 113 aa, Glycine max
  Coding DNA Sequence Number=SeqID_30828
MTKLGLCLSSGPPPLNDKRGANNHKVSPRIMGISAYHGCRMTKLGLCVPPDTTVSEWQRGADNRKVSPRIMGISAYHGCRMTKLGLCVPPDTTVSEWQRGADNRKVSPRTTSS

SEQ ID NO: 147607 - protein, 44 aa, Glycine max
  Coding DNA Sequence Number=SeqID_30829
RTREPRLARPQKGTLRQLATPLGNGNFDRQYFNNTHEALRLEMC

SEQ ID NO: 147608 - protein, 220 aa, Glycine max
  Coding DNA Sequence Number=SeqID_30830
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=4e-30, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYTSSPSEGYMPSPSNDYMSSPSKGYTPSPSEDYTSSPSGLHVLTFRGLHVLTFRGLHVLAFKGLHALTFRGLYAFTFRGLHVLTFRELHVLAFRGLHSLAFRGLQVLTFKGLHVLPFRGLHVLAIRGLQVLTIGGLHALAFRGLHALAFRGLHVLPFRGLHVLAIRGLHALNFRGLHVLGFRGLHVLTFRGLHIFAFRGLHICAFRGLKVLCP

SEQ ID NO: 147609 - protein, 70 aa, Glycine max
  Coding DNA Sequence Number=SeqID_30831
  Subcellular localization annotation: CTP_CleavageSite=22; ConfidenceScore=5.06e-01
MVKQQANNTFLLSSRGVIFGLQARKISNNSKSCTLIRLGLSYIFTSENGKQFIIPAIIKGVQSINHSNIA

SEQ ID NO: 147610 - protein, 202 aa, Glycine max
  Coding DNA Sequence Number=SeqID_30832
  Gene Ontology: Mol. function=catalytic activity; Cellular component =endoplasmic reticulum; Biological process=metabolic process
  Homolog annotation: Hit_ID=Q1T038; Match level="QueryCoverage=89%, HitCoverage=67%, E-value=1e-100, Identity=90%"; Hit description =Sterol desaturase
  Pfam annotation: Domain name=Sterol_desat; Domain location=1-144; Score=72.2; E_value=1.7e-18; Accession=PF01598.8; Description=Sterol desaturase
MVFSYPVFRYMGMRSSFPLPSWKVVLIQIIFYFILEDFIFYWGHRILHTKWLYKHVHSVHHEYATPFGLTSEYAHPAEILFLGFATIFGPAITGPHLITLWLWMVLRVLETVEAHCGYHFPWSLSNFLPLYGGADFHDYHHRLLYTKSGNYSSTFTYMDRIFGTDIGYRKLKALKSIGVEDNMAGVVYNVLMAVSGHSCPVN

SEQ ID NO: 147611 - protein, 863 aa, Glycine max
  Coding DNA Sequence Number=SeqID_30833
  Gene Ontology: Mol. function=protein binding; Cellular component =membrane; Biological process=defense response
  Homolog annotation: Hit_ID=Q1SWW3; Match level="QueryCoverage=99%, HitCoverage=98%, E-value=0.0, Identity=54%"; Hit description=Disease resistance protein
  Pfam annotation: Domain name=LRR_1; Domain location=571-592; Score =12.6; E_value=1.2; Accession=PF00560.23; Description=Leucine Rich Repeat
  Pfam annotation: Domain name=LRR_1; Domain location=594-616; Score =12.4; E_value=1.4; Accession=PF00560.23; Description=Leucine Rich Repeat
  Pfam annotation: Domain name=LRR_1; Domain location=618-640; Score =7.3; E_value=12; Accession=PF00560.23; Description=Leucine Rich Repeat
  Pfam annotation: Domain name=LRR_1; Domain location=750-772; Score =4.8; E_value=36; Accession=PF00560.23; Description=Leucine Rich Repeat
  Pfam annotation: Domain name=LRR_1; Domain location=774-796; Score =2.8; E_value=84; Accession=PF00560.23; Description=Leucine Rich Repeat
  Pfam annotation: Domain name=LRR_1; Domain location=798-820; Score =0.2; E_value=2.6e+02; Accession=PF00560.23; Description=Leucine Rich Repeat
  Pfam annotation: Domain name=LRR_1; Domain location=821-850; Score =1.5; E_value=1.5e+02; Accession=PF00560.23; Description=Leucine Rich Repeat
  Pfam annotation: Domain name=NACHT; Domain location=177-329; Score= -28.0; E_value=0.0088; Accession=PF05729.3; Description=NACHT domain
  Pfam annotation: Domain name=NB-ARC; Domain location=136-439; Score =283.7; E_value=3.4e-82; Accession=PF00931.13; Description=NB-ARC domain
  Pfam module annotation: Pfam domain module=LRR_1::LRR_1::LRR_1::LRR _1::LRR_1::LRR_1::LRR_1::NACHT::NB-ARC; Domain location=571-592::594 -616::618-640::750-772::774-796::798-820::821-850::177-329::136-439
MAEAVVEIVLEKLNSLIQKELGLFLGFDQDIKRIANLLTSIKATLEDAEEKKFSNRDIKHWLGKLKDAARILDDILDECGPSDKVQNSYLSSFHPKHVVFHYKIAKNMKMIREKLEKIANERTEFNLTEMVRERSGVIEWRKTSSVITEPHIYGREEDKDKIIEFLVDDASHYEDLSVYPIVGLGGLGKTTLAQLIFNHEKVVHHFELRIWVCVSEDFSLRRMTKVIIEEATGRAREDMDLEPQQRGLQDLLQRKRYLLVLDDVWDDKQENWQKLKSLLACGAPGASILVTTRLSKVAEIMGTIKIPHELSLLSDNDCWELFKHQAFGPNEVEHVELEDIGKEIVKKCGGLPLAAKELGSLLRFERKKNEWLNVKERNLLELSHNGNSIMASLRLSYLNLPIRLRQCFAYCAIFPKHEQIWKQQLVELWMANGLISSNERLDFEDVGDGIWNELYWRSFFQDIKKDEFGKVTSFKLHGLVHDLAQSVTEDVSCITDDNGGTVLIEKIHHLSNHRSRSDSIHLHQVESLRTYLLPHQHGGALSPDVLKCSSLRMLHLGQREELSSSIGDLKHLRYLNLSGGEFETLPESLCKLWNLQILKLDNCRNLKILPNSLILLKYLQQLSLKDCYKLLSLPPQIGKLTSLRSLTKYFVSKEKGFFLAELGALKLKGDLEIKHLGKVKSVKDVKEANMSIKPLNKLKLSWDKYDEEWEIQENVKEILEGLCPDTQQLQSLWVGGYKGDYFPQWIFSPSLMYLRIEGCRDVKALDEALQHMTVLHSLSLYYLRNLESLPDCLGDLPLLRELAIAFCSKLRRLPTSLRLQTLKTLRIWGCPDLEMETRHDSSKVAHFPEIRVNGYLIKVIFSP

SEQ ID NO: 147612 - protein, 89 aa, Glycine max
  Coding DNA Sequence Number=SeqID_30834
MVLQTPWTFKRHVSAYGNPAALCMQLPAASTYYSKISSQVIPVLLDLHVVELSSSHEPSEPTGANKDIGTSELTPEVSSNLEHLDRIEL

SEQ ID NO: 147613 - protein, 133 aa, Glycine max
  Coding DNA Sequence Number=SeqID_30835
MKSSKKKKGKGMREKQMILQQLMFLLKKREFRLRKQGPSNLPATLILRKLLRTPEKWLLRNVLKHSLRFFNNAYEEIKASAKEDREKLATARNECKKLKELVIQYEAPLTQAEKSKEELENNLEIFHLRRNQI

SEQ ID NO: 147614 - protein, 403 aa, Glycine max
  Coding DNA Sequence Number=SeqID_30836
  Gene Ontology: Mol. function=cyclin-dependent protein kinase regulator activity; Cellular component=nucleus; Biological process =regulation of progression through cell cycle
  Homolog annotation: Hit_ID=Q8GVE0; Match level="QueryCoverage=83%, HitCoverage=99%, E-value=1e-104, Identity=60%"; Hit description =Cyclin D1
  Pfam annotation: Domain name=Cyclin_C; Domain location=245-377; Score= 58.8; E_value=1.8e-14; Accession=PF02984.9; Description=Cyclin, C -terminal domain
  Pfam annotation: Domain name=Cyclin_N; Domain location=111-243; Score= 138.9; E_value=1.4e-38; Accession=PF00134.13; Description=Cyclin, N -terminal domain
  Pfam module annotation: Pfam domain module=Cyclin_C::Cyclin_N; Domain location=245-377::111-243
MGMIVTTKYISHSKENEGRDLYLSSTATLSFSTVTHTSGDFSDRFPAKPHRKPWPENEPPPIAMSVSCSNCFPDDDDSFLLCGEDSSGIIDSSPECSSDLDSPPPSEAEAESIAGFIEDERNFVPGFEYLNRFQSRSLDASAREESVAWILKVQAYYAFQPLTAYLSVNYLDRFLNSRQLPQTNGWPLQLLSVACLSLAAKMEEPLVPSLLDLQVEGAKYVFEPKTIRRMELLVLGVLDWRLRSVTPFSFLDFFACKLDSSGTFTGFLISRATQIILSNIQEASFLAYWPSCIAAASILHAANEIPNWSFVRPEHAESWCEGLRKVEKVIGCYQLMQELVINNNRRKPPKVLPQLRVTSRPIMRSSVSSFSASSSFSPSSSLSCKRRKLNNSLWVDDDKGNSK

SEQ ID NO: 147615 - protein, 123 aa, Glycine max
  Coding DNA Sequence Number=SeqID_30837
MTTSGRRSSGSYEGQFWKKCFRKLLPEDLLPEFAFVTSRRSSSGMYNGIILNDLGVVNFWMWLYDNLNVLVYDAYVLKMDEDQWRYDFAMSQEVHMDYDYDNQEECGVNEPHVDCSNAFNTSQ

SEQ ID NO: 147616 - protein, 175 aa, Glycine max
  Coding DNA Sequence Number=SeqID_30838
  Subcellular localization annotation: CTP_CleavageSite=54; ConfidenceScore=5.31e-01
DDASWLDPGAPTEGAGGPSNAGNGAGAVRFLLFFVFFLDLGARTSTLGATTGVRVVGVSAREKLTGTGVGGELTKIDAGGELTSVTAGGVVVGGVATGGVATRGVVVGARATTLDGGDAIVGDETGGVAIAALGDEAGGDEVGEATNTIDFGLEGVVAGMLSTLFFKYKYLKIKI

SEQ ID NO: 147617 - protein, 418 aa, Glycine max
  Coding DNA Sequence Number=SeqID_30839
  Homolog annotation: Hit_ID=Q6Z867; Match level="QueryCoverage=35%, HitCoverage=56%, E-value=7e-26, Identity=40%"; Hit description=RNA recognition motif (RRM)-containing protein-like
EEEFDDDDDEEEGMLPLDDMNKWFEKKPRGFGEGKVYDTSVEDKLLEEMRQSRIAQAENLTKLKSNPVKHASNESVQKKKDSELVPIGGRVCLVNLPKKKNIHKDLKSALQGIPGITNIVPAVTGNKKTRDPICKGFAYVDFECEEDAIRFVELYTGQAITFGKIQKQIKCELLNVQSSSSSLKLSKNLNAAPQLVARFEEVSNEDSNLDGSALSSWDEANSSDDLDDLDYQMNGEEQEDDEDNQESVSTLGVDHDDSVEMRIDPEICSLPSEQVDRNHAAEQKSSAKVKQENARKKKPTSKDRDKKVLGVPGSSRRLKIREKAVLSDVFSKSMLPGDVCEKVDRVCSMASLPMEVAKWLNANYDSSWKPTKLRVEVVQLVTGYCSINHPLHFLVQDFRNLSQLSEGFIIKHIPRDQD

SEQ ID NO: 147618 - protein, 129 aa, Glycine max
  Coding DNA Sequence Number=SeqID_30840
  Homolog annotation: Hit_ID=Q9FNY4; Match level="QueryCoverage=49%, HitCoverage=12%, E-value=3e-10, Identity=48%"; Hit description=DNA polymerase lambda
MGLPLDLKERSIAWGYPAALIFEYIMGIWSDLYREAKAFQFHWRIKCNLLEQGLSQLIQCRLKQQAESKGFRFDDTRLFPSTQPSGGKWGAKGSASLKFYTEKEIFDFLDLPWLEPHEEISKYVNGLQV

SEQ ID NO: 147619 - protein, 457 aa, Glycine max
  Coding DNA Sequence Number=SeqID_30841
  Gene Ontology: Mol. function=transferase activity, transferring glycosyl groups; Cellular component=cytoplasm; Biological process =metabolic process
  Homolog annotation: Hit_ID=Q947K4; Match level="QueryCoverage=96%, HitCoverage=95%, E-value=1e-126, Identity=50%"; Hit description =Thiohydroximate S-glucosyltransferase
  Pfam annotation: Domain name=Glyco_transf_28; Domain location=11-144; Score=-17.1; E_value=0.085; Accession=PF03033.10; Description =Glycosyltransferase family 28 N-terminal domain
  Pfam annotation: Domain name=UDPGT; Domain location=9-457; Score= -23.5; E_value=1.9e-09; Accession=PF00201.9; Description=UDP -glucoronosyl and UDP-glucosyl transferase
  Pfam module annotation: Pfam domain module=Glyco_transf_28::UDPGT; Domain location=11-144::9-457
MAEQRQNNVHVLVLPYPAQGHINPLLQFAKRLASKGVKATVATTHYTANSINAPNITIEAISDGFDQAGFAQTNNNMQLFLASFRTNGSRTLSLLIKKHQQTPSPVTCIVYDSFFPWALDVAKQNGLYGAAFFTNSAAVCNIFCRIHHGFLQLPVKTEDLPLRLPGLPPLDSRSLPSFVKFPESYPAYMAMKLSQFSNLNNADWIFVNTFQALESEVVKGLTELFPAKMIGPMVPSSYLDGRIKGDKGYGASLWKPLAEECSNWLEAKAPQSVVYISFGSMVSLTAEQVEEVAWGLKESGVSFLWVLRESEHGKLPLGYRELVKDKGLIVTWCNQLELLAHQATGCFVTHCGWNSTLESLSLGVPVVCLPQWADQLPDAKFLDEIWDVGVWPKEDEKGIVRKQEFVKSLKVVMEGERSREIRRNAHKWKKLAREAVAEGGSSDNHINQFVNHLMNLI

SEQ ID NO: 147620 - protein, 147 aa, Glycine max
  Coding DNA Sequence Number=SeqID_30842
  Gene Ontology: Mol. function=protein binding; Biological process =defense response
  Homolog annotation: Hit_ID=Q1SWV1; Match level="QueryCoverage=70%, HitCoverage=9%, E-value=2e-26, Identity=55%"; Hit description =Disease resistance protein
MALAKLKCCNLIPNNFRSSFHGSGKFVSQEAAKPNKDLWIVSCKEVEGLHEALQHITNLKKLRLESLPNLEFLPDCIGNLPLLRQLHIWNCDKLTCLPPSLSLLSSLKELMIWGCHPELEKRCEKEMGEDWPKIAHVPCVEVISWRQ

SEQ ID NO: 147621 - protein, 477 aa, Glycine max
  Coding DNA Sequence Number=SeqID_30843
  Gene Ontology: Mol. function=protein binding; Cellular component =membrane; Biological process=defense response
  Homolog annotation: Hit_ID=Q1SWV1; Match level="QueryCoverage=79%, HitCoverage=59%, E-value=6e-45, Identity=43%"; Hit description =Disease resistance protein
  Pfam annotation: Domain name=NB-ARC; Domain location=62-297; Score =56.7; E_value=6.7e-14; Accession=PF00931.13; Description=NB-ARC domain
MAGAVLEIAHENLKSCTTMIRDQRDDGLLLGFDGDMEMFDSLFTAIKPYSQIYELDDILDYWVNQVLRLKHQEVKSNLLVKLQSSFLLSLHPSQGGLGKTTLAQLIFNHGMVVNHFESRIWAYVSENFDLMRVTKDIIEAASGCVCENLDIGLLQRKLQDLLQRKGYLLVLDDVLSERSKVAIVMGTMPPHELSMLSHNACWELFKHQAFVSNEVQEVGLERIGKEIVKKCGGVPLAAKVLGGLEFLNACPYIKLLAFTIKSQTMSYCAIFPKDEIIRKQELIEFWMANGILKQMNLAKSQVVAEEEEGLCMAELKLLKLKGDLHIKHLEKVKSVMDASKASMSRYNGVHFPQWMSSSPSLKYLELEDRKVCSQLPELGKLLFLKTMHVYNMIHVKHLFEESYDGGVVFMAIENLSLEKLPNLTRLSRDDGENMFPHLSKLEITECPKLSGFPSLPSINDLHIQGRGLATHSSHPHY

SEQ ID NO: 147622 - protein, 45 aa, Glycine max
  Coding DNA Sequence Number=SeqID_30844
MHRREVPMEKGTSLPMEKGFKILLFPIIDSLGNPLRIFTVFPSTI

SEQ ID NO: 147623 - protein, 68 aa, Glycine max
  Coding DNA Sequence Number=SeqID_30845
MAEDGGARWMMATTINKEFDRWIMMWKAECEYCMAMEETSNEENECRWDLRWWLFIAENVNYRMNDKT

SEQ ID NO: 147624 - protein, 56 aa, Glycine max
  Coding DNA Sequence Number=SeqID_30846
MVVLLGTIDVGKFNTAEIDFVADPPSTDRTVKVLADEGAPLPEIIFGDDYRWSAAE

SEQ ID NO: 147625 - protein, 121 aa, Glycine max
  Coding DNA Sequence Number=SeqID_30847
  Gene Ontology: Cellular component=extracellular region; Biological process=cellulose and pectin-containing cell wall organization and biogenesis
  Homolog annotation: Hit_ID=Q9FL80; Match level="QueryCoverage=99%, HitCoverage=43%, E-value=8e-39, Identity=61%"; Hit description =Expansin-A22 precursor
  Pfam annotation: Domain name=Pollen_allerg_1; Domain location=28-106; Score=133.2; E_value=7.3e-37; Accession=PF01357.11; Description =Pollen allergen
MFTKIAIYKAGIIPVMYRRVPCNKSGGVKFEMKGNPYWLLVLLYNVGNAGDVTQVSIKGSSNTGWQSMSRVWGQNWVTGSNLVGQALSFQVTTSDGKMLEFDNVAPSNWQFGQSYETYQNF

SEQ ID NO: 147626 - protein, 152 aa, Glycine max
  Coding DNA Sequence Number=SeqID_30848
  Gene Ontology: Mol. function=transferase activity, transferring glycosyl groups; Biological process=metabolic process
  Homolog annotation: Hit_ID=Q9FUJ6; Match level="QueryCoverage=98%, HitCoverage=60%, E-value=5e-13, Identity=35%"; Hit description=UDP -glucosyltransferase HRA25
EIQLLPNSPMMDTANLPWCSLGKNFFLHMVEDTQSLKLGEWWLCNTTCDLEPGALAMWPSLAIVEPNQFNELAIGLDLLNKPFLWVVRPSNENNKVGLGLDQDENGLIMKGEIRKKVEQLLGNEDIKARSVKLKELTVNNFDEGGQSSQNIE

SEQ ID NO: 147627 - protein, 448 aa, Glycine max
  Coding DNA Sequence Number=SeqID_30849
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=98%, HitCoverage=98%, E-value=1e-122, Identity=47%"; Hit description=UDP -glucosyltransferase HRA25
  Pfam annotation: Domain name=UDPGT; Domain location=4-448; Score= -91.9; E_value=5.4e-06; Accession=PF00201.9; Description=UDP -glucoronosyl and UDP-glucosyl transferase
MTIPHFLLIPYPVLGHVNPLIHLSQILVKHGCNITFLNTEFSHKRLNNNTGSGSGLDNLKTSGIKFVTLPDGLSPEDDRSDQKKVVLSIKTNMPSMLPKLIHDVNALDVNNKITCLVVTLSMTWALKVGHNLGIKGALLWPASATSLAMCDFIPKLIHDGVIDSYGVPIRRQEIQLSPNMPMMDTENFPWRGHDKLHFDHLVQEMQTMRLGEWWLCNSTCNLEPAAFFISPRLLPIGPLMGSESNKSSFWEEDTTCLEWLDQQLPQSVVYVSFGSMAVMDPNQFNELALGLDLLDKPFIWVVRPSNDNKVSINEYPHEFHGSRGKIVGWAPQKKILNHPALACFMSHCGWNSTVEGVSGGIPFLCWPFAKDQHVNKSYVCDVWKIGLGLDKDENGIISKGEIRKKVEKLLLDEDIKARSLKLKESTMNNIGKFGQSTKNLEKFINWAK

SEQ ID NO: 147628 - protein, 587 aa, Glycine max
  Coding DNA Sequence Number=SeqID_30850
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=99%, HitCoverage=96%, E-value=1e-119, Identity=48%"; Hit description=UDP -glucosyltransferase HRA25
  Pfam annotation: Domain name=UDPGT; Domain location=2-420; Score= -120.5; E_value=0.00015; Accession=PF00201.9; Description=UDP -glucoronosyl and UDP-glucosyl transferase
QGHVNPLMQFSQLLAKHGCKVTFVHTEFNHKRAKTSGADNLEHSQVGLVTLPDGLDAEDDRSDVTKVLLSIKSNMPALLPKLIEDVNALDVDKKITCIIVTFTMSWALEVGHRLGIKGALLCPASATSLASVACIPKLIDDGIIDSQGLPTKKQEIQLSPNMPTMNTQNFPWRGFNKIFFDHLVQELQTSELGEWWLCNTTYDLEPGAFSISPKFLSIGPLMESESNKSSFWEEDTTCLEWLDQQQPQSVIYVSFGSLAVLDPNQFGELALALDLLDKPFIWVVRPSNDNKENANAYPHDFHGSKGKIIGWAPQKKILNHPALACFISHCGWNSTLEGICAGVPFLCWPCATDQYLDTSYICDVWKIGLGLDKDENGIILREEIRKKANQLLVDEDIKARSLKLKDMIINNILEGGQSSKNLNFFMDWANSAVIDHNKLKELALGLDFLDTSFLWVVGPSNDNEVNNAYFDEFHGSKGRIVGCTPQKKILNHPAIACFISHCGWNSTIEGVCGGVPFLCWPLAQDQFVNKSHICDVWKVGLGLDKDENGFISKGEIRKKVEQLLGDDCIKARSLKLKELTLNNTVEG

SEQ ID NO: 147629 - protein, 368 aa, Glycine max
  Coding DNA Sequence Number=SeqID_30851
  Gene Ontology: Mol. function=double-stranded RNA binding; Cellular component=intracellular
  Homolog annotation: Hit_ID=Q5IZK7; Match level="QueryCoverage=33%, HitCoverage=55%, E-value=2e-10, Identity=33%"; Hit description=DsRNA- binding protein LH2
  Pfam annotation: Domain name=dsrm; Domain location=138-177; Score =16.4; E_value=0.029; Accession=PF00035.15; Description=Double -stranded RNA binding motif
  Pfam annotation: Domain name=dsrm; Domain location=53-119; Score =46.2; E_value=1.1e-10; Accession=PF00035.15; Description=Double -stranded RNA binding motif
  Pfam module annotation: Pfam domain module=dsrm::dsrm; Domain location=138-177::53-119
  Subcellular localization annotation: CTP_CleavageSite=73; ConfidenceScore=5.71e-01
MDTPQFNASSSNISPSPSPQQPSPPIPVAYQPQSQPLSSSSASLPPGLPDAPYKTRLQSFTQKCNISLPMYINVNEGRQHDPKFRSTVWVDGMKYTSPNTFSRLRAAEADVARMALENLHVKFKTKERPVTHENTTLSKSILHEYAAKLKGTTYVGDAARSKKEAEQLAARNAITSILDGATSGLLYETIKSKYSTFGAVRSTKSECINASSATVKHVPSLVAVPVAANGNETKVALPVPSFNQECQMREHVSSVQAITITEVPNLNLLPGPEQSTAGVSCELSIGIGSGALSIGDGSRELSVGDGSGSKKRKRNKSKANKKLTIKAFSLSRIASYSVPQEHVKVINDHFGLLHRQQHSRESGELYRI

SEQ ID NO: 147630 - protein, 127 aa, Glycine max
  Coding DNA Sequence Number=SeqID_30852
  Gene Ontology: Mol. function=alpha-amylase activity; Cellular component=cellular_component; Biological process=carbohydrate metabolic process
  Homolog annotation: Hit_ID=Q0QJL6; Match level="QueryCoverage=47%, HitCoverage=37%, E-value=1e-16, Identity=62%"; Hit description =Putative alpha-amylase
MGAVLLPDAAFGIFPRFSIVPRHPLICRTTSTTSIRKSYNLIMLEKEKNGFNISFYFQGHWAFPQDKLMQEYAYILTHPGTPTIFYDHFYDFGIHDVMTELIEARRRARIHCGSSIKIYTMQTMKVM

SEQ ID NO: 147631 - protein, 153 aa, Glycine max
  Coding DNA Sequence Number=SeqID_30853
MGVSEKVFQSDYPGSKNSRFKTDFPKTDPQREYETLKRTCDMQNWRRETFALNPLMVVGRRRELEKKRKIGKQGALREEEKNGWKSLHLRLLREKEEERIDGFFKKWKVQDSSPHHKTNGFENYFSPRVPLSSPYPPSSNPEPGYGSDHSPQM

SEQ ID NO: 147632 - protein, 567 aa, Glycine max
  Coding DNA Sequence Number=SeqID_30854
  Gene Ontology: Mol. function=RNA binding; Cellular component=nucleus
  Homolog annotation: Hit_ID=Q32SG0; Match level="QueryCoverage=94%, HitCoverage=83%, E-value=1e-103, Identity=44%"; Hit description=KH -domain protein
  Pfam annotation: Domain name=Extensin_2; Domain location=197-503; Score=-129.3; E_value=0.029; Accession=PF04554.4; Description =Extensin-like region
HKIQDELIIAREIVINDAESSVRYKLTKRQTQEEIQRCTGAIVITRGKYRLPNAPHDGEKPLYLHISAGAHIKETAERILAVDRAAAMIEEILKQVQNSQSISSVTPSALVNGVKMLSTCVFLGFDADPSLNIVARIRGPNDQYINHIMNETGATVVLRGRGSGNNECLNGEDGQQPLHLFLSSNNAKSLEDAKLLAENLLDTICTECGASSAVPPPQQAYTAVPPPQQVYSAVPPPQQVYSGPSLLKQIPAAISPPQVYSAVPPPQQLLTGVQSSGIDLEAGASLITSSMSAAGVLTPVPPASLVGVTGVTGALTLGTTPQSIRHLSSGPQANMTGYTPPPLVSGGTSYIGYGGLYPQATPLQQVALALRHSPPVASTVAPTTSASNRGSKSTLSSDLEKEKRPPQRRKFQELPVGSKDTTKLNQVCGMVNVSKLTDLIAMNLPTGGMERLQPLKTNEQSDGPVVRNISTMPAPKKLVQPSSNGMPPPLLRTMPPPPPPPKFCGPSEVKVQAKNKTLLKTKSDAVPDTLVKLMEYGEEDDDDIDSSEESLPHDAGATGVQKPFWAL

SEQ ID NO: 147633 - protein, 116 aa, Glycine max
  Coding DNA Sequence Number=SeqID_30855
ELFTHREGINIPCACHKGRKPLIECAQLNKGVALAPTYPRKKPFGVGDARPGEPEASLGELGSRKFQKNSQFTLFLVVFVPESDNQTSIQAIPRPCVATGAKHRDLVINDENITPG

SEQ ID NO: 147634 - protein, 95 aa, Glycine max
  Coding DNA Sequence Number=SeqID_30856
MCVPCSRLPSLAPKAKSSRKYLRSIRLRQERGLRTIGRIELAYGRIEVRATRFLDLAQFLTKLHKISSTSSDMDNRSKEQLCACKVYVAGHLALG

SEQ ID NO: 147635 - protein, 693 aa, Glycine max
  Coding DNA Sequence Number=SeqID_30857
  Gene Ontology: Mol. function=transmembrane receptor activity; Cellular component=exocyst; Biological process=exocytosis
  Homolog annotation: Hit_ID=Q9FNR3; Match level="QueryCoverage=93%, HitCoverage=95%, E-value=1e-129, Identity=40%"; Hit description =Leucine zipper protein-like
  Pfam annotation: Domain name=Exo70; Domain location=100-682; Score =381.2; E_value=1.6e-111; Accession=PF03081.6; Description=Exo70 exocyst complex subunit
GCIGCGEGSVEVDFGVEKESEPVIGELEREENLIAAVRHIVKALGPNKTLTSDAKKILADLGTRLSSMSIRSEKDEGKQGQGEDGGDDHDGSDDLHDDYDDDEGVSAIEERLNVIQEKIMRWEEDQSMIWDLGPMEASEYLNAANEARRLIEKLESLHLKKEDQEYKCMQRAYSVLQTAMARLEEEFRNLLIQNRQRFEPEYVSFRSNEEDAADENSIVSLGDELVEESLQRDSVSRAYEEHIIDLVHPAVIPDLRCIANLLFASNYVQECSNAYIIVRRDALDECLFILEMERLSIEDVLKMEWGTLNSKIKRWIWAVKIFVRVYLASERWLSDQIFGEGEPVGLSCFVDASKASMLQLLNFGEAMSIGPHQPEKLFRVLDIYEVLQDLMPDIDALYSDEVGSSVKIECHEVLKRLGDCVRVTFLEFENAIATNVSSTPFVGGGIHPLTKYVMNYLRALTDYSDILNLLLKDQDEDAISLSPDMSPGTEEDNRSQGSPSRVSSMALHFRSIASILESNLEEKSKLYKEVSLQHLFLMNNLHYMAEKVKGSELRLVHGDEWIRKHNWKFQQHAMKYERASWSSILNLLKDEGVFVPGITSVSKSLVKERLRSFYLGFEDVYRIQTAWIIPDFQLREDLRISISVKVIQAYRSFVGRFSSYTSDKIIKYSPDDLENYLLDFFEGSQKLLQNPHR

SEQ ID NO: 147636 - protein, 57 aa, Glycine max
  Coding DNA Sequence Number=SeqID_30858
MEPMKEWPTTSTYIKNGGIKSKKMQKIRKKDEGLSISPSPRRAQRAACAKCENWYLH

SEQ ID NO: 147637 - protein, 131 aa, Glycine max
  Coding DNA Sequence Number=SeqID_30859
  Gene Ontology: Mol. function=serine carboxypeptidase activity; Cellular component=cellulose and pectin-containing cell wall; Biological process=proteolysis
  Homolog annotation: Hit_ID=Q9SGA9; Match level="QueryCoverage=81%, HitCoverage=22%, E-value=1e-52, Identity=86%"; Hit description =Putative serine carboxypeptidase II
  Pfam annotation: Domain name=Peptidase_S10; Domain location=1-121; Score=-167.5; E_value=0.00022; Accession=PF00450.12; Description =Serine carboxypeptidase
DFSHWSGYDPCTEKYAEIYYNRPDVQKALHANKTGIPYRWTACSEVLNRNWNDTDVSVLPIYRELIAHGIRVWVFSGDVDSVVPVTATRYALAQLKLSTKIPWYPWYVKNQLLPVLNFIHPCEAELRFGPT

SEQ ID NO: 147638 - protein, 146 aa, Glycine max
  Coding DNA Sequence Number=SeqID_30860
MVGYMPLSFAGLVFAGERIEVGLRGKFDYAALTSSSNRRLGAGGAKKKERDAHIGTAVPTWPSSPQTPYNPMYQYPPHQYNYLANIDGRQRRRGEGMHHPLGNKTWKKELHHQECALDQKLEGDVLMEEKKERTGDHKIEGIKEGE

SEQ ID NO: 147639 - protein, 380 aa, Glycine max
  Coding DNA Sequence Number=SeqID_30861
  Homolog annotation: Hit_ID=Q8LPL2; Match level="QueryCoverage=27%, HitCoverage=18%, E-value=1e-20, Identity=48%"; Hit description =Putative transport protein
THLSVDWEDEKSKKYYDKYALMLTIHVGNHLSEKCIPPCHVLEALLAPGSELWMFNEGALLFWLKAMICQLSPTCDQIAKSCSSPTTTQLAFLYVSYGLMAIGTDGVKASSLAFGMDQLCRKEKDAAIIESYFNWSYASGLVAVLFGITILVYLQENLGWKRWNDKDRFIAVMGVKGKPSCNARIPIPLTGITTGLLQFQTWRYLNMHNLWVQGIIGMIVSVVVDVVVGIGVLLALLLYVKIRQRKRMVRAVEGSLVAFRYQDLQNETMNFSEKLGEGGFGSVFKGTLGDTSVVAVKKLESTSHVEKHFQMETTKLGKHNNMLPEETIVALPEAKCVDGVTQAQIDGCQRTLGNSEYRREGNRSHYEKGTFFRKHNQDMA

SEQ ID NO: 147640 - protein, 140 aa, Glycine max
  Coding DNA Sequence Number=SeqID_30862
  Gene Ontology: Mol. function=dihydrolipoyl dehydrogenase activity; Cellular component=cytoplasm; Biological process=cell redox homeostasis
  Homolog annotation: Hit_ID=Q1T0D6; Match level="QueryCoverage=56%, HitCoverage=15%, E-value=3e-11, Identity=47%"; Hit description =Pyridine nucleotide-disulphide oxidoreductase, class I
MEDPTPPNLDLTKKEGRGDDVCEKRRCGETMCDQLKFHHHRCFRSDYVCENFSMLMVGATNGRDDGLKTTIVEGDAVEETCVNRDCVPSRALLAMSGRMRELKSMEVWNTLMCWISSLNSEDKQSPIEEAFQIWVLFFKR

SEQ ID NO: 147641 - protein, 216 aa, Glycine max
  Coding DNA Sequence Number=SeqID_30863
MEVAYTCSDEKDAQNKEKKKKKEEEGGKERIKKNLHTYSLVLFIRSGKSLKSRAGDQLPQIGKEEAQKAKTSILLRVWKLLKFKTPWLGERKYREWRRKKEEPSQKAEEVTTDAQNAPKVEVGDRTPVGAMKDLVFNTKIFRNLFNSPLINTSVKIACGLGPILGEPFTFSIHFPPLPTESIAKEPSRIQKDVPHVHIPTPHVDGTTIVAIALYLG

SEQ ID NO: 147642 - protein, 158 aa, Glycine max
  Coding DNA Sequence Number=SeqID_30864
MEPKEIAIYKEAMLQFVIKASLKDHEDYIVETNPSVDCVYPKPVFTDDDKLVEFAWSQEIDANKLRCLEEVFGAKESVSMEDMVTKINKPLNGYFLQDHCLHLHRLHLLSSMLTSDYILASKVIESWSDGLVTGSRRRMRNKTILQGSLAQVRYRLLK

SEQ ID NO: 147643 - protein, 74 aa, Glycine max
  Coding DNA Sequence Number=SeqID_30865
  Subcellular localization annotation: CTP_CleavageSite=28; ConfidenceScore=5.04e-01
MLVCNSAYLSAKYKDMNATPCSVANWILSSSSSSTLLTSILEQQLPLCSKGVKPIWVRVERYEVEGLKRVNVEG

SEQ ID NO: 147644 - protein, 42 aa, Glycine max
  Coding DNA Sequence Number=SeqID_30866
MTLLQQQGSSTYNSSQVNQIVTMTGSGHALIGCTDPIDDWYG

SEQ ID NO: 147645 - protein, 140 aa, Glycine max
  Coding DNA Sequence Number=SeqID_30867
MTKAYTKTTLCKSISKALPPGMIKQLLLFHPFGRFYYFNITAHTIRSEDPRTKQLTKNKLHKNANGELRRNSHHSHHNLFEIVLDIPHVRDGLRAEYECNPRAQFVLISQTTEKKERKSVNVSKRRLCCEIDGEEVLRNS

SEQ ID NO: 147646 - protein, 87 aa, Glycine max
  Coding DNA Sequence Number=SeqID_30868
  Subcellular localization annotation: CTP_CleavageSite=31; ConfidenceScore=5.42e-01
MITSRHRQKGVGKATKQRQRHVVLFTSMRAYASKKMCVRMRWWFFKTLSMAQCRSVEGRFVGYWLERFSLMGLITNYFGPPRPGKQS

SEQ ID NO: 147647 - protein, 103 aa, Glycine max
  Coding DNA Sequence Number=SeqID_30869
  Gene Ontology: Mol. function=DNA binding; Biological process=DNA integration
  Homolog annotation: Hit_ID=Q2HSF6; Match level="QueryCoverage=86%, HitCoverage=7%, E-value=2e-22, Identity=54%"; Hit description =Glycoside hydrolase, family 1; Zinc finger, CCHC-type; Polynucleotidyl transferase, Ribonuclease H fold
MDEARPTATSTHPSIIIGKDEKGNNTPEKKYRAMIGSLLYLTASRPNIVFIVCLRARFQSCPKVSHVTNHGLWLKKESDFDLVGYCDVDFDETKHNCPTNLRN

SEQ ID NO: 147648 - protein, 293 aa, Glycine max
  Coding DNA Sequence Number=SeqID_30870
  Gene Ontology: Mol. function=DNA binding; Cellular component =chromatin; Biological process=DNA integration
  Homolog annotation: Hit_ID=Q1S785; Match level="QueryCoverage=80%, HitCoverage=33%, E-value=9e-58, Identity=45%"; Hit description =Integrase, catalytic region
MQECLLHNKRKVLWFFDSGCSWHMTGDKRKFLNLEKRKGEGFVAFGDKRKTLIKGVAYRIYSLRTQVVEKSIHVVFDEHDNTLEKRRITDQQEELERTRINKRTNQFIKNKFWNLVPPLKNQSVIGTKWVFKNKLNEEGEAIRNKARLVAQGDNQQQGIDYEETFALVARLEAIRILLAYAAHKDIKLYQMDVKSAFLNGFINEVYVKYPLGFEDKEKPQHVYKLVKALYGLKQAPRPWYCGSNAFQVYFDDVKDSSQESTVKQVSRIKDSFNQSKFQESKSRSIKASFKNQD

SEQ ID NO: 147649 - protein, 84 aa, Glycine max
  Coding DNA Sequence Number=SeqID_30871
MKVKEYATKHIQSQYKNKLHHLHQAYLKEKDRPKFVSWNWLIKNKLNCSKFQERSLTNKANRSNQEIKSIIGTKSIKQKTFEMD

SEQ ID NO: 147650 - protein, 121 aa, Glycine max
  Coding DNA Sequence Number=SeqID_30872
MESSLAMRCSSRFDVCVCGSCEGGVKGDEGWFCWSKEGHEITVEQLVQLLEQGVGVGKRAQVLGLTRGPGTGPFDPRGPWGEGGLIYLVRVRSGADWPGPLPMRAYAGRPYTGRAGPLTLP

SEQ ID NO: 147651 - protein, 230 aa, Glycine max
  Coding DNA Sequence Number=SeqID_30873
  Gene Ontology: Mol. function=DNA binding; Cellular component=oxygen evolving complex; Biological process=DNA integration
  Homolog annotation: Hit_ID=Q0KIN0; Match level="QueryCoverage=63%, HitCoverage=9%, E-value=6e-39, Identity=60%"; Hit description =Integrase core domain containing protein
  Pfam annotation: Domain name=DUF1605; Domain location=54-209; Score =3.0; E_value=0.059; Accession=PF07717.6; Description=Domain of unknown function (DUF1605)
MKDLDPLKYFLGIEVAQSTSCIAISQRKYVLGILIEIGMLNCRPCDTAMDSNIKLLLGLGESLEDLEKYHRLVGGLNYLIVTRSNITFAISVVSQFLNASCDSHWHVVMCILQYIKNASGCRLLYEEKDHHQAGDLPLVFVFLLEEMNIKDWMKEEAWVWVKIVTSMWSKEVLPRWVAYHELVLTTKEYMRQVTELKPEWLVEIAPHNYQLKDVEDSYSKKMSRGAGRAS

SEQ ID NO: 147652 - protein, 88 aa, Glycine max
  Coding DNA Sequence Number=SeqID_30874
MEEVEVGLVDEWVSPAMCHTSEKWCAWELAQRHMVARRTWLWSPEKGDGDRRLHVGKRETLLLSNSSRECMHCFLRSYMYEGEGIEEP

SEQ ID NO: 147653 - protein, 192 aa, Glycine max
  Coding DNA Sequence Number=SeqID_30875
METSQARFKANQNSIQNLEIEDGKSYSMENCWWEKELQPYNQYEEERISNLDNLLMQLMETSEATQHTIQNLEIQVGKLAKQVAKLPLVTREENFVEVEAYEESLVEEHDSREKDEGKESILQVNTPPHQLIGKEERLGECDKCLSVILSLNTNTSLAMVWKAFSGYMSFMESLTKKQKFKEDVFYVTFMPP

SEQ ID NO: 147654 - protein, 172 aa, Glycine max
  Coding DNA Sequence Number=SeqID_30876
  Gene Ontology: Mol. function=hydrolase activity; Biological process =aromatic compound metabolic process
  Homolog annotation: Hit_ID=Q2XFA2; Match level="QueryCoverage=93%, HitCoverage=60%, E-value=5e-54, Identity=61%"; Hit description =Hydrolase, alpha/beta fold family
MGARFIMRAAVKQPAGVLSLSLIDPPVSGPGRRLYPGQWPWYEDSIRDAQRGMDAEAMKQYCPAWSDDQRQLRAEWLHTCYTPAIRRAYDDFHQLDIHQYFPQLPAKTLLMVAGKGGVIQAEDEAEIRELLPTIEISRVAGAGHMIPWDDFHGFFNAFGTFLGPSLTPETQP

SEQ ID NO: 147655 - protein, 263 aa, Glycine max
  Coding DNA Sequence Number=SeqID_30877
  Gene Ontology: Mol. function=hydrolase activity; Biological process =aromatic compound metabolic process
  Homolog annotation: Hit_ID=Q2XFA2; Match level="QueryCoverage=87%, HitCoverage=85%, E-value=1e-78, Identity=63%"; Hit description =Hydrolase, alpha/beta fold family
MFHAHTAGVEGKPLRANQLARLQHGGNFGFHGAKEGAKSVEEAVKIIPRDHVTGAGYPADLNGRQQLADFGFIFRLNDAALACHHQQGFCRQLREILMDIELVKIVIGATDGRRIAGMQPLGAQLTLVIAPGRAVLLHGFSIHAALRVANGIFIPRPLTRIETPARSGNRRIDQRQRQHAGRLFHRRTHDEARAHRMANQVIARQPQRIREGVDVIGAALHAVIQPFTAAGEPATAHVQYPGIKMLRKNFRHKTPGDRRAGDT

SEQ ID NO: 147656 - protein, 364 aa, Glycine max
  Coding DNA Sequence Number=SeqID_30878
  Homolog annotation: Hit_ID=Q1RUD8; Match level="QueryCoverage=46%, HitCoverage=32%, E-value=4e-23, Identity=37%"; Hit description=IMP dehydrogenase/GMP reductase
MANQGDWVPVMDVLALLIFGVVLFPNVDGLVDLAAIDAFLAYHHSKESPVVAVLADLFDTFDRRCEKSSTRIICCLPAICVWLVSHLFQQDTRHPCPLLSHRSCTENRRIDWDQLLAGIGGRTINWFPRWKEGKEGVLFSCGGYPNIPLVGTRGCINYNPALAIRQLGYPMRGAPTEESMSPFLVRDFGAQNFKAIQRIHKAWETPLKKDQDLRGIRNGIIGGLAHQVKVVSEESFEAPEEDEEVQALKSELGKAKLAKEKFKLVATHIRKECAGLREENATTARALEQETKRARKEECGRNKFRGALWGSNSELKLRREERDQSRAHSMVLKEELVACSRSKRSLSQRLCETETNMLAIIAKY

SEQ ID NO: 147657 - protein, 129 aa, Glycine max
  Coding DNA Sequence Number=SeqID_30879
MRWSARREIQVLSTWARSNRRSSLTSTTKHYYGHTVFASAKRGILGLGSRVPKEGATNSLGVKEKGVEGWGRGDRGEEEPVGSGWRDVEEGEVEARELDGEEFGGDDGAEEGGKGLEEVGVRVRVRERV

SEQ ID NO: 147658 - protein, 170 aa, Glycine max
  Coding DNA Sequence Number=SeqID_30880
MDCQTWGIEGVGEFDVFELIKVGSTRGKVAEGKGDIRLGFGATKIEGKSISRNLTSQLTKKDKIYEYDVQLHNINNQKLASDQVMVDDCRVFQMVDDIEIIMIMSQQEYDDAFASTTPYCCGVYTQHMGGVAASVCHEPPWLQGLRPHRHGGPVAHHAASHHRALMGAEI

SEQ ID NO: 147659 - protein, 104 aa, Glycine max
  Coding DNA Sequence Number=SeqID_30881
  Homolog annotation: Hit_ID=Q1SGW6; Match level="QueryCoverage=37%, HitCoverage=7%, E-value=7e-14, Identity=87%"; Hit description =Glycoside hydrolase, family 28
MKTRMGSEGSDEWTDVGLAGFRRQEGGIWWPRARMSDGACTKPYCHRRKVAANGGGAAMDDGVGDEKYWPLMPALPSYEYGREHPGPRYSSLIHGQNLRDVVIT

SEQ ID NO: 147660 - protein, 110 aa, Glycine max
  Coding DNA Sequence Number=SeqID_30882
MCSTLRYNVVLIVGGGDGGSSLCQVLVDFPSIFVAPNPSLISPFPTFDTMDHWSTIKPTHQPQQLEPSHTNESELPINTHETPSATLPLVEPTLINSNTSNSPTPSIPQV

SEQ ID NO: 147661 - protein, 171 aa, Glycine max
  Coding DNA Sequence Number=SeqID_30883
MEEGTQRWHTVFGGGSDLGVLGSHLDKDDVYWADLAGLVVLEVGVRQVGSDLADGGGVGVGKDRGVADLVGRRRERWRKEKIERWRFCGHSLNGLRDTKVRELRVAHDGSAGEVVRGHHHDGLGLRVKLCRTRKGYEGVLTSEIDSSGSFDGGARDSFDSHTEMKVTPSCV

SEQ ID NO: 147662 - protein, 101 aa, Glycine max
  Coding DNA Sequence Number=SeqID_30884
  Homolog annotation: Hit_ID=Q6Z157; Match level="QueryCoverage=72%, HitCoverage=28%, E-value=2e-09, Identity=43%"; Hit description =Oxidation resistance 1-like protein
MEMDNKQGSEEMIRFLCVNRYYNMCLNDLLALGGGGNYALCLEEDLLSGTSGPSDTFGNKCLAHSPEFELKNVKLTKLKQIIKWLSSTAGCSSILYIYFLH

SEQ ID NO: 147663 - protein, 71 aa, Glycine max
  Coding DNA Sequence Number=SeqID_30885
  Gene Ontology: Mol. function=aspartate-tRNA ligase activity; Cellular component=cytoplasm; Biological process=tRNA aminoacylation for protein translation
  Homolog annotation: Hit_ID=O81892; Match level="QueryCoverage=60%, HitCoverage=6%, E-value=6e-13, Identity=77%"; Hit description =Putative aspartate--tRNA ligase
YYSLPNSKVGRCFRDEDLRADRQPEFTQLDMEIAFTPYKDMLMLNEESIRKSPVDGKPMLLTPEESIFKSK

SEQ ID NO: 147664 - protein, 133 aa, Glycine max
  Coding DNA Sequence Number=SeqID_30886
  Homolog annotation: Hit_ID=Q8RV68; Match level="QueryCoverage=93%, HitCoverage=86%, E-value=2e-36, Identity=58%"; Hit description =Expressed protein
  Pfam annotation: Domain name=DUF842; Domain location=15-131; Score =92.7; E_value=1.1e-24; Accession=PF05811.3; Description=Eukaryotic protein of unknown function (DUF842)
MDHFAAHEEQLASQRMRQKLEEVNVAAQTNFVPVQSHLHYIVQKTYFKCAYECFDRSKSQEEISSCVEKCSVLSNLQHTLEMAQFQERLNRSLRVCQDKYKAARLQNKNDAMKDLVSCAERSIQKASRGLLWN

SEQ ID NO: 147665 - protein, 111 aa, Glycine max
  Coding DNA Sequence Number=SeqID_30887
  Gene Ontology: Mol. function=zinc ion binding; Cellular component =integral to membrane
  Homolog annotation: Hit_ID=A0FK64; Match level="QueryCoverage=74%, HitCoverage=40%, E-value=9e-20, Identity=51%"; Hit description=PHD4
MASKPRSVEEIFKDYSARRIAIIRALTHDVDKLYGLCDPGEEEVPPELPEPTLGINFARDDVSRRDWISLVAMHSDSWLLSVADPTLRFFTTFILHWSINNRLKKNTVGIS

SEQ ID NO: 147666 - protein, 151 aa, Glycine max
  Coding DNA Sequence Number=SeqID_30888
  Homolog annotation: Hit_ID=Q9FKW5; Match level="QueryCoverage=25%, HitCoverage=5%, E-value=4e-10, Identity=76%"; Hit description =Arabidopsis thaliana genomic DNA, chromosome 5, TAC clone:K2A18
KTCLFLLGWRTAALKNVEVNEAKRHEAKAAVEGAGVEATCSQMRPRMGSLVEMGGRPRYSVSTWSSAGAETRRSQERAGIMHAEDAFHEGSELARAACRSSQANFSVLATCLFRCLGHLVRQLDRLCHHEKSKSCFTMFTSSWIQVPKSNL

SEQ ID NO: 147667 - protein, 129 aa, Glycine max
  Coding DNA Sequence Number=SeqID_30889
  Gene Ontology: Mol. function=nucleic acid binding; Cellular component= intracellular; Biological process=regulation of transcription
  Homolog annotation: Hit_ID=Q9SVY1; Match level="QueryCoverage=88%, HitCoverage=33%, E-value=8e-66, Identity=88%"; Hit description=Zinc finger-like protein
  Pfam annotation: Domain name=zf-C2H2; Domain location=56-78; Score =23.3; E_value=0.00089; Accession=PF00096.16; Description=Zinc finger, C2H2 type
  Pfam annotation: Domain name=zf-C2H2; Domain location=82-107; Score =1.6; E_value=7.1; Accession=PF00096.16; Description=Zinc finger, C2H2 type
  Pfam module annotation: Pfam domain module=zf-C2H2::zf-C2H2; Domain location=56-78::82-107
MHMWGHGSQYRKGPESLRGTQPTGCRNNIDHPRAKPLKDFRTLQTHYKRKHGIKPFMCRKCGKAFAVRGDWRTHEKNCGKLWYCICGSDFKHKRSLKDHIKAFGSGHAAYGIDGFEEEEEPASEVEQDR

SEQ ID NO: 147668 - protein, 133 aa, Glycine max
  Coding DNA Sequence Number=SeqID_30890
  Gene Ontology: Mol. function=nucleoside-triphosphatase activity
  Homolog annotation: Hit_ID=Q1W2L1; Match level="QueryCoverage=77%, HitCoverage=34%, E-value=7e-22, Identity=58%"; Hit description =Suppressor of K+ transport growth defect-like protein
MQFQGANDRIHEAGRVGRQCRKLCEEIWVVLDDGGHSPASNRDATVASRPKTKPKDGEGSGEDEDPEQAKLQVGLNSAIVREKPNVKLNDITRLSPLDQEAIVLPPFVIVVVRLRPDVWNMFVLMSLSSTWSN

SEQ ID NO: 147669 - protein, 150 aa, Glycine max
  Coding DNA Sequence Number=SeqID_30891
  Gene Ontology: Mol. function=sucrose synthase activity; Biological process=sucrose metabolic process
  Homolog annotation: Hit_ID=Q9FRX3; Match level="QueryCoverage=86%, HitCoverage=16%, E-value=6e-39, Identity=59%"; Hit description =Sucrose synthase 1
MAIIIHERSLLVPNAKGTTCNQQLEGVSGTDHTHIFQVPFILESGTLLKWISRLDVWPYLETYVEDVASEIAAELQGYPDFIIGNYNDGNLVTSLLAYKIGVAQEKNPCTNDLDLWLEKYAELAQRYMQVVVDEIVFNNIDPLKAVQLSL

SEQ ID NO: 147670 - protein, 991 aa, Glycine max
  Coding DNA Sequence Number=SeqID_30892
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=97%, HitCoverage=97%, E-value=0.0, Identity=54%"; Hit description=Leucine- rich receptor-like protein kinase
  Pfam annotation: Domain name=LRRNT_2; Domain location=21-61; Score =52.7; E_value=1.2e-12; Accession=PF08263.3; Description=Leucine rich repeat N-terminal domain
  Pfam annotation: Domain name=LRR_1; Domain location=115-137; Score =16.0; E_value=0.13; Accession=PF00560.23; Description=Leucine Rich Repeat
  Pfam annotation: Domain name=LRR_1; Domain location=139-161; Score =20.1; E_value=0.0082; Accession=PF00560.23; Description=Leucine Rich Repeat
  Pfam annotation: Domain name=LRR_1; Domain location=163-185; Score =17.0; E_value=0.067; Accession=PF00560.23; Description=Leucine Rich Repeat
  Pfam annotation: Domain name=LRR_1; Domain location=187-210; Score =13.4; E_value=0.81; Accession=PF00560.23; Description=Leucine Rich Repeat
  Pfam annotation: Domain name=LRR_1; Domain location=212-234; Score =15.9; E_value=0.14; Accession=PF00560.23; Description=Leucine Rich Repeat
  Pfam annotation: Domain name=LRR_1; Domain location=236-258; Score =13.7; E_value=0.68; Accession=PF00560.23; Description=Leucine Rich Repeat
  Pfam annotation: Domain name=LRR_1; Domain location=260-283; Score =0.5; E_value=2.3e+02; Accession=PF00560.23; Description=Leucine Rich Repeat
  Pfam annotation: Domain name=LRR_1; Domain location=285-307; Score =9.4; E_value=5; Accession=PF00560.23; Description=Leucine Rich Repeat
  Pfam annotation: Domain name=LRR_1; Domain location=308-330; Score =5.6; E_value=25; Accession=PF00560.23; Description=Leucine Rich Repeat
  Pfam annotation: Domain name=LRR_1; Domain location=332-354; Score =9.2; E_value=5.4; Accession=PF00560.23; Description=Leucine Rich Repeat
  Pfam annotation: Domain name=LRR_1; Domain location=356-375; Score =5.8; E_value=24; Accession=PF00560.23; Description=Leucine Rich Repeat
  Pfam annotation: Domain name=LRR_1; Domain location=380-402; Score =8.4; E_value=7.7; Accession=PF00560.23; Description=Leucine Rich Repeat
  Pfam annotation: Domain name=LRR_1; Domain location=404-426; Score =12.3; E_value=1.4; Accession=PF00560.23; Description=Leucine Rich Repeat
  Pfam annotation: Domain name=LRR_1; Domain location=428-450; Score =3.0; E_value=79; Accession=PF00560.23; Description=Leucine Rich Repeat
  Pfam annotation: Domain name=LRR_1; Domain location=452-474; Score =13.8; E_value=0.63; Accession=PF00560.23; Description=Leucine Rich Repeat
  Pfam annotation: Domain name=LRR_1; Domain location=476-498; Score =8.5; E_value=7.2; Accession=PF00560.23; Description=Leucine Rich Repeat
  Pfam annotation: Domain name=LRR_1; Domain location=500-523; Score =12.2; E_value=1.5; Accession=PF00560.23; Description=Leucine Rich Repeat
  Pfam annotation: Domain name=LRR_1; Domain location=525-547; Score =12.5; E_value=1.3; Accession=PF00560.23; Description=Leucine Rich Repeat
  Pfam annotation: Domain name=LRR_1; Domain location=549-571; Score =10.8; E_value=2.7; Accession=PF00560.23; Description=Leucine Rich Repeat
  Pfam annotation: Domain name=LRR_1; Domain location=572-593; Score =14.7; E_value=0.34; Accession=PF00560.23; Description=Leucine Rich Repeat
  Pfam annotation: Domain name=LRR_1; Domain location=90-113; Score =8.4; E_value=7.6; Accession=PF00560.23; Description=Leucine Rich Repeat
  Pfam annotation: Domain name=Pkinase; Domain location=683-959; Score =136.4; E_value=7.5e-38; Accession=PF00069.15; Description=Protein kinase domain
  Pfam annotation: Domain name=Pkinase_Tyr; Domain location=683-959; Score=97.1; E_value=5.2e-26; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=21-61::115-137::139-161::163-185::187-210::212-234::236 -258::260-283::285-307::308-330::332-354::356-375::380-402::404 -426::428-450::452-474::...
  Pfam module annotation: Domain location=476-498::500-523::525 -547::549-571::572-593::90-113::683-959::683-959
MFVFFLLFLCFLSPLPHSLSLTQDGLFLLEARRHLSDPENALSSWNPAATTPCRWRSVTCDPLTGAVTSVSLPNFSLSGPFPAVLCRIASLTTLNLASNLINSTLSAVAFAACRNLVFLDLSQNNLVGPIPDSLAGIATLQHLDLSGNNFSGAIPASLASLPCLKTLNLVNNLLTGTIPSSLGNLTSLKHLQLAYNPFSPSRIPSQLGNLRNLETLFLAGCNLVGRIPDTLSNLSHLTNIDFSQNGITGHIPQWLTRFKRVNQIELFKNKLSRGVTPKECRNMPSLRFFDASTNELTGTIPTELCELPLASLNLYENKLEGVLPPTIARSPNLYELKLFSNKLIGTLPSDLGSNSPLNHIDVSFNRFSGEIPANICRRGEFEELILMYNYFSGKIPASLGDCKSLKRVRLKNNNLSGSVPDGVWGLPHLNLLELLENSLSGQISKAISGAYNLSNLLLSYNMFSGSIPEEIGMLDNLVEFAASNNNLSGKIPESVVKLSQLVNVDLSYNQLSGELNFGGIGELSKVTDLNLSHNMFNGSVPSELAKFPVLNNLDLSWNNFSGEIPMMLQNLKLTGLNLSYNQLSGDIPPLYANDKYKMSFIGNPGICNHLLGLCDCHGKSKNRRYVWILWSTFALAVVVFIIGVAWFYFRYRKAKKLKKGLSVSRWKSFHKLGFSEFEVAKLLSEDNVIGSGASGKVYKVVLSNGEVVVAVKKLCGAPMNVDGNVGARKDEFDAEVETLGRIRHKNIVKLWCCCNSGEQRLLVYEYMPNGSLADLLKGNKKSLLDWVTRYKIAVDAAEGLCYLHHDCVPPIVHRDVKSNNILVDAEFVAKVADFGVAKMVTGISQGTRSMSVIAGSYGYIAPEYAYTLRVNEKCDIYSFGVVLLELVTGRPPIDPEYGESDLVKWVSSMLEHEGLDHVIDPTLDSKYREEISKVLSVGLHCTSSIPITRPTMRKVVKMLQEVTTEVPKSRSVNGGNVPCSYEGASHAINEV

SEQ ID NO: 147671 - protein, 120 aa, Glycine max
  Coding DNA Sequence Number=SeqID_30893
  Gene Ontology: Mol. function=nucleic acid binding; Cellular component= intracellular; Biological process=regulation of transcription
  Homolog annotation: Hit_ID=Q1SHX5; Match level="QueryCoverage=69%, HitCoverage=25%, E-value=7e-27, Identity=68%"; Hit description=Zinc finger, C2H2-type
MDVEENYNNNRTLLHHLHPKEEEQDQEDGPDETVTVALHIGLPSPSAAEIASVLSSACSTDQEQQQQQQQQDGFLSNRLNKGQYWIPTPSQILIGPTQFSCPVCCKTFNRYNNMQVSVLT

SEQ ID NO: 147672 - protein, 285 aa, Glycine max
  Coding DNA Sequence Number=SeqID_30894
  Gene Ontology: Mol. function=DNA binding; Cellular component=nucleus; Biological process=regulation of transcription
  Homolog annotation: Hit_ID=Q5QMP4; Match level="QueryCoverage=87%, HitCoverage=73%, E-value=3e-97, Identity=67%"; Hit description=No apical meristem (NAM) protein-like
  Pfam annotation: Domain name=NAM; Domain location=49-190; Score =200.3; E_value=4.5e-57; Accession=PF02365.6; Description=No apical meristem (NAM) protein
MTQCSDSENNHHNIIVEGRKDSLIRTCPTCGHHIKCQEQGGGIHDLPGLPAGVKFDPTDQEILEHLEAKVRSDIHKLHPLIDEFIPTLEGENGICYTHPEKLPGVSKDGLIRHFFHRPSKAYTTGTRKRRKVHSDEDGSETRWHKTGKTRPVYNIAKLKGYKKILVLYTNYGKQRKPEKTNWVMHQYHLGSDEEEKEGELVVSKVFYQTQPRQCGSLMKDSSVPPGKHMKGQSVHVEVMNNNKNSNNNGYVEYYHSSNFISFDQGGQNAQVISHFPVHEGAPFIP

SEQ ID NO: 147673 - protein, 117 aa, Glycine max
  Coding DNA Sequence Number=SeqID_30895
MSKKIDSKYQFCSKECSCDGGRLIGVRENDVDEEAVGGVPAGVIKDIVDIFEKETKTGVGGEYLYNMLILSENNEVKKEKGKRRRKEKIRRVSQKDSRIKRKCPVIVKSLRVLVQIA

SEQ ID NO: 147674 - protein, 998 aa, Glycine max
  Coding DNA Sequence Number=SeqID_30896
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=98%, HitCoverage=76%, E-value=3e-75, Identity=43%"; Hit description=D -galactoside/L-rhamnose binding SUEL lectin; Integrase, catalytic region; ...
  Homolog annotation: Hit description=Galactose-binding like; Peptidase aspartic, catalytic
GWLINSMDLKLVSNFIRFLTAKVVWDSIATTYFDSGDTSQVYDLKRRVTRLKQGDRSIETYYNNLQGLWREIDFRRPNPMLCDADIQRYNLILQEDRVYTFLDGLDDRLNKIRADVLQMQPFPMVEQAYALVRREDLSHSVVMVNEDIASGGAMLSRRGHKPQHRLSLQMTSNGKPTTKSQSQGEGEGCKHCGNMKHTKETCFKLHGYPDWWHELKEKKKRESSGGNNSGRAALVSVEPQLSLITQQESPSGHASQNDSGNQGSSYSYSKQGNRDNWIIDSGATNHMTFDLHDFSKTSQLNRTCIDNANGVTYPVIVAGTFDFSPSFSLPNTLLVPSLFNKLLSIGQVTKELNCCAIMYSNFCLFQDILTKEIIGRGTKREGLYCLDDFSYELFTKVSESDFKCEASIQAKSHRVPYPISLNKCDTPFSIIHSDVWGPAPINIPFGVRWFIMFIDDLVTAVYLMNRQPSRVLNYKTPLQVLAKHVTLPYVLMLPPRKFGCVTYVHIPKNQRMKLDLCVVHCVFLGHGAHKKGYCCYDPVTRRLYTTMNVTFIESENFFTFQSSHSSRQGEMMSEEQNWKDWPGFEASNDVGVIAEIEESAETESEQPLLVEAETEILNSPQNISIGYKLPFRHNWGQPPNRYSPDHGTSNYPKWIQAIEEEMKELQENNAWSLVPLPEGKKIVGCKWVFTIKHKADGSVERYKARSVVCKLKKALYILKQSPRAWFGRFSFAMRKHGFKQRHSDHTLFLKHQQGKVTTLIIYVDDMIIIGNDEKEISRLQEHLATEFEMKNLGGLKYFLGIKVAQSKRGIFLSQRKYVLDLLSKTGMLDCRPANTPHLHIQGYTDADWAGSISDRKSTSGYLTFVGGNLVSWRSKKQKVVALSSVEAEFRGMTKGVRELLWLKRLVEEVICSTQDTMDLFCDNKAAIAIAHNPVQHDRTKHVEGDTHFIKEKLEDKIIQFPFVKSEDQLTDILTKVVSSKIFHNSLDKLGIEDIYAPT

SEQ ID NO: 147675 - protein, 128 aa, Glycine max
  Coding DNA Sequence Number=SeqID_30897
MTGFFGAMFLNQSMGAEGDWEIQMFFWALADKYSRLFTNSCNPNALVAEMGYWLGENVTIGWGCKYPPKQTMLFLEGPMGIGKLCCVAAWDLAKHRAWAWINAKGKGRKFSYCEWEMNPRACLNCLTL

SEQ ID NO: 147676 - protein, 371 aa, Glycine max
  Coding DNA Sequence Number=SeqID_30898
  Gene Ontology: Mol. function=acyl-CoA dehydrogenase activity; Cellular component=integral to membrane; Biological process=electron transport
  Homolog annotation: Hit_ID=Q1BBV9; Match level="QueryCoverage=95%, HitCoverage=87%, E-value=2e-37, Identity=30%"; Hit description=Acyl -CoA dehydrogenase, type 2-like protein
  Pfam annotation: Domain name=Acyl-CoA_dh_1; Domain location=201-346; Score=-10.0; E_value=0.0035; Accession=PF00441.14; Description=Acyl -CoA dehydrogenase, C-terminal doma
  Pfam annotation: Domain name=Acyl-CoA_dh_2; Domain location=213-343; Score=32.1; E_value=1.4e-06; Accession=PF08028.2; Description=Acyl -CoA dehydrogenase, C-terminal doma
  Pfam module annotation: Pfam domain module=Acyl-CoA_dh_1::Acyl-CoA_dh_ 2; Domain location=201-346::213-343
MHDDVVDAMRKGGFYTMLFPKEVGGAELRPIDAMRLMSALSYAHASSGWCTMVNNMEGTTMAIYLDDEGIANVFKDGVDITIAGNGVPRGFARKVDGGYMIRGNWAYGSSIFHAEWIHSGCFLLDPKDPSGKALLKDETGAPQIIVAHHPRSTIQLLGNWDVLGLRATGSFDYTLATDEDLFVPDSMTYSFTQSAPKRGQTQGHLGLAGYSALTHTSWAIGVGRRILDELAKVIRQRQDPFGKSADSASLRFQFANAEARYRAARALAMETWEDVSQTTASGGVPSLDQMTMVKLSLRYMHDIVSDVATFAHRAARGASLHNTAMQRFYRDIHSGTQHILLADQIVEECGKGLLGLPGPDARWTVFGISEN

SEQ ID NO: 147677 - protein, 62 aa, Glycine max
  Coding DNA Sequence Number=SeqID_30899
MGSSLSYKVRTMIEVPRDALVADEVPPVPEAIAGAIGVSPVSVGLDGTTAKKKSDSILAREC

SEQ ID NO: 147678 - protein, 106 aa, Glycine max
  Coding DNA Sequence Number=SeqID_30900
MCKEYKGTGVNRYYYMCLNDLLALGGGGYYSVRVDQVHTMSRCILSHVLAFALVSALSVFSCLVNVAQAQSANTTTDPSEGLNFWEFSQFQFSRRFREIANSSSST

SEQ ID NO: 147679 - protein, 121 aa, Glycine max
  Coding DNA Sequence Number=SeqID_30901
  Homolog annotation: Hit_ID=Q1SPA8; Match level="QueryCoverage=36%, HitCoverage=9%, E-value=9e-12, Identity=77%"; Hit description =Glycosyl transferase, family 8
MVKEWDLQSSNPSRRNIKGSNHSKINFNVERSQRFEKHEYGYVEFVVLRRTYDRGMGAEDECGVGGGGGTREKVEKCNGKRREEEKQKIASEWGEEQMPAGKEKERAPHLRKEEERMRGAS

SEQ ID NO: 147680 - protein, 114 aa, Glycine max
  Coding DNA Sequence Number=SeqID_30902
METGKHDETEDENKLDGEKLIEERSKEVETPKDDPKGNQEARRLWVDVISENRNPTKGRMMSYVAPKMVEGQIEIEIEDEDIESEIRYWENALILYVLGGDLSMNTIKNFMERN

SEQ ID NO: 147681 - protein, 86 aa, Glycine max
  Coding DNA Sequence Number=SeqID_30903
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=66%, HitCoverage=25%, E-value=4e-16, Identity=58%"; Hit description =Protein ULTRAPETALA2
MQKPSCSVGQSPSCKNPHAVTQTSLYCIQITCDDDEERSSLKASRGCSRSSTCQGCSTCYCEGCIKCRFEDCNCQECRDFMLYAKP

SEQ ID NO: 147682 - protein, 362 aa, Glycine max
  Coding DNA Sequence Number=SeqID_30904
  Gene Ontology: Mol. function=RNA-directed DNA polymerase activity; Biological process=RNA-dependent DNA replication
  Homolog annotation: Hit_ID=Q2HRL0; Match level="QueryCoverage=31%, HitCoverage=20%, E-value=1e-30, Identity=46%"; Hit description=RNA -processing protein, HAT helix
MEVVVMKGPYTIRSMPVVLKEWRPDFSLKQDMLRTIPIWIKLPKLPLYLWGERSLNKIGSAIGTPMVTDECTTHKLKVSYARMLVEVDITRKLVEEIAIKDKDGRKIMQPIEYEWRPKFCDKCQKIGHQCGNGVKKKKWQPKPQQERKHEIPVEVSTPRKETTTSKANGDEGKTWIRTTKDDEEMWTKVSKASKDRGFEWPPSLRSGTMITSWNVRGLNKVGKLREISSHLLELQPEIAILIETRVKENKDANVREKLRLNGNYLDNYTCHANGRLWIHWDLNRVDVKCVSRTSQLIHCGVYDVTGNFKFWLTAIYASNALDRRKILWKDIEKIHETHQGAWCVVGDYNNVAKAQDRIGGNM

SEQ ID NO: 147683 - protein, 537 aa, Glycine max
  Coding DNA Sequence Number=SeqID_30905
  Gene Ontology: Mol. function=RNA-directed DNA polymerase activity; Cellular component=nucleus; Biological process=RNA-dependent DNA replication
YTNRSTKTVVTLIPKNDDAKCVKDYRPIAGCTTFYKIISKILTARLGGVLQDVISHNQSAFVPGQNIHNHIMLAYELIRGYTRKNGTPRCMMQSNLQKAYDMVDWRALEDVMQEIGLPRTFTNWIMTTVKTVSYSFNINGQMTEDMQACRGIRQGDPISPLLFVIMMEYFNRMFDKMQQNPNFNHHAKCEKMGITHLTFADDVLLFCRGDSKSVDMMFDTVQNFSDATGLVINLTKCKIFFGGIDDETKGVIKRTTNFKEGHFPIRYLGVPLTSKKLTITHYLPLVEKIVCRTRHWTTRLLSHAGRIQLVKKIEAIYKSFIWTGCSEVKKKSPVAWETVCRPKCQGGLDIINLTVWNQSIMQVDSQSHWSWMFNNILDQREKVRLKQEWNNQMQRDKFSMKTMYNLLMDKSDWVPWRFLLNHNIARPRDIENLWLTCHGRMATKDRLKRFGMIKENQCSLCKESEESIAHLFFDCKITKSIWEQILKWIEVTHEPKTWDVELKWAIRETGKKGWKAKLLKLFTRCGYIEMMKFSRIM

SEQ ID NO: 147684 - protein, 621 aa, Glycine max
  Coding DNA Sequence Number=SeqID_30906
  Gene Ontology: Mol. function=DNA-directed RNA polymerase activity; Cellular component=nucleus; Biological process=transcription
  Homolog annotation: Hit_ID=Q1S319; Match level="QueryCoverage=80%, HitCoverage=29%, E-value=0.0, Identity=65%"; Hit description=RNA polymerase Rpb1, domain 5
  Pfam annotation: Domain name=RNA_pol_Rpb1_5; Domain location=1-458; Score=53.8; E_value=2.3e-13; Accession=PF04998.8; Description=RNA polymerase Rpb1, domain 5
LNTFHLAGRGEMNVTLGIPRLQEILMAAARDIKTPFMTCPLRHDKSMKDAICLADKLKKITVADIIKSMKVSVVPVTVLGGQVCSIYKLVMKLYKSKQYPEYTDITLDDWEETLRVNFVRELEDAIQNHMTLLSKISGIKKFKTDPQSNYSNSSEDAHSNGSESEKKGQNNDDDDEDGGGVEDTEGYEDLGSDAQKRKLQGTDEVDYEDGPEEETHDGELSEEIEGDEDGSDVDANENYNNVTDANNSEGLEKPSKSKTIDEKQNLKREKKKSEPTTKKYDRAIFVEAKGKHFEIHFRFTGEPHILLTQIAQRTAKKVCIQNFGKVGECKAITCKESGVIYYGKDGRKRIEISASEKEQIPALQTSGVHFKTFWELEDDLDVRYIYSNNVHAMLNAYGVEAARETIIREVQNVFKSYGISVNIRHLTLIADFMTHTGSYRPMNRTGSIADSTSPFIKMCFETAGNFIVEAAYHGQVDNLETPSARICLGLPVKMGTGPIASTPRQWAATTVAEDVDHVGHVVDKVHEDPHVGANIKDFPDPPKFLVHSTSMPQPLAFVAVDADMLRHAMIPESLEHMINMRMATIGTDAYTLPEHYLRLARDEGAIQMTKMVEDEDDDRWD

SEQ ID NO: 147685 - protein, 155 aa, Glycine max
  Coding DNA Sequence Number=SeqID_30907
  Gene Ontology: Mol. function=RNA-directed DNA polymerase activity; Biological process=RNA-dependent DNA replication
MMISLFGFAGEKIGTRGCIWLYTRFGHEEAKHKDLKIQYVVVHDHTSYNILLNRPSLNTLGAIMSTPHLAMKFSSETRSIIIVHADQKMARKCYMASMKIANMSRIDPTFHCHRIYVNPQGNTCKSQQVSGHFRNEKSKELEGSTMVSRPDSLPI

SEQ ID NO: 147686 - protein, 232 aa, Glycine max
  Coding DNA Sequence Number=SeqID_30908
  Gene Ontology: Mol. function=DNA binding; Cellular component =chromatin; Biological process=DNA integration
  Homolog annotation: Hit_ID=Q1S3I6; Match level="QueryCoverage=69%, HitCoverage=11%, E-value=4e-44, Identity=52%"; Hit description =Integrase, catalytic region
MSEGSEQTPSMDSFLYLHPSENPVVTLISPVLDSTNYHSWSISMITALSAKNKVKFVDGSAPEPPKIDRMHAFSNSDWAECRDSRCSIIGFSIYLGHSLISWRSKKQSTVFHSSSEAEYRALASTTCELQWLTYLLQDLHVSFVQLAIPYCDNKSTIQIASNQVFHERTKHIDIDCHIVHEKVNSGLLKLLLVSSSMQLANIFTKVLSPSIFQGLCSKLGMMNIHSQLEGGS

SEQ ID NO: 147687 - protein, 127 aa, Glycine max
  Coding DNA Sequence Number=SeqID_30909
  Gene Ontology: Mol. function=nucleoside-triphosphatase activity
  Homolog annotation: Hit_ID=Q1SFG1; Match level="QueryCoverage=94%, HitCoverage=40%, E-value=2e-27, Identity=74%"; Hit description=AAA ATPase
MEKSLLIVEEANLSSRSFSGRVSDDKANRSGRKGMVLPFQPLSLTFDEIKYSLDMPQEMKKQGVFEERRELLKGVSGVFRPRVLTALMGAIQGVPKIKEGYNPATWMLEVTSAGIEASLKIFQTKGY

SEQ ID NO: 147688 - protein, 175 aa, Glycine max
  Coding DNA Sequence Number=SeqID_30910
MFDQQAAVSPAKPPESPDHEVDDPLYLMILTIPRLFVFGVFNQNFSLYIKHENLSEIAHSGQCLSISVIQLWILHLTETSMQAGSYDVYGFLEPQSIQRSGQSQFESKSYIKSWMQSSKHGVYFGTYLNGALKELDDTPQPKSKAAASVIDKKEALSALLRHALDVHDNLRNFQE

SEQ ID NO: 147689 - protein, 106 aa, Glycine max
  Coding DNA Sequence Number=SeqID_30911
MDRNRGSKGCKKRMRRRKLRRLRHTNYKRWRQESRLLMELEEEGNRPQQGKTGTAKGFKELKIRILVEKSPSNNFGIGIGINPGIGSPGKTRGVGNWLKCGKIKGE

SEQ ID NO: 147690 - protein, 105 aa, Glycine max
  Coding DNA Sequence Number=SeqID_30912
MNAFYGHESPENYLFLLAHLGAQCPMCTIKKVIWTFRLPVTKDETNIQCMLEIKCGSDLICTSFWSRNMGPTHFISKKEIISSQAEKPMNLFGGGVGVCHRLGLG

SEQ ID NO: 147691 - protein, 154 aa, Glycine max
  Coding DNA Sequence Number=SeqID_30913
MKYFVTRKQNFPKVEFQHCMSCRKEHKLRLKSKPNTKNYQDALTNKSWTCYPWPYQKLPSILLPTNPKPHSHGHRSSHPKASPSLPHPNPHQLVPATCIQSQRLHLHVLRFPFIMINSEFELNGNEEHLKLQLTTSMEKQSQSIEFRFGLNCKN

SEQ ID NO: 147692 - protein, 209 aa, Glycine max
  Coding DNA Sequence Number=SeqID_30914
  Gene Ontology: Mol. function=DNA-directed RNA polymerase activity; Cellular component=nucleus; Biological process=transcription
  Homolog annotation: Hit_ID=Q1S319; Match level="QueryCoverage=53%, HitCoverage=6%, E-value=3e-54, Identity=91%"; Hit description=RNA polymerase Rpb1, domain 5
  Pfam annotation: Domain name=RNA_pol_Rpb1_4; Domain location=1-88; Score=79.4; E_value=1.1e-20; Accession=PF05000.7; Description=RNA polymerase Rpb1, domain 4
  Subcellular localization annotation: CTP_CleavageSite=32; ConfidenceScore=5.16e-01
MTSNLNSRTSSGILKKLLSEGILKPSGKNCISLMTTSGAKGSMVNFQQISSHLGQQELEGKRVPRMVSGKTLPCFPPWDCSPRAGGFIIDRFLTALHPQEYYFHCMAGREGVGSSTAWLECLSIGIKAAAEMLALKGGAMIGTWELWGWVTQMLGCLSIGNLVGCQCLEKVYLWRSTAMIGTWELWGADVAHRVVWDAWWGIKCLVLPP

SEQ ID NO: 147693 - protein, 156 aa, Glycine max
  Coding DNA Sequence Number=SeqID_30915
  Gene Ontology: Mol. function=DNA-directed RNA polymerase activity; Cellular component=nucleus; Biological process=transcription
  Homolog annotation: Hit_ID=Q1S319; Match level="QueryCoverage=94%, HitCoverage=9%, E-value=1e-68, Identity=84%"; Hit description=RNA polymerase Rpb1, domain 5
  Pfam annotation: Domain name=RNA_pol_Rpb1_5; Domain location=8-155; Score=-125.4; E_value=0.0026; Accession=PF04998.8; Description=RNA polymerase Rpb1, domain 5
MTSLLRRLVDTAVKTSRSGYLQRCLMKNLECLKVCYDHTVRDADGSIIQFHYGEDGVDVHQTSFITEFGALSTNKELVFSNYCRQLDRSSPYINKLPEALEGKAEKFSKQRNLGSMEQADFLRLMEHKYVSCLAQPGEPVGVLASQSVGEPATQMT

SEQ ID NO: 147694 - protein, 873 aa, Glycine max
  Coding DNA Sequence Number=SeqID_30916
  Gene Ontology: Mol. function=DNA-directed RNA polymerase activity; Cellular component=nucleus; Biological process=transcription
  Homolog annotation: Hit_ID=Q1S319; Match level="QueryCoverage=92%, HitCoverage=48%, E-value=0.0, Identity=69%"; Hit description=RNA polymerase Rpb1, domain 5
  Pfam annotation: Domain name=RNA_pol_Rpb1_1; Domain location=1-379; Score=-71.3; E_value=1.2e-07; Accession=PF04997.3; Description=RNA polymerase Rpb1, domain 1
  Pfam annotation: Domain name=RNA_pol_Rpb1_2; Domain location=381-566; Score=282.7; E_value=7e-82; Accession=PF00623.11; Description=RNA polymerase Rpb1, domain 2
  Pfam annotation: Domain name=RNA_pol_Rpb1_3; Domain location=569-774; Score=141.2; E_value=2.9e-39; Accession=PF04983.8; Description=RNA polymerase Rpb1, domain 3
  Pfam module annotation: Pfam domain module=RNA_pol_Rpb1_1::RNA_pol _Rpb1_2::RNA_pol_Rpb1_3; Domain location=1-379::381-566::569-774
MDYTTPLWGPFDDKSLCKSCGQTSKHCPGHFGHIELVSPVYNPLMFNILSNILQRTCFTCHHFRAPSKEVDIRTSQLELIMKGDIIRAKRLESIIPGKSVDSFNPDESIHPGDGDESQCYSAEQLGENWTSLQFSEAMSVLRKLLTKKHKKCQKCGAKNPKISKPTFGWFHMNVLSADETRADTIRSVESETTNDDISLGGGDTTDVEDITSAGTAKRDKRKKEKLSYKLAEQNKLSGSLLPSQVKGILELLWENEARLCSYINDIQDQGFGKKAGHSMFFLENIFVPPIKFRPPTKGGDNVMEHPQTVLLTKVLQCNISLGDAHLNKSDPSKVLSRWMDLQQSVNMLFDNKTASGKRDVATGICQLLEKKEGIFRQKMMGKRVNFACRSVISPDPYLAVNEIGIPPYFALRLSYPERVTPWNVVKLRNAILNGPESHPGATHYADKVSIVKLPPKGKLLSLTSRKLPTSRGVILHQGKISDHEFEGKVVYRHLKDGDVVLVNRQPTLHKPSIMAHIVRVLKGEKTVRMHYANCSTYNADFDGDEINVHFPQDEISRAEAYNIVNANNQYVKPTSGDPIRALIQDHIVSAALLTKKDTFLSYEEFNQLLYSSGVSMAGLGSFYGKHGQKVFISNSESEMFLFPPAIWKPEPLWTGKQVISALLYYITRGSPPFTAEKNAKIPSNFFKTQIRKGKRYTEDTSKKKDKPDEDKLLIYKNDLVRGVVDKAQFGDYGMIHTVQELYGSNVAGNLLSALSRLFTTFLQMHGFTCGVDDLMLTEGKDVERMNQLKSCEIIGDSVHREFIGVKNSDNIGTHTIDDILKEQPLTCLFSELNTPALEAFPAHDGASFCHFGSTSCVVVTHIDHSYPWSFIPI

SEQ ID NO: 147695 - protein, 376 aa, Glycine max
  Coding DNA Sequence Number=SeqID_30917
  Gene Ontology: Mol. function=RNA-directed DNA polymerase activity; Cellular component=intracellular; Biological process=RNA-dependent DNA replication
FDGSRKSVIGEVDLPITIGPFVFQITFQVMDIQAAYSCLLGRPWIHEAGAVTSTLHQKLKFVRNGRLITVSGEEALLVSHLSAFSFIGADETEGTSFQGLTVEGKKPEKNEVSFATWKSAQKVVQEGTGEGWGKVVQLLESKNREGLGFAFSAGSATNSVGSSSITSTFCSAGFINNPPEANAVLEDAPEEIVLAFVTPGKLVRNWDAVDIPSVVHASKLGIYEPVEHNNLAPSPNFESPVYEAEEEEDDEIPEELARLLEYEKKTIRPHEELVEVINLGTEEDKKEVKIGASLEATVKRRVIELLKEYADVFAWSYQDMPGLDPRIVEHRLPLRPECPPVKQKLRRTRPDMALKIKEEVQKQIDAGFLVTSEYPQ

SEQ ID NO: 147696 - protein, 300 aa, Glycine max
  Coding DNA Sequence Number=SeqID_30918
  Homolog annotation: Hit_ID=O21999; Match level="QueryCoverage=20%, HitCoverage=42%, E-value=4e-22, Identity=80%"; Hit description=LacZ -alpha
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSISYGTVTLGLERGLMVNATLVAAVFQIGVVLVMGRLSERVGPGRMTLLGGLVTAAAAFPLFWLIESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147697 - protein, 197 aa, Glycine max
  Coding DNA Sequence Number=SeqID_30919
  Gene Ontology: Mol. function=DNA-directed RNA polymerase activity; Cellular component=membrane; Biological process=regulation of transcription, DNA-dependent
  Homolog annotation: Hit_ID=UPI00006BE4BC; Match level="QueryCoverage =98%, HitCoverage=40%, E-value=6e-66, Identity=63%"; Hit description =RNA polymerase sigma-54
  Pfam annotation: Domain name=Sigma54_DBD; Domain location=36-196; Score=222.9; E_value=7.3e-64; Accession=PF04552.3; Description=Sigma- 54, DNA binding domain
MLNSKNAPTLRVSEEYKDILTTYSHDKNSSEHKQAALFIKQKLDAAKWYIDAINQRQNTLLQTITAIVKFQKEYFITGDEKSLKPMILKDIADITGFDISTISRVVKSKYADTPNGIIYLKDLFSDSLTNDDGEEVSTKEIKTHLQEVISKENKRKPLTDDALVVILKEQGYNIARRTIAKYREQLNIPVARLRKEL

SEQ ID NO: 147698 - protein, 227 aa, Glycine max
  Coding DNA Sequence Number=SeqID_30920
  Gene Ontology: Mol. function=transporter activity; Cellular component= membrane; Biological process=transport
  Homolog annotation: Hit_ID=Q1XP44; Match level="QueryCoverage=99%, HitCoverage=32%, E-value=6e-48, Identity=45%"; Hit description=TonB -dependent receptor precursor
MGSQHVGVFYDGIQLGNAQNGVIDLGKFSLDDIGEISLYNGQKSEIFQPAKDFGSSGSIYLQPKTPYFSGNKKTNLVLRIKNSSIDLFNPSFRLEQKLSDKISASFSSEFIQSDGQYKYKYQKKRPDGTIANDTIATRYDSYITAKRFETSLQGNLNNGDWNVRGYGYISDRGIPSAIVNNGFNPKGQKLLDRNYFVQAHLRKKIFPKFETQLKAKFAYDYTRYMDT

SEQ ID NO: 147699 - protein, 157 aa, Glycine max
  Coding DNA Sequence Number=SeqID_30921
  Homolog annotation: Hit_ID=O04892; Match level="QueryCoverage=45%, HitCoverage=13%, E-value=1e-23, Identity=76%"; Hit description =Cytochrome P450 like_TBP
  Subcellular localization annotation: CTP_CleavageSite=51; ConfidenceScore=5.23e-01
MDGAKARDLYPAVGARTKAPMSRRARRVAAKPQGASPGRSGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVE

SEQ ID NO: 147700 - protein, 165 aa, Glycine max
  Coding DNA Sequence Number=SeqID_30922
MKLAKYKWRRTKAQVEKDKAPEWRMMKAQVEKDEGPEAETLSRLLITYQGNPCGVYPDLSFFTGSGVYPDLSSLTRSGVYPDLSSFTGSGVIQTFIACIKRSAPTQVHIIWSGLHIDDCNLMNLVLLQVERLLQANQRSLKDYHCRPYPKNANLLTHANNGLILS

SEQ ID NO: 147701 - protein, 256 aa, Glycine max
  Coding DNA Sequence Number=SeqID_30923
  Gene Ontology: Mol. function=transporter activity; Biological process= transport
  Homolog annotation: Hit_ID=Q1R3I2; Match level="QueryCoverage=64%, HitCoverage=31%, E-value=4e-40, Identity=48%"; Hit description =Putative conserved protein
GFLGALNDTPYSYDPEKAKAILQKAGLTNVSFKLSTSNQPPYLDIAQALQGSFAKGGVKVEVQPGLSSEVSTRVKAHQYEATLNAWGADYFDPNTNAASFAYNPEDGSKTIAYRSDWHIPELSKQTLAATAEADSNKRVALYQAMQREVLKNSPFRSNGSVSVIGRVRPATLAALQPPRHQPAVAAGDAGGFVSVYLHAVAPVASRPGAANRRRSRQRSHLCSGASRPGAGSAGAGAVLALYQPSGAGQSRPVASH

SEQ ID NO: 147702 - protein, 360 aa, Glycine max
  Coding DNA Sequence Number=SeqID_30924
  Gene Ontology: Mol. function=transcription factor activity; Cellular component=nucleus; Biological process=regulation of transcription, DNA-dependent
  Homolog annotation: Hit_ID=Q1RYM8; Match level="QueryCoverage=55%, HitCoverage=57%, E-value=3e-24, Identity=35%"; Hit description =Pathogenesis-related transcriptional factor and ERF
  Pfam annotation: Domain name=AP2; Domain location=146-210; Score =147.7; E_value=3.2e-41; Accession=PF00847.10; Description=AP2 domain
MVEARVIEAQQDHCCCGGYSQLLIIHTCFLTVAHQRGLGSGSGKFLAAEQGGDEETEESTVGSVPSHVVSAASAQTNNQWVPASGSPMMSRFMNAPSSPGLSPLFGVGHKRAREDDTGAGASVGLGVVAAASSQTQGNESGGGERRRRYRGVRQRPWGKWAAEIRDPHKAARVWLGTFDTAEAAARAYDEAALRFRGNRAKLNFPENVVQVQPPPPLPNLPASAVAGSGSGSVVTGFAPTVMQGTRFQDSSDFLRDYWGYSQLLRSTGEFHGLDHWFFDSQMAAFQSSLPSSLLPSPPPPAFLPSSASYPLFSSSQQMGIFRPPGEQGHGGEDGGSGSGFTELLPSTWSDTSGYPPPPPG

SEQ ID NO: 147703 - protein, 181 aa, Glycine max
  Coding DNA Sequence Number=SeqID_30925
MACEHRWNFDLHFSPSLEQQACGRPLPALRMHVWTIELTQALLCDPKPLMVPPIAAIHLPSCGFHMTILRKVGPPLQWSVVLVGPGFHDKYVAEPWYQFLVEGDSVHGDKLLFHYRSREDIWEMGPSNCLAAIRFSAAFRVSKDKDTSFEVDVIGPIHWQGRPRSVLATGDTSLQPMSLNT

SEQ ID NO: 147704 - protein, 293 aa, Glycine max
  Coding DNA Sequence Number=SeqID_30926
  Gene Ontology: Mol. function=histone-lysine N-methyltransferase activity; Cellular component=nucleus; Biological process=chromatin modification
  Homolog annotation: Hit_ID=Q6ZW69; Match level="QueryCoverage=86%, HitCoverage=50%, E-value=1e-141, Identity=97%"; Hit description=CDNA FLJ41529 fis, clone BRTHA2014792, weakly similar to ENHANCER OF ZESTE
  Pfam annotation: Domain name=SET; Domain location=97-226; Score =186.7; E_value=5.7e-53; Accession=PF00856.18; Description=SET domain
MTVTIQPFALMSSNKDIITLKDPHTEELPQYIHINQNEFCIRRHKKQKEEDIAICECKYDADDPDNACGDSCLNVLTSTECTPGYCHCDILCKNQKFQKCEYAKTKLFKTEGRGWGLLADEDIKAGQFVIEYCGEVISWKEAKRRSQAYENQGLKDAFIIFLNVSESIDATRKGSLARFINHSCQPNCETRKWNVLGEIRVGIFAKHDIPIGTELAYDYNFEWFGGAKVRCLCGALKCSGFLGAKSRGFQSTIFSNVGKTMSRRILIYGKMMMAGCYDQISLLSLYMCVKPRL

SEQ ID NO: 147705 - protein, 99 aa, Glycine max
  Coding DNA Sequence Number=SeqID_30927
  Subcellular localization annotation: CTP_CleavageSite=24; ConfidenceScore=5.03e-01
MVSLTEKPKFHGSRPRGGPTKGTVAMRFRCRDGGAWTSRAEDRTGQGRRVAARFPGLSHAFQGEPNPNLVREMSTGNDGGGGGRRRRAADDTCSDANLN

SEQ ID NO: 147706 - protein, 463 aa, Glycine max
  Coding DNA Sequence Number=SeqID_30928
  Gene Ontology: Mol. function=zinc ion binding; Cellular component =integral to membrane; Biological process=behavior
  Homolog annotation: Hit_ID=Q1RYL8; Match level="QueryCoverage=96%, HitCoverage=96%, E-value=1e-177, Identity=71%"; Hit description=Zinc finger, DHHC-type
  Pfam annotation: Domain name=zf-DHHC; Domain location=135-199; Score =121.0; E_value=3.5e-33; Accession=PF01529.11; Description=DHHC zinc finger domain
MSFSNHRLELFSLHALKKFICGGRLVFGPDARSLFVTLLLIIVPVIIFCVCVASHLRHEFSSYNSGYAILVVAILFTIHVLVVLFLTSSGDPGIVPRNPYPPEEEFRYDSSVSVDAGGAGRQTPSLQFPRTKEVVVNGIAVRVKYCETCMLYRPPRCSHCSICNNCVERFDHHCPWVGQCIGLRNYRYFFMFVSSATILCIYVFSLSALYIKVLMDNYDGTVWKAMKESPASVILMAYCFISLWFVGGLTGFHLYLLGTNQPLCICKGKAAYNIPPPYLRIAKSLWAMGLLPLVLQTTYENFRYRADGRINVFNRGCLNNFLEMFCTKVKPSRNNFRAFAREEVPPRPRAPIIPRDRDDLGGDRRPKVEADLDIGEDLLKISQRRNIEELDEDIQGRGSNGPPGNTSEPDSIMSSDHRAPTIRSDARHLSWERSGNWEIAQDVLANSNVTESRNYVTSKEMRQ

SEQ ID NO: 147707 - protein, 384 aa, Glycine max
  Coding DNA Sequence Number=SeqID_30929
  Homolog annotation: Hit_ID=Q9C770; Match level="QueryCoverage=34%, HitCoverage=40%, E-value=2e-56, Identity=82%"; Hit description =Integral membrane protein, putative; 85705-84183
  Subcellular localization annotation: CTP_CleavageSite=36; ConfidenceScore=5.28e-01
MSSLLNGLGGGLNFIQSIGATLTVSLSPPCPRNQPKHATVEGFDSVQALRTMHGVSDAGASSEQRRRVGCGFRPIMVVVLENGELELDDDKDVGEGDGGAAKGDFERGGDFTNRSTTSIGCGSGGDSGCGASSAVGEMPLVAAESGGGGGATCYPAGNDDGDEGEIGELGLALEGHDVSEDSSEEGGGGADGLVERHRKVAEGDIAENDGDAEDEVEGGDLEELEFGTDGLHGDHLEPGDGNIAKEGVGGHVAHGEEDRILEAIVAQKVLVEEQYPNVGGVPRRHQSDPCYPAGNDDAGDFDDHEGAGGVEVGGWFIEEEHDGVVDDVGVDGDTTAFATGDATVALVADDQRREKLRGERGVPCQGISAKILIEYFSQEDPCNV

SEQ ID NO: 147708 - protein, 82 aa, Glycine max
  Coding DNA Sequence Number=SeqID_30930
MVYKVEILLVGWGIHRVNIVLAEHINGCRGDNMSEERPYRKKNHKLVQGYGHEGSATAAWKLGFRYVEVESDYANAGYLELL

SEQ ID NO: 147709 - protein, 219 aa, Glycine max
  Coding DNA Sequence Number=SeqID_30931
MVRTFEVLCPFFNIQPIVLVFLYFFQMKLIGKIGWVSLNSVSKKLLEFDSNVFHCFKDCFFKVLSIEKIHRLETKRKKGLSIFFSYSIKPMIGSELTKPCDFQSKECVCVTVATITKFLVANGWIHEGCPKLCNKKVDCEKFPYTCQGRGSKSATTVASWQEGEFDPKGIPKVIDRTLGENLAFKFKLPGIEPEMSYSFVKKSDDLVYTVHQISLSGVV

SEQ ID NO: 147710 - protein, 264 aa, Glycine max
  Coding DNA Sequence Number=SeqID_30932
  Gene Ontology: Mol. function=histone-lysine N-methyltransferase activity; Cellular component=nucleus; Biological process=chromatin modification
  Homolog annotation: Hit_ID=Q6ZW69; Match level="QueryCoverage=91%, HitCoverage=49%, E-value=1e-129, Identity=97%"; Hit description=CDNA FLJ41529 fis, clone BRTHA2014792, weakly similar to ENHANCER OF ZESTE
MTWKRQAVAIAINAGCCGLVLYSVEKIPVYDSAEDEPVSNFNGRTEPSLDVIVKAEQLSESTAFHVQPLDSVQMKDLDVKKIKTDVADEDMNFYSQDSEHTLSQKNAISHIRSNTAGRNYCLGPRSMSTKRSRAYNGGRFKNLIEKKIDVKFAAALLASKEAQEEIFNCEVSSMQKMKDDATSALDSLYDEIRPAIEEHERDSQDSVSTTVAEKWIQACCLKLKAEFDLYSSIVKNVACTAQRASGQVKPTEVDNENEIKLLTG

SEQ ID NO: 147711 - protein, 72 aa, Glycine max
  Coding DNA Sequence Number=SeqID_30933
LNDGGCTNNARQSIRGAPDSMGSGLNDGGCTNSARQSIRGAPDSMVEDAGTALGNQFMGLRIRSEFRTEWST

SEQ ID NO: 147712 - protein, 44 aa, Glycine max
  Coding DNA Sequence Number=SeqID_30934
  Subcellular localization annotation: CTP_CleavageSite=16; ConfidenceScore=5.26e-01
MAFALASLAFPSSVFRAWTSSSSSGASKFSSLITLNLESQSNPH

SEQ ID NO: 147713 - protein, 80 aa, Glycine max
  Coding DNA Sequence Number=SeqID_30935
MNKKDRLGLNLDGKLARFKGWAVASFLGLYKVKWWLNRNIEMVITQATRLQMRNKVEDEMVEGKNHSFQRGQHTKDVKDL

SEQ ID NO: 147714 - protein, 61 aa, Glycine max
  Coding DNA Sequence Number=SeqID_30936
MEKLRVCNIYVSQWEYGTIQHEVKAQKMGEKSFLENSYMILKQLDSAATLVEWIRKQRQKF

SEQ ID NO: 147715 - protein, 100 aa, Glycine max
  Coding DNA Sequence Number=SeqID_30937
MGLNGVLLGNRPALAARVASGADLVVRARGGYFVGAEEITGDGSACRRVVVEDTGRESTEKKEGRPSFDVRRCTIKLYTKINLKADNSGPPKITYIHDPP

SEQ ID NO: 147716 - protein, 72 aa, Glycine max
  Coding DNA Sequence Number=SeqID_30938
MELHELPPMLLVFNQPGPHFDKELTRWLTDEQHKSAHVHVLINCVIESRSVVGQTMCTQDQLVNLESRSASQ

SEQ ID NO: 147717 - protein, 130 aa, Glycine max
  Coding DNA Sequence Number=SeqID_30939
  Homolog annotation: Hit_ID=Q9ZQ61; Match level="QueryCoverage=51%, HitCoverage=5%, E-value=2e-10, Identity=47%"; Hit description =Putative helicase
MPLLNLSEWKKETLEKKKSHDLKLQLISHRKIDGRIYNLPKVSEVVALISGDRNEPLNMDIILQLQNGKLQRINELHASYLAPLELVGLGSSSSMDSFASWKMNGSRMEKEEREEMPLQGEDESRRSSPP

SEQ ID NO: 147718 - protein, 142 aa, Glycine max
  Coding DNA Sequence Number=SeqID_30940
  Gene Ontology: Mol. function=transcription regulator activity; Cellular component=nucleus; Biological process=regulation of transcription
  Homolog annotation: Hit_ID=Q8LRU0; Match level="QueryCoverage=82%, HitCoverage=18%, E-value=1e-50, Identity=83%"; Hit description=Myc -like regulatory protein
MKVHVAMWMRNMVLEWREGYYNGDIKTRKTVQAMELEMKADKIGLQRSEQLKELYKFLLAGEADPQTKRPSAALAPEDLSDLEWYYLVCMSFVFNHNQSLPGRALEIGDTVWLCNAQHADSKIFSRSLLAKGKFHLYSLRSF

SEQ ID NO: 147719 - protein, 418 aa, Glycine max
  Coding DNA Sequence Number=SeqID_30941
  Gene Ontology: Mol. function=triacylglycerol lipase activity; Biological process=lipid metabolic process
  Homolog annotation: Hit_ID=Q1RN82; Match level="QueryCoverage=99%, HitCoverage=98%, E-value=1e-159, Identity=61%"; Hit description =Calmodulin binding heat shock protein
  Pfam annotation: Domain name=Lipase3_N; Domain location=9-76; Score =89.8; E_value=8.5e-24; Accession=PF03893.7; Description=Lipase 3 N -terminal region
  Pfam annotation: Domain name=Lipase_3; Domain location=109-239; Score= 83.9; E_value=5e-22; Accession=PF01764.16; Description=Lipase (class 3)
  Pfam module annotation: Pfam domain module=Lipase3_N::Lipase_3; Domain location=9-76::109-239
MSAICGLPILECVYCLACARWVWKKCLYTAGYESENWGLATAQEFEPVPRICRLILAVYEDDIRNPQWAPQGGYGINPDWVILRKDYDDNQGRVTPYMIYLDHDHAEIILAVSGLNLGKESDYIVLLDNKLGQAEFHGGYVHNGLLKAAGWVFDAEYEILRELVAENPNYMLIFTGHSLGAGVVALLTMLAVHNRDKLGISRNKIRCFAIASPRCTSLNLAVRYADVINSVVLQDTCTLEEKKLRDPRRLYAPGRLYHIVERKPFRIGRLPPVVRTAVPVDGRFEHLVLSCNATSDHAIIWIERESRRALDLMRDKDEQHMEIPEEQKMERHESIAREHSEEYHAALKRAVALDIPQAYSPSLYGTFNQIDVGEDSGRSSVLGSSLSHKKRAQNWNEFVGRLFDVDDSGHMVFKKTSP

SEQ ID NO: 147720 - protein, 66 aa, Glycine max
  Coding DNA Sequence Number=SeqID_30942
MVMEEQEENVGEEGEEAGNFWRKEREAIREEKSGPFWMLKSCLDLRVVSPVPVLHVSLHLSGPVFK

SEQ ID NO: 147721 - protein, 173 aa, Glycine max
  Coding DNA Sequence Number=SeqID_30943
MDKLHKINMQGRTDKNWAEKHAKWISGSSMNFEIGQSSKETNIVQPECNPAYTPIPPMIDYIPPTYTPIRTMTDYFFPSPLNMDYTPPIVQPDDFLSNVFGTDCGTSTSACEYMHSLQNEVGKFTPPSFNLMFSQDVEENNPLLHDISDQRPHRNPGRNGRRPPCGTGHHYGD

SEQ ID NO: 147722 - protein, 289 aa, Glycine max
  Coding DNA Sequence Number=SeqID_30944
  Gene Ontology: Mol. function=oxidoreductase activity; Cellular component=apical plasma membrane; Biological process=flavonoid biosynthetic process
  Homolog annotation: Hit_ID=Q6TY49; Match level="QueryCoverage=54%, HitCoverage=56%, E-value=2e-37, Identity=47%"; Hit description =Reductase 1
  Pfam annotation: Domain name=Aldo_ket_red; Domain location=112-289; Score=-41.0; E_value=7e-07; Accession=PF00248.11; Description =Aldoketo reductase family
MFNIFYNNPTLPFVELFAIISDNNNPLSNQHDSTSNLEDLSNEYETYWVKNHGSDTDSSSRLEKSNMFPSHKTIFKRVYPLLEQQVAWTLLYSKSMRRSSRSSTNFLLFFFLNSQRKNLGNGRKSIHREDLALNQRVGFIETHQEMHSILKHIHIKLWDLRHLDRRLKIEYLDLYLIHWPINVKPGDWETPYTKDLISAFNLTGVWKQMEECKKLGLAKSIGVSNFTCKKLKDLLSFATIPPSVNQGIIITAFSPLGAKGASWGSNVVMDSEILKEIAKAHGRTIAQHN

SEQ ID NO: 147723 - protein, 79 aa, Glycine max
  Coding DNA Sequence Number=SeqID_30945
MKNEERMINKRRITEEQTTNGVGIDHGCDSEQNKAFGLKVAPLGELSSARRVDNFILKQPCSPRRAGYFIMKLSRWLRG

SEQ ID NO: 147724 - protein, 380 aa, Glycine max
  Coding DNA Sequence Number=SeqID_30946
  Gene Ontology: Mol. function=protein binding; Biological process=red or far red light signaling pathway
  Homolog annotation: Hit_ID=Q9FV01; Match level="QueryCoverage=87%, HitCoverage=99%, E-value=3e-79, Identity=46%"; Hit description=SKP1 interacting partner 4
  Pfam annotation: Domain name=F-box; Domain location=23-70; Score =39.0; E_value=1.6e-08; Accession=PF00646.23; Description=F-box domain
  Pfam annotation: Domain name=Kelch_1; Domain location=115-161; Score =35.3; E_value=2.1e-07; Accession=PF01344.15; Description=Kelch motif
  Pfam annotation: Domain name=Kelch_1; Domain location=181-226; Score =36.3; E_value=1.1e-07; Accession=PF01344.15; Description=Kelch motif
  Pfam annotation: Domain name=Kelch_2; Domain location=115-161; Score =17.8; E_value=0.038; Accession=PF07646.5; Description=Kelch motif
  Pfam annotation: Domain name=Kelch_2; Domain location=180-226; Score =17.6; E_value=0.046; Accession=PF07646.5; Description=Kelch motif
  Pfam module annotation: Pfam domain module=F-box::Kelch_1::Kelch _1::Kelch_2::Kelch_2; Domain location=23-70::115-161::181-226::115 -161::180-226
MEHLDDGKESSNSVNEIEATNSLLICGLPDDLSLMCLARVPRKYHSVLKCVSKRWRDLICSEEWYHYRRKHKLDETWIYALCRDKSNEIFCYVLDPTTSRRYWKLLDGLPPHISNRKGMGFEALGNKLFLLGGCSGFLDSTDEAYSYDASSNCWVEAASLSNASDFYLSYNNNNKVLPHQLRCYFACEVLDEKLYAIGGLVSNSSDNSWDTFDPLTKCWTFHIDPNIASDIEDSVVLDGKIYTRCARHTDVAPHAFAVVYEPSSGTWQYADADMVSGWTGPAVVVYGTLYVLDQSLGTRLMMWHKERREWIPVGKLSPLLTRPPCQLVAVGKSIFIVGKTLSTVVVDVGDLGNEGQVMMGSSIPGLLSDFNVISCKCLSI

SEQ ID NO: 147725 - protein, 365 aa, Glycine max
  Coding DNA Sequence Number=SeqID_30947
  Gene Ontology: Mol. function=protein binding; Biological process=red or far red light signaling pathway
  Homolog annotation: Hit_ID=Q9FV01; Match level="QueryCoverage=82%, HitCoverage=93%, E-value=5e-67, Identity=45%"; Hit description=SKP1 interacting partner 4
  Pfam annotation: Domain name=F-box; Domain location=23-70; Score =35.5; E_value=1.8e-07; Accession=PF00646.23; Description=F-box domain
  Pfam annotation: Domain name=Kelch_1; Domain location=115-161; Score =34.6; E_value=3.4e-07; Accession=PF01344.15; Description=Kelch motif
  Pfam annotation: Domain name=Kelch_1; Domain location=163-208; Score =42.6; E_value=1.3e-09; Accession=PF01344.15; Description=Kelch motif
  Pfam annotation: Domain name=Kelch_2; Domain location=115-161; Score =18.5; E_value=0.024; Accession=PF07646.5; Description=Kelch motif
  Pfam annotation: Domain name=Kelch_2; Domain location=163-208; Score =30.1; E_value=8e-06; Accession=PF07646.5; Description=Kelch motif
  Pfam module annotation: Pfam domain module=F-box::Kelch_1::Kelch _1::Kelch_2::Kelch_2; Domain location=23-70::115-161::163-208::115 -161::163-208
MEHVDKGKESSNSDNEVEATNSPIICGLPDDISLMCLARIPRKYHSVLKCVSKRWRDLICSEEWICYRRKHKLDETWIYALCKDKSKEIFCYVLDPTDPIRYWKLVGGLPPHISKREGMGFEVLGNKLFLLGGCREFLGSTNEVYSYDASSNCWAQATSLSTARYNFACEVLDEKLYVIGGSGSNSSDHSWETFDPLTNCWTSQTDPKIVSEIKHSVVLDGNIYVRCARFCANPRVFSVVYKPSSGTWQYADDDMVSGWTGPVVVVDGTLYVLDHSLGRTRLMISLKEGREWIPVGRLLPLHTRPPFQLVAVGKSIFVVGRVLSTVVVDVGDLGNEDQFPAVSPCPALLLPKFMFFVIAHLALQS

SEQ ID NO: 147726 - protein, 89 aa, Glycine max
  Coding DNA Sequence Number=SeqID_30948
PVEWILPTPTPYQLVEPIQVIEVSSSEEDPEEDPEELPPEPAMDAFDLPEDDEDPLPDVDSLEDIMSASEADSTEESGPGGTANSEDSS

SEQ ID NO: 147727 - protein, 108 aa, Glycine max
  Coding DNA Sequence Number=SeqID_30949
MTIICPCVPSDLIISGWRKGVRMTIICLRMSSGLPPLDDKKVQNDHNLSLCAIRLDRLRMAKRCGMTIICLFMSSGSPPLDDKRHRMTIICLCVPSDSIVSGWRKGAE

SEQ ID NO: 147728 - protein, 57 aa, Glycine max
  Coding DNA Sequence Number=SeqID_30950
  Subcellular localization annotation: CTP_CleavageSite=27; ConfidenceScore=5.38e-01
MSHSQGFFKGSLAASNGSSWWPPVVVSCGEGSVRISLSELVSLSGSLLFALSASIRT

SEQ ID NO: 147729 - protein, 122 aa, Glycine max
  Coding DNA Sequence Number=SeqID_30951
  Homolog annotation: Hit_ID=Q1T3M2; Match level="QueryCoverage=91%, HitCoverage=59%, E-value=4e-55, Identity=86%"; Hit description =Barwin-related endoglucanase
MFSNSFKPHQLTLNSFEKGGDGGGPSECDNQYHSDDTPVIALSTGWFKNRSRCLHNITISANGKRVVAMVVDECDSTIGCDEDHDYQPPCSNNIVDASKAVWGALGVPHNQWGGLEITWSDA

SEQ ID NO: 147730 - protein, 66 aa, Glycine max
  Coding DNA Sequence Number=SeqID_30952
MEKQECISTQLHVKTLEIKETNITITGNKEIREALELQGDNCGAGEQVDAEKHACTVHMFNFSGYD

SEQ ID NO: 147731 - protein, 413 aa, Glycine max
  Coding DNA Sequence Number=SeqID_30953
  Gene Ontology: Cellular component=integral to membrane
  Homolog annotation: Hit_ID=Q9M2D2; Match level="QueryCoverage=86%, HitCoverage=90%, E-value=1e-110, Identity=55%"; Hit description =UPF0187 protein At3g61320, chloroplast precursor
  Pfam annotation: Domain name=UPF0187; Domain location=84-399; Score =444.2; E_value=1.7e-130; Accession=PF05249.2; Description =Uncharacterised protein family (UPF0187)
  Subcellular localization annotation: CTP_CleavageSite=6; ConfidenceScore=5.30e-01
MYQKPRTQLKPTSLSSLFTPKCLLNQKLLLLPSWKPNKTYKPLTILASFPPGPTSGPAQTLISLLRSIPDWADAVQERGMQKKRALYTHQNWRDHRSSLRHLRHVFSSLSSRVILSLVPPVLFFTAFAATIAAYNEALLLHLLPDFLPLLRASSLPYQLTAPALALLLVFRTEASYSRFVEGKKAWTIVIAGTHDFARQVAAVVVDDDGGNFAIKHALLHYIIAFPIALKCHVLYGSDVRSDLQHLLEVDDLAVVMNSKHRPRCIIEFISQSIRLLKLEESRRNALESKMTCFHEGIGICDQLMGIPIPLAYTRLTSRFLVLWHLTLPIILWDDCHWIVVPATFISAASLFCIEEVGVLIEEPFATLALDDLCQKAQKDIREAIATGNLIHARLVAKQNSHSEEHSPNGWPNS

SEQ ID NO: 147732 - protein, 542 aa, Glycine max
  Coding DNA Sequence Number=SeqID_30954
  Gene Ontology: Mol. function=protein-tyrosine kinase activity; Cellular component=cytoplasm; Biological process=protein amino acid phosphorylation
  Homolog annotation: Hit_ID=Q1SVI3; Match level="QueryCoverage=99%, HitCoverage=99%, E-value=0.0, Identity=76%"; Hit description=Protein kinase
  Pfam annotation: Domain name=Pkinase; Domain location=59-361; Score= -27.2; E_value=6.1e-07; Accession=PF00069.15; Description=Protein kinase domain
  Pfam annotation: Domain name=Pkinase_Tyr; Domain location=142-361; Score=-70.8; E_value=4e-08; Accession=PF07714.7; Description=Protein tyrosine kinase
  Pfam module annotation: Pfam domain module=Pkinase::Pkinase_Tyr; Domain location=59-361::142-361
MGIQCSRLIPCCVDSQVKASVIETPDAEIEDSSEVSNWPTFREYTLEQLKNATSGFAVENIVSEHGEKAPNVVYKGKLENQMRIAVKRFNRNAWPDARQFLTSANEPSVVNKPHIGNMQVCLKLKIVSVHTFFQWAANNLRFLGFIVSVKLMEEARSVGQLRNQRLANLLGCCCEGEERLLVAEYMPNETLAKHLFHWETQPMKWAMRLRVVLHLAQALEYCTSKGRALYHDLNAYRVLFDEDGNPRLSSFGLMKNSRDGKSYSTNLAFTPPEYLRTGRVTPESVIYSFGTLLLDLLSGKHIPPSHALDVIRGRNLQMLTDSCLEGQFSDDDGTELVRLASRCLQYEPRERPNPKSLVVALAPLQKETEVPSHVLMGIQHSTTFASLSPLGEACSRKDLTAIQEVLESIGYKDDEGVANELSFHMWTDQMQDTLNCKKKGDVAFRQKDFRLAIECYSQFIDAGTMVSPTVYARRSLCYLISDMPQESLNDAIQAQIVSPVWHIASYLQSVALTGLGMENEAQAALKEGTTMESKRNATPKQK

SEQ ID NO: 147733 - protein, 45 aa, Glycine max
  Coding DNA Sequence Number=SeqID_30955
MALNPMLSTLHSSLGWIDLGKWEQTFLRDLVATLVIALGQFWIHW

SEQ ID NO: 147734 - protein, 513 aa, Glycine max
  Coding DNA Sequence Number=SeqID_30956
  Gene Ontology: Mol. function=diaminohydroxyphosphoribosylaminopyrimidi ne deaminase activity; Biological process=riboflavin biosynthetic process
  Homolog annotation: Hit_ID=Q8L8N0; Match level="QueryCoverage=74%, HitCoverage=92%, E-value=4e-98, Identity=48%"; Hit description =Probable riboflavin biosynthesis related protein
  Pfam annotation: Domain name=RibD_C; Domain location=234-426; Score= -53.0; E_value=0.032; Accession=PF01872.8; Description=RibD C -terminal domain
  Pfam annotation: Domain name=dCMP_cyt_deam_1; Domain location=66-187; Score=117.3; E_value=4.2e-32; Accession=PF00383.13; Description =Cytidine and deoxycytidylate deaminas
  Pfam module annotation: Pfam domain module=RibD_C::dCMP_cyt_deam_1; Domain location=234-426::66-187
  Subcellular localization annotation: CTP_CleavageSite=58; ConfidenceScore=5.41e-01
SSSFHKKISRATKRRPAVSDNTMQAQCPSLPDCTLQVPRFSISATPPNFASFLSPSKCAGSNGENDDDDGFYIRRCVELARKAVGFTSPNPLVGCVIVKDGKVVGQGFHPKAGQPHAETVPNCDLGRNIKVFVGRWDCQVFALRDAGDLAQSATAYVSLEPCNHFGRTPPCTEALIKAKVKKVVVGMVDPNPIVAFKGVERLRDAGIEVVVGVEEELCKSLNEPYIHRMLTGKPFLTLRYSLSVNGNFMDLLGDGVTDCGGYYSRLLQEYDAVVISSSLFSENLSVPASQEPGANQPIRIILHKDPSSSNQIPLAINGVTHKVIIFTDNKTVTAPEVAQQGIETVALDQINLDVILDYCNRQGLCSVLLDIRGSFGEFEDLVKEGIKKNYINKFVTEILPVWNGHTEPDPLHTLKSLEQGAEVFLVNSPALIGFFFNLALNWPDARQFLVNSPAPIGSAERCDAGTSRSPVWHIASYLLSVALTGLGMENEAQAALKDSTTLESKRNATPKQK

SEQ ID NO: 147735 - protein, 113 aa, Glycine max
  Coding DNA Sequence Number=SeqID_30957
  Gene Ontology: Mol. function=nucleic acid binding
  Homolog annotation: Hit_ID=Q9FNZ2; Match level="QueryCoverage=77%, HitCoverage=23%, E-value=2e-22, Identity=59%"; Hit description=Zfwd1 protein
  Pfam annotation: Domain name=WD40; Domain location=34-72; Score=31.8; E_value=2.4e-06; Accession=PF00400.22; Description=WD domain, G-beta repeat
MEIEEMQQGLLRLSRNHHQGYVNTGSTTIVYMVNNALTKLQEHKKVITGIALPVGSDKLYSGSTDGTVRIWDCHTGQCAKVINLGAEVTSLISEGSWIFVGLQNAVQGVVHAN

SEQ ID NO: 147736 - protein, 61 aa, Glycine max
  Coding DNA Sequence Number=SeqID_30958
MELSNGKGPSRVNLGCVEAYQGRALDFVNPYGSASAKVGFDESCVQCKYCALTYTPLTKWQ

SEQ ID NO: 147737 - protein, 105 aa, Glycine max
  Coding DNA Sequence Number=SeqID_30959
QFGINEKPEAYAANIYNRPPQQQNQQQQNNYDLSSNRYNPGWRNHPNLRWSNPPQQQQQQQQPAPPFRNAAGPSRPYVPPPMQQQQQRQQATEAPSQPSLEELVR

SEQ ID NO: 147738 - protein, 62 aa, Glycine max
  Coding DNA Sequence Number=SeqID_30960
RLFANGDDAKDLTWHTNGKNCDGMRKYMMLYMMISSPRQPGNDIDVYLSSLIEDLKKLWDKE

SEQ ID NO: 147739 - protein, 274 aa, Glycine max
  Coding DNA Sequence Number=SeqID_30961
  Gene Ontology: Mol. function=chitin binding; Cellular component =extracellular region; Biological process=chitin metabolic process
  Homolog annotation: Hit_ID=UPI0000612705; Match level="QueryCoverage =99%, HitCoverage=93%, E-value=2e-29, Identity=28%"; Hit description =UPI0000612705 related cluster
EGCTPWPGEAWRSSPLEGFTPLPSEDYTSSPSEGYTSSPSEDYTSSPSEDYTSSPSEGCTPSPSEDYSTSEDYMSLPLEDSTSLPSEDCMSSSLEGHTPSPSEDYTSSPSRDYTSSLHRTTCPCLQRTTHPCLQRITRPHLEWAARPGLERAASARLQRAPRTRLQRNTRPRLQRATRPHHQRTSRPRLQKAACPHLQRTTRPRLQRTTRPHLHRTTWLHTLTFRGLQVLTFRGLQTLAFRGQHVLVFRGLHALAFRGLHVLAFTGLHVLTFRG

SEQ ID NO: 147740 - protein, 55 aa, Glycine max
  Coding DNA Sequence Number=SeqID_30962
MENLLMDLQIEVVVIGQDVAEQQHHPYLGQGGHAGGHDPYLSPYSGPGEILPRYA

SEQ ID NO: 147741 - protein, 82 aa, Glycine max
  Coding DNA Sequence Number=SeqID_30963
PAIMIDASSNEEKSYYKVLKKSNRLNLMFMRMTIADSINTTLLKSDNAKVFMGLVEERSQTTDKSLAGTLMSSVTTMKFMVH

SEQ ID NO: 147742 - protein, 55 aa, Glycine max
  Coding DNA Sequence Number=SeqID_30964
MQDSKRDLYIGAYLNGPNNYLKGIITSALKAHDDTPQSKSKATARWIVVKTERKH

SEQ ID NO: 147743 - protein, 99 aa, Glycine max
  Coding DNA Sequence Number=SeqID_30965
MTQELVARGDTLRLSAPRHSVTPSVIDEQRPMWSSVPIPEMSASSGGDFFKSHKIRRSKSLAFVDHPTISVILTLRSCDTQRQIMVILYPFVIQRQRAR

SEQ ID NO: 147744 - protein, 70 aa, Glycine max
  Coding DNA Sequence Number=SeqID_30966
MDICEDTDIPVILGRPFMLTASCIVDMGRRKLELGFEDQKIDFDLFVEDKPAPEQNVCLQVMEGRQEVLT

SEQ ID NO: 147745 - protein, 62 aa, Glycine max
  Coding DNA Sequence Number=SeqID_30967
MVTRSVKFRNVTETKRKYCYAIPIRPTWAFQILPPEGGCFWRKQPGSPGRAGWHAPPLFCYK

SEQ ID NO: 147746 - protein, 78 aa, Glycine max
  Coding DNA Sequence Number=SeqID_30968
MGHHRFVILFGRNNQYENTEKVIKGFPMNPKRIKFISEWPTPPSVEGRSPEYEEPRDLRSTPFQGGGNDAILPRKGIG

SEQ ID NO: 147747 - protein, 75 aa, Glycine max
  Coding DNA Sequence Number=SeqID_30969
  Subcellular localization annotation: CTP_CleavageSite=37; ConfidenceScore=5.21e-01
MPISPCKSISWSVLSRHGPLGAPENSTGAPGFPARVRGLYQSSGVLVPPPPPPTRSHHHRDCARKTPSGPEEGQQ

SEQ ID NO: 147748 - protein, 92 aa, Glycine max
  Coding DNA Sequence Number=SeqID_30970
  Subcellular localization annotation: CTP_CleavageSite=39; ConfidenceScore=5.19e-01
MGGPPILPKSLPAICSFMAFMSAFICSCTFSTSPIILALAQERMQWAMQPMKSMDDMGLNQFRFFNMVHDILVKVKLEVTRTSTVLNVFGSK

SEQ ID NO: 147749 - protein, 95 aa, Glycine max
  Coding DNA Sequence Number=SeqID_30971
MVEMMGRVNLGLKVRMVVMTCRIQFEQNWMRARGISKICPIMQKIAVELCNRIFVLVQKMLVHCWLWERWYILGSGHFLADPNGQNVDLCTRDLQ

SEQ ID NO: 147750 - protein, 64 aa, Glycine max
  Coding DNA Sequence Number=SeqID_30972
IHMAQEEDASTDQIPEPSPVPIPDDATPSAPAPELEQPISQDSPVAQVLDLNEHAQEQPQEQDI

SEQ ID NO: 147751 - protein, 75 aa, Glycine max
  Coding DNA Sequence Number=SeqID_30973
MRVVITERAGRTKSVSYLCFPLISDERYLTPFVAQYVKSRDVPKIKREQAYAIRENSVMLEQPSLPGQAELAWAS

SEQ ID NO: 147752 - protein, 69 aa, Glycine max
  Coding DNA Sequence Number=SeqID_30974
GFVRAHALSALLNRLARISEFRLSAAFLAQQIDRSGALSGMALCSVNKHSSSFFQILPRAKPGIVALSG

SEQ ID NO: 147753 - protein, 239 aa, Glycine max
  Coding DNA Sequence Number=SeqID_30975
  Gene Ontology: Mol. function=coproporphyrinogen oxidase activity; Cellular component=chloroplast; Biological process=porphyrin biosynthetic process
  Homolog annotation: Hit_ID=Q8UD80; Match level="QueryCoverage=100%, HitCoverage=78%, E-value=1e-129, Identity=90%"; Hit description =Coproporphyrinogen 3 oxidase, aerobic
  Pfam annotation: Domain name=Coprogen_oxidas; Domain location=14-239; Score=14.5; E_value=7e-17; Accession=PF01218.9; Description =Coproporphyrinogen III oxidase
MERPILPKGLPEDIEDKKAVAQAWFQHLRDTIVASFETLENELTGPLSDQEPGRFVQKDWLRDNGEGGGGKMSMMEGRVFEKVGVHTSTVYGEFSPEFRNQIPGAEEDPRFWASGLSLIAHPVNPNVPAVHMNTRMVVTTSHWFGGGADLTPVLGRRRTQQDADTQLFHRAFEITCNRHPVADYPRYKTWCDEYFYLKHRDEPRGTGGIFFDWLHPQEQNGGWDANFAFVQDVGRAFNL

SEQ ID NO: 147754 - protein, 85 aa, Glycine max
  Coding DNA Sequence Number=SeqID_30976
  Subcellular localization annotation: CTP_CleavageSite=36; ConfidenceScore=5.20e-01
MPPLAGVCAAHKFDSPSQRVDTIFKDVGARGSATAPAANKSVRACSCGKRFVWDAKKPAPRPENGSTAFPRPLTGLKWKAGGSWK

SEQ ID NO: 147755 - protein, 84 aa, Glycine max
  Coding DNA Sequence Number=SeqID_30977
PSAVRLSSTLKSYSEPHELIFIHASSTIESGAPQIDCQKHVRLSSTLKSYPEPHELIVIHASSTIESGALRIDCLALFMHPPPS

SEQ ID NO: 147756 - protein, 241 aa, Glycine max
  Coding DNA Sequence Number=SeqID_30978
  Gene Ontology: Mol. function=DNA binding
  Homolog annotation: Hit_ID=Q1S0F5; Match level="QueryCoverage=78%, HitCoverage=36%, E-value=3e-22, Identity=33%"; Hit description=IMP dehydrogenase/GMP reductase
MERVAKVVKILAQELDRVKQNRNGVVGIPRQCLEERAKALADQGKWTSFVDILALLVFKIVLFPNVDGLVDLAAIDAFLAYHYSKESPDIAILADAYDIFNLRCEKSNARIVCCTPALYVWLVSHVFCHQGRHVCPLQGYHMCVEKEKSNWERLLASMVGASVSWFPRWKEGGAGVLCSYEGFPNIPLMGTRGYINYNPVLAIRQLGYPMRGASSEEIIVPFVAQGFSEGNAKMLQRIQKA

SEQ ID NO: 147757 - protein, 164 aa, Glycine max
  Coding DNA Sequence Number=SeqID_30979
MAEVTTEAIASLAQYYDQPEEVEAPEEDEEVQALRVELEKAQTVKERFKSVALKIRKENAVGKNMAGTNSEGLCGADELKVCLRSKRSLSQHLCETETNMLAINSKYQEELNPAMVHEHKVADEYARVYVEKEARGRVIDSLHQEATIWMDRFALTLNGSRELP

SEQ ID NO: 147758 - protein, 45 aa, Glycine max
  Coding DNA Sequence Number=SeqID_30980
PSPPEPFIFEADLEPSPQPEPEPSAQCQTLPISQDPPSAPSIGPE

SEQ ID NO: 147759 - protein, 84 aa, Glycine max
  Coding DNA Sequence Number=SeqID_30981
MAASDHTILHNRVHIPTKKSLLELSSQDALLALNKLLSKKLEALTETLSCTLCGGAHGPGLCIPTEETSHEVNYMGNQPRQTLM

SEQ ID NO: 147760 - protein, 101 aa, Glycine max
  Coding DNA Sequence Number=SeqID_30982
MGPDGCRETRGIGTREAAHKPRQDFRIQKVWVDFFSLEIRGCWVFGSYDGKLVEMMGRVNLGLNVRMVVLKAWAEQMRPWGRQVGCYFPKPSLTNPDPTRA

SEQ ID NO: 147761 - protein, 53 aa, Glycine max
  Coding DNA Sequence Number=SeqID_30983
MDTSLKIGEDEWREKEKRSTKLYASNEGMNENAKNESKNAQMEAYSCWKRGLP

SEQ ID NO: 147762 - protein, 96 aa, Glycine max
  Coding DNA Sequence Number=SeqID_30984
MLASVWRVKPEDVGRLAELQERVRRSRAQGPRIRGSTEIKIVKACFKGTFPAGPIYSSIYMKPAENEDYIPTSLDADLVKLFGATAVKSLITPCEG

SEQ ID NO: 147763 - protein, 94 aa, Glycine max
  Coding DNA Sequence Number=SeqID_30985
  Homolog annotation: Hit_ID=Q2K749; Match level="QueryCoverage=81%, HitCoverage=7%, E-value=2e-23, Identity=71%"; Hit description =Excinuclease ABC subunit B protein
MGPGSDAGKPLFRKNTLDEMTVGRTEKPVRGAVPDKPATEPGKRFSPLLEGQPERAADDLRPLVRGKIGAGSYEDAGEQKRKSRTKGKTGRPGR

SEQ ID NO: 147764 - protein, 284 aa, Glycine max
  Coding DNA Sequence Number=SeqID_30986
  Gene Ontology: Mol. function=RNA methyltransferase activity; Biological process=RNA modification
  Homolog annotation: Hit_ID=Q8UDX4; Match level="QueryCoverage=45%, HitCoverage=100%, E-value=8e-65, Identity=96%"; Hit description=Acyl- CoA hydrolase
  Pfam annotation: Domain name=4HBT; Domain location=180-257; Score =60.7; E_value=4.8e-15; Accession=PF03061.12; Description =Thioesterase superfamily
  Subcellular localization annotation: CTP_CleavageSite=8; ConfidenceScore=5.64e-01
MRAPLSPRCAIARPSRVCWRNPPQARWNSSPIFRSPISPMRWVNCTSSASSRSASIRRGPPRLNGPSAAKKSHWCWAPKARACARRPARPSRRSPVSICRERSNRSTCRTRRPSPFTQRSNFWAKRRPDACPSLRNHKAHRMLRLCHSHGAHLNMTDQTIKPTGELTLRTLAMPADANPAGDIFGGWVMSQMDLASGIRAAERSRCRVVTAAVKEMAFELPVKIGDTLSIYTDIARVGRTSITLTVEAWAQRSRYDKLEKVTAGTFIMVAMDENGQPTPIPPAE

SEQ ID NO: 147765 - protein, 100 aa, Glycine max
  Coding DNA Sequence Number=SeqID_30987
MARTCSPLKARTCSPLKVRACRPTKVKVHDPLTVRTCSPLKLKIDCPFERGDNSCNLILSFCKSLWELPQSVRLRFMHGAFHCPSVGLRGTNCCLVFTTS

SEQ ID NO: 147766 - protein, 83 aa, Glycine max
  Coding DNA Sequence Number=SeqID_30988
MQPCCKIENSILESTDPTELESQFVFVTTDHDRSMLDSSEPIELESIPLTPTKRVSSDEFDDEPKNFQISPAEVSSNKLAKHS

SEQ ID NO: 147767 - protein, 98 aa, Glycine max
  Coding DNA Sequence Number=SeqID_30989
MWFEISRHYNYIKCNIEAMQNVENEANAVIIRMRVNSVHENVIGSRALESRCVKVPQLFLTCFGISRPYNETNYKCALEFRGITVTLSVFVLAKMNTV

SEQ ID NO: 147768 - protein, 122 aa, Glycine max
  Coding DNA Sequence Number=SeqID_30990
MLVFGRQQARLPLVNERLVCPWLMKGADNHKVFPACHLPPWVRMTKGAEDDVSLRASTGSSAPDNHLGYFRLPPDLTEVIFVRITAWGISIRHLTSRVRMTESAKDDVNLRMSTGSLAAIDK

SEQ ID NO: 147769 - protein, 92 aa, Glycine max
  Coding DNA Sequence Number=SeqID_30991
MARGTLPTAKGKGCDCCKFGGSVDFDPPAKPILCLTEPCVERKSSWLSAYKIPEADELSMMQSVGINSLSAPLEPPCQASITGAKPNVTYTH

SEQ ID NO: 147770 - protein, 109 aa, Glycine max
  Coding DNA Sequence Number=SeqID_30992
MESSDVRGHLMVISTFRQPGANEPVDTQRLTSSSTPFVILTHGVRWQAEIPCGHPHLSSTEANESDSIRMMLRHSSPTTHEILLCWARAIKFDGMGNCHGCPTLSLSRH

SEQ ID NO: 147771 - protein, 114 aa, Glycine max
  Coding DNA Sequence Number=SeqID_30993
  Subcellular localization annotation: CTP_CleavageSite=83; ConfidenceScore=5.75e-01
MTVYTPPTLTYYQTTSVVSPPPMLTGNKTTTGLVNPTLKWTKTTTVVRPPPMLTGNKTTTGLANPTLKWTKTTTGCLISTDVVFLHYKDGSYDDRCRCCRHTTTSGTKTVWGPS

SEQ ID NO: 147772 - protein, 134 aa, Glycine max
  Coding DNA Sequence Number=SeqID_30994
MELPTVATYPSAGGQGETQRSVFQKGKRVGVATNIYLRKTLEKPKRGLRILKIRVRELFTHGKCISIPHARHKGRQPLIECAKHVFDKGVALAPTYPQITCGTNNRLKLTLQEENGLLMIEEGDEDAQDKKEDP

SEQ ID NO: 147773 - protein, 81 aa, Glycine max
  Coding DNA Sequence Number=SeqID_30995
MAQKIIWLTFLVFLILQHNFGTMEASRKLIHTHPPPAIPRSPQAPALWYTPNDEDGGHDAFRPTCRGHSPGAGHDNPPTKP

SEQ ID NO: 147774 - protein, 144 aa, Glycine max
  Coding DNA Sequence Number=SeqID_30996
  Gene Ontology: Mol. function=phosphoinositide phospholipase C activity; Biological process=intracellular signaling cascade
  Homolog annotation: Hit_ID=Q69L69; Match level="QueryCoverage=79%, HitCoverage=16%, E-value=7e-14, Identity=36%"; Hit description =Calcineurin-like phosphoesterase-like protein
MTTMKNKYEECSKYAWGAAVLGFLYREMCSATDYKTKSIGGRCILLQLWAWERCPTLAPKRTPSQIENIPLGHRWLRRGNQHIGNDDVKVFRRKLDIMKRHEFVWEPYPSTVISLLPPVCLVGTLAWRKTKMFVDPENAKMATL

SEQ ID NO: 147775 - protein, 180 aa, Glycine max
  Coding DNA Sequence Number=SeqID_30997
  Homolog annotation: Hit_ID=Q1SMF0; Match level="QueryCoverage=96%, HitCoverage=37%, E-value=7e-22, Identity=32%"; Hit description =Tetratricopeptide-like helical
VNEQHVDCSDGFNTSQVFATRDDILQCAQSVAHENGFVTVIMKSDTNTGIRGKTSFVLIGCKRSGQYRSRKKDFVRRDTGSRKCGCPFKLHGKSVVGGQLTMDEKTIIVNMTKSMVKPRNILLTLKEHNVNSCTTIKQIYNARSAYCSSIRGSDTEMQHLMKLLERDQYIHWHRLKDEDV

SEQ ID NO: 147776 - protein, 134 aa, Glycine max
  Coding DNA Sequence Number=SeqID_30998
MPIGWTSQKSGADIEEEELTDLRSNPFQGEGDDTILPRKGPVTRAMSKRLQEDWARVVEEGPRVLMNLRESTKKHKGGVFCEKRVANSNKAHLSLPEGSKRRQCLLVEAIVLAWASWAATTSLFSPINRGKRAE

SEQ ID NO: 147777 - protein, 165 aa, Glycine max
  Coding DNA Sequence Number=SeqID_30999
LAELGIEARSGFKSHGEGSTQLSGSIQLSSIESFFGKAEAKTIADINTISEEIVCVTVGTITRIVLDNHSWCYTACIQCHKKSDAEMVPFTCACGKYNKEVVLRYRLEDGDVDLNASPQALDKLLGYELAFKIKVQPKFRNSVVLKCSDDSSLINAVMDMLADAE

SEQ ID NO: 147778 - protein, 124 aa, Glycine max
  Coding DNA Sequence Number=SeqID_31000
LVAPPDSIPSVERFNEWVAWPGTQPPLHREDEGLIAQSLIRRKRVVETQEAATTSKKSLEASSEPSKPVANTTSIQQAADPSTPEDQTTPILSPNTSPSATPVLRLTDEEDVQTPDTQDRSQDF

SEQ ID NO: 147779 - protein, 32 aa, Glycine max
  Coding DNA Sequence Number=SeqID_31001
MMVILRLVSTERSKFDSSAGRKVHWPKGVSLE

SEQ ID NO: 147780 - protein, 76 aa, Glycine max
  Coding DNA Sequence Number=SeqID_31002
MKFFTINPRWKMMRKKPDLFHQSQPHSLNYEVVQYPVGTLFKGMSFLTKQDVQNALHQYHGIIHPCLQAVGNKKAM

SEQ ID NO: 147781 - protein, 106 aa, Glycine max
  Coding DNA Sequence Number=SeqID_31003
MYPLLVPQRMHPPMCWDKEFSGDGVWKVKGKVPRQVKSTTFMQTPCCHGYSVAGQHHLDFQNLGCYSLLVEKLNMPPKGSDQFRVYGLWLINEMLGTTKEQSLIEL

SEQ ID NO: 147782 - protein, 95 aa, Glycine max
  Coding DNA Sequence Number=SeqID_31004
  Gene Ontology: Mol. function=DNA binding; Biological process=DNA integration
  Homolog annotation: Hit_ID=Q6VPE6; Match level="QueryCoverage=93%, HitCoverage=29%, E-value=9e-09, Identity=36%"; Hit description =Putative integrase
MVCAAKGNKGSKELVLNKGDWVLERINKNAYRLDLPKEYGVRNTINITDLVLSAGVADSDDEGFTDLRTNPLQEGGDDAILPRMGPITRSLARRL

SEQ ID NO: 147783 - protein, 415 aa, Glycine max
  Coding DNA Sequence Number=SeqID_31005
MDEDFKHTLIAKGSTVAKQQNFSKTNIKAMKVALEQGLKEASLVDINAINERKHNRLAKAIADEDQGLSETDDEDEGLVQVAFQKRKTRVTKANPKIGDKEWEVSFAENKEDLASSSSSSDSESTDDTPISPLQDAQRIPLAFINGNPTLETSYSKFVLCAPVAREIAFKTLPTDAIVHLPPPQWTCPMQPNIIKMSPYYFALGTQQWVHPSIEVSATQARKKQIHTLNIYDARTFWNQIVWMDSQKASTSGYDGSGNVEHRNIVQVLCPIRNYHFDDACVYFTKVANNYLFIQHLVKLPTIQYDNTYNLKKMIEDQMLAHVTQLHEAQQKKKAEEQVVATMKEDVASVQAKASKVVDDTIVCGVIIDFTNTGVIEETLEASNTTITDEVEHNALKPVSNHSGEVATWDWYQICL

SEQ ID NO: 147784 - protein, 43 aa, Glycine max
  Coding DNA Sequence Number=SeqID_31006
MAEVSTEAIASLAQYYDQPLRDPRMPSRGKETIPLLRILSLFS

SEQ ID NO: 147785 - protein, 239 aa, Glycine max
  Coding DNA Sequence Number=SeqID_31007
  Homolog annotation: Hit_ID=Q1SP03; Match level="QueryCoverage=54%, HitCoverage=26%, E-value=8e-14, Identity=33%"; Hit description=IMP dehydrogenase/GMP reductase
MGSSQRPSLKKRFYQVKRQAFCKAYGKIWDLAMIEVSTEAIASLAQYYDQPLRCFTFGDFQLSPMNFQDSPNLGVGIRPQEASRKWGSQNTEKIFGAIDAFLAYHNHKESPVVAMLADLYDTFDRICEKSNTKIVCCTSALYVWANWDQLLASKEGAYVNWFPRWKEGRTGFLISCGGFPNVPLMGTRGCISYNPVLAIRQLGYPMRGAPLEDELAPDKELRDNGPIGGYREWLKAHVQ

SEQ ID NO: 147786 - protein, 130 aa, Glycine max
  Coding DNA Sequence Number=SeqID_31008
MVGYTPSSFADLVFANERIEVGLKRGKFNHPAWTNEKTGANEEGENEGETHVATTVPTWPSFPPTQQCHYSTNNNPSPYPPPSYPQRPSLNQPQNPPTRQPMPKHHLAKTKKEFCSKKPVGFTPNSSVIC

SEQ ID NO: 147787 - protein, 53 aa, Glycine max
  Coding DNA Sequence Number=SeqID_31009
MTGLSLLSLTFGSWYCIVGGILEVVSNPWRFILGNWFCDSDLDNLTGIDRVLT

SEQ ID NO: 147788 - protein, 85 aa, Glycine max
  Coding DNA Sequence Number=SeqID_31010
MERDEKRFEYRFCCSSKENNAEEDKEGGIGAISIGEIKRKLKKKKIASYESRFDEEMSKIGRFEGLRMEERRKGEEAVQGFLKNV

SEQ ID NO: 147789 - protein, 270 aa, Glycine max
  Coding DNA Sequence Number=SeqID_31011
  Subcellular localization annotation: CTP_CleavageSite=37; ConfidenceScore=5.35e-01
MAESSKKRKGSSASASAQRIHSTNSTLLILFRIVFFRRTAETDNTLISEVFGIKMVIDQSLFHDLNQLSSDGVPFEGTLNDDWKFDFSAHDARQLVCTNHADMTGRLLAGSLAFESRILHYLIVRILLPRSSNLAQVSKEDLVIMWAFHTGCQLDWAHLVRYRMHKALRLNAPLPYPHLVTLFFRHFQIPLDSEPYVPIKRSFLIGAAVIASLGYRKKHDGSWVKKAAQPADDEGNLPTEDSSSLQKIFSIVTSFHLVLEWLSKAYIYVT

SEQ ID NO: 147790 - protein, 42 aa, Glycine max
  Coding DNA Sequence Number=SeqID_31012
MSEIRRFGGLGMEERRKRKGAAQGSLENVIFIEQDAWPSVLV

SEQ ID NO: 147791 - protein, 61 aa, Glycine max
  Coding DNA Sequence Number=SeqID_31013
MGKGWLRWRLLEDLFRVLPELPEERVLEDFRKKGSSGSTLRKNPFFRKVSGRTTSSVVYVY

SEQ ID NO: 147792 - protein, 260 aa, Glycine max
  Coding DNA Sequence Number=SeqID_31014
MDEIEEVKEWMKADMEAMKEKMAIMMEAMMSMKKIMKVNAAAVAVTSAVAEVDLTPPSTLNQINHPTSDMVGQGGKELGNTGGPHFVQVQSKHAFPPYDLPPNYTPLNVAHTLDENVDNSAPIPIESQQPQFDNAHVSQPMGETHEAPRDHNLADFKPHLEYVIEGKAIGSVPLPNTLEGPQFCPQPQPLHFAVGRVPLAMVERGKFDHIEERLRAIEGGEDYAFADMAELCLMLAVVIPPKFKMPDFDKYKGLLAPRIT

SEQ ID NO: 147793 - protein, 202 aa, Glycine max
  Coding DNA Sequence Number=SeqID_31015
MVIDQSLFHDLTQLSSDGVPFEGTLNDNRKFDFSTHDARQLVCTNHADITGRLLAGLLAFESRILHYLIVRILLPRSSNLAQVSEEDLVIMWAFHTGRQLDWAHLVRYRMHKALRLNAPLPYPHLVTLFFRHFQIPLDSEPYVPIKRSFLIGAAVIASFGYRKEHDGSWVKKGAQPADDEGNLPVEDNSSLLRKLLDKFDGL

SEQ ID NO: 147794 - protein, 82 aa, Glycine max
  Coding DNA Sequence Number=SeqID_31016
MERDEKRFEYRFCCSSEENSLEEDNEGGIGVVDALIAIGEIKRKLKKKRIASYGSRFDEEMSKIGRFEGLGMEGRRKEEEAA

SEQ ID NO: 147795 - protein, 724 aa, Glycine max
  Coding DNA Sequence Number=SeqID_31017
AGAQQAGAKTETPAVNEAEVVAIAVAQGRDPVAALKAAHDKADGDKAKAAAAKPPENGPLGKLPDPVYVPLKAKALEVMLADQLSWITAWRTERFASPQYADKYYQRKPFYQQALNEQTSALPSAAAPAESEGPREVPFIDKDRLDRAAWGYDFAHTGIVALLGQVLLDVIPTTQTNQLGGPLVAAQESEYIQIKKSGDARRAALMGSPTMLDFYDNYVHDTLAKYNHDPLHSSFSHGANGYERSEYGIGRAGHDGMSGADIAVLNHGPDAIVSVQVDGYGGPRANPYGGGGGFCCVMVPDVWRPGLTAKITWTSDPNAWIDPKHIPDDHASHYQRHGPITVPIERWEKGADSPFLHTTWTAGVSGSPVATRLEAKSSENTYQTYQGGNCMSDTADSTLSALKALIAAFQTGATPVAVKTSTAEAASLPPNFPGPDDKKGEKPADNSVLQKAEYNERGRLPASRTQAEGNYARQYLEGYVGEEPMRCTGHDTSMIKHIRILPGGLAVLAAVFLCLLTACRDHSRDGMSGADINVYNHGPDAIVSMQVDGYGGPRANPYGGGGGFCCVMVPNDWRPGLTAKITWTSDPNSWMKSSEMPDDYETHYQKHGPITVPIERWEKGPGLADSAFLHPAWAAGLPESTLNALKALIAAFQTGATPVAVKTSTAEAASLPPKFPGPDDKNGEKSADNSVQQKAEYNERGRLPASRTQAEGNYARQYLEGYVG

SEQ ID NO: 147796 - protein, 214 aa, Glycine max
  Coding DNA Sequence Number=SeqID_31018
  Gene Ontology: Biological process=peptidoglycan metabolic process
  Homolog annotation: Hit_ID=Q0TE35; Match level="QueryCoverage=99%, HitCoverage=25%, E-value=4e-66, Identity=59%"; Hit description =Putative VGR-related protein
MLLQNASLTLQAPVDQGFGIKIQQPVRVLQGVITSFERLSTAKEETRYALTLQPRLALLSKSHQNRIYQDMSAPQIVEHILRTRHQMRGEDFVFQLAHEYPRREQVMQYGEDDLTFISRLLGEVGIWFRFTADTRLNIDVAEFYDDQQHYEMGLSLPSVAPSGQHDGGSESVWDLQSRHHVVERSVFTRDYNYRNAPEDMNLNVNVSRGDSTTY

SEQ ID NO: 147797 - protein, 71 aa, Glycine max
  Coding DNA Sequence Number=SeqID_31019
MDQVDPHDLRYTRMHTQHKCVPRMPPTTIATLNTGTFTFIEPKRCQGTKENMAPKREKQEEECTKMAGVVF

SEQ ID NO: 147798 - protein, 218 aa, Glycine max
  Coding DNA Sequence Number=SeqID_31020
  Gene Ontology: Mol. function=transferase activity, transferring nitrogenous groups; Cellular component=membrane; Biological process =biosynthetic process
  Homolog annotation: Hit_ID=Q5N9Z8; Match level="QueryCoverage=53%, HitCoverage=25%, E-value=3e-52, Identity=86%"; Hit description =Putative aspartate aminotransferase
  Pfam annotation: Domain name=Aminotran_1_2; Domain location=1-210; Score=-90.1; E_value=0.0073; Accession=PF00155.11; Description =Aminotransferase class I and II
MSELFLDSLMLITYYYSICFLLDPKLLESKITERLRLLILCSPSNPTGSVYPKELLEEIARIVAKHPRLLVLSDEIYEHIIYAPATHMSFASLPGMWDRTLTVNGFSKAFSMIGWRLGYIAGPKHFVAACGKIQSQVLLVAEQGTEPTSIYERKYEYIQNRDVARLNGQLVVSRAFRDKNLKMHLRSDPDIHYTDITPDVELLILASDGLWKFNEPYT

SEQ ID NO: 147799 - protein, 83 aa, Glycine max
  Coding DNA Sequence Number=SeqID_31021
MYDSIMSEEVDMNVENEGDAGVKVEHVDCSDAFNTSQRNDLATCKRSAEYRPKKNDLARTCTGSRKCGCPFKLHAKPVLGGEG

SEQ ID NO: 147800 - protein, 97 aa, Glycine max
  Coding DNA Sequence Number=SeqID_31022
MEEVIVVVYYDGDVVSISEGVLFECPNGSKFIKISEEMSFVALRKAVMDIVRGDSCVEYDCMKLKDDNKVGKMIFIFLQFSSKGSIELYAMVDQSLE

SEQ ID NO: 147801 - protein, 539 aa, Glycine max
  Coding DNA Sequence Number=SeqID_31023
  Gene Ontology: Mol. function=oxidoreductase activity; Cellular component=intracellular; Biological process=lignin catabolic process
  Homolog annotation: Hit_ID=O24044; Match level="QueryCoverage=99%, HitCoverage=91%, E-value=0.0, Identity=75%"; Hit description=Laccase
  Pfam annotation: Domain name=Cu-oxidase; Domain location=163-316; Score=221.8; E_value=1.5e-63; Accession=PF00394.12; Description =Multicopper oxidase
  Pfam annotation: Domain name=Cu-oxidase_2; Domain location=430-538; Score=101.1; E_value=3.4e-27; Accession=PF07731.4; Description =Multicopper oxidase
  Pfam annotation: Domain name=Cu-oxidase_3; Domain location=37-153; Score=235.0; E_value=1.6e-67; Accession=PF07732.5; Description =Multicopper oxidase
  Pfam module annotation: Pfam domain module=Cu-oxidase::Cu-oxidase _2::Cu-oxidase_3; Domain location=163-316::430-538::37-153
MGPAPIQSFALPAMLLFSMIIIPQLALGGITRHYHFDIKYQNVSRLCHTKSVVTVNGQFPGPHIVAREGDRLLIKVTNHVQNNISIHWHGIRQLRSGWADGPAYVTQCPIQTGQSYVYNYTIFGQRGTLFWHAHISWLRSTLYGPIIILPKQGAPYPFTKPYKEVPIIFGEWWNTDPEAVITQALQTGGGPNVSDAYTINGLPGPLYNCSAKDTFKLKVKPGKTYLLRLINAALNDELFFSIANHTLTVVDVDAIYVKPFDTDTILIAPGQTSNVLLKTKSHYPNATFFMSARPYATGQGTFDNSTVAAILEYEVPPHFVHSTTSVKKLSLFKPILPALNDTSFATNFANKLHSLASAQFPANVPQKVDKHFFFTVGLGTTPCPQNQTCQGPTNATKFAASVNNVSFIQPTTALLQAHFFGQSNGVYSPYFPISPLVPFNYTGTPPNNTMVSNGTKVVVLPFNTSVELVMQDTSILGAESHPLHLHGFNFFVVGQGFGNFDPKKDPANLNPVDPVERNTVGVPSGGWVAIRFLADNPVL

SEQ ID NO: 147802 - protein, 46 aa, Glycine max
  Coding DNA Sequence Number=SeqID_31024
MEGKEPTLNLEDECAWSFRTRVGVRDDCFESRTFPFICIDLARPRL

SEQ ID NO: 147803 - protein, 778 aa, Glycine max
  Coding DNA Sequence Number=SeqID_31025
  Gene Ontology: Mol. function=RNA-directed DNA polymerase activity; Cellular component=chromatin; Biological process=chromatin assembly or disassembly
MAERRSKGLCYFCDEPYSPNHALTHKKLEIHVLEVSDTEEEIVDQFDNTQEDGSTSLDPQISVNALTDIPILSVAVADGARVNITSTVKQFSWILQNTGFTSYMLLIPLGCCDVVLGIECLVTLGDITWNFDRLSMQFYVQGANPINKRPYRYAKQQKDVIDKLVHDSLKSSIIQKSSSPFASPVVLVGKKDGSWRLCVDYRDLNNQTIKDRFPIPVVDDLLDELHGSKMFSKIDLWLGYNQVRMENNDIHKTAFKTHGDHFEYLVMPFGLTNALATFQGLMNNIFQGYLRKFLLVFFDDILVYSKDLQHHLSHLHMVLLTMRRNSLYAKKSKCYFGVERVEYLGHFITKDGVSSDPAKIMAIKNWPIPTSLKQLRGFLGLTRYYRWFVRGFGGIARPLTNMLKKNNFHWSDEAKAAFQSLKDSLIQSPVFALPDFSKVFMVEVDASGYGIGVVLMQNHHPIAFISRVLNIQQQLLSTYEKELLAVVFAVQKWRHYLLNTHFIIRIDHRSLQYILSQRLTTSFQQKWLVKLMEFDFTIEFKQGRKNLAADALSRQEAVDCQTITTLILESNMLNKIIRSWQADPDIQKLIQDLKTDASSHKHHTWNHNELRRKERLVVGKDLTLRIDLLQWIHVGPTSGHSGREATLKRLKSVVYWRGMTKDVRVFVLSCEVCQKRKYDKSAYPGLLQPLPIPERIWQHITMDFIEGLPNSKRKQVIYVVVDILNKAAHFMSLDNVFKLHGFPDSITSDRDPIFVSQFWKDLMAFQGVQLQLSSAYHP

SEQ ID NO: 147804 - protein, 128 aa, Glycine max
  Coding DNA Sequence Number=SeqID_31026
MEPPMLGVEEECHSNESGWTMYIGSPRDEDAQHCDDDDDNHSLEEDYYDYEAAAAQHCDVESDDSMASDASSGPSKSKEQVKKNNKYCSEKKVEKKNEIMAFANSMDKAPAAVQNGSKVKPFILFKQG

SEQ ID NO: 147805 - protein, 64 aa, Glycine max
  Coding DNA Sequence Number=SeqID_31027
MASYGGELVLDSSSPCSGISNHLSSFSIPLPLIFKKQRTPLMKKIQGLQALHGATLCGSVIFQS

SEQ ID NO: 147806 - protein, 183 aa, Glycine max
  Coding DNA Sequence Number=SeqID_31028
IGSEKLEPSDQMIQNLTHDRHSRENKIHICSLNVTWYKRKKGFFWSEKKKELKVKVNQMGPMITMKGVEGEEEVDVHGHGRTNRRRATVRVDRVGNFLPPPKNNFSATLGHFGPLNVMVDVFFSVLDVVGYEIVSIIARETQILVVVFSVPVYVGGGDGFLDGCSLGATAWRFNLQWGEKEKE

SEQ ID NO: 147807 - protein, 954 aa, Glycine max
  Coding DNA Sequence Number=SeqID_31029
  Gene Ontology: Mol. function=zinc ion binding; Cellular component =membrane; Biological process=defense response
  Homolog annotation: Hit_ID=Q1SJ37; Match level="QueryCoverage=96%, HitCoverage=94%, E-value=0.0, Identity=46%"; Hit description=Zinc finger, FYVE/PHD-type
  Pfam annotation: Domain name=RCC1; Domain location=126-175; Score =34.6; E_value=3.5e-07; Accession=PF00415.9; Description=Regulator of chromosome condensation (RCC1)
  Pfam annotation: Domain name=RCC1; Domain location=180-230; Score =13.5; E_value=0.024; Accession=PF00415.9; Description=Regulator of chromosome condensation (RCC1)
  Pfam annotation: Domain name=RCC1; Domain location=233-282; Score =26.8; E_value=7.6e-05; Accession=PF00415.9; Description=Regulator of chromosome condensation (RCC1)
  Pfam annotation: Domain name=RCC1; Domain location=295-344; Score =14.7; E_value=0.018; Accession=PF00415.9; Description=Regulator of chromosome condensation (RCC1)
  Pfam annotation: Domain name=RCC1; Domain location=347-396; Score =24.1; E_value=0.00051; Accession=PF00415.9; Description=Regulator of chromosome condensation (RCC1)
  Pfam module annotation: Pfam domain module=RCC1::RCC1::RCC1::RCC1::RCC 1; Domain location=126-175::180-230::233-282::295-344::347-396
LTLDIAHGKNFVDRISNDSTLYLESSYVGLEHANMQPRASVGDGFRVSASSTPSNSSGGSEPDDIDSFHAVYIWGEVLANGVSPDGIGTQIPSKTDVLIPKALESNVLDVCHIATGAHHIAIATRQGHVFTWGQESGGRLGHGIDKDFSSPVLVEFLEGNNFEFVACGEYHTSALSKSFELYTWGDGTHNVGLLGHGSEASHWIPKMVNGPLEGLQVVSIACGTWHSALATSNGKLFTFGDGAFGVLGHGDQESVWYPKEVQLLTGLKTIKVACGVWHTAAIIEVAFQSGSNSSSWKLFTWGDGDMHRLGHGNKETYLQPTRVAPLMEYNFHQVECGHNMTIALTTSGHVFTMGGTEHGQLGNPMSLGKIPTLVQDKLLGEFVEKISCGAHHVAILTNKSEIYTWGMGANGRLGHGDVEDRKSPTLVTLKATTLTPTPEKPHRVCDNCNVKLKVVNDNGASKLDRKVTPSHHSINGNERLGQGTIRSTRTLLSPITEPIKYLEIKNSNPKNKFDSTSFIRASQVPSHVQLKDIAFPSSLSSSQSVLKSTIPLASPPRTPPPHTNSGPIFTNTRKQSPTRLASPRYFGSLNNNLRRTNDALNQEVSKLQNQIQSLKQRSDMQDVEIKKLNKKVVEAIAFSAVESSNHGVTKEFFESTVYQEITEKLPQKIPESKTLRIVLTQAEDFLKGIVESKTSSSSKLESKQPNAPDIPNLNNGSSNLQKNRVEENVDIAGVNPCQDEGKFLEESNISNLQPKKQNALDIATLDGVCSKLQKQRIQENMEANGANPCHDEESFLEESNKSKLDYRKQNIPTSDTSTSKMREHKLDKNVDDVELDSCQDREILLEESSETNLDIKYQNAPNMLASISDVSEFQDDKLEENVEVARVDPSQAEGHIPQECNGSFASSVCKIMPSQNSYNDSRSMDTSRLGKQGEIQVIEKFERGVYVILMLQSD

SEQ ID NO: 147808 - protein, 205 aa, Glycine max
  Coding DNA Sequence Number=SeqID_31030
MGEVEEVQKQIKADMEAMKKQMAIVMEAMMSIKEIMEVNATAIAATSTIIEVDLTPQIYGRSGRQRVGRYGRPSFSAKNEHAFPPYGLPPNYTLPNVAYTPGEDVNNFAPILIESRQPQTDHAHVSQPVGKTHEIPHRNLANFEPRLRYATEGQAVGDIPLQNTLEGPQFHPQPQPFYGKIVCYTPLSFADLVFTGERIKVGLER

SEQ ID NO: 147809 - protein, 73 aa, Glycine max
  Coding DNA Sequence Number=SeqID_31031
  Homolog annotation: Hit_ID=Q1S8E6; Match level="QueryCoverage=59%, HitCoverage=6%, E-value=2e-13, Identity=75%"; Hit description =Transporter, major facilitator family, putative
MVPFVFNVEITQQGKFKGDTEELTLDGSVDWHGRPAIRAKSGRWVAGTIVLSREIRLSIVADDRGDSWQKLEP

SEQ ID NO: 147810 - protein, 526 aa, Glycine max
  Coding DNA Sequence Number=SeqID_31032
  Gene Ontology: Mol. function=transporter activity; Cellular component= membrane; Biological process=oligopeptide transport
  Homolog annotation: Hit_ID=Q1S8E6; Match level="QueryCoverage=99%, HitCoverage=77%, E-value=0.0, Identity=83%"; Hit description =Transporter, major facilitator family, putative
  Pfam annotation: Domain name=MFS_1; Domain location=1-461; Score= -2.3; E_value=0.0004; Accession=PF07690.6; Description=Major Facilitator Superfamily
  Pfam annotation: Domain name=PTR2; Domain location=37-445; Score =347.4; E_value=2.3e-101; Accession=PF00854.12; Description=POT family
  Pfam module annotation: Pfam domain module=MFS_1::PTR2; Domain location=1-461::37-445
  Subcellular localization annotation: CTP_CleavageSite=8; ConfidenceScore=5.03e-01
MGQNNAAAANSVSKWTGTVYIFSLVGAFLSDSYWGRYKTCAIFQVIFVIGLVSLSLSSYLSLIRPKGCGNETIPCGKHSSLEMGMFYLSIYLIALGNGGYQPNIATFGADQFDEEHSKEGYSKVAFFSYFYLALNLGSLFSNTILGYFEDEGLWALGFWVSAGSAFAALVLFLLGTPRYRHFKPSGNPLSRFSQVLVAASRKWRAQMTSNGEDLYVMDENESPTNGNRKILHTGGFKFLDRAAFISPRDLEDQKSGVYNPWRLCPITQVEEVKCILRLLPIWLCTIIYSVVFTQMASLFVEQGAAMKTTISNFRIPPASMSSFDILSVAVFIFFYRRVIDPLVGRLKKKSSRGLTELQRMGIGLVIAVMAMVSAGIVECYRLKYANSGCPHCSGTSSLSIFWQIPQYALIGASEVFMYVGQLEFFNAQTPDGLKSFGSALCMTSISLGNYVSSILVSIVMKISTEDHMPGWIPGNLNRGHLDRFYFLLAILTSIDLVLYIACAKWFKSIQLEGKYEENDMPGSFKV

SEQ ID NO: 147811 - protein, 96 aa, Glycine max
  Coding DNA Sequence Number=SeqID_31033
  Gene Ontology: Mol. function=structural constituent of ribosome; Cellular component=ribonucleoprotein complex; Biological process =translation
  Homolog annotation: Hit_ID=Q2QW49; Match level="QueryCoverage=43%, HitCoverage=8%, E-value=3e-07, Identity=67%"; Hit description =Ribulose bisphosphate carboxylase large chain, putative
MKIQIHEKLKSTFQDMHRKLWSTFQGLRIGYSWEQISNGDDGVGPVAQRIRACGYEPRCRGFESLLTQNWPKKEKIFPFEGKKIMIGLADPKLWNL

SEQ ID NO: 147812 - protein, 93 aa, Glycine max
  Coding DNA Sequence Number=SeqID_31034
YCTPRQAQGDGPQAADAPPPPHQADPARSLGMERYLQHLVRQQAANHQGQMQIHESLYQLSLSQQGQGFIPFGCPTPDQFRAEVAWPGYWPEA

SEQ ID NO: 147813 - protein, 217 aa, Glycine max
  Coding DNA Sequence Number=SeqID_31035
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=71%, HitCoverage=66%, E-value=7e-39, Identity=50%"; Hit description =Transcription factor, MADS-box
  Pfam annotation: Domain name=SRF-TF; Domain location=26-76; Score =77.2; E_value=5.3e-20; Accession=PF00319.9; Description=SRF-type transcription factor (DNA-binding and dimerisation domain)
MDTKSVPSLNDGNVKKTKGRQKIEMKKISNERYLQATFSKRRTGIFKKASELATLCDVDLAVIVFSPGNRVFSFGSPHVDSVIQRYIAHAPTPPTLDLNEPFCTMDERGLHAHLDYLANRFTREKKREEDLNRLLEVSKNHFWWTSPIESMNKAQVENYKKALEDLKTLVNKKRGSSSSHVNSAVPMQNPMGVIDGTILCYRQFNDIQRNGPTPGLF

SEQ ID NO: 147814 - protein, 143 aa, Glycine max
  Coding DNA Sequence Number=SeqID_31036
MLQKTRPYVKGSNKTHVNLEKSSTITNPYLFPPTLKCLDEGISVISKSYRPSILSLIKAEEFSFVSSHMPGASTIQEPQLFTLDVEQTILHQKVASEARLTGAFSIRGKCAESPPTFIERKTLEKPKETGHAEYSRFGSCIYV

SEQ ID NO: 147815 - protein, 150 aa, Glycine max
  Coding DNA Sequence Number=SeqID_31037
VFLCGGDDDGDGSDVNNDDKDTSDGHSGSGNNNDDGGGVGISGGGDVDSGGSNDMVLVTNSSDGGGHGGINNGGGSNVSGVGGSDGGGVIVMVGMKVILLVVVVTMTMTVTLMIDGGGDNYGGGGGYNIGGDDGDNNNDYGGDNNASGVW

SEQ ID NO: 147816 - protein, 169 aa, Glycine max
  Coding DNA Sequence Number=SeqID_31038
  Gene Ontology: Mol. function=transcription factor activity; Biological process=regulation of transcription, DNA-dependent
  Homolog annotation: Hit_ID=UPI0000E6980A; Match level="QueryCoverage =89%, HitCoverage=65%, E-value=6e-24, Identity=53%"; Hit description =transcriptional regulator
  Pfam annotation: Domain name=LysR_substrate; Domain location=1-158; Score=4.2; E_value=0.00045; Accession=PF03466.10; Description=LysR substrate binding domain
MPVLFGRQCVAPLLIDLAQEHPGLELEMSFIDRVVDLVEEGFDMAVRNGTLQDSSVLVARRLGEHRMVLCAAPEYLQKKGDLRRGAGRTRHCMVALLDGQPGNSSGKTRPAVKAGTGCALRRACGLATDAASAAESQNCRRYARQPFTVSAVAGNACAHKKAALNARPE

SEQ ID NO: 147817 - protein, 162 aa, Glycine max
  Coding DNA Sequence Number=SeqID_31039
  Gene Ontology: Mol. function=catalytic activity; Cellular component =fatty acid beta-oxidation multienzyme complex; Biological process =metabolic process
  Homolog annotation: Hit_ID=UPI00005F7512; Match level="QueryCoverage =98%, HitCoverage=55%, E-value=2e-71, Identity=78%"; Hit description =COG1024: Enoyl-CoA hydratase/carnithine racemase
  Pfam annotation: Domain name=ECH; Domain location=1-82; Score=-60.9; E_value=0.0087; Accession=PF00378.10; Description=Enoyl-CoA hydrataseisomerase family
MIEGSALGGGFEAALAHHFILAQNSARMGFPEIAFNLFPGMGGYSLVARRSGMKLAEELICEGESHSAEWYETRGLVDKVFQPGDSYRTTRTFIDTLRPKLNGVRAMLKARQRVLQLSRAELMDITEDWVDYAFTLEPKDIAYMERLVQLQNRHSASLRKAG

SEQ ID NO: 147818 - protein, 607 aa, Glycine max
  Coding DNA Sequence Number=SeqID_31040
  Gene Ontology: Mol. function=signal transducer activity; Cellular component=integral to membrane; Biological process=signal transduction
  Homolog annotation: Hit_ID=Q5PCZ7; Match level="QueryCoverage=99%, HitCoverage=93%, E-value=0.0, Identity=66%"; Hit description =Hypothetical protein yciR
  Pfam annotation: Domain name=EAL; Domain location=364-590; Score =290.2; E_value=3.8e-84; Accession=PF00563.11; Description=EAL domain
  Pfam annotation: Domain name=GGDEF; Domain location=192-350; Score =219.5; E_value=7.3e-63; Accession=PF00990.12; Description=GGDEF domain
  Pfam annotation: Domain name=PAS; Domain location=70-182; Score=25.4; E_value=0.0002; Accession=PF00989.14; Description=PAS domain
  Pfam annotation: Domain name=PAS_4; Domain location=76-187; Score =5.1; E_value=0.064; Accession=PF08448.1; Description=PAS fold
  Pfam module annotation: Pfam domain module=EAL::GGDEF::PAS::PAS_4; Domain location=364-590::192-350::70-182::76-187
  Subcellular localization annotation: CTP_CleavageSite=76; ConfidenceScore=5.56e-01
MAVPLTPAQASLLRAMTVITSSINLTLSLHGSPVPMHFVGRKVNQSTWAGTASAWGDTSSVARDLTLGLSFAEQVVSEANSVIVILDQRGNIQRFNRLSEEYTGLKEQEVIGRNVFQLFMTKQEAQASRRNIAGFFRDGNSYEVERWVKTRKGQRLFLFRNKFVHSGSGKNEIFLICSGTDITEERRAQERLRVMANTDTVTGLPNRNAIHQQISLALELANGSQTGVVYLDLDNFKKVNDAYGHMFGDQLLQAVSLAILSCLGKDQTLARLGGDEFVVLAEHTSQAALEAMASRILERLRQPFRIGLIEVYSGCSIGITLAPLHGEDRESLIRNADTAMYHAKENGRGKFCVFASEMNQRVFEYLWLDTNLRKALEQDHLVVHYQPKIDRDGEVRSAEALVRWNSPERGLVPPGDFISYAEESGLIVPLGRWVMLNVLQQIVKWRSEGIYLRVAVNVSAKQLIDQSIYSDLKQALSEAGISECPIDIELTESCLIENEAGALKLMKQFQELGAQVHLDDFGTGYSSLSQLARVPIDAIKLDQIAGARDRCRGESPGFTGHAEGIETKAEEKFVLTNGVDGRQGYYYAKPMPAEQLGHWLAKHPARV

SEQ ID NO: 147819 - protein, 111 aa, Glycine max
  Coding DNA Sequence Number=SeqID_31041
MGEMPATQLAQASSARPGKLSSRRRARWLPPEANRLLEESSGGPKWNLADYIIIPFLTYGMLRNLTNCATMLPFEFRHVTKLHELPHDGCQVPQNGQIKVACHQAKVPGRN

SEQ ID NO: 147820 - protein, 210 aa, Glycine max
  Coding DNA Sequence Number=SeqID_31042
MSHDCPFTGLRNAPLPRTNVHPQLRCMALAPVHFRRKDPYLDQYGFGPPVRVTVPSTCSWLDHLVSGLMHRTERPVQTRFRCAYTYRLKLARYTKSLTHYTKGTVSLPSSGCFSPFPHGTGSLSVMHEYLGLDRGRPMFRQDFTCPALLKDFCYSTCTGLSPTSVEFSNSFHFIHKSHWPGPRSLATTSGVSFDVLSSGYLDVSVPQVRF

SEQ ID NO: 147821 - protein, 218 aa, Glycine max
  Coding DNA Sequence Number=SeqID_31043
  Gene Ontology: Mol. function=nucleic acid binding
  Homolog annotation: Hit_ID=Q8LEE2; Match level="QueryCoverage=73%, HitCoverage=52%, E-value=4e-17, Identity=32%"; Hit description =Glycine-rich RNA-binding protein-like
MDIGIGQAIGLETVISLETVIRIGIEDNVWNPEEDRIENEQEHSRGHDRDVDREHSIDLNIVRKMDRTSDPDRSFDEDKKDQSRRNNDLNVSNQHSMDLSSDSAGTHNDQVEAQLERSTQQLDQLKKEVSQMEEGLEEKRLHVKELQKQSKKLEDALINAKKNSSYHQMQLMKLHKCFLQVNDCTEGLRTTEKELQVCVLTPHNSDLYTNLQSMSCVF

SEQ ID NO: 147822 - protein, 110 aa, Glycine max
  Coding DNA Sequence Number=SeqID_31044
  Subcellular localization annotation: CTP_CleavageSite=57; ConfidenceScore=5.53e-01
MVNVSQKKKVQVSSPGRATPVRKYKRGGGGTFSSPKTLPPHFKNPQAHGNYENNSPQASIVEFLLPFSRFNSLPTSLCCILKQWGMPHCPHSLAIYVQTCAHQVFGEMPQ

SEQ ID NO: 147823 - protein, 166 aa, Glycine max
  Coding DNA Sequence Number=SeqID_31045
  Homolog annotation: Hit_ID=Q2HRX8; Match level="QueryCoverage=77%, HitCoverage=21%, E-value=6e-10, Identity=30%"; Hit description=IMP dehydrogenase/GMP reductase
MASLLHLPIVRAFHTFELLYVDDIVDMLVELLESGTYAWGTVTLVHMYDNLNEASKSTVRQLARYITLLQALPVSTYRRRLDKLTPDVVYWIPNGDHRSFREFEVISLFSGHLRWGPLTVIHRPKKVVRQFGYIQTIPPHLVVPSASVEEMDAKWMQFGDYIAHVG

SEQ ID NO: 147824 - protein, 54 aa, Glycine max
  Coding DNA Sequence Number=SeqID_31046
MAIISTTITIIVIMTNIIAINMAVIAVVAIVIMLVTMMVIMMTIMVIVVMMILT

SEQ ID NO: 147825 - protein, 46 aa, Glycine max
  Coding DNA Sequence Number=SeqID_31047
METSQASFEVNQNSIQNQEIQEHMVRWMTIENPMLEDSETQCSGRM

SEQ ID NO: 147826 - protein, 439 aa, Glycine max
  Coding DNA Sequence Number=SeqID_31048
  Gene Ontology: Mol. function=methyltransferase activity; Cellular component=nucleus; Biological process=nucleobase, nucleoside, nucleotide and nucleic acid metabolic process
  Homolog annotation: Hit_ID=Q8LFA9; Match level="QueryCoverage=97%, HitCoverage=99%, E-value=1e-103, Identity=48%"; Hit description =Methyltransferase-like protein 2
  Pfam annotation: Domain name=MT-A70; Domain location=256-423; Score =107.8; E_value=3.2e-29; Accession=PF05063.5; Description=MT-A70
MEGEHDDSQKLSLFYESGIYYFDDSNAVFVDPVRVLNRSYHRFTVSPSTYYSRFFKSPTTPNSVSSTVSSSLRKRKRKPKEPPPLNERELIALQRHQEARPLLLAAHECLLKSTELLNVLKTLKSESRCSKKECEGGQQHSFVDLGRGSPQLEVTLSLRVSDADTHLPPNELEDSLSVQCCEQKVLPAFNNLVANDTKDDAVAEILDNCYIVPRESCFYMVLPVCLYDLINGNPVAEILWHFLEYLLCLAHADSGFNLIVVDPPWENASAHQKSRYFLSLPIKQLTHTEGAIVALWVTNREKLRSFVERELFPAWGVSYAATFYWLKVKQNGSWICDLDLFHHRPYECLILGYSPGKVNNTDNQSKFKPVKNDRVIMSIPGDFSRKPPIGDLLLEYVPGLKPSRCIELFAREIMAGWVAWGNEPLYFQDSKYFVKKMDQ

SEQ ID NO: 147827 - protein, 137 aa, Glycine max
  Coding DNA Sequence Number=SeqID_31049
MQFVHASHLSLHSGPLHTPNSPPINLTRPIPNLTTWTHPPHNLQCDSPHSIISPPEIELYEILHSSTHPAKTIGGKRDPRDSRPLGFKSPATQHRLLLHHRRIKWSTTEQPRRRRAGESRRGEKEKTTGEENGGEEQ

SEQ ID NO: 147828 - protein, 141 aa, Glycine max
  Coding DNA Sequence Number=SeqID_31050
MTRNKKTDQMMFEIAKEIADKIDSLEELASQGSFVTRGCQDVLTVAIGRPEHPGHVGASVARASTKESYVDPSGNDPNMDELEKYGLHGSTTIHNIPLRNDQVKVGVEEVQDAHDHIPIPTQEDKQGAMGLKKPTVRLNLD

SEQ ID NO: 147829 - protein, 94 aa, Glycine max
  Coding DNA Sequence Number=SeqID_31051
MSSEESTLHLEDECNWKWCIPNVTKGVDHFLGHLCYSWMPADLCFCVVSTLGGKPSDVSLLEKLLWRLDLSMVIFSHGVAAKDKEEEVRGDVIH

SEQ ID NO: 147830 - protein, 147 aa, Glycine max
  Coding DNA Sequence Number=SeqID_31052
TYKEEPTEDLALHNYEASFTTKRREDEGLRKYKWSSQSKISQLFGTWTFLSLENPRHVEASRKGIGGFVYACALSAILNRLALISGFQLSACFSRSADGLKRRGVLRSADGSLSQKIGLEGGELVLDYLLLEVASPITVPPSPFRCD

SEQ ID NO: 147831 - protein, 47 aa, Glycine max
  Coding DNA Sequence Number=SeqID_31053
  Homolog annotation: Hit_ID=Q8H902; Match level="QueryCoverage=93%, HitCoverage=5%, E-value=4e-12, Identity=71%"; Hit description =Putative DNA binding domain containing protein
MAKDNQPIPSRAMILSRKYRTLVSSWIEPLQEEAEIGYEIDYISRDC

SEQ ID NO: 147832 - protein, 404 aa, Glycine max
  Coding DNA Sequence Number=SeqID_31054
  Gene Ontology: Mol. function=RNA-directed DNA polymerase activity; Cellular component=intracellular; Biological process=RNA-dependent DNA replication
DEELPERGRNHNLALHISVNCKSDALSNVLVDTGSSLNVMAKSTLDQLSYQGPPMRRSGVVVKAFDGSRKSVIGEVDLPITIGPFVFQITFQVMDIQAAYSCLLGSPWIHEAGAVTSTLHQKLKFVRNGRLITVSGEEALLVSHLSAFSFIGADETEGTSFQGLTVEGKKPEKNEVSFATWKSAQKVVQEGTGVGWGKVVQLIESKNREGLGFASSAGSATNSVGSSSITSTFCSAGFINNSPEANAVLEDVPEERVLAFVTPGKLVRNWDAVDIPSVVHASKLGIYEPVEHNNPALSPNFESPVYEAEEEEDDEIPEELARLLEYEKKTIRPHEEVVEVINLGTKEDKKEVKIGASLEATVKRRVIELLKEYADVFAWSYQDMPGLDPRIVEHCLPLKPECSP

SEQ ID NO: 147833 - protein, 103 aa, Glycine max
  Coding DNA Sequence Number=SeqID_31055
MGIKGKKELPLSEGKIIGREVRGDADKAPQRRMLIASTRRQQEVAPGGEDVEHLDHTADDVHEQPKKATANDVITDAERFSRQTLRHISFDGLCSSCGNESLE

SEQ ID NO: 147834 - protein, 514 aa, Glycine max
  Coding DNA Sequence Number=SeqID_31056
  Gene Ontology: Mol. function=catalytic activity
  Homolog annotation: Hit_ID=Q6ATQ2; Match level="QueryCoverage=58%, HitCoverage=60%, E-value=1e-107, Identity=63%"; Hit description =Expressed protein
  Pfam annotation: Domain name=SpoIIE; Domain location=284-509; Score= -19.6; E_value=0.0079; Accession=PF07228.3; Description=Stage II sporulation protein E (SpoIIE)
MPSNYFSRLGVSIRRSVVGKEGRIRDSAEVLIGQGKLWFGSSKFFHSVQSSYFVELQLLVRPGIALASSSELAGKRRTLSVVDTLSRTFSVPSVSGPSFQVCGYHIGSALAGPDQFSSGTKFRIKTMAAHLPRIVVGESCLDNPTLKGSCRSLSTKNSYSICLSTKLRNGGKVSMSLRNHQQPDNSAVYGYFIYNAAKTWCNSHPYMQSGSGDFHTLSSSCYSVGPAHDVPFDTSAHEEQLSSSADPSEQKTPSGKTLKLISGSCYLPHPDKEETGGEDAHFICSEEQAIGVADGVGGWADLGVNAGYYSRELMSKSVEAIQEEPKGSVDPARVLEKAHSSTKARGSSTACIIALTDQKDNRTGHKGLNAINLGDSGFMVVRDGCTIFRSPVQQHDFNFTYQLECGSNGDLPSSGQVFTIPVAPGDVIVAGTDGLFDNLYNNEITAVVVHAMRAGLSPQVTAQKIAALARQRAMDKDRQTPFSTAAQDAGFRYYGGKLDDTTVVVSYITGSGDA

SEQ ID NO: 147835 - protein, 259 aa, Glycine max
  Coding DNA Sequence Number=SeqID_31057
  Gene Ontology: Cellular component=peroxisomal membrane; Biological process=peroxisome fission
  Homolog annotation: Hit_ID=Q10MN2; Match level="QueryCoverage=90%, HitCoverage=90%, E-value=6e-57, Identity=55%"; Hit description =Peroxisomal biogenesis factor 11 family protein, expressed
  Pfam annotation: Domain name=PEX11; Domain location=29-256; Score =203.0; E_value=7.2e-58; Accession=PF05648.4; Description=Peroxisomal biogenesis factor 11 (PEX11)
MDSNSKPSAPPPNPNPNPPPSKKHQRDLLSHVEAYLAKRDGVDKLLKISRYATKLILASSLLQSNPTLSHRLKSFESSVGVSRKAFRLGKFVQDLNALKTTHPHSKRQLFLSLLAYGGEGFYYFVEQFVWLAKSGLIDPKHARFFQKLSAWAEFVGYFGSVALKLGDLQEIAKEEACVESSVEITRLRGSGCVDEEVRLGKLREKKMMKRLSVVQDLADAVMALDDILDGKGPFSKPVLMALAGLLSALISSHKNWISC

SEQ ID NO: 147836 - protein, 163 aa, Glycine max
  Coding DNA Sequence Number=SeqID_31058
  Gene Ontology: Mol. function=methyltransferase activity; Cellular component=nucleus; Biological process=nucleobase, nucleoside, nucleotide and nucleic acid metabolic process
  Homolog annotation: Hit_ID=Q8LFA9; Match level="QueryCoverage=61%, HitCoverage=26%, E-value=3e-18, Identity=41%"; Hit description =Methyltransferase-like protein 2
MECILHVIILNCFHMWKSDLEQIHNLIAAHADSGFNLIDVNPPRENASSHQKSRKDFHLKENGSWICDLDLFHHRAYECFILGYSPGKVNNTDNQLKFKSVKNDPVVMSIPGDYSRKLPIAAYFWAQTSLMYRAICYIAGWVAWGNEPFYFQDLKYFVKKLDK

SEQ ID NO: 147837 - protein, 99 aa, Glycine max
  Coding DNA Sequence Number=SeqID_31059
  Gene Ontology: Mol. function=monooxygenase activity; Biological process=electron transport
  Homolog annotation: Hit_ID=Q1S220; Match level="QueryCoverage=64%, HitCoverage=12%, E-value=4e-13, Identity=56%"; Hit description=E -class P450, group I
MFYKWEDENKGVDEFEIEVSKDLHDLTSDIISKVAFGSNYEEGKEIFDLLEHYHLVSLANRSVYHMTKTRTLKWVFAYEEKQRKKEIREENLQISSSVD

SEQ ID NO: 147838 - protein, 143 aa, Glycine max
  Coding DNA Sequence Number=SeqID_31060
  Homolog annotation: Hit_ID=Q1S220; Match level="QueryCoverage=44%, HitCoverage=12%, E-value=4e-12, Identity=48%"; Hit description=E -class P450, group I
GTWWLRAKEEEGCSGWGQRRGRTVVVGGGGNMKGEEERRKQEGEEKRKEKCEEGGGNMRVPWVIARPMALCHDTLERVCLFYHKWSRTYGKTVLYWHGSKPKLVLSDPDMIKEILLKTGEWFERIDPNPSATVLWRRRGMDCA

SEQ ID NO: 147839 - protein, 280 aa, Glycine max
  Coding DNA Sequence Number=SeqID_31061
  Gene Ontology: Mol. function=helicase activity; Biological process =viral genome replication
  Homolog annotation: Hit_ID=Q1SRJ5; Match level="QueryCoverage=99%, HitCoverage=33%, E-value=3e-79, Identity=49%"; Hit description =Probable helicase [imported]-Arabidopsis thaliana-related
MVHGPCGILRPASPRMKEGKCSRFYPKKFQLTTLIDGDGYPVDRRRNTGQTITKNEIIIDNRCIVPYNPKLLKKYQAHINIEWCNQNTSIKYLFKYINKGYDKVTAVMVHDDTRTVPHANTLNDEIKEYLDCIYISPCESTWRIFGFPIHGRKPSIERLQFHLPRQHSVLYQDHDDIDDLLSNPSISKSKFIAWMNANQAFVEGQSLTYSEFVTKFVYNQKQRCWQLRKKGYTIGKLQWVPPTTGELFYLRMMLTVSRGPISFEDIRIVAGVEYPTYREA

SEQ ID NO: 147840 - protein, 99 aa, Glycine max
  Coding DNA Sequence Number=SeqID_31062
MVGTKPKRLPRLLRSKAHSCISATFSITFMPASLQQDCEKNNFLSPKIPLRQEKINILLLVLDSAKALGIEWGWPGTGKLFAPGLDNPSRRKMLESQAF

SEQ ID NO: 147841 - protein, 129 aa, Glycine max
  Coding DNA Sequence Number=SeqID_31063
  Homolog annotation: Hit_ID=Q3N3G4; Match level="QueryCoverage=97%, HitCoverage=28%, E-value=1e-31, Identity=52%"; Hit description =Similar to permeases precursor
DFAIKIDRAELDNGGTFTVSGKAPVGSKVFLEIWSEKQVRASYFDSKKDPQTGKIPYILYLSKEVPAYYQIVLPVDEKSELEAIKAEGNKWSLSKSLKDLGADVAYQAPAKIKIDAYKAGFLASVIGSR

SEQ ID NO: 147842 - protein, 191 aa, Glycine max
  Coding DNA Sequence Number=SeqID_31064
  Homolog annotation: Hit_ID=Q5ZD36; Match level="QueryCoverage=66%, HitCoverage=5%, E-value=2e-26, Identity=52%"; Hit description=Zinc finger-like
MKHFTDTLISANIGLVYAKSLLRKLTGGSELPSNWDRNRDTDDASSDAGSSSVGSQSTDELSEILSQADVWLGRAELLQSLLGSGIAASLDDIADGQSSARLRDRLVADERYSMAVYTCKKSHPPFASWRNSEEARTDRPSQQLRSLNGEWDAPCSGALSAAGVVVTRSVTATLASADVRRCFCRYAPPRQ

SEQ ID NO: 147843 - protein, 61 aa, Glycine max
  Coding DNA Sequence Number=SeqID_31065
MQEVDVSIPASTAETLVEKAQLNMFNVTTHAPPPPIQLLPPPLVSVPLNVTTRLVATVSAL

SEQ ID NO: 147844 - protein, 492 aa, Glycine max
  Coding DNA Sequence Number=SeqID_31066
  Gene Ontology: Mol. function=zinc ion binding
  Homolog annotation: Hit_ID=Q6K9X4; Match level="QueryCoverage=79%, HitCoverage=50%, E-value=6e-54, Identity=36%"; Hit description =Ubiquitin-protein ligase-like
MTDPGEGFVFRKDNFGCSQATSNTSDTSSEDDIDVNTIEETGASSSQAVPTVHSQQSEPNNRVSDGLEISGDQICSQGTICENLDRQGSSAHVETRDLESSSSTRFEREDGTGGNVDTMPTEDPSNGLTQPSLQIEDTDQGNMHELSEVHTEQSQRGDIINDESDIVDDVDLIESIALEGEQQEEVIIENDGSVWHQSVDDNQLGSTTNEWPQNILGGEDGENSRMQEQEAPEVWQEDGGFQEAVEIWLGGPSDNEVAPVGRIHGFYFPEDDNVYSVELRELLSRRSVSNLLGSSFRESLDQLIQSYVERQGHAHVEWELQETTPSPLAEQVSRQHSRDPIVSPQATVNSSLDRPLPPTPPPQPLWDRHSRHDNWSQSDINNQRLGIEWDIVNDLRIDMVRLQQRMNNMQRMLEACMDMQLELQRSIRQEVSAALNRSTGSSDDQVEFITGIHDGVSTDDKSKWECVRKGLCCICCESNIDSLLYRCYSASL

SEQ ID NO: 147845 - protein, 93 aa, Glycine max
  Coding DNA Sequence Number=SeqID_31067
DGPVGGAGTNGDVEVERARIRGISEDEGASDIFPLALHGPLKVTARSSRFQQFFFTYATLMAGLRLSKVNESEVTPLALHKSVISVGKPSLEE

SEQ ID NO: 147846 - protein, 213 aa, Glycine max
  Coding DNA Sequence Number=SeqID_31068
  Homolog annotation: Hit_ID=Q1SKD7; Match level="QueryCoverage=99%, HitCoverage=53%, E-value=4e-08, Identity=26%"; Hit description =Ankyrin
MASRKRKAHASTSQARYDRSRFTSQEAWDRYSSVVIGRKILPERNVMLYYTEFDEFTEELERRNRHKELTNFMDGNIDVAIMKEFYANLYDPEDKSPKQVRFRGHLVKFDADALNTFFMTPVIIEEGENLPAYSRFSQLRPNPQELAARLCIPGKGFELNVDGNADGLPLKILRKNLTTLAQTWSVLSFSNLVPTSHTSDITLDKARLIYGII

SEQ ID NO: 147847 - protein, 83 aa, Glycine max
  Coding DNA Sequence Number=SeqID_31069
MGKLYADAPNDVVTTCNFKAKENWKQDEGEKQLGFVFSPLTCAKHTNPNQPAWPRRSGLNGDGPTMSVAGASYDGGVAASVSE

SEQ ID NO: 147848 - protein, 106 aa, Glycine max
  Coding DNA Sequence Number=SeqID_31070
MSSLKLTIQLSHHWHWRDSAYVEPAALAKQVRLGQLGQVLQSRGIVVPGGFANMADEFVLKVSRHCYWRERCLRGAHACRPNIVAYKKQAFLEIFSERVSQVGVAE

SEQ ID NO: 147849 - protein, 98 aa, Glycine max
  Coding DNA Sequence Number=SeqID_31071
  Subcellular localization annotation: CTP_CleavageSite=60; ConfidenceScore=5.58e-01
MALLGNFSKGSMTNSMTDFSILKAFKVSSHSPKPSKVTQVAWHPPWFTGISSSLEAELMGAMHVVEISKSKSGLHYGSSVTHPLLFWLSKILPLCLGA

SEQ ID NO: 147850 - protein, 107 aa, Glycine max
  Coding DNA Sequence Number=SeqID_31072
MALIRSKTKRISSVHNEDDILTSVSDIEHEVMQSYPARALDRRLQVDWAKDAKESLRVLMNLRHLLATPPFIFSYLLSLSLHSYSPTFKFLSMASYGGELLRDSPSS

SEQ ID NO: 147851 - protein, 91 aa, Glycine max
  Coding DNA Sequence Number=SeqID_31073
  Gene Ontology: Mol. function=nucleic acid binding
MEVESIIQKKTPRNKSHLVRRLVKLEYKDGHSMIKHLNIFKGLVNQLTKINTKIDDELQALVLLISLPESWDMLVVTLSNSAPKGKLGYHH

SEQ ID NO: 147852 - protein, 66 aa, Glycine max
  Coding DNA Sequence Number=SeqID_31074
MKNLVRRQRVHDKTNHTLGNQSGSCCFARMLQPCGIGTNLKEHSNRVYLPPSSRLRRIHQGLSLVI

SEQ ID NO: 147853 - protein, 214 aa, Glycine max
  Coding DNA Sequence Number=SeqID_31075
  Gene Ontology: Mol. function=ubiquitin thiolesterase activity; Biological process=ubiquitin-dependent protein catabolic process
  Homolog annotation: Hit_ID=Q9FPS9; Match level="QueryCoverage=39%, HitCoverage=9%, E-value=1e-15, Identity=49%"; Hit description =Ubiquitin-specific protease 15
  Pfam annotation: Domain name=zf-MYND; Domain location=76-113; Score =35.2; E_value=2.2e-07; Accession=PF01753.9; Description=MYND finger
MLEPRESDIPVLFLVLVVLPLVAYILLGKWSETTKKRDTINLLAHLAAEEALRAEEMVVADVIPPVSASKNEHHVCARCSVPARTRCSRCKIVRYCFGNCQIIHWRLNHKQKCQRLEPPKSSSFPLAVSVEELGHGSYFYENLNNQYLGLSLKQTLRESAPLHIIVGPDNLSDSGDWRDKGAVTEVRDQRKCQRPPYQEPLDWPTRKRVALRSA

SEQ ID NO: 147854 - protein, 209 aa, Glycine max
  Coding DNA Sequence Number=SeqID_31076
  Homolog annotation: Hit_ID=Q944E5; Match level="QueryCoverage=19%, HitCoverage=7%, E-value=4e-09, Identity=70%"; Hit description =Cellulose synthase-like protein OsCslA9
MQELVQMECSRWASKGLNIKYEEVATWDDQDARDVTDYHFIVEQEVGSCTYAFFGFNGIAGVWRISTLYESEGTCDKFELQILAPNILHKLNAPSKYTPSFMDLPPRETMKMDLHNKKSMPSMSPKKKLTAKFALMKSRPLSEQEILTESRPENHYQFLNVLKTSLTSSSEKSIAGEAPQSNTKDGASSAVLYMLYLPCIIKVCPLCYP

SEQ ID NO: 147855 - protein, 77 aa, Glycine max
  Coding DNA Sequence Number=SeqID_31077
MAPPIHMTLEHKNHEGFKVVLLDERPPDRRLHCARDMWHARLTREQQGSAPDAGASGSVLPLGATGGVPAAGATPDT

SEQ ID NO: 147856 - protein, 145 aa, Glycine max
  Coding DNA Sequence Number=SeqID_31078
PRVNEGGVGGEKGVNGVGVVECDVIEVVLVVGEAVVHYTEGGAIPSQVGIAHNMLLALSETSNVVSFKIPMDSILEVFWGFIAENENAKKFFEKIEQYFAKNEKSEASNILAKLISIKPARAFRFDLTSCTLWAIKVSYNTQKEK

SEQ ID NO: 147857 - protein, 133 aa, Glycine max
  Coding DNA Sequence Number=SeqID_31079
MVDLNELSVVDHCLPYNKHNLYDVTFNNTHTIYTFLTSDPSLIDSWICTASSLWASTSPLRSQSQRSRLSFSSSKPLKFSRTIRAAAADETIEAPAKEEAALCSPKTLKKRVPSCECEEEGVLRKESKESFEG

SEQ ID NO: 147858 - protein, 147 aa, Glycine max
  Coding DNA Sequence Number=SeqID_31080
  Homolog annotation: Hit_ID=Q1SAV4; Match level="QueryCoverage=44%, HitCoverage=16%, E-value=2e-12, Identity=54%"; Hit description =Integrase, catalytic region
GPLPSQPAHLPPTNTNNHLDIEPLSLLDWKWDTSASPPTKLVLVQWSGLALEDITWEAWDALPDSYNLEDKVNFPEGGDVSDISPATSSANASRPKSNELREWHGLAILVYDISILTLHGCMYNASSHGRYWLMERLSNRKRGGLFP

SEQ ID NO: 147859 - protein, 143 aa, Glycine max
  Coding DNA Sequence Number=SeqID_31081
  Gene Ontology: Mol. function=transporter activity; Cellular component= mitochondrial inner membrane; Biological process=transport
  Homolog annotation: Hit_ID=Q5JMQ9; Match level="QueryCoverage=79%, HitCoverage=22%, E-value=6e-14, Identity=42%"; Hit description =Putative mitochondrial deoxynucleotide carrier
  Pfam annotation: Domain name=Mito_carr; Domain location=27-142; Score= 3.0; E_value=0.0019; Accession=PF00153.17; Description=Mitochondrial carrier protein
MKKTVVVVGKGRVFLAAMEGEPSQLKRAAIDASAGAISGGISRTVTSPLDVIKIRFQMLSKPILVVVVKCQVYRTIADIQCCKLQSGMSILQHKEVQLEPTSSWTLLRKDLSTPSKYTGMLQASKDIFREEGIWVGIRLTHFL

SEQ ID NO: 147860 - protein, 442 aa, Glycine max
  Coding DNA Sequence Number=SeqID_31082
  Gene Ontology: Mol. function=translation elongation factor activity; Cellular component=intracellular; Biological process=translational initiation
  Homolog annotation: Hit_ID=Q9FF87; Match level="QueryCoverage=65%, HitCoverage=77%, E-value=1e-23, Identity=27%"; Hit description =Arabidopsis thaliana genomic DNA, chromosome 5, P1 clone:MRO11
  Pfam annotation: Domain name=mTERF; Domain location=82-354; Score =67.1; E_value=5.7e-17; Accession=PF02536.5; Description=mTERF
  Subcellular localization annotation: CTP_CleavageSite=59; ConfidenceScore=5.26e-01
MFNKLLYLKDVTFTATSRYPFIHHHSPLLFPLRFYTTTTSNSHSFAVSYLIHNFGFSPESASRTCDSYRICFRTPEKPDSAIRFLRDHGFSNSQINSMVRRVPWLLSCDPCKRVLPKFQFLLSKGVSSSTIVDIVSKSPAILSRSLENTIVPSYDLVFRFLKSDDHTISCLFGNCIYYGRRDYIERNIRVLLDNGVGETNIARLLRNRCRAVFTSDILKVVEEVKDLGFDPSKSAFVTALLALKSMSQTSWKEKVGVYKKWGWSDEACLEAFRRHPHCMLASIDKINTVMNFWVNQLGWDSLDLVRSPKILGLSMEKTIIPRALVVQYLVAKGLRKKSACFHIPFAVSKKAFMEKLYQLSSDNFRIQHCRLVLAWGEPWHNGKRCKGLGRIVGVQWGSELLFMHTSFSRWHYGKLVGGLDKSVEGSYSNQGNLPLHLHFGNC

SEQ ID NO: 147861 - protein, 43 aa, Glycine max
  Coding DNA Sequence Number=SeqID_31083
MASKPAPPEDNFEKKAMKAMRVMEDVVFSSGDEVNLDSQEVEI

SEQ ID NO: 147862 - protein, 141 aa, Glycine max
  Coding DNA Sequence Number=SeqID_31084
  Gene Ontology: Mol. function=O-methyltransferase activity; Cellular component=cellular_component; Biological process=lignin biosynthetic process
  Homolog annotation: Hit_ID=Q1T3W1; Match level="QueryCoverage=99%, HitCoverage=39%, E-value=8e-48, Identity=61%"; Hit description=O -methyltransferase, family 2
  Pfam annotation: Domain name=Methyltransf_11; Domain location=47-138; Score=10.2; E_value=0.0054; Accession=PF08241.2; Description =Methyltransferase domain
  Pfam annotation: Domain name=Methyltransf_12; Domain location=47-137; Score=19.1; E_value=0.0097; Accession=PF08242.2; Description =Methyltransferase domain
  Pfam annotation: Domain name=Methyltransf_2; Domain location=1-141; Score=68.7; E_value=1.9e-17; Accession=PF00891.8; Description=O -methyltransferase
  Pfam module annotation: Pfam domain module=Methyltransf _11::Methyltransf_12::Methyltransf_2; Domain location=47-138::47 -137::1-141
MTFWELAGCEPKFNNLFNDAMASDTQWVSSVVIEKCKGVFDLSESLVDVGGGTGTMAKAIAKSFPKLKCVVFDLPRVVGDLQGTDNIKFVGGDMFEEAFPLADCITLKWVLHNWNDEDCVKLLNKCKEAIPNHGGVIIIEV

SEQ ID NO: 147863 - protein, 271 aa, Glycine max
  Coding DNA Sequence Number=SeqID_31085
MVPRSCDRMASMDFWRFSKASLYCSIYIVLEHYDDLQRGLLVLGDDEDGEVGLVGVDFNGDLKDAHEVEVVAEEQRDGGDAHSVMAKAKYGCTNNLLPSINLNTTCSNLWGTLESLSLKLVLAEDVIKKVGEVVNLEGGWDSNYPKEMLPIEIGNIILAIPPPCSIAVLNSLTWEGSKDEDFSLAVAYQTITNGIVIQHDPLCKIVLLVRCMGKLRLSFMSCVIVNMRRLWKHIIAPQAWNSFFQGDLEELDMTMCKKNDSMLEDIIARDS

SEQ ID NO: 147864 - protein, 110 aa, Glycine max
  Coding DNA Sequence Number=SeqID_31086
MADVSECESRFEEHKEGFALLGTIGSLLGFDENPKDYVNCSTIQWHHVSVYPQKLGDLLTKQVVASYIITEGVGDTGREIWFMENGRIVIVHYSHLKHLSIYGLVSCYHK

SEQ ID NO: 147865 - protein, 251 aa, Glycine max
  Coding DNA Sequence Number=SeqID_31087
  Pfam annotation: Domain name=Mak16; Domain location=1-94; Score= -117.0; E_value=5.3e-05; Accession=PF04874.5; Description=Mak16 protein
MTTPRKEKKREARREEKAEKAALLEKSIEKELLERLQKGVYQQSDIYNYPLEEYNKVLDMEKLQIADEEEDEEEPEVEYVEGYDELEEEEDMEDFGGFATLKSQGDFDDDENAESTDDEEEEAIDQSRAKRKMALSSKKLEKNGLGSKLKKTRVLVEKLAINKVGAIPGTAVKLCLDDQLVMGSLIWKQPLCICKGSVAYNDPPPYLHIARSFGALGLSVRTLVKDRGWYNSCIRHCYGQERKNAIAESEF

SEQ ID NO: 147866 - protein, 231 aa, Glycine max
  Coding DNA Sequence Number=SeqID_31088
  Homolog annotation: Hit_ID=Q5JMX2; Match level="QueryCoverage=42%, HitCoverage=17%, E-value=1e-11, Identity=37%"; Hit description =Putative vascular plant one zinc finger protein
MERRTIEGFSESLSSCADSSGAVTLPLFYVVVLNPIAPSLQFKAKVFYIGYFVIFVKEGMMRESFKGKGGSSSLQSMKEKEKHLVEKIQGIFNSLQCARKEGRGNDIVIFEEQMHQLLREWKAELESPANSLADGSFGSFPSELAQMLLGTEEKDDATSPLTKPVPLKNEILTNNISDINFQYFQEGLTKLIPQNWLLMWGLNTTLKAAIKEVPKEATIGGLGVTTIKTAF

SEQ ID NO: 147867 - protein, 106 aa, Glycine max
  Coding DNA Sequence Number=SeqID_31089
MDTLLCAKDVISWLCGNKRNCWRRNESNGDPLVLVVENDLMRATWCRIVEQVVTRSEGKARQRCGDTKVLRWWPEVLMPTKVTRDEWAMAKRKKIYRSRGGSFWRW

SEQ ID NO: 147868 - protein, 308 aa, Glycine max
  Coding DNA Sequence Number=SeqID_31090
  Homolog annotation: Hit_ID=Q9SLB9; Match level="QueryCoverage=73%, HitCoverage=50%, E-value=6e-88, Identity=67%"; Hit description =Expressed protein
MGHNSNLLGQFDLYHDLRHNTEMKNNSESTQFSLEGFDCSQFFEADDNVQHGENIIPNILPNICPPPSAFLAPKCALWDCFRPAQGVEWCQNYCSSCHELLANNEGLPGMTPILRPWGIGVKDGPLFAAVLAKTQGKEVGIPSCEGAASTKSPWNAPEFFDLSFLEGETVREWLFFDKPRRAFESGNRKQRSLPDYSGRGWHESRKQVMKEHGGQKRSYYMDPQPLSYLEWHLYEYEINNQDGCALYRLELKLVDKKKSPKGKVTKESLTDLQNKMGQLTAAVPSTDDGQPVKGKTKAKSENDESPNK

SEQ ID NO: 147869 - protein, 444 aa, Glycine max
  Coding DNA Sequence Number=SeqID_31091
  Gene Ontology: Mol. function=transferase activity, transferring hexosyl groups; Cellular component=integral to membrane; Biological process=metabolic process
  Homolog annotation: Hit_ID=Q53UH2; Match level="QueryCoverage=95%, HitCoverage=91%, E-value=1e-135, Identity=54%"; Hit description =Glucosyltransferase
  Pfam annotation: Domain name=UDPGT; Domain location=1-442; Score= -141.4; E_value=0.0017; Accession=PF00201.9; Description=UDP -glucoronosyl and UDP-glucosyl transferase
MGHQTAFLHLCNKLAIRGHKISFITPPKAQAKLEPFNLHPNSITFVTINVPHVEGLPPDAQTTADVTYPLQPQIMTAMDLTKDDIETLLTGLKPDLVFYDFTHWMPALAKRLGIKAVHYCTASSVMVGYTLTPSRFHQGTDLMESDLMEPPEGYPDSSIKLQTHEARTFAAKRKDTFGSNVLFYDRQFIALNEADLLAYRTCREIEGPYMDYIGKQFNKPVVATGPVILDPPTLDLEEKFSTWLGGFEPGSVVYCCFGSECTLRPNQFLELVLGLELTGMPFLAAVKAPLGFETVESAMPEGFQERVKGRGFVYGGWVQQQLILAHPSVGCFITHCGSGSLSEALVNKCQLVLLPNVGDQILNARMMGTNLEVGVEVEKGDEDGMYTKESVCKAVSIVMDCENETSKRVRANHARIRELLLNKDLESSYVDSFCMRLQEIVEGI

SEQ ID NO: 147870 - protein, 185 aa, Glycine max
  Coding DNA Sequence Number=SeqID_31092
  Homolog annotation: Hit_ID=Q2HUH8; Match level="QueryCoverage=93%, HitCoverage=56%, E-value=5e-16, Identity=28%"; Hit description =Histidine triad (HIT) protein; Homeodomain-like
MGTTMTMIHPPVQKFNGCYKQVNKHRRSESSEKDVLANAHMIYSQDTDQPKLDAKFMSKCSKRTKVSAFGNYSSSSNPETRVEVEEYDMSLPMSCPIGQKAAKRKSKGKESPNTLNLSGIENVMKDKNMNISKLIQLKEAQERHLQEQKRHMEYGIVMKDTSNMFEQQRKDHEKYCDHIRKKLGY

SEQ ID NO: 147871 - protein, 141 aa, Glycine max
  Coding DNA Sequence Number=SeqID_31093
  Homolog annotation: Hit_ID=Q1SEN7; Match level="QueryCoverage=37%, HitCoverage=11%, E-value=3e-10, Identity=64%"; Hit description =Peptidase M, neutral zinc metallopeptidases, zinc-binding site
MKRNENGRWRRCEDTGAEHVEVEVIGLLEEVELLGGLRGEDVARAAAEAAVVDSGDATFRWVVLSFSVGGDLLDKVSARVCDEGVATVVDGDVIGSIDLFEGERGEEEAATGAEVVGGEGVEWRYPRRKCCSGDGVGGVLV

SEQ ID NO: 147872 - protein, 51 aa, Glycine max
  Coding DNA Sequence Number=SeqID_31094
MGMGKGERSENEDGMTMGKEEMEKPGQDTWREGCACNRGKLKTFKLLHGKK

SEQ ID NO: 147873 - protein, 513 aa, Glycine max
  Coding DNA Sequence Number=SeqID_31095
  Gene Ontology: Mol. function=transmembrane receptor activity; Cellular component=membrane; Biological process=defense response
  Homolog annotation: Hit_ID=Q1SGR7; Match level="QueryCoverage=95%, HitCoverage=44%, E-value=1e-157, Identity=56%"; Hit description=TIR; Disease resistance protein; AAA ATPase
  Pfam annotation: Domain name=NACHT; Domain location=201-352; Score= -33.3; E_value=0.023; Accession=PF05729.3; Description=NACHT domain
  Pfam annotation: Domain name=NB-ARC; Domain location=159-455; Score =115.2; E_value=1.9e-31; Accession=PF00931.13; Description=NB-ARC domain
  Pfam annotation: Domain name=TIR; Domain location=24-138; Score =118.9; E_value=1.4e-32; Accession=PF01582.10; Description=TIR domain
  Pfam module annotation: Pfam domain module=NACHT::NB-ARC::TIR; Domain location=201-352::159-455::24-138
MASNNNSSSSSIIVQHCNYSSYDVFVSFRGKKFVHLGDDTRLKKGERILSNLMQAIEGSQIFVIVFSKNYAFSSWCLKELAKILDCVRVSGKHVLPIFYDVDPSEVRNQTGDYEKAFAKHEDREKMEEVKRWREALTQVANLAGWDMRNKSQYAEIEKIVQEIISKLGHNFSSLPNDLVGMESPVEELEKLLLLDLTDDVRIVGICGMGGIGKTTLATVLYDRISHQFDAHCFIDNVSKTYRHCGQIGVLKQLLHQTLNEDLQICNLYHAANLMQSRLRYVKSIIVLDNVNEVEQLEKLVLNREWLGAGSRIIIISRDKHVLKKCGVTVVYKVQLLNGANSLKLFCKKAFDSVDITGDYEELKYEVLKYANDLPLAIKVLGSVLSGRSVSYWRSYLDRLKENPNKDILDVLRISYDELQDLEKEIFLDIACFFCGNEELYVKKVLDCCGFHSEIGIRALVDKSLIDNSSGFIEMHNLLKVLGRTIVKGNAPKEPGKWSRVWLHEDFYNMSKAT

SEQ ID NO: 147874 - protein, 267 aa, Glycine max
  Coding DNA Sequence Number=SeqID_31096
  Gene Ontology: Mol. function=catalytic activity; Biological process =cellular metabolic process
AKAQIAKKNERYVKQANKNMKEVVLEPGDWVWVHMRKKRFPKQRKSKLQPRGDGPFQVLERINDNAYRMIFQVSMEANAFQEEGNDENPKISQIQGPMTRSRTKQSVDTLQQMVIGILNKAQVEKDEGLEDCHHQKGGDCGSNDFQDYFDDAKESRVKQVPKNQASRIKSQRIKIQEQLSFKIQDSRTIKIKIQEKKSRSNRYIYIGCNTENKRRYISWGSVQVEGTSTWLFKENKGGYIPCGSLACKGFYKVERNLKNRWLLGDWM

SEQ ID NO: 147875 - protein, 757 aa, Glycine max
  Coding DNA Sequence Number=SeqID_31097
  Gene Ontology: Mol. function=translation elongation factor activity; Cellular component=intracellular; Biological process=translation
  Homolog annotation: Hit_ID=Q56YJ4; Match level="QueryCoverage=92%, HitCoverage=91%, E-value=0.0, Identity=72%"; Hit description =Putative GTP-binding protein
  Pfam annotation: Domain name=EFG_C; Domain location=479-569; Score =79.1; E_value=1.4e-20; Accession=PF00679.14; Description=Elongation factor G C-terminus
  Pfam annotation: Domain name=GTP_EFTU; Domain location=60-258; Score =221.0; E_value=2.6e-63; Accession=PF00009.17; Description=Elongation factor Tu GTP binding domain
  Pfam annotation: Domain name=GTP_EFTU_D2; Domain location=279-374; Score=34.5; E_value=3.6e-07; Accession=PF03144.15; Description =Elongation factor Tu domain 2
  Pfam annotation: Domain name=MMR_HSR1; Domain location=63-184; Score =12.5; E_value=7.2e-05; Accession=PF01926.13; Description=GTPase of unknown function
  Pfam annotation: Domain name=Miro; Domain location=64-184; Score= -12.8; E_value=0.095; Accession=PF08477.3; Description=Miro-like protein
  Pfam module annotation: Pfam domain module=EFG_C::GTP_EFTU::GTP_EFTU _D2::MMR_HSR1::Miro; Domain location=479-569::60-258::279-374::63 -184::64-184
  Subcellular localization annotation: CTP_CleavageSite=38; ConfidenceScore=5.85e-01
MVGPIIRSLWSSTRKSFSSSSSSFSPSPPLSHSRFFSRAFAAAPATAPAAATTASSLDPSRLRNLAVIAHVDHGKTTLMDRLLRQCGADLPHERAMDSISLERERGITISSKVTSVSWKENELNMVDTPGHADFGGEVERVVGMVEGAILVVDAGEGPLAQTKFVLAKALKYGLRPILLLNKVDRPAVSEETCDEVESLVFDLFANLGATEEQLDFPVLYASAKEGWASTTFTKDPPADARNMSQLLDAVVRHVPPPNANIDAPFQMLVSMMEKDFYLGRILTGRIFSGVVRVGDKVHGLRNKDSGAEKIEDGKANIFMSRYQSCPLSTVYERGSVVKLMKKKGTNMVLTDCAGAGDIISIAGLSSPAIGHTVATVEIMSALPTVELDPPTISMTFGVNDSPLAGRDGTHLTGGRIGDRLMAEAETNLAINVLPGLSESFEVQGRGELQLGILIENMRREGFELSVSPPKVMYKTESGQKLEPVEEVTIEVNDEHVGLIMEALSHRRAEVTDMGPVSGTVGRTRLCLTCPSRGLVGYRSVFSSDTRGTGFMHRAFHAYEKFRGPLGNVRKGVLVSMGFGTITAHALMSLEARGTLFVTPGMESLELLKINLEEDFTAKELFAINLAMIFLPKSTLVFYSQIVAKHFDLGLRLKFIPKKHEAYDGMIVGEHSRDTDLDVRSILSLNVNPVRAKELTNIRAATKDDNVKLTPPRLMTLEEAIGYVASDELIEVTPKSIRLRKKYLDVNKRKAMSKKPKE

SEQ ID NO: 147876 - protein, 171 aa, Glycine max
  Coding DNA Sequence Number=SeqID_31098
  Gene Ontology: Mol. function=acyl-CoA dehydrogenase activity; Cellular component=peroxisome; Biological process=fatty acid metabolic process
  Homolog annotation: Hit_ID=Q9LLH9; Match level="QueryCoverage=93%, HitCoverage=23%, E-value=1e-51, Identity=59%"; Hit description=Acyl -coenzyme A oxidase 3, peroxisomal precursor
MDNDRVSRRTEVLTNHLLRRTPPPSALLHPHPCLSYSPPELSNTISFDTREMRKLMDCHNLEERDWIFSLILQSPLFNPRHRAGRVFVSPDYNQPMEHQRQATMKRIGYLLQKGVFRGWLTGNGPEQELRKLALHEVIGMYDHSLAVKLGVHFFLWKSVVGKKCPPYHSWK

SEQ ID NO: 147877 - protein, 254 aa, Glycine max
  Coding DNA Sequence Number=SeqID_31099
  Gene Ontology: Mol. function=transcription factor binding; Cellular component=intracellular; Biological process=regulation of transcription, DNA-dependent
  Homolog annotation: Hit_ID=Q9FJH0; Match level="QueryCoverage=86%, HitCoverage=96%, E-value=1e-106, Identity=90%"; Hit description=GTP -binding protein, ras-like
  Pfam annotation: Domain name=Arf; Domain location=2-184; Score=-98.9; E_value=0.04; Accession=PF00025.11; Description=ADP-ribosylation factor family
  Pfam annotation: Domain name=MMR_HSR1; Domain location=14-139; Score =18.9; E_value=1.9e-05; Accession=PF01926.13; Description=GTPase of unknown function
  Pfam annotation: Domain name=Miro; Domain location=15-139; Score =72.4; E_value=1.5e-18; Accession=PF08477.3; Description=Miro-like protein
  Pfam annotation: Domain name=Ras; Domain location=15-186; Score =311.5; E_value=1.5e-90; Accession=PF00071.12; Description=Ras family
  Pfam module annotation: Pfam domain module=Arf::MMR_HSR1::Miro::Ras; Domain location=2-184::14-139::15-139::15-186
MGAYRADDDYDYLFKVVLIGDSGVGKSNLLSRFTKNEFSLESKSTIGVEFATRSIHVDDKIVKAQIWDTAGQERMENVIHIFLGYRAITSAYYRGAVGALLVYDVTRHVTFENVERWLKELRDHTDANIVIMLVGNKADLRHLRAVATNDAKAFAERENTFFMETSALESLNVDNAFTEVLTQIYRVVSRKTLEIGDDPAALPKGQTINVGSRDDVSAVKNYSLQLQYLHKYSAQYTGKGLQEITQLEALLFFS

SEQ ID NO: 147878 - protein, 146 aa, Glycine max
  Coding DNA Sequence Number=SeqID_31100
  Homolog annotation: Hit_ID=Q39203; Match level="QueryCoverage=31%, HitCoverage=6%, E-value=4e-07, Identity=60%"; Hit description =Receptor-like protein kinase precursor
  Subcellular localization annotation: CTP_CleavageSite=32; ConfidenceScore=5.57e-01
MKLHDLVPVGMHRVFSSMPLLSMSPAVARTFTASRNSSNYAMVCDTDISSFDVSPKVAWSGVVVVLGVVVMVKKRGGGRKGLEEEEEDGFSEKVWHGGFENVFQGELSDASVVVLKRLERPRGGEKEFRVEVSTTVFQTRLFYLFL

SEQ ID NO: 147879 - protein, 63 aa, Glycine max
  Coding DNA Sequence Number=SeqID_31101
MREADDGIERPAKYKSERKEKGILGNGSLERFLAGVGLKGRGGRGVRGKGLNVRTERKEIVWF

SEQ ID NO: 147880 - protein, 210 aa, Glycine max
  Coding DNA Sequence Number=SeqID_31102
  Gene Ontology: Mol. function=RNA-directed DNA polymerase activity; Biological process=RNA-dependent DNA replication
  Homolog annotation: Hit_ID=Q1SL34; Match level="QueryCoverage=72%, HitCoverage=32%, E-value=3e-09, Identity=26%"; Hit description =Endonuclease/exonuclease/phosphatase
MRRALDPGLNTPHQGASVSNSHEEGVGGIGFSSLINELIKKSNIGILCLLETNVSGNKARNIINKFSLDMSYVVEAQGQAGGIWYFTSIYARPHVQSYRALETSKSVANNQIADQIDGPWSLFGDFNVLLQDHKHCGGSQRALLCGDMAFQNFVQDYHLMDKGYQGEGKNQKNSQAVSPLNSLGKREGRHKRIQAVSPSILLAKGEEKKR

SEQ ID NO: 147881 - protein, 257 aa, Glycine max
  Coding DNA Sequence Number=SeqID_31103
STKKVKTKDRDEVRDEAMLIVKLSARGGYVGSEAEAGKVTTPTKKFMEKLFEINGGIVFTDFTSLMKEMIDTKRHLGYQIYNYKSPILMYKLDPCPTILITLEKFKEQCGSRKKIPNVSVLGKHVAFRMIENKFQKKWAKKSGSKHPFFTVIEKEGGSKWGGMLRIGKLTSIPFRSHSSKICVEIDLGRKLVPQINVLRHIIKLEYEGLHSICFNYEKYVEVRKKNDDDNPNAEVGSKPTVASNHIGGESAGLYRLG

SEQ ID NO: 147882 - protein, 103 aa, Glycine max
  Coding DNA Sequence Number=SeqID_31104
MIMRGQDIYSSQDEATTFPSSSENEEAKGEESSEEIYPQEEGQPLLVKEKCKEASVSSKRNNQHENTEKGVPINSKRIKVIPEWPAPPSVLRKQAQSFKNLGI

SEQ ID NO: 147883 - protein, 84 aa, Glycine max
  Coding DNA Sequence Number=SeqID_31105
MYPEEILGTEGGRYNGIILNDLGVVNFWMWLYDNLNVLVYDAYVLKMDEDQWRYDFAMSQEVHMDYDYDNQEECGYKSRIASNN

SEQ ID NO: 147884 - protein, 97 aa, Glycine max
  Coding DNA Sequence Number=SeqID_31106
  Subcellular localization annotation: CTP_CleavageSite=23; ConfidenceScore=5.17e-01
MAEKADGEVFRKTQPFPESFRKKCSSGSNQTSSGRTLLPEDFRKTSSGNFPEEVVHPEEFRKTRTSGRSFKVPEDLSGRTPSSGMFLEEPLLPEVIL

SEQ ID NO: 147885 - protein, 190 aa, Glycine max
  Coding DNA Sequence Number=SeqID_31107
  Homolog annotation: Hit_ID=Q1SKD7; Match level="QueryCoverage=89%, HitCoverage=45%, E-value=2e-17, Identity=30%"; Hit description =Ankyrin
MAPKKLSTKRSRRDAAAEGTSAAPEFDSHRFRSAEHQQRFEAIKGWSFHRERRVQLWDDEYTDFQEEIARRRWTSLVTPMAKFDPNIVLEFYANAWPTVEGVRDMRSWVRGQWIPFDADALSQFLGDPLVLEEGQECEFSQRRNRANGFDEEAITQLLCTPGQNFAWTAAGDGCGSCREGISTPRVCHKG

SEQ ID NO: 147886 - protein, 51 aa, Glycine max
  Coding DNA Sequence Number=SeqID_31108
GINSWGYGHDGGGYMNDNQFMGLRIRFDDGGCTNSARQSIRGAPDSMVEDT

SEQ ID NO: 147887 - protein, 292 aa, Glycine max
  Coding DNA Sequence Number=SeqID_31109
  Gene Ontology: Mol. function=phosphopantetheinyltransferase activity; Cellular component=integral to membrane; Biological process =macromolecule biosynthetic process
  Homolog annotation: Hit_ID=Q9FHT4; Match level="QueryCoverage=93%, HitCoverage=50%, E-value=1e-93, Identity=62%"; Hit description =Endosomal protein-like
  Pfam annotation: Domain name=EMP70; Domain location=25-292; Score= -65.9; E_value=6.6e-13; Accession=PF02990.7; Description=Endomembrane protein 70
MTLLILCAFPFFFLTTVRHTDISIFPFAHQVANVEEKREDLGEVLNGDRLVVAPYKLDFQIDIEPESICTKRLTIKEVAQFRHAVLKDYFYQMYYDDLPIWGFLGKFDSEDKDDQTGAIVHLFKHVHFEILYNKDRIIDVFIQNDPQAVVDLTENKEVEVDFTYSATWVETDTPFEKRLEKYSQTSSLSHNLEIHWFSVINSCATVLLLTGFLAIILMRVLKNDFVKFTPDEEAVDDQEESGWKYIHGDVFSSTWNRNPAIYTGSFVYCTGDHICTNVWHCGLLCSFLLLHD

SEQ ID NO: 147888 - protein, 156 aa, Glycine max
  Coding DNA Sequence Number=SeqID_31110
  Gene Ontology: Mol. function=protein serine/threonine kinase activity; Biological process=protein amino acid phosphorylation
  Homolog annotation: Hit_ID=Q1T003; Match level="QueryCoverage=98%, HitCoverage=21%, E-value=8e-46, Identity=61%"; Hit description =Protein kinase; Concanavalin A-like lectin/glucanase
  Pfam annotation: Domain name=Lectin_legB; Domain location=21-156; Score=-6.1; E_value=5.4e-10; Accession=PF00139.10; Description =Legume lectin domain
MSLLCFPSILSIFCFFSFVTAATEFDFGTLTLGSLKLLGDAHLNNATVSLTRDLAVPTSSAGRALYSRPVRFRQPGNRFPASFTTFFSFSVTNLNPSSIGGGLAFVLSPDDDTIGDAGGFLGLSAAADGGGFIAVEFDTLMDVEFKDINGNHVGVD

SEQ ID NO: 147889 - protein, 173 aa, Glycine max
  Coding DNA Sequence Number=SeqID_31111
  Gene Ontology: Biological process=response to stress
  Homolog annotation: Hit_ID=Q1T005; Match level="QueryCoverage=99%, HitCoverage=100%, E-value=1e-72, Identity=81%"; Hit description =Universal stress protein
  Pfam annotation: Domain name=Usp; Domain location=3-164; Score=89.2; E_value=1.2e-23; Accession=PF00582.16; Description=Universal stress protein family
MAKARTVGVAVDFSPTSKLALRWAVDNLINKGDQIILITVQPPQAHHTRKELFEDTALVPLEELRELNFTKQYGIARDPEVIGILDTASKTKGLPWEEIKYGAKAVAKVYWGDPREKLCNAVEDLHLDSLVVGSRGLGPIKRVLLGSVSKHVMTNASCPVTVVKGKQSSNSRH

SEQ ID NO: 147890 - protein, 137 aa, Glycine max
  Coding DNA Sequence Number=SeqID_31112
  Gene Ontology: Mol. function=RNA-directed DNA polymerase activity; Biological process=RNA-dependent DNA replication
  Homolog annotation: Hit_ID=Q1SQN7; Match level="QueryCoverage=67%, HitCoverage=20%, E-value=1e-11, Identity=28%"; Hit description=RNA -directed DNA polymerase
MPFVYLGIPLGAFLKRIRTWKPALQKLKRKMAPWKQKVNGGLGLKNVELFNKALIVKWKWRLLEKEKTMWAKILIAKYGPVWRKVKKGCNNASNGILGGRSMELEITVEEKFEGMRARVRSAIDGHAKESQFEGGRK

SEQ ID NO: 147891 - protein, 486 aa, Glycine max
  Coding DNA Sequence Number=SeqID_31113
  Gene Ontology: Mol. function=protein serine/threonine kinase activity; Cellular component=cell surface; Biological process =protein amino acid phosphorylation
  Homolog annotation: Hit_ID=Q1T003; Match level="QueryCoverage=99%, HitCoverage=69%, E-value=0.0, Identity=76%"; Hit description=Protein kinase; Concanavalin A-like lectin/glucanase
  Pfam annotation: Domain name=Pkinase; Domain location=156-429; Score =179.3; E_value=9.5e-51; Accession=PF00069.15; Description=Protein kinase domain
  Pfam annotation: Domain name=Pkinase_Tyr; Domain location=156-429; Score=125.4; E_value=1.6e-34; Accession=PF07714.7; Description =Protein tyrosine kinase
  Pfam module annotation: Pfam domain module=Pkinase::Pkinase_Tyr; Domain location=156-429::156-429
MNLDVDKYLNDFMYVGFSASTQGSTEIHRIEWWSFGSSFAAAAAVAPPPPAVSLMNPTENSVKFAPPPSLAPSHSEEKESKSKSSCHNGLCKQNMGAVAGVVTAGAFVLALFAGALIWFYSKKFKRVKKFDSLGSEIIRMPKQFSYKELNSATKCFNANRIIGHGAFGTVYKGVLPENGDIVAVKRCSHCSQGKNEFLSELSIIGSLRHRNLVRLQGWCHEKGEILLVYDLMPNGSLDKALFEARTPLPWAHRGKILLGVASALAYLHQECENQVIHRDIKTSNIMLDEGFNARLGDFGLARQTEHDKSPDATVAAGTMGYLAPEYLLTGKATEKTDVFSYGAVVLEVASGRRPIEKDANGGGKGGISCNLVEWVWSLHREARLLMAADPRLEGEFDEGEMRKMLLVGLACSHPDPLTRPTMRGVVQILVGEAEVPLVPRTKPSTGFSTSHSHLLLSLQDSVSDCDGIITISTSTSENSFNLGDIV

SEQ ID NO: 147892 - protein, 122 aa, Glycine max
  Coding DNA Sequence Number=SeqID_31114
  Gene Ontology: Mol. function=glutamate decarboxylase activity; Cellular component=membrane fraction; Biological process=carboxylic acid metabolic process
  Homolog annotation: Hit_ID=Q1S578; Match level="QueryCoverage=78%, HitCoverage=19%, E-value=1e-46, Identity=92%"; Hit description =Pyridoxal-dependent decarboxylase
MVLSKTASEKDVSIHSTFASRYVRTSLPRFKMAEQSVPKEAAYQIINDELMLDGNPRLNLASFVTTWMEPECDKLIMAAINKNYVDMDEYPVTTELQASPTLIHYFQSSEIKFSFNQFLTCG

SEQ ID NO: 147893 - protein, 484 aa, Glycine max
  Coding DNA Sequence Number=SeqID_31115
  Gene Ontology: Mol. function=UTP:glucose-1-phosphate uridylyltransfera se activity; Cellular component=cytoplasm; Biological process =metabolic process
  Homolog annotation: Hit_ID=Q9LKG7; Match level="QueryCoverage=77%, HitCoverage=73%, E-value=1e-170, Identity=82%"; Hit description=UTP-- glucose-1-phosphate uridylyltransferase
  Pfam annotation: Domain name=Ribosomal_L27e; Domain location=414-484; Score=118.7; E_value=1.6e-32; Accession=PF01777.8; Description =Ribosomal L27e protein family
  Pfam annotation: Domain name=UDPGP; Domain location=1-378; Score =552.6; E_value=4e-163; Accession=PF01704.8; Description=UTP--glucose- 1-phosphate uridylyltransferase
  Pfam module annotation: Pfam domain module=Ribosomal_L27e::UDPGP; Domain location=414-484::1-378
MRTTFLKSNLKPCAGLKNFLKDYFLRSPFLNLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQVDPRAQVVSSLTGKEYVFVANSDNLGAIVDLKILNHLIQNKNEYCMEVTPKTLADVKGGTLISYEGRLLEIAQVPDEHIFIILIDDIMFVMVNEFKSIEKFKIFNTNNLCLTIIYRWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKRPYGQCLVAGINKYPAKKSRVKALVKLVNYQHLMPTRYTLDVDLKDAVNPDVLNAKDKKATALKETKKLLEERFKTGKNRWF

SEQ ID NO: 147894 - protein, 178 aa, Glycine max
  Coding DNA Sequence Number=SeqID_31116
  Gene Ontology: Mol. function=binding; Biological process=metabolic process
  Homolog annotation: Hit_ID=Q1SZZ7; Match level="QueryCoverage=99%, HitCoverage=100%, E-value=2e-86, Identity=84%"; Hit description =Armadillo
  Pfam annotation: Domain name=Arm; Domain location=52-92; Score=9.9; E_ value=0.7; Accession=PF00514.13; Description=Armadillobeta-catenin -like repeat
  Pfam annotation: Domain name=Arm; Domain location=93-133; Score=27.8; E_value=3.9e-05; Accession=PF00514.13; Description=Armadillobeta -catenin-like repeat
  Pfam module annotation: Pfam domain module=Arm::Arm; Domain location =52-92::93-133
MFTNDQRQQERTGRYGTSRVEFLQKLVTQFQNTSEDETREKILANLANFAYDPYNYNFLRQLNVLELFVDCLTEPNEKLVEFGIGGICNSCVDPANSAIVTTFGGIPLIIQCLSSPVRNTVNYALGALYYICNESNKEEILRPEVVDVIRRYAAAEEVSVSFSNLAKAFLSKHLAENY

SEQ ID NO: 147895 - protein, 73 aa, Glycine max
  Coding DNA Sequence Number=SeqID_31117
MEEDEERVSEKAGFARIEREHRPFDRAIALVLIWWWVENGNVEIREKKPSLDVGASANQGKKYKHRSVETMDI

SEQ ID NO: 147896 - protein, 190 aa, Glycine max
  Coding DNA Sequence Number=SeqID_31118
  Gene Ontology: Mol. function=4 iron, 4 sulfur cluster binding; Cellular component=intracellular; Biological process=regulation of transcription, DNA-dependent
  Homolog annotation: Hit_ID=Q62M48; Match level="QueryCoverage=92%, HitCoverage=46%, E-value=7e-61, Identity=61%"; Hit description =Radical SAM domain protein
MYAATMGIAIKGRGSTSHLAGRFESTVSEAVDDGWAVDESEEFLAPRLRTEVRAETARSIITRNTSPDVGFSQSVNPYRGCEHGCSYCFARPSHAYLNLSPGLDFETKLFAKTNAPQLLRKELSKPGYVPQPIALGINTDAYQPIERKFKLTRQLIEVMLETKHPFSLITKNALVERDIDLLAPLAAENL

SEQ ID NO: 147897 - protein, 97 aa, Glycine max
  Coding DNA Sequence Number=SeqID_31119
MGTNQTGKRFYQVKIKGLDVTNLKELGRLMGPLQMQAFRKAYGKILDLTIAEIFTEVVGFGMRVGSCKENSKRRSGPTTEVLGKARQGIWRIKRSGS

SEQ ID NO: 147898 - protein, 77 aa, Glycine max
  Coding DNA Sequence Number=SeqID_31120
MVRTAVLLVLYMHRSPIGNLVPLDLQIEAMLRRNRAERRRKLLQNRTVASILEEETHFSDLLSPDLPSSSGICHSIT

SEQ ID NO: 147899 - protein, 369 aa, Glycine max
  Coding DNA Sequence Number=SeqID_31121
  Gene Ontology: Mol. function=transferase activity, transferring glycosyl groups; Biological process=carbohydrate metabolic process
  Homolog annotation: Hit_ID=Q11YB7; Match level="QueryCoverage=99%, HitCoverage=67%, E-value=1e-105, Identity=50%"; Hit description=A -glucan phosphorylase, glycosyltransferase family 35 protein
MYSFLEDTGIKFQIEIHSAPVWVKVWYLDPEIFHTAPMFFLSTDVPENDHVSKTICHKLYDANESTKLAQYILLGKGGAQLLDEMNLERDIYHLNEAHALPAAFYLLRKYNGDLSKVKEKLVFTTHTPEEAGNEKHNLKLCYDMSYFSGFSMEEAKSIEGVDDERFNHSLCALKMAKVANGVSQLHGVVSRAMWSKYPGICEIKSITNAQEFKYWADKRLYNSKDERDDQAFDYRKKYLKKRLFKIVADQTGNLFNPNIFTIVWARRFAGYKRADLLLHDKDRFYKLLNNPEHPVQIIWAGKPYPMDYSAISTFNTLVEESKNHKNMAVLTGYELSLSKSLKQGSDLWLNNPRVPREASGTSGMTAAMN

SEQ ID NO: 147900 - protein, 232 aa, Glycine max
  Coding DNA Sequence Number=SeqID_31122
  Homolog annotation: Hit_ID=Q1RTB4; Match level="QueryCoverage=39%, HitCoverage=27%, E-value=1e-11, Identity=34%"; Hit description=IMP dehydrogenase/GMP reductase
MARVAKVGKIMVQELDHVKQNRNEVVRIPRKHLEGKTKTLADQGEWASFIDAFALLIFGVVLFPNMEGLVDLAAIDAFLAYHHSKESPVIVILADVYDTVLFSCEGFPNVPLMGKRGCINYNPVLAIRQLSYPMRGAPLEESITPFIARGFSDPNARVLQGAAREEEAKTLEESEEVQTLKAELEKAQVVKEKFKSMAIKVWKEYDELRDINMAIAEALERETKRARKEEHG

SEQ ID NO: 147901 - protein, 114 aa, Glycine max
  Coding DNA Sequence Number=SeqID_31123
MTGHDWPLDFLFPTYRYIGTDASGDRVTTDRSLPLPGAKQAKNIAARQPKMAPRKLASKRSRKDKAAEGTSSAPEYDSHRFRTAEHQQRFEAIKGWSFLRERRVQLRDDEYTDF

SEQ ID NO: 147902 - protein, 436 aa, Glycine max
  Coding DNA Sequence Number=SeqID_31124
  Gene Ontology: Mol. function=DNA binding; Cellular component=nucleus; Biological process=regulation of transcription, DNA-dependent
  Homolog annotation: Hit_ID=Q0PJH7; Match level="QueryCoverage=99%, HitCoverage=100%, E-value=0.0, Identity=89%"; Hit description=MYB transcription factor MYB177
  Pfam annotation: Domain name=Myb_DNA-binding; Domain location=60-105; Score=58.0; E_value=3e-14; Accession=PF00249.21; Description=Myb-like DNA-binding domain
MAIQGQNAFTRSQGGLPIGDEISFNSGVHSVADIPLHDQLSCGNDYALKVRKPYTITKQRERWTDEEHKKFLEALKLYGRAWRRIEEHVGTKTAVQIRSHAQKFFSKILRESSGNSTTLEESIEIPPPRPKRKPIHPYPRKLVEFPKTGISNSEHPLRSNSLKSSDFGQENNSPKSVLSTVVSETVGSSDSDTSSRCLSPASSISGVPTNRFPLAEPKTSFKEEGSAPSSAHDEQPPVKLEFFHKESVSTRDDATEESSGRTLKLFGTTLLVTDTCKPSSPTTEPCKPTPAAAMYLMQLQNVCSDVTEGHASIVPWWTLPHNTPFMPLHKEPKGKHLYSNLGEFEHKEVQKEGSWTGSNTSSIDDGDNTEKSDDQAKSHVHGFSKSETLTISELRVRPKTCGKGFVPYKRCMAERENQCSSVYYEEREEQRIKLSL

SEQ ID NO: 147903 - protein, 370 aa, Glycine max
  Coding DNA Sequence Number=SeqID_31125
  Subcellular localization annotation: CTP_CleavageSite=20; ConfidenceScore=5.12e-01
MLGAVQLGLLAACVVLFVPMGMAGWHLSRNKVLFFSGALFITLAVGVHLTPYFPSVSDFVTSVSSSSVNVVVDDRDSCVSLLHEIVWEVRPRRVFDFELNDNNNSVNYDKSWSWKRSGSVDSCEFQRLKRYDVSVLLNGSWVVIAGDSQARIFALSLLSLVLEPEGMESVKGSLFKRHSDYHTVVDEIGMKLDFMWAPYVTNLTSLVAGFKRNRVYPDLLVMGSGLWHMLHFTNASDYGFSLGLLRSSVTSLLPVSSEFGNDEAVAVSASVRSPHLFWLGMPTLVNSMLNTKEKREKMTDLMWGEYEREVQGSGMLRQFGGPLQLVDIGSLSRNCGIKCTVDGMHYDGVVYEAGVQILLNALLIESHQRL

SEQ ID NO: 147904 - protein, 166 aa, Glycine max
  Coding DNA Sequence Number=SeqID_31126
  Gene Ontology: Cellular component=cytoplasm; Biological process =autophagy
  Homolog annotation: Hit_ID=Q3MQ10; Match level="QueryCoverage=58%, HitCoverage=28%, E-value=1e-46, Identity=92%"; Hit description =Autophagy protein 5
  Pfam annotation: Domain name=APG5; Domain location=6-165; Score= -78.2; E_value=0.0094; Accession=PF04106.3; Description=Autophagy protein Apg5
MSKQKLLNFLSVDISFVQLHLCYGPVISDSVWELREWVTCNLETYRRVASKLKLGTFEDEYMENVSSVLIKSPQSPGDTDVTGQVKTGRIPVRLYLWTVNEEFDDFEDAPQIDNWDKVSYINRPVEIYKEDVAYGKVNSHHVVNGVRAKSSHNFVKVEWWAIGKER

SEQ ID NO: 147905 - protein, 221 aa, Glycine max
  Coding DNA Sequence Number=SeqID_31127
  Gene Ontology: Mol. function=transferase activity; Cellular component= cytoplasm; Biological process=auxin mediated signaling pathway
  Homolog annotation: Hit_ID=Q8H1Y6; Match level="QueryCoverage=99%, HitCoverage=100%, E-value=1e-107, Identity=86%"; Hit description =Glutathione-S-transferse-like protein
  Pfam annotation: Domain name=GST_C; Domain location=99-195; Score =54.9; E_value=2.7e-13; Accession=PF00043.15; Description=Glutathione S-transferase, C-terminal domain
  Pfam annotation: Domain name=GST_N; Domain location=5-79; Score=65.6; E_value=1.6e-16; Accession=PF02798.10; Description=Glutathione S -transferase, N-terminal domain
  Pfam module annotation: Pfam domain module=GST_C::GST_N; Domain location=99-195::5-79
MSKGDKVEVLDFWASPFCARVKVALEEKGVNYVASEEDLFGGKSELLLKSNPIHQRVPVLLHNDKPLAESSIIVSYIDEVWSSNPLLPTLAYDRAQARFWTDYIDKKVFETGRSIWGSNGEEREVGTRDFIEVLKHLEEALGEKNYFGGDAFGYVDIIAIGHSAWFLAYEKLGGFKVEDHSPKISAWIKRCLQRESVAKVLPDPEKVYQFVLHFRKMLGLE

SEQ ID NO: 147906 - protein, 843 aa, Glycine max
  Coding DNA Sequence Number=SeqID_31128
  Gene Ontology: Mol. function=sucrose synthase activity; Cellular component=cytoplasm; Biological process=sucrose metabolic process
  Homolog annotation: Hit_ID=Q9FX32; Match level="QueryCoverage=95%, HitCoverage=86%, E-value=0.0, Identity=71%"; Hit description=Sucrose synthase, putative
  Pfam annotation: Domain name=Glycos_transf_1; Domain location=559 -741; Score=81.3; E_value=2.9e-21; Accession=PF00534.10; Description =Glycosyl transferases group 1
  Pfam annotation: Domain name=Sucrose_synth; Domain location=8-556; Score=885.0; E_value=3.5e-263; Accession=PF00862.10; Description =Sucrose synthase
  Pfam module annotation: Pfam domain module=Glycos_transf_1::Sucrose _synth; Domain location=559-741::8-556
MASAPALKRTDSVVDNMPDALRQSRYHMKRCFAKYLGKGRRIMKLHHLMEEMELVIDDKSERSQVLEGILGFILSSTQEAVVDPPYVAFAIRPYPGVWEFVKVSSEDLSVEAITPTDYLKFKERVHDEKWATDENSFEADFGAFDFQIPQLTLSSSIGNGLQFTSKFLTSKLTGKLEKTQAIVDYLLTLNHQGESLMINESLNSSAKLQMALVVADAFLSGLPKDTAYQNFELRFKEWGFERGWGDTAGRVKETMRTLSEVLQAPDPVNLEKFLSSLPIIFNVVIFSVHGYFGQADVLGLPDTGGQVVYILDQVKSLEAELLLRIKQQGLNVKPQILVVTRLIPDARGTKCHQELEPISDTKHSHILRVPFQTDKGILHQWISRFDIYPYLERFTQASKILEFMEGKPDLVIGNYTDGNLVASLMARKLGITQGTIAHALEKTKYEDSDVKWKELDPKYHFSCQFMADTVAMNASDFIITSTYQEIAGSKDRPGQYESHAAFTLPGLCRVVSGINVFDPKFNIAAPGADQSVYFPYTEKEKRLSQFHPAIEDLLFSKVDNIEHIGYLADRRKPIIFSMARLDVVKNLTGLVEWYGKNKRLRNLVNLVIVGGFFDPSKSKDREEMAEIKNMHDLIDKYQLKGQFRWIAAQTNRYRNGELYRCIADTRGAFVQPALYEAFGLTVIEAMNCGLPTFATNQGGPAEIIVDGVSGFHIDPLNGDESSNKIADFFEKCKMNQSQWNVISAAGLQRINECYTWKIYANKMVNMGNIYTFWRQVNKEQKEAKQRYIQMFYNLIFKNLVKTVPVPSDEPQQPVGKQPSLKSRSTGRSHSRLQRLGYYIALIN

SEQ ID NO: 147907 - protein, 644 aa, Glycine max
  Coding DNA Sequence Number=SeqID_31129
  Gene Ontology: Mol. function=DNA binding; Biological process =regulation of transcription
  Homolog annotation: Hit_ID=Q9FFI5; Match level="QueryCoverage=80%, HitCoverage=89%, E-value=7e-87, Identity=39%"; Hit description=NAM (No apical meristem)-like protein
  Pfam annotation: Domain name=NAM; Domain location=5-133; Score=323.6; E_value=3.4e-94; Accession=PF02365.6; Description=No apical meristem (NAM) protein
MAPVLPPGFRFHPTDEELVAYYLKRKINGRKIELEIIPEVDLYKCEPWDLPGKSLLPGKDLEWYFFSPRDRKYPNGSRTNRATKSGYWKATGKDRKVNSQARAVGMKKTLVYYRGRAPHGSRTNWVMHEYRLDERECETNSGLQDAYALCRVVKKTAVIPPKVGGHYVNVPNANKITSDQSSSIELYSEGRHEDLDSSNYLMSMDICSPCNMGNDQTSLTINSGMTRDLEKWSHFSSQDPLFSLPTSSSFSNFGAIAYPPSKVDIALECARMQHRFVMPPLEVDDFPQVGVSELKMAQASGSMQGSCRTETDILQEILSVAQVSQELINQSSYSQDWGGNDNYAPREDDFTFMVGTNYNHSNEMSSMRYVDKTWEDAINTRTIEIGDVDEEFKEERMVENLRWVGMSSEDLEKMQEQKIVPIEDISSFQTNREENEVQESEQQNNKEHNDTEINDFSLGFINDDDPNKNFIEDGNMDDYSSSPSFEVVEEIKVNHGMLVSTRQVVETFFHQIVPSQTVQVHLINSVMAHNHYVENAEAMLMIMENQGSLLRNKVKAYVMGKLIKPSKTIASAIVFIFAFVLMHCVYLKEEVEIWNESNNEVWFVGVKSHDEKGLSAILKKIGIFLTISLALCTMWANQNMIVNP

SEQ ID NO: 147908 - protein, 157 aa, Glycine max
  Coding DNA Sequence Number=SeqID_31130
MLKINNTHKTLKPIFFTPKTLDFDKHQSLLQRFNYPLTYLRSNNTFPLNDEGNWWCHMVFEEEGEDCLREVENKNMIPMLILLLPPELLPHRSHINRFDEFWVVGGVGSGSIVVARVVVWVVMWRVMRCSHGFCWGGDKKVGGGLRVIKKEGYMLKP

SEQ ID NO: 147909 - protein, 419 aa, Glycine max
  Coding DNA Sequence Number=SeqID_31131
  Gene Ontology: Mol. function=transferase activity; Cellular component= chloroplast; Biological process=biosynthetic process
  Homolog annotation: Hit_ID=Q0PZK5; Match level="QueryCoverage=99%, HitCoverage=86%, E-value=1e-136, Identity=63%"; Hit description =Phytoene synthase protein
  Pfam annotation: Domain name=SQS_PSY; Domain location=150-419; Score =230.8; E_value=3e-66; Accession=PF00494.10; Description =Squalenephytoene synthase
MSGTLLWVVSSPGLEVSHSSGLLDSIRSVKFLDSSKAMSRDFGSIRAKLGKEKGWRLCSLSTDMKYTCVGRSGLESASNFPLIANVLVNPAAGEVAVSSEQKVYDVVMKQASLVKRKLGAAGELDAKPDIALPGNLSLLNEAYDRCGEICAEYAKTFYLGTLLMTPERRRAIWAIYALAGLQKQSTVKLFQSSVRHFQMSKSLMSILITEVGQIRCGVGERMNLLMVLMLHKLRQLLRNRWESRLEELFQGRPFDMLDAALSDTVAKFPVDIQPFKDMIEGMRLDLKKPRYKNFDELYLYCYYVAGTVGIMSVPIMGISPNSQATTESVYNAALALGIANQLTNILRDVGEDASRGRVYLPQDELAQAGLSDEDIFAGKVTDKWRNFMKSQIKRARMFFDEAEKGVTELNEASRWPALF

SEQ ID NO: 147910 - protein, 489 aa, Glycine max
  Coding DNA Sequence Number=SeqID_31132
  Gene Ontology: Mol. function=[ribulose-bisphosphate carboxylase] -lysine N-methyltransferase activity; Cellular component=nucleus
  Homolog annotation: Hit_ID=Q6NQJ8; Match level="QueryCoverage=91%, HitCoverage=87%, E-value=1e-137, Identity=55%"; Hit description =Protein SET DOMAIN GROUP 40
  Pfam annotation: Domain name=SET; Domain location=32-302; Score =104.1; E_value=4.1e-28; Accession=PF00856.18; Description=SET domain
  Subcellular localization annotation: CTP_CleavageSite=73; ConfidenceScore=5.28e-01
MEQEHPNLESFLSWAAQLGISDSTTRTNQPQHSLSSCLGSSLSVSHFPHSGGRGLGAVRDLRRGEIVLRVPKSALMTRETVMEDKKLCDAVNRHSSLSSAQILIVCLLYEMGKGKTSRWHPYLMHLPHTYDVLAMFGEFEKHALQVDEAMWVTEKAMLKAKSEWKEAHSLMQDLMFKPQFFTFKAWVWAAATISSRTLHIPWDEAGCLCPVGDLFNYDAPGIEPSGIEDLDRLLSNTSIPDTIVLNGDKNIMVDAEQLDSHSWRLTDGGFEEDANAYCFYAREHYKKGDQVLLCYGTYTNLELLEHYGFLLQENPNDKVFIPLEPALYSSTSWSKESLYIHHNGKPSFALLAALRLWATPQNRRRSVGHLVYSGSRVSTDNEIFIMKWLSKTCDAVLRNLPTSLEEDTLLLNAMDNSQDFSTFMEITKLVSSREETYTFLETHNMKDTHSFTDILLIERRKRKDIYITRNGLNRKASLMQQEVEAFAYV

SEQ ID NO: 147911 - protein, 481 aa, Glycine max
  Coding DNA Sequence Number=SeqID_31133
  Gene Ontology: Mol. function=electron carrier activity; Cellular component=membrane; Biological process=electron transport
  Homolog annotation: Hit_ID=Q7W2W6; Match level="QueryCoverage=53%, HitCoverage=90%, E-value=1e-114, Identity=75%"; Hit description =Cytochrome C1
MGADKPGGALRLAHVFPVRGVQAPHHQEEQEQEQHDTDAQLHAESLDGLGHPGHERGQVGDVVVVCCGLGRIGGLEFGLEGGMAVVAGYRLGLDRGKTLRIVHRRDPFPRLRRAVLAFDLVHRHRRQLARTLAFPQRVRHADGREDQVVPARGTRGVAVERAQVGVDVVGTRGAGVDGFGAGDHGQVRGRGAKPLLGVLGRHGDIHHVADLLAGEQQAFLDLLVGQANVLELVVAHRRCAMAVQTVVDEQLGAVLQRRHVVDAVRRLVQQKSRVRRRKWRRHLLEGAQAAPDRHQEEECQVQQRADLRRDVQRRTGRLRTDVAEHQEVDHEDAVDPLVPRGAVADRLDRRMVQPRQEEQDDHGAAHGDHAPELGVDHAQQHGHDDQDAGHGDAHEALQVALDEQRDGAQHRGAGQHPRELVGGGAQHRVERREVPHRGDVRRRLERVGRDEVVELQEVPAHFRREEHDEGEHQQEARDADQ

SEQ ID NO: 147912 - protein, 115 aa, Glycine max
  Coding DNA Sequence Number=SeqID_31134
  Gene Ontology: Mol. function=RNA-directed DNA polymerase activity; Biological process=RNA-dependent DNA replication
MVEKERFDHIEERMRAIEGGGDYAFADMAELCLVPNVVIPPKFKVPDFNKYKGTTCPKNHLKMYTNLELSRVHSWKNLMVAFIRQYQYNSNMAPDRIQLENMCKNEHKSFKEYAQ

SEQ ID NO: 147913 - protein, 264 aa, Glycine max
  Coding DNA Sequence Number=SeqID_31135
MQSQFQSQMQSQGLALPPKPEVGPSTARVSIKDSCVDPSGNGPDMGDSDKYGLYIKENSPRLVALGRVYEGSTTVHNIPLLHDEVKVGVEEVKDTDAPIHVPTEEGAMRPAKPADRPNHEVMWDTTMFGVFNEDFPLYIKYEDLSKIAHGGQCLGISVIQLWIPHMTELSMRAGNSDVYGFLEPHALKGLDDTPQPKSKAGARWIVVKVSDLNNASTQKGSTDCKYYMMHWMSTIIIGTFKNNWEEYFNDARPLEPKRLKELCI

SEQ ID NO: 147914 - protein, 217 aa, Glycine max
  Coding DNA Sequence Number=SeqID_31136
  Gene Ontology: Mol. function=phosphotransferase activity, alcohol group as acceptor; Cellular component=cytoplasm; Biological process =carbohydrate phosphorylation
  Homolog annotation: Hit_ID=Q1SWC0; Match level="QueryCoverage=77%, HitCoverage=35%, E-value=8e-59, Identity=69%"; Hit description =Mevalonate and galactokinase
MKEGGSQKKKKQLAEDPGITRGRGRGSLRESAEEGEEEGKWRNKKRLAIFVMAKTKCAELIDFSPICTTDVQLPAGGTFVIAHSLAESQRVVTAAKNYNNRVFECHLASIVLGIKLGMKPREAIVNIKTISDVEGLCLSFASIHKSSDPVLAIKEEPCTAEEIEKITDEKLTSIFSNNTIYLNAIKASEHYKLHQRATRVYSEAERVLAFKDIVSTN

SEQ ID NO: 147915 - protein, 87 aa, Glycine max
  Coding DNA Sequence Number=SeqID_31137
MSDFLAQSKRQVIEVNLQLPRNLGLQTGWSRPVSTKQFLAVGVFGGAQKRGIVFDAFHQIHLLLHCVCSSSMQKIPHTHARCMAQIL

SEQ ID NO: 147916 - protein, 337 aa, Glycine max
  Coding DNA Sequence Number=SeqID_31138
  Homolog annotation: Hit_ID=Q2HV71; Match level="QueryCoverage=43%, HitCoverage=18%, E-value=1e-50, Identity=67%"; Hit description =Protease-associated PA; Proteinase inhibitor I9, subtilisin propeptide
MYGFSVVLSSEELKAIKNTHGFVVAYLDRNVTIDTTDTSEFLSLDSSSGLWHASNFREDVIVGVIDIGVWPKSEGFKDHGMTKKIPNKWKGSCKEVWDFNTSMCNFKLIGARYFNKGVIEANSKVKINMNSARDTLGHGTHTLSDVVVVMFLKNLMCSSKNSSSNDEVPVLVLPYAPPLARMEQEEQDQELELVDVIFKYEEEELEGRVYIYLGCNTDNKKWYISYGSVQVEDTSTWLFKENKGGYIPCGSLLVKDFTRLLEISRTDGCLGTGCRHGVVLVVSQLQIHYVVDGKDEVSLELQEEQHGRGKDETPTEDAQTRGSDEPRRQSRTPAAKM

SEQ ID NO: 147917 - protein, 188 aa, Glycine max
  Coding DNA Sequence Number=SeqID_31139
FFLLTKDDKEDLSNFEIVKRPMLEFQSENCNETLSSSSNSHHSQKEEKKSNHQQIIEECQQQICRITKADSESSTSKLKEEDDEEEQEQEDGFKTPTSLDHKIPLPLQCPPAPRKTQPSLKRKASYYNNHCNYCRHPLDLSKESKMTGVVASPRRVHESENESVRVRTRALEMSESEKESVRVRDGSK

SEQ ID NO: 147918 - protein, 172 aa, Glycine max
  Coding DNA Sequence Number=SeqID_31140
  Homolog annotation: Hit_ID=Q1T283; Match level="QueryCoverage=59%, HitCoverage=50%, E-value=1e-06, Identity=31%"; Hit description =Nucleic acid-binding, OB-fold
MLCWSRYKLVVKMEQNGEKANFHFWDAVCIKIFGKNADECRQELIASGDEIKVFPACVDQLLGKTWVVRFKHRIQMHQSSVLDFSEQEHHIQSVIFTLGLQDEQCLSNKSAAVGAASSSQQDYHPTSSEYDPGNAAFVTPAKRTSDQQGSSQFDSDNFTAYELSTNKHIKAE

SEQ ID NO: 147919 - protein, 298 aa, Glycine max
  Coding DNA Sequence Number=SeqID_31141
  Gene Ontology: Mol. function=glycine hydroxymethyltransferase activity; Cellular component=membrane fraction; Biological process =serine family amino acid metabolic process
  Homolog annotation: Hit_ID=Q8PPE3; Match level="QueryCoverage=53%, HitCoverage=38%, E-value=2e-79, Identity=90%"; Hit description =Serine hydroxymethyltransferase
  Pfam annotation: Domain name=SHMT; Domain location=1-133; Score= -55.7; E_value=3.1e-13; Accession=PF00464.10; Description=Serine hydroxymethyltransferase
SIVFPGIQGGPLMHVIAGKAVAFKEALEPGFKAYQQQVVKNAQAMANTLIARGYKIVSGGTQNHLMLVDMIGKDVSGKDAEAALGKAHITVNKNSVPNDPRSPFVTSGLRLGTPAVTTRGYVEQDCVDLANWIADVLDAPNDDAVIARVRDAVSAQCRKYPGRALTPALEQPRMDERHLKYLYTALAPGDGWRGGDDAAADGAGPVRSWHAGLGDGDAAVGPGRHCRLPGLVVAQCGFSDAGACRAARAPSLVVDAAGGRSRRLAPAGAGAVVGRHRARRRHHPVAAGPVDAGAGCDA

SEQ ID NO: 147920 - protein, 131 aa, Glycine max
  Coding DNA Sequence Number=SeqID_31142
MIVHAHTSYNILLDRPSLNALGIVVSTSHLTMKFSPDVENIITVHADQRTTKECYMTSHRLHPYTREKALEVIHYVETRMKTEEVEELELNSRTNDDNQVKPVKETSTFQLRPKEEQVTYLGNQLLDDELY

SEQ ID NO: 147921 - protein, 118 aa, Glycine max
  Coding DNA Sequence Number=SeqID_31143
  Subcellular localization annotation: CTP_CleavageSite=44; ConfidenceScore=5.04e-01
MGIVPVTNGPDTNPYVEGFFAVSTGLLLCRSVFSNDSLPKSPVLASLKELGGRGGTCKRHSNTQLPKPFFGLVQKEGLYAVSERLPLTPLMVTHLNWHCVMVTSHVCSTSNIGYWNVS

SEQ ID NO: 147922 - protein, 310 aa, Glycine max
  Coding DNA Sequence Number=SeqID_31144
ASEPVDTQRLTSSSASLSSRDGESDDLRRYLMVIHTFCQPEASEPIDTQRLTSSAAPLSSKDGESDDMRRYLMVIRTFCEPEASEPIDTQRLTSSSASLSSRDGEFVDMQRYLMVICPLFQPEASEPTDTLRLTSSSAPLSSRDEASEPVDTQRLTSSSAPFSSRDSESDYMWRYLMVIRTFGQPEASEPVDTQRLTSSSASLSSRDDESDDMRRYLMVIRTFCLPEASEPIHTQRLTSSSAPLSSRDGESDDIQRYLMVIRTFCHLEASEPVGTQRLTSSSAPLSSKDGESDDMRRYLMVIRTFCQPEP

SEQ ID NO: 147923 - protein, 138 aa, Glycine max
  Coding DNA Sequence Number=SeqID_31145
MPWCTLETTYMLLDYVEIVPRKITLKLAYINGHPFVLCDVEISNLEYTGLSKWKRVIKKTSSWWMLQDMDISFLLEGAGGNIMATYFAAILLMLSTHKLVTETDYIRDYGIKDRDRVCAIDLFKSQLYLPLVLYSDYW

SEQ ID NO: 147924 - protein, 387 aa, Glycine max
  Coding DNA Sequence Number=SeqID_31146
  Gene Ontology: Mol. function=malate dehydrogenase (acceptor) activity; Cellular component=membrane; Biological process =tricarboxylic acid cycle
  Homolog annotation: Hit_ID=Q3R0R6; Match level="QueryCoverage=99%, HitCoverage=68%, E-value=1e-158, Identity=72%"; Hit description =Malate:quinone-oxidoreductase precursor
  Pfam annotation: Domain name=Mqo; Domain location=1-349; Score=612.4; E_value=4e-181; Accession=PF06039.5; Description=Malate:quinone oxidoreductase (Mqo)
MQYSEDPAQIKQWAPLLMEGRDPKQKVAATWMPLGTDVNFGVITRQLTTGLQRSPNFSLHLNHEVSALRQNADKSWNVTVKDLKAGTESTTHARFVFIGAGGAALKLLQMSGIPESKDYAGFPVGGQFLAFQGQDVTSRHGVKAYGMAETGSPPMSVPHLDARKLDGKPVVLFGPFALYSTKFLKHGSWWDLYSSVTHNNVGPMLEVGKDNLDLVQYLMGQARLNDADRQAELVKYFPNAKPGDWKLVTAGQRVQIIKRDPLKGPVLQFGTEIVTDKDHTIAALLGASPGASTSPPIMLDLMAKAFPDQMKAGWETRLREIVPSYGRKLNDSAALVNEIRTLTSQTLHLPYLEVPVDANAAAPAPAAIPAPAPVKEKRNANEELQAL

SEQ ID NO: 147925 - protein, 122 aa, Glycine max
  Coding DNA Sequence Number=SeqID_31147
MFKGETGQKHENGVYLAKWGGNNLACLGELGGNLLPHFVEKWLLGLPQCFRKILETLGKPFPLNIGGSKDTKEENQVVAMCPSRASEGEAHGCAFQRRKDVRSRHQRLFVGNVGKTEGNRSK

SEQ ID NO: 147926 - protein, 176 aa, Glycine max
  Coding DNA Sequence Number=SeqID_31148
MRNKSNQDMQDKWWKDLRRLCGAECEDKWFDKLSEWKLGDGGCGELDVEFVWRRGCFVWEESQVNQLKALLVREPSQENEEATEEWVFGGQILVADLEAIYSTEGYILFVWRLFLNRLPTRDSLKRKNINLDMDDNSCVFCSQVEESADHAFMNCRKIYPLWKKMLCLAKMLFCPT

SEQ ID NO: 147927 - protein, 862 aa, Glycine max
  Coding DNA Sequence Number=SeqID_31149
  Gene Ontology: Mol. function=siderophore-iron transporter activity; Cellular component=outer membrane; Biological process=siderophore transport
  Homolog annotation: Hit_ID=Q8PQZ3; Match level="QueryCoverage=76%, HitCoverage=93%, E-value=0.0, Identity=65%"; Hit description =Ferripyoverdine receptor
MHPCRIEVGQGLGEEVGLLLVVALQADLVAWLQQCVQQLAHIGGGDLASPGPRRGTFQAGLAAAFQRIPARVHRPASDWCRCNYGIIMKRGATCSAAKRRARTKAGPFRIAVCRPTVSAHRFAGGSELPAQAGRHEARFAVVVVVQIRPVGLVQCVAHAQRCGPAVADAVVGIELHQHVGRLVHRDRAAQRVGDVVALHLALPLQAAANAQAFQRAAQLQLGVELQQILRRIGVQQVGSRSGDLDVGVAGIDRPARQDLAVDVHLPAARLGAVDADVGGGAIAERTFRHAHVAHRVVVLLGLEHGGIGGQAAIQPLGLDACFQVRALHRCQQVLVAVLEVLRVEDLGVAGIGRHVRGDVVDQAHVRGDFIAHLVRTAGAGVGACGVVRAAEGFPAAQARACNQRQRIGQAQAGGQVDTTLRGPGHAARAGAAVGHFGDVAVPAVHIGDVVAAFAATARPVGRVVQREGIRRAFQVRPLRANGEVVLAAEQVEAAGQVGIDIATGVLGIAGGRAQEDARAGHRVRVAGAVQAHVLHVATGVGGVDLQQPVVTEALFQVGERGVALALPVAPLRRQGDRGAVGDVAFQHRHAGHLVLVVTVVIQATIGIGGDHAAAETAVIGQRRGHVRLHAPIVPAAGADRERGIELLARALAQQVDRGRRHAGATEQAVGAADHFDAVVEGGVVFLVGRTAVGGNAIDLEVGDGKATRVVQRALGVIEGHADAGDVAHHVVDAEQRFVLQALEADRRGRLRGFLQRDRQAGGAGWRSGLLGTDADPVQGLGIGGAIGGGERAGRGQQGQRRKQGSRQQRAAGQAVTQGQGHGGLEAWKRGRAAAVVQYPGRRLRAHQVHLGGGGHCVGCKCK

SEQ ID NO: 147928 - protein, 154 aa, Glycine max
  Coding DNA Sequence Number=SeqID_31150
MARIKIPHQGDVGKMMMKKGFKKNTSDKSDYKIKLPPKPPKRKDQLEPFYPKMTKDQNLKGKEGLDEEFPISSSSKPTSSVKYKKKDAKVVDLSSSQGPSNLEDDKVDSNNNDPSNPIVEQEVQPEVAHPEKEELLNVDDLAVIIPKLLVNKVL

SEQ ID NO: 147929 - protein, 37 aa, Glycine max
  Coding DNA Sequence Number=SeqID_31151
MVVMRITRMKRNFLWGGNEDSWFDKKLGVESELGEEY

SEQ ID NO: 147930 - protein, 497 aa, Glycine max
  Coding DNA Sequence Number=SeqID_31152
  Gene Ontology: Mol. function=carboxy-lyase activity; Biological process=sodium ion transport
  Homolog annotation: Hit_ID=Q4UZ70; Match level="QueryCoverage=75%, HitCoverage=68%, E-value=0.0, Identity=91%"; Hit description=Alpha subunit of malonate decarboxylase
EATAFGGGIVIAQVNEIVDTLPRVDIPADWVNFVVQAPKPNHIEPLFTRDPAQISEIQVLMAMMAIKGIYAEYGVNRLNHGIGFDTAAIELLLPTYAESLGLKEKICQHWALNPHPALIPAIESGFVKSVHSFGSELGMEKYIAARGDVFFTGADGSMRSNRAFSQTAGLYACDMFIGSTLQVDLQGNSSTATRDRIAGFGGAPNMGSDARGRRHASDAWIKAGQQAARPGEIPRGRKLVVQMVETFREHMAPAFVDRLDAWDLAERAQMPLPPVMIYGDDVSHVLTEEGIANLLLCRTPEEREQAIRGVAGYTAVGLGRDRAMVENLRDRGVIRRPDDLGISVRDASRDLLAARSVKDLVRWSGGLYDPPKRFRNWTHCGAVSARCGAGRRTGLGQPGNPAGAGGAGRRDDGAHHHRRTGLRQRVASGDQRLRRASSAARCTHLDQRCGCNSGGGQPATGPGRGNPAQWRCTMNRTQRHSYYEADARERIAGLIDA

SEQ ID NO: 147931 - protein, 897 aa, Glycine max
  Coding DNA Sequence Number=SeqID_31153
  Gene Ontology: Mol. function=RNA-directed DNA polymerase activity; Cellular component=chromatin; Biological process=chromatin assembly or disassembly
  Pfam annotation: Domain name=RVP; Domain location=357-465; Score= -13.0; E_value=0.074; Accession=PF00077.10; Description=Retroviral aspartyl protease
  Pfam annotation: Domain name=RVP_2; Domain location=341-479; Score= -33.1; E_value=0.00038; Accession=PF08284.2; Description=Retroviral aspartyl protease
  Pfam module annotation: Pfam domain module=RVP::RVP_2::RVT _1::Retrotrans_gag; Domain location=357-465::341-479::599-768::103-193
MASHDKSTLDRIEDAIAKLVASQIQVTDKLEDLLLRLSNLEHTATTHSPSSSSANPHHTNSIITPPKMKLDVPCFDGSDPSGWIFKISQFFAYHSTPESERLTIASFYMEGPALAWFQWLSRNHQLTTWASFLEAIEARFSHSPYEDPTGILFKLTQKGTVSQYLQQFETLANRIVDLSPSLLLSCFVSGLDPDIRREVQALQPLTLVHAAGLARLQKEKLADNRSAFCGRATFTTSPPPPQPQPPPTLLPSTTSTHPPPLPLLPTPPKPPPLPLKRLTPAEMALRREQGLCFNCDDKFTKGHRCASRFSLLIADEDNPPEPSDPFIPNPNPSPENPNPPNSNQPEQPHAQISFCALSGHSPPETLRLLGQVSHHAVVVLVDGGSTHNFVQNRLVRHLGLTPQPTFPLHVLIGNGNEIECHTICPNTMIQIQGYTFTTDLRVLPICGADIVLGVHWLKSLGPILTDYTNLTMKFNHQGALIELWGDLVQDLQVVSPPQLRRMIQTDCVSDFFHIQVCSSIHTSPNTPPEIQSLLHKFESLFQPPSSLPPSRPTNHCIHLTSASSHVNVRPYRYPYYQKYEIEAQVSAMFQTGIIRPSNNPFSSLVLLVKKRDGSWRFCVDYRALNALTIKDRFPIPTIDELLDELGGATWFSKLDLMQGYHQILMNEADINKMAFRTHQGHYEFLVMPFGLCNAPSTFQATMNNTFEPYLRKFVIIFFDDILIYSKSFMEHLNHLNTAFEVLRDNKFFLKLSKCSFATQQVEYLGHIVSPRGVEPMAAKIEAVHQWPTPNSVRALRGFLGLSGFYGQFIRGYLSIAAPLTLLLTKDAFQWNEAADKAFNQLKEALCRAPVLHLPDFSIPFVVETDASDEGMGAILSQHNHPIAFFSQQFSPKLLRAS

SEQ ID NO: 147932 - protein, 470 aa, Glycine max
  Coding DNA Sequence Number=SeqID_31154
  Gene Ontology: Mol. function=zinc ion binding; Cellular component =nucleus; Biological process=regulation of transcription
  Homolog annotation: Hit_ID=Q39540; Match level="QueryCoverage=80%, HitCoverage=99%, E-value=1e-110, Identity=55%"; Hit description=AOBP
  Pfam annotation: Domain name=zf-Dof; Domain location=123-185; Score =141.8; E_value=1.8e-39; Accession=PF02701.6; Description=Dof domain, zinc finger
MQENKDPAIKLFGQKIAFPGEADSQAIAGGETDWPPAMDVDKDEEDFGIGNPDKDEKDKDPRAEKVSEKTKEADPPPDAADSKTSEGIQNPNTPSIDEESAKSKNDKSENDQQENNNNKTLKKPDKILPCPRCNSMDTKFCYYNNYNVNQPRYFCKACQRYWTAGGTMRNVPVGAGRRKNKNSASHYRHITISEALQAARIDAPNGTHLLKQNGRVLSFGLDPPICDSMASILNLTAEKKGTLNNNTRNGFHTIEDQRNKDNHNNNNNNGDDCSSASSITVSNEESGKSTSQESIMVPNSNGFIHQVPCISTLPWPYPFPSAAPAMCPPGFPMSFYPAAFWNIPWFPSQHSHHSAPTPRSPSSGPNSPTLGKHSRVVAEKQDHLQEESPSRQRNGSVLVPKTLRIDDPSEAAKSSIWATLGIKNECVTGGGMFKGFQSKKDEKDHVVEASPVLRANPAALSRSLNFHENS

SEQ ID NO: 147933 - protein, 101 aa, Glycine max
  Coding DNA Sequence Number=SeqID_31155
MEIDKSKGFRKDWKLEKVKFREEMKIEKSPYRPRVDLEDIEEWFHTHDGEYPIIHKEKLPCGPVTPTLLDIAAITGLKPLGKTLALGLFEDTIQRSEIKID

SEQ ID NO: 147934 - protein, 65 aa, Glycine max
  Coding DNA Sequence Number=SeqID_31156
MSHFRVSDIVATRRVVTSLTMTALGILEDLGGTMNAHLKDSYHLEDKGGGVGGFDYLYGDVRVIR

SEQ ID NO: 147935 - protein, 168 aa, Glycine max
  Coding DNA Sequence Number=SeqID_31157
  Gene Ontology: Mol. function=nucleotide binding; Cellular component =intracellular; Biological process=small GTPase mediated signal transduction
  Homolog annotation: Hit_ID=Q9LH50; Match level="QueryCoverage=43%, HitCoverage=32%, E-value=3e-31, Identity=89%"; Hit description=GTP -binding protein-like
MKTRRIKGPFLAGGVPYLGLDGLLVDDERFGLKLDANGGFRIDVELVLGEAREELGLPHGGVSDQHHLEHVVDLVVVFAVQEGGGAAAVVVVVVLMNHRLLGFFCFFVSLVFLMIEAGLNPSSFGERKRKITTVVLVGLTKNRGGVRRKEKGGGGLGWELGWTPSFFR

SEQ ID NO: 147936 - protein, 335 aa, Glycine max
  Coding DNA Sequence Number=SeqID_31158
  Gene Ontology: Mol. function=transferase activity, transferring glycosyl groups; Biological process=sucrose metabolic process
  Homolog annotation: Hit_ID=Q5EEP9; Match level="QueryCoverage=86%, HitCoverage=36%, E-value=1e-54, Identity=38%"; Hit description =Sucrose-phosphate synthase 1
  Subcellular localization annotation: CTP_CleavageSite=35; ConfidenceScore=5.36e-01
MSTSASGSTTPSSPLTPTSPPGSPCHHLPLQHPLRGATIPRGGDFVLNPTHYFVQEVIGIDEINLYRSWVWESSGEEHQAGEHVLADSEPRSPKEADMSNDLSKGEKSNLVSDLSTHGGVGDCNRAKLPRISSADAMETWANSQKGKKLYIVLIRIHSLIRGEHMELGRDSDTGGQVKYVVELARALGSMPGVYRVDLLNRQVSTPDIGGGHAVWPIAIQGHYADVGDFAALLSGASNVPMLFTSHSLGQDKLEQLLKQGQLLKDEINTTYKIMHRIEAEELALNGSEIVFTSTIQEIEGQWRLYDGFDPVSEHKLQARIRRNMSCYGRFMPRMA

SEQ ID NO: 147937 - protein, 77 aa, Glycine max
  Coding DNA Sequence Number=SeqID_31159
MDCDTTSSLLETIKAIFESAGKDRAEGTVDARANFFQKRSRQDRRLGNKFNLSSIKLRGRAHEAKLTEDHNRRMLIE

SEQ ID NO: 147938 - protein, 128 aa, Glycine max
  Coding DNA Sequence Number=SeqID_31160
  Gene Ontology: Mol. function=transferase activity, transferring glycosyl groups; Biological process=pyridine nucleotide biosynthetic process
  Homolog annotation: Hit_ID=Q6XQM5; Match level="QueryCoverage=48%, HitCoverage=11%, E-value=3e-25, Identity=84%"; Hit description =Nicotinate phosphoribosyltransferase-like protein
MATTLYKVSLAPGSGCIEVNLQLCLCSERAFSNNGFTPSVAPLQCMQLMTVNFYFSIVTCLFFFEDIKKDTLPALRDIREQCINQLEQMRPDHMRRLNPTPYKVSVSAKLYDFIHFLWLNEAPVGELQ

SEQ ID NO: 147939 - protein, 81 aa, Glycine max
  Coding DNA Sequence Number=SeqID_31161
MLEVQKIQPRRTPFTSMMHLQDHEEVNDFHARLFEVIRHICFDFALNYLSGTIPKEWGSTKLTNMEIPKEFIYDLKLIEVQ

SEQ ID NO: 147940 - protein, 106 aa, Glycine max
  Coding DNA Sequence Number=SeqID_31162
MSLRRCATHANLENDDYDDHPIWDDDDSNIDDYPFDVPTQLYHCWEVIFEVDMPSFDIGSELICDIDDAFDDVNENPDDHCWEVGFKINMLVLDVDIAMDVNEEHI

SEQ ID NO: 147941 - protein, 89 aa, Glycine max
  Coding DNA Sequence Number=SeqID_31163
  Homolog annotation: Hit_ID=Q1T098; Match level="QueryCoverage=44%, HitCoverage=6%, E-value=2e-12, Identity=82%"; Hit description =Forkhead-associated
  Subcellular localization annotation: CTP_CleavageSite=45; ConfidenceScore=5.11e-01
MMLFFGLPLKCLPHRTCFLLQNPNVLICTPNFTIGSSRSCNFVLKDQTISANLCKIKHTQVHANLCKFNSNPPLYSSSNSNVNDNNYNN

SEQ ID NO: 147942 - protein, 115 aa, Glycine max
  Coding DNA Sequence Number=SeqID_31164
  Gene Ontology: Mol. function=DNA binding; Cellular component=nucleus; Biological process=regulation of transcription, DNA-dependent
  Homolog annotation: Hit_ID=Q8GT89; Match level="QueryCoverage=63%, HitCoverage=7%, E-value=5e-23, Identity=80%"; Hit description =Hypothetical transcription factor
MLKLILMQSLCCLVRGVRKTLNSELWHACAGPLVSLPQVGSLVFYFPQGHSEQLLLEEQQHHKFQTTPIFHISCCVKFKMSHFMQTRRQEVSAVGVVLSHLNYRDADCNQAFNFS

SEQ ID NO: 147943 - protein, 99 aa, Glycine max
  Coding DNA Sequence Number=SeqID_31165
  Homolog annotation: Hit_ID=Q1T098; Match level="QueryCoverage=46%, HitCoverage=7%, E-value=3e-15, Identity=84%"; Hit description =Forkhead-associated
  Pfam annotation: Domain name=IBB; Domain location=1-70; Score=16.8; E_ value=5.4e-06; Accession=PF01749.10; Description=Importin beta binding domain
MDADEGRRRREDTMVEIEKNRREESLQKKRCEGLQSQQIPSSLHSIVIYLTQLLLSQSAQNPNVLICTPNFTIGSSRSCNFVLKDQTISANLCKIKHTQ

SEQ ID NO: 147944 - protein, 53 aa, Glycine max
  Coding DNA Sequence Number=SeqID_31166
MRDVNIRSIWRFCYVVSKIEEGRRKREVINTKGECSPFSKSSILLMWQFNSVE

SEQ ID NO: 147945 - protein, 219 aa, Glycine max
  Coding DNA Sequence Number=SeqID_31167
  Homolog annotation: Hit_ID=Q5PI23; Match level="QueryCoverage=48%, HitCoverage=63%, E-value=2e-40, Identity=73%"; Hit description =Hypothetical protein yciE
  Pfam annotation: Domain name=DUF892; Domain location=1-91; Score =44.0; E_value=2.6e-11; Accession=PF05974.3; Description=Protein of unknown function (DUF892)
  Pfam annotation: Domain name=DUF892; Domain location=114-219; Score =42.8; E_value=3.2e-11; Accession=PF05974.3; Description=Protein of unknown function (DUF892)
  Pfam module annotation: Pfam domain module=DUF892::DUF892; Domain location=1-91::114-219
MKCVAMEGLIEEANEVIEATEKNEIRDAALIAAAQKVEHYEIAAYGTLCTLAEQLGYKAAVKLLAETLEEEKDADMKLTDIAVGHVSSRRGDNVVCTGYTVGNMVERQCPVVMTDIENYHDWLRDAHAMEKQAESMLESMVKRIDSYPELCTRLEQHLFETRRQITVLDDIIARNNISRSVLKDSMSKIAAMGQSIGGMFPQDEVVKGVISGYVFEQFE

SEQ ID NO: 147946 - protein, 81 aa, Glycine max
  Coding DNA Sequence Number=SeqID_31168
  Subcellular localization annotation: CTP_CleavageSite=41; ConfidenceScore=5.07e-01
MVRAEINRPNSQKHVPSGVANCHNQPFGGRATQGSRVRLPREENARSCHQHLFEENIGKTGMSGLRTFIVKGSEVIFMHGE

SEQ ID NO: 147947 - protein, 195 aa, Glycine max
  Coding DNA Sequence Number=SeqID_31169
MGDQEETQEQTKADMSALKEQMASMMEAMLGMRQIMEKNVATAAAVSSAAEADPTLLATAHHPPPNAVGRERSTLGHNSNPHLGYNRVAYPYGLPPNYTPPVMHDDAGDVDFYPPIPVKGPTPNTLPQHNLTAQPIFLSTKGPPPAAEERRKLDLIEERLRVIEGFGDYPFVDMVDLCLVPDVIIPLKFQVPEFN

SEQ ID NO: 147948 - protein, 236 aa, Glycine max
  Coding DNA Sequence Number=SeqID_31170
  Homolog annotation: Hit_ID=Q2HRX8; Match level="QueryCoverage=57%, HitCoverage=18%, E-value=2e-20, Identity=39%"; Hit description=IMP dehydrogenase/GMP reductase
  Pfam annotation: Domain name=DUF1723; Domain location=9-50; Score =11.3; E_value=0.023; Accession=PF08330.1; Description=Protein of unknown function (DUF1723)
MAKFGRPAPEIEGLVAETGSFHLPVREVTITLDDVTLLLHLPILEAFHSFEQFHVDNIVDMLVELLESETYAWGAATLMHMYDNLNEASKSTARQLAGYITLLQHFPSIGSALAAEDYDKMRPRACRWTSGRALPVSTYRRRLDKLTLEVMCWIPYGDHRSFREFEVISLFFGHLRWGPLTVIHRPKRVVRQFGYIQTIPPHPTAHSTFVEEMDARWMQFDDYIALVGEICVAFGQ

SEQ ID NO: 147949 - protein, 117 aa, Glycine max
  Coding DNA Sequence Number=SeqID_31171
  Subcellular localization annotation: CTP_CleavageSite=45; ConfidenceScore=5.02e-01
MGEEVSAQLAQASQGFLKKFPDAPSKLITLQKPQMPFFNKMGEVVAAQLAQASSARPGELGCFHLKQENVQNLLDEPRFENFYLDPQFDKFTPYFCIFWLFSFRNLMELYGFDDDVC

SEQ ID NO: 147950 - protein, 32 aa, Glycine max
  Coding DNA Sequence Number=SeqID_31172
MAGHFGGIPLEVFGCILEANLISVSYFGLAIL

SEQ ID NO: 147951 - protein, 851 aa, Glycine max
  Coding DNA Sequence Number=SeqID_31173
  Gene Ontology: Mol. function=protein serine/threonine kinase activity; Cellular component=spliceosome; Biological process=protein amino acid phosphorylation
  Homolog annotation: Hit_ID=Q2QLI7; Match level="QueryCoverage=54%, HitCoverage=59%, E-value=1e-154, Identity=56%"; Hit description =Protein kinase domain containing protein, expressed
  Pfam annotation: Domain name=DUF1777; Domain location=239-436; Score=- 95.1; E_value=0.086; Accession=PF08648.2; Description=Protein of unknown function (DUF1777)
  Pfam annotation: Domain name=Pkinase; Domain location=587-775; Score=- 19.7; E_value=2.2e-07; Accession=PF00069.15; Description=Protein kinase domain
  Pfam annotation: Domain name=Pkinase_Tyr; Domain location=587-760; Score=-140.1; E_value=0.00071; Accession=PF07714.7; Description =Protein tyrosine kinase
  Pfam module annotation: Pfam domain module=DUF1777::Pkinase::Pkinase _Tyr; Domain location=239-436::587-775::587-760
ASCIVQGHFARETLLHAKDIETKTQCNVDDRFISPDGEDGACYQSHVGRGIHEDGMGNGLFDGKDGRASTDGMGNGLLDHKHGCFKGNEKLKGYCDDEDVEVDGGKVGYYKNSSSESGREKDRRSRYSHSRDRYRSRSRSTGHATDRSHSGSIVEEHARSKRKHSGEQGDDSYASRLKTDYDLDDERMMASRRESRDLVVDKRREHRTSYHTQEAWGRARSSDRDVDRDLKMEKEQERSRNREVNWVHRREKERERSCERHRRDVEKDRREREDDRDRRREKESDRIRETVFERDRRRDKEKDQSRDRTRGDERVRDQETAEHNDRSWKRDKIKEREKRDDIKRHKDRGNGMGKYLSHEDDYYDAHDRYRRRLKQEERECHQERKRKSSHVKVYNSMGSTLIDDANKLERGEDEQDDLDEKVTLQLPDQEEEDFNRVKEESRRRREAILEKYKKQHQQIELNTENEGKDRQAVEIPPSIPDALDGKSDGVDDVEVETLFSVRKSPAENGNVASDKISSAGGLGEGSPKSERSDDKFCDDIFGETPTGVQKSGKGEGLRIERGGLHDNWDDAEGYYSYHFGEVLYGRYEVIAAHGRGVFSAVVRAKDLKNSNGEPREVAIKIIRSNDTMYKAGMDELVILKKLVGADPDDKCHCVRFLSSFKYKNHLCLVFESLHMNLREVLKKFGRNIGLRLTAVRAYAKQLFIALKHLRNCVLGLPYDHPLDMWSVGCCLYELYTGKVLFPGFTNNDMLWLHMELKGIFPKKMLRKGAFIEQHFDQYLNFLATEEDPVTKKAIKRMIVNIKPKDIGTIISGSPGEDPKIQEVDSLTGIESPIHHWQGNNVADFDSHNDVH

SEQ ID NO: 147952 - protein, 60 aa, Glycine max
  Coding DNA Sequence Number=SeqID_31174
MDTSEPYTGAMKGTMHKPQVNLGADQKFSPNRFPATRGTVHEPQANLGADQKFLPVDVFK

SEQ ID NO: 147953 - protein, 119 aa, Glycine max
  Coding DNA Sequence Number=SeqID_31175
MARRQLTKAYNDDGVQCDACRRYVTRHVHELHTPGPFVGLRAECFELAAHVDDVVASSRVVLFTAKRGYLKGKTKGNLQDKSSDHMKLLGESDGVATGWSENASEMLKNTTRKRKQMKK

SEQ ID NO: 147954 - protein, 130 aa, Glycine max
  Coding DNA Sequence Number=SeqID_31176
MKIEPGLEDEANPSMFNHNAFLHHYHCLAPSTSHQSRVEPPRLRHRHRHRSRKSDEEIECGCEIAPAVPFPTPPRNSGTNFRVIDDDDVEEGEIFEDDDDVAKQHAQSEAEPGEIDPTGDRGVRSDNKNL

SEQ ID NO: 147955 - protein, 83 aa, Glycine max
  Coding DNA Sequence Number=SeqID_31177
MTEDIVVFEMCVDYHVGRLRVPSDSQMTTWVFHLPPDSWVKISRCCLCTDNHLGISSCHLTLGSGSTDVVFVRITTWVFPPTT

SEQ ID NO: 147956 - protein, 521 aa, Glycine max
  Coding DNA Sequence Number=SeqID_31178
  Homolog annotation: Hit_ID=UPI0000E478AA; Match level="QueryCoverage =46%, HitCoverage=28%, E-value=2e-27, Identity=32%"; Hit description =PREDICTED: similar to cortical granule protein with LDL-receptor -like repeats
LHVLAFRGLHVLDFRGLHVLAFRGLAACPRLQKVSRPPPSEGYTSSPSESCKSSPSEGYTSSPSEGCTSSPSESYTSLPPKGCTSSTFRGLHVLAFRGLHVLASRGLYVLAFRGLHVLAFRGLYVLAFGGLHVLDFRRLRVLAFRGLYILAFRGLHVLASRGLYVLAFRGLHFLTFSGLHVLNFRGLDVLTFRGLYVLAFRGLHILTSKGLHVLAFKGLHVLASRGLYVHSFRGYILTFKGLHVFAFRGLHVLASRELKFLGHPPNIGGPTVRAQPKEEAGITPTRHPVDSKKSNRVLGARHHNSPGTASNGQQTHRHHLQSPPQLIYKGWSVAYDPWPTKSKAKVQWHAETPYTVIHTHTFAFPTRESSGMQRHPMVIHPPTFATPTRESGGMRRHLTVIRTSSFEDPNQVVGGNTQVVIRTKTTSVDPDPRVRWQEEIPKWLSVQRQHLLILTQESGGRKLPEEAWARLGMLGNNLLPILAINKGKEADRGAPVTLLRRFREQFREDFHPFFMRSSVFN

SEQ ID NO: 147957 - protein, 65 aa, Glycine max
  Coding DNA Sequence Number=SeqID_31179
MPRQNDLMGYSFAGKNPKRFDMPSGCSIDGLKDVIKQVAPQSGHSEYSKKLIKFEIIELKLTMTC

SEQ ID NO: 147958 - protein, 118 aa, Glycine max
  Coding DNA Sequence Number=SeqID_31180
  Homolog annotation: Hit_ID=Q2R1R7; Match level="QueryCoverage=64%, HitCoverage=4%, E-value=1e-09, Identity=40%"; Hit description=AT hook motif-containing protein, putative
MHDYSFVPQHTNDPLHHTNKGSSDNSTKNEGYVDLRDHSETCGYSQAAMWYQEKTRKNIKQANPKHSLCCSMGRIQLSFLKNPLMLLQKLLCDEKSHESKNYQQNMRAYNMMFAFSSP

SEQ ID NO: 147959 - protein, 72 aa, Glycine max
  Coding DNA Sequence Number=SeqID_31181
MRLFSNKFKMRNRKIKFTTIAAIAFSVISSLLLLRCSLPPVANIILPSLQLQCGYGFSDKHEPLFVGAEGQQ

SEQ ID NO: 147960 - protein, 234 aa, Glycine max
  Coding DNA Sequence Number=SeqID_31182
MGSKDVQVIRQVGCLKGRREGCVRSTSGGSRRMVYMERNKKSIQTCEVFMMWGIMQLLRKENVDEGNELEKSGHVHSRSTNSCFTFLLAFKLDLLLHTHGVAATAPPPSLPSSPATPPPSPPIRLAVSTRPHPPSHKNRLCHNRTKLHTLCLELTATPAYGKILAAFRLRVRLPAVESAATLRFDLCVNVSDLARPGLPIQPVRPLCECLMLRGTEVSRGSTGLTFNPNKHLKE

SEQ ID NO: 147961 - protein, 144 aa, Glycine max
  Coding DNA Sequence Number=SeqID_31183
MTSPLPWPSIRGIGCGVWCGCDKDDFCDSGGGDELTRRVVWGEKEVEWRGRKAEMEEEQLRQLAKEEDQTVKSTKTDRLFIHSERAEERERESGVLGIEGVNRGNEKTAHAFNYLKKIKFSLKQRRFFSSERTDHHGYEGEDQA

SEQ ID NO: 147962 - protein, 116 aa, Glycine max
  Coding DNA Sequence Number=SeqID_31184
MVLFLCKWKKSSALNEKMRRKTHGTSSQLEKENRDKKNKQREKYNGDRVVTATSEYLVILRDLDSVNLISNENMWITDSGATLHVIARNEFFTSYTPSDGYLQTNIGMTLLLRESN

SEQ ID NO: 147963 - protein, 160 aa, Glycine max
  Coding DNA Sequence Number=SeqID_31185
MAILGYLLILVKVITLSITYWAMKAHVSKLWKIVDNVNESAIGRNTIECVFCDEYVKVIIDLVRDSNVPSPFLAIQHSRLQAKIVGFMDNTPWWELENDHRLVEYNDTRHYQTEVSVPLIPRCHTLISSGDHCLLACDFRLITSKCLTPIVVESVKFRDV

SEQ ID NO: 147964 - protein, 86 aa, Glycine max
  Coding DNA Sequence Number=SeqID_31186
MNDDDDDNEVTSQRDARRSRIKAHAMCGHEDEVDYVGCSIISLLLCEAIVPVLERRSRPQSNKRPHSGIWGMIAWHDRPMGFGVES

SEQ ID NO: 147965 - protein, 346 aa, Glycine max
  Coding DNA Sequence Number=SeqID_31187
MERLTVYFIDMLQGLLEGFEGVHIHRDDHHHHHQNDTLTTFQLLHDMIQSNIVNIQCEEEVQDDALEHRDGEGVADKDEDEVEDDVLKFDAHKHMEPLLAKNPPNLASDCFSSNLISAFQLHVPQPNQDPAFSFSGVQRLSPVLVEEPHFTWAPRINIEMILMDEKAHKIVAQIKNVDPGKWNDVVKVEMKYDFTLFDDVFTSSANPDYLIDVIGELLDVLQWSLDGKPKKLVFIMKDKCGTIVNCTLWEDFTFMLKDYLDKHENGPEGEFDPKDIPEAIDRILGKKFAFRFKGMLNNTQYPVSQISEDEDLIMLLLKRLPTYELVEIEPEMLDLSMKQRDDISYT

SEQ ID NO: 147966 - protein, 101 aa, Glycine max
  Coding DNA Sequence Number=SeqID_31188
  Homolog annotation: Hit_ID=P93081; Match level="QueryCoverage=44%, HitCoverage=7%, E-value=3e-13, Identity=91%"; Hit description=3 -hydroxy-3-methylglutaryl coenzyme A reductase
MKKYHIVSSKGAAIVGNKPPREKTVLMPTQWLGRTSKEKYTGKKGRIQKGTGNIYPAVMADIKDNSPAKTDPTTMVAKSLEFDHGDSLLAPFTPCKFKQAN

SEQ ID NO: 147967 - protein, 76 aa, Glycine max
  Coding DNA Sequence Number=SeqID_31189
  Subcellular localization annotation: CTP_CleavageSite=32; ConfidenceScore=5.03e-01
MMTMSVVVMLVMMVNDGSVRSDGGANVVVGVCTMKRSKETPKLKFVRLASCWSLSGEEVEEWKTHGSSKLGSKEAK

SEQ ID NO: 147968 - protein, 114 aa, Glycine max
  Coding DNA Sequence Number=SeqID_31190
MKVAIIKVVLGSTMNHVEGCWIGEEFATSEGGGGGVQSSSRFSIGMHNFLMVLLLGLRTSSTVCFTLGHLGIGASKVGNFSFLDVGASIGFSFVTPIDLLSYITLHVGENELQE

SEQ ID NO: 147969 - protein, 135 aa, Glycine max
  Coding DNA Sequence Number=SeqID_31191
MHRCHPTRVLPTVIQLKSVKPLCSGSSSGSRLVHLFDGLCEVWKLTYTINIFSKCHGAVVTKLSFDSDVGDEDANSKYFEEPLSATESSRTMLRETHTFLPGNGCLPVLETGLEEVTLSEAVLRADEGRHKGDSL

SEQ ID NO: 147970 - protein, 77 aa, Glycine max
  Coding DNA Sequence Number=SeqID_31192
RCEDELVIKLLGKKIGCGVMKDKLNHSWCLSRGFDTSLEDWKLFEELEHRASAPMHAQCEKPSWKPVTCLLSVCLEA

SEQ ID NO: 147971 - protein, 83 aa, Glycine max
  Coding DNA Sequence Number=SeqID_31193
MSGFTRNSPQISASPHQLDLAPYASEPYNAQWNAPGLLRDKHTLRSSRILGEMEVDEPWLGLWLPLNYQGVFVIGSAVDRLCG

SEQ ID NO: 147972 - protein, 98 aa, Glycine max
  Coding DNA Sequence Number=SeqID_31194
MEEDSSQAIPSNHINHIIKATKPIKSTSRPLEDEAKDDEVVTLGEKNVATLKLNPQSIMEKACTCTNEEDTQKRKKKRKKKKKAKKGSDAILPPKGIE

SEQ ID NO: 147973 - protein, 1113 aa, Glycine max
  Coding DNA Sequence Number=SeqID_31195
  Gene Ontology: Mol. function=DNA binding; Cellular component=beta -galactosidase complex; Biological process=DNA integration
  Homolog annotation: Hit_ID=Q1SS72; Match level="QueryCoverage=72%, HitCoverage=90%, E-value=0.0, Identity=48%"; Hit description =Integrase, catalytic region
  Pfam annotation: Domain name=HMG-CoA_red; Domain location=862-1113; Score=81.6; E_value=2.7e-28; Accession=PF00368.9; Description =Hydroxymethylglutaryl-coenzyme A reductase
  Pfam annotation: Domain name=zf-CCHC; Domain location=172-189; Score =13.8; E_value=0.0052; Accession=PF00098.13; Description=Zinc knuckle
  Pfam module annotation: Pfam domain module=HMG-CoA_red::RVT_2::zf -CCHC; Domain location=862-1113::324-580::172-189
VRAGDLLRVSELQQEASSIKQGSLSVMEYFTKLRVIWDEIENFRPDPICTCTVKCTCLVLNTIAQRKQEDRVMQFLRGLNEQYGNIRSHVLLMDPIPTIPKIFSYVAQQERQLGNNSLSSFNPEPKEISSINVVRSVCEFSGRTGHNESVCYKKHGLPPNYDGKGKGYGTRKTCTYCGKLGHTIDVCYKKHGYPPGFKFNNGKAIANSVVATEGKATDDQILSQESQEQVRFSSEQYKALLALIQQPSAGTSASIKPQVASISSCTNNDPTADSTLTKVKYPLHSVLSYSRLSHSHKHFVMSITAITEPRTYAEASSHDCWIKAMKAELDALQQNHTWILTPLPPHKKAIGCRWVYKVKHNADGSIERYKARLVAKGYSQQEGLDFLDTFSPVAKLTTVRMLLALAALRNWHLRQLDVNNAFLHGDLHEEVYMKPPPGLVMDDPNLVCRLQRSLYGLKQASRQWFTRLSSFLLSQGFRQSSADHSLFLYSHTDNTITAVLVYVDDIILAGDNLKFIIHFTKLLDQTFSIKDLGTLKFFLGLEVARSSHGIHLCQRKYTLDILSDSGMLGSRPVSTPMDYSTKLSASLGTPLSKTAASSYRRLIGRLIYLTNTQPDIAHAVQQLSQYMANPTSTHSQATYRVLRYLKSSPGSGMFFAAHGDLTLKAFSDSDWAGCRDTRRSITGFSVYLGESLISWRSKKQSTVSRSSSEAEYRVLASTTCELQWLGYLLHDFRVPFLQPATLFCDNQSAIQIASNPVFHERTKHIEIDCHIVRDKVNTGLLKLLPVSSSMQLADIFTKPLTPAIFQGHAVFGHFARDLRLSFSLYGTIPLLTGGTLPLPLPRPPEPSISTTTTPTRRGGTPPLPLRKPLMRSLSLCTSPTPSSSCSSSSSQQTIKSNSERDNEKIQGWFSRQSREEEVKPVSLLLVNWNSYASTQTSEDSSTFPFDIKSAIRSANDIVSDTFNVSSRFARLQGIQYAIAGKNAYLRFTCSTSDAMGMNMVSNGVQNKPAAVNWIEGRGKSVVCEAIIKEVVQVLKTNVSALVELNMLKNLVGSTIAGALGGFNAHASNIVFAIFIATGQDPAQNFESSHCITMMEAINDGRDLHILVTMPSIE

SEQ ID NO: 147974 - protein, 86 aa, Glycine max
  Coding DNA Sequence Number=SeqID_31196
MAGGGVAYTLKVSETMSLADLMADLISKGKVDESSERERERIRGFRRGSGGVPPLLVGVVVVLMDGSGGLGRGSGRVPPVNKGIVP

SEQ ID NO: 147975 - protein, 333 aa, Glycine max
  Coding DNA Sequence Number=SeqID_31197
  Gene Ontology: Mol. function=RNA-directed DNA polymerase activity; Cellular component=mitochondrion; Biological process=RNA-dependent DNA replication
MMKWGVKGQVLANFVVELTQAPLQQIESSPCVLLVNGAVNKVGSGAGIVLEGPDGVVVEQSLKFNFSLTHNQAKDPQLAKYLEKIKELAQLFGRFEPDHLLRANNDKDDILSKLGSSKKHGLPVDKMEGAKCIKEATRYVPIRGKLYHRGLSQPLLRCLALTQATVIVTEVHEGVEATDKVILNGLKTHFQQARESWVDEVHLVLWSYCTTLHSSIHEVPFTLVYGTNAMILIEVVKPMFQVDTFEEERFDVDRLVDLDTIGEMQGLNKIRLPTSYLPNGLALIELAKQLAYKLWALTEQRRLAQTKVSILLGSYPARVKFRGADLVEMPKSD

SEQ ID NO: 147976 - protein, 285 aa, Glycine max
  Coding DNA Sequence Number=SeqID_31198
  Gene Ontology: Mol. function=hydrolase activity, hydrolyzing O -glycosyl compounds; Biological process=carbohydrate metabolic process
  Homolog annotation: Hit_ID=P16551; Match level="QueryCoverage=62%, HitCoverage=25%, E-value=6e-70, Identity=67%"; Hit description=Alpha- galactosidase
  Pfam annotation: Domain name=LacY_symp; Domain location=136-285; Score=-189.9; E_value=1e-08; Accession=PF01306.10; Description=LacY protonsugar symporter
  Pfam annotation: Domain name=Melibiase; Domain location=1-116; Score=- 243.0; E_value=0.048; Accession=PF02065.9; Description=Melibiase
  Pfam module annotation: Pfam domain module=LacY_symp::Melibiase; Domain location=136-285::1-116
MGAHIGHHKCHATFRQHSIEFRGLTALFGHMGLELDPLTVDEKEREGYRHYAALHKQWREVIHRGTQWRVDMPDATTMAQGIVSEDKTYGLFMVSQLAMPDYTLMMPLRMPGLEASAQYRITLLDHPNIQITGEGGHTMRRLPVWMDAPQTVSGEWLMQAGIALPILDPETAILIGVERVGGLYIGFVFSAGSGAIEAYIERVSRNSFFEYGKARMFGCLGWGLCASTGGILFGIDPSYVFWMGSGAALLLMLLLVVAKPKPNQTAQVMNATGRQPAADYSQNRL

SEQ ID NO: 147977 - protein, 85 aa, Glycine max
  Coding DNA Sequence Number=SeqID_31199
MEDPEMSYEQVVQHLPFLALMPTFCLFSILMVNSLVVQVQTSVQLLAHWIAHSPSSKNVARCTQHSIKMTKLSLLGFLLTDQVDP

SEQ ID NO: 147978 - protein, 116 aa, Glycine max
  Coding DNA Sequence Number=SeqID_31200
MVLPIRHVATCVTQSLVARSLSSEARLSYMSILAPAVGNDETILVALCFCLYSFPMTRPLRKSAMNLRNDGGDPSMLEQMEYMRRQMAQMKDIRRENVEVRMENAEARRVDEALHA

SEQ ID NO: 147979 - protein, 349 aa, Glycine max
  Coding DNA Sequence Number=SeqID_31201
MQEELSANGGPLGSEGYTTPQSQVRKHKGTKTKNVCKHEEAKGKRRSDVRAYCDAWGENFRDVTPWSKKMKVIFDKDLMAVTTVRRQKHCRKLGFVVPKEKGTLFAKSQRNTPKSFSCFLLVVVKVIFDKDLTAVMTVQRQKHCRKLGFVVSKEKDLILWDGQEKKRNHYWVTMEINYETLYLWAKPEVDKQKINKTAWVSVNSVGGRGILTLFTTSYKIFKDRLFQVKAIEENVELLDGFPNHWTSSLRNYGGYNLEALSTSDQWDVEEMKQLTLFTTMFKSSRIIELEYRSVDLRVFIEQTTKKSMTPFKHKMARLLAKKEKVDKMAAATAIVAGVLRPMRLANPRR

SEQ ID NO: 147980 - protein, 174 aa, Glycine max
  Coding DNA Sequence Number=SeqID_31202
  Gene Ontology: Mol. function=sequence-specific DNA binding; Cellular component=intracellular; Biological process=regulation of transcription, DNA-dependent
  Homolog annotation: Hit_ID=Q1RXP9; Match level="QueryCoverage=98%, HitCoverage=96%, E-value=7e-48, Identity=58%"; Hit description =Transcription factor CBF/NF-Y/archaeal histone
  Pfam annotation: Domain name=CBFD_NFYB_HMF; Domain location=9-74; Score=120.3; E_value=5.4e-33; Accession=PF00808.13; Description =Histone-like transcription factor (CBFNF-Y) and archaeal histone
  Pfam annotation: Domain name=Histone; Domain location=6-77; Score =7.6; E_value=0.023; Accession=PF00125.14; Description=Core histone H2AH2BH3H4
  Pfam module annotation: Pfam domain module=CBFD_NFYB_HMF::Histone; Domain location=9-74::6-77
MAGVREQDQYMPIANVIRIMRRILPAHAKISDDAKETIQECVSEYISFITAEANERCQREQRKTVTAEDVLWAMEKLGFDNYAHPLSLYLHRYRKTEGEPASARRASASASPSMQMHPRTHPHSHPPNYSHHGFGMFDFDPSSQGFYRDDASSSGSGGFVASFDPYANIKRDPL

SEQ ID NO: 147981 - protein, 88 aa, Glycine max
  Coding DNA Sequence Number=SeqID_31203
MEKLMEENHREEVLPNSVRTFNAYHRARTHYHKVKSLGELMKYNHIFLVGGTHEYCNTSNESHQNERNLEIIQGRKSIKKENEFLLAE

SEQ ID NO: 147982 - protein, 248 aa, Glycine max
  Coding DNA Sequence Number=SeqID_31204
  Gene Ontology: Mol. function=transition metal ion binding; Cellular component=cytoplasm; Biological process=proteolysis
  Pfam annotation: Domain name=Transposase_21; Domain location=186-248; Score=-118.3; E_value=0.00017; Accession=PF02992.5; Description =Transposase family tnp2
MDRSWMNASHMSPAYENVVQQFLKFALERSRSVEDERYLYPCIKCLSGRRQKSLKLLPAVLSLVNVKAKYGWSDKNFTSLLKVMHDMLPEENTLSKSYYEAKKILCSMGMEHQKIRACSNDCILYKNEFEEMHKCPRCGVSQFKVQDDNECSSDASMKKGPPTKVLWYLSIIPRFKCIFANGDDAKDLTWHADGRIYDGMLCHSDDSSQWKKINHLYPDFKKEARNLRLGLATNRMNSFGSLSTKHSS

SEQ ID NO: 147983 - protein, 186 aa, Glycine max
  Coding DNA Sequence Number=SeqID_31205
  Gene Ontology: Mol. function=actin binding; Biological process =cytoskeleton organization and biogenesis
MKILKGHTKNLHHPEASITKSYIAEETIDFCSEYIEKEKPVGLPESRHDERVVGKCSRGLDVSTLGLKELKQVHLYILNNNNEVVLYIVRHKALVKENNPKMVKKCIATLPSSPSSESTPSPSTSKMMRKATRLRSLSAKPVEVERPTVHVDLTTGKDDGSHKKKLRTYLGVIARDKVDVRCVNCK

SEQ ID NO: 147984 - protein, 191 aa, Glycine max
  Coding DNA Sequence Number=SeqID_31206
  Gene Ontology: Mol. function=transition metal ion binding
MYPVEWNMKVLKGYSKNQYRPEASIVERYVAEESIEFCSQYIETVKFVGIPQTRHGRTWGVVVPNLNVPAWKGYDINNYSFYTKSQDDKSNMQNNGDKHVPKGLTKLVDRPEHDDDLIYHMTLMIPQLFLKPMQVSWDATMFRVYNDNVPLKHKDLWEIAHDVGISNWWLYVLRTMLSPGFVPCTISPTTT

SEQ ID NO: 147985 - protein, 58 aa, Glycine max
  Coding DNA Sequence Number=SeqID_31207
MSGNSPCHIHFVLASFIPTFNIGTEKFPAQRSILHWSPSTRDETGGMSSSTTFNYAPG

SEQ ID NO: 147986 - protein, 153 aa, Glycine max
  Coding DNA Sequence Number=SeqID_31208
MEVAMKMKEMNLRGGSRDSSMIKSTKPLQIWQTHERESIEKWFESIHNIYMAKHKSDSKKPLYSGCKNSLTLLLAVLSLYKVNDDEDYSSDENSKKGPPAKVLWYLPIIPRFKRLFANEDDAKDLTWHANGRKSDGMVHHPADCSQWKKIDGL

SEQ ID NO: 147987 - protein, 128 aa, Glycine max
  Coding DNA Sequence Number=SeqID_31209
WNNGGGGGNVGGGGGGDNGDSDNGGCGSDGGNGGGMVEVIVVVVVVEEWLCWWRWWNGCGGGGGVGGNKVWWWWNGGGGMVVMVAVVEAATMMDQVQLLRYLETLLSLGDDEEKRMITMELLMVDYSI

SEQ ID NO: 147988 - protein, 430 aa, Glycine max
  Coding DNA Sequence Number=SeqID_31210
  Gene Ontology: Mol. function=protein binding; Cellular component =integral to membrane; Biological process=defense response to fungus
  Homolog annotation: Hit_ID=Q1SWI7; Match level="QueryCoverage=97%, HitCoverage=88%, E-value=1e-137, Identity=39%"; Hit description =Leucine-rich repeat
  Pfam annotation: Domain name=LRR_1; Domain location=11-33; Score =10.1; E_value=3.7; Accession=PF00560.23; Description=Leucine Rich Repeat
  Pfam annotation: Domain name=LRR_1; Domain location=112-134; Score =9.5; E_value=4.7; Accession=PF00560.23; Description=Leucine Rich Repeat
  Pfam annotation: Domain name=LRR_1; Domain location=136-159; Score =10.7; E_value=2.9; Accession=PF00560.23; Description=Leucine Rich Repeat
  Pfam annotation: Domain name=LRR_1; Domain location=161-184; Score =2.5; E_value=96; Accession=PF00560.23; Description=Leucine Rich Repeat
  Pfam annotation: Domain name=LRR_1; Domain location=209-231; Score =6.3; E_value=19; Accession=PF00560.23; Description=Leucine Rich Repeat
  Pfam annotation: Domain name=LRR_1; Domain location=234-256; Score =4.7; E_value=38; Accession=PF00560.23; Description=Leucine Rich Repeat
  Pfam annotation: Domain name=LRR_1; Domain location=258-279; Score =5.1; E_value=32; Accession=PF00560.23; Description=Leucine Rich Repeat
  Pfam annotation: Domain name=LRR_1; Domain location=307-326; Score =11.6; E_value=1.9; Accession=PF00560.23; Description=Leucine Rich Repeat
  Pfam annotation: Domain name=LRR_1; Domain location=331-353; Score =8.1; E_value=8.6; Accession=PF00560.23; Description=Leucine Rich Repeat
  Pfam annotation: Domain name=LRR_1; Domain location=35-57; Score =11.7; E_value=1.8; Accession=PF00560.23; Description=Leucine Rich Repeat
  Pfam annotation: Domain name=LRR_1; Domain location=355-377; Score =10.5; E_value=3.1; Accession=PF00560.23; Description=Leucine Rich Repeat
  Pfam annotation: Domain name=LRR_1; Domain location=379-402; Score =11.5; E_value=2; Accession=PF00560.23; Description=Leucine Rich Repeat
  Pfam annotation: Domain name=LRR_1; Domain location=404-426; Score =11.2; E_value=2.2; Accession=PF00560.23; Description=Leucine Rich Repeat
  Pfam annotation: Domain name=LRR_1; Domain location=59-81; Score =18.5; E_value=0.024; Accession=PF00560.23; Description=Leucine Rich Repeat
  Pfam annotation: Domain name=LRR_1; Domain location=83-105; Score =15.5; E_value=0.19; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=11-33::112-134::136-159::161 -184::209-231::234-256::...
  Pfam module annotation: Domain location=258-279::307-326::331-353::35- 57::355-377::379-402::404-426::59-81::83-105
PIPCGIRNLTLIQNLDLSGNSFSSSIPDCLYGLHRLKSLDLRSSNLHGTISDALGNLTSLVELDLSANQLEGTIPTSLGNLTSLVALYLSYNQLEGTIPTFLGNLRNSREIDLTFLDLSINKFSGNPFESLGSLSKLSSLWIDGNNFQGVVKEDDLANLTSLTDFGASGNNFTLKVGPNWIPNFQLTYLEVTSWQLGPSFPLWIQSQNKLKYVGLSNTGIFDSIPTWFWEAHSQVLYLNLSHNHIRGELVTTIKNPISIQTVDLSTNHLCGKLPYLSNDVYDLDLSTNSFSESMQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKILRLRSNSFSGHIPNEICQMSLLQ

SEQ ID NO: 147989 - protein, 74 aa, Glycine max
  Coding DNA Sequence Number=SeqID_31211
MSLFSTRRCALLELLYSYEECHQHILFNLISLGEFGLIAVVMAVITTEQSFSVTTSLVAKQFKGTIVVIAITDE

SEQ ID NO: 147990 - protein, 195 aa, Glycine max
  Coding DNA Sequence Number=SeqID_31212
  Gene Ontology: Mol. function=sugar porter activity; Cellular component=integral to membrane; Biological process=transport
  Homolog annotation: Hit_ID=P68183; Match level="QueryCoverage=59%, HitCoverage=39%, E-value=5e-57, Identity=96%"; Hit description =Maltose transport system permease protein malG
YFETIDGSLEEAAALDGATPWQAFRLVLLPLSVPILAVVFILSFIAAITEVPVASLLLRDVNSYTLAVGMQQYLNPQNYLWGDFAAAAVLSAIPITVVFLLAQRWLVNGLTAGGVKEGDHQQQDRRRVDQHIKGRFMIDDDQPHYRVEKVDHQSFHQRIFAGLLGGEQHIRQMHRLFTQKDDQYQAKAQQTEVQH

SEQ ID NO: 147991 - protein, 158 aa, Glycine max
  Coding DNA Sequence Number=SeqID_31213
MACLSTIRHPMWHTLSMRMSINPLLYPLRANNPKLIMHRNGKVGSSRGKAQGIEEGEDYAFANLEELFLVSNIITPPKFKALDFDKNKGTTCPKNHLKMYCRKMGAYAKDEELLIHSFQESLTGVAVTWYTNLEPSRVHSWKDLMVAFVRQCQYNGFG

SEQ ID NO: 147992 - protein, 106 aa, Glycine max
  Coding DNA Sequence Number=SeqID_31214
  Homolog annotation: Hit_ID=Q681N2; Match level="QueryCoverage=52%, HitCoverage=8%, E-value=1e-10, Identity=66%"; Hit description=Arm repeat containing protein
MQGGPQSEPFDVEMGDRLEDMIRDLGQESFQQAHAFGRFCFGGFVEEWDTNKGNKHDVTTLFNLSINLANKGRAIRPAIVSPLLQLLKDTKLGMIEEALYGLLLLV

SEQ ID NO: 147993 - protein, 95 aa, Glycine max
  Coding DNA Sequence Number=SeqID_31215
  Gene Ontology: Mol. function=RNA-directed DNA polymerase activity; Biological process=RNA-dependent DNA replication
  Homolog annotation: Hit_ID=Q2HUG4; Match level="QueryCoverage=84%, HitCoverage=20%, E-value=2e-12, Identity=34%"; Hit description=RNA -directed DNA polymerase
MHNLNSNIIVLIPKVPNADRIELFRPIACGRNILDYIAVTSEAINMLDTKAFSGNLSIKVDIKMWVKAIILSTKLSISMNGKGKQLVMKNQSSTM

SEQ ID NO: 147994 - protein, 70 aa, Glycine max
  Coding DNA Sequence Number=SeqID_31216
MAKSVFGYTKIAGGKRGSPWQTPLVQLKKSTTFPFIEMDNLVDKMIAFTHCTKTSKKQSNYYKCITLAVE

SEQ ID NO: 147995 - protein, 83 aa, Glycine max
  Coding DNA Sequence Number=SeqID_31217
MSVVDIKIGALLEKLHSISVNWVILHRFTIIVIDDIIKRGRLFYDGRTDHLRMGIFLRCCLIQRMGIQRKTYNNNNNNNALSH

SEQ ID NO: 147996 - protein, 220 aa, Glycine max
  Coding DNA Sequence Number=SeqID_31218
  Gene Ontology: Cellular component=chloroplast thylakoid membrane
  Subcellular localization annotation: CTP_CleavageSite=50; ConfidenceScore=5.51e-01
MAEAIMGFTPFKSHTLSSCLQTNKFQVNQSSRLPKQHSNSSLINRPWQVLEGKSKKRGSLCKVNGLPDWPLMAIIVEQMEGQRDLITEKTVSHLSDQAIKNVYSWYIMFTVWGCLFFGAMKDPYYDSETYRGDGGDGTGNWIYEKIFYSITSLELSSGMPCPVWIRGVLCFSLDTIIVKDINQDAMEAEAREALWREELIEEIEQKVEGLRELEEAGKKN

SEQ ID NO: 147997 - protein, 109 aa, Glycine max
  Coding DNA Sequence Number=SeqID_31219
MSYFKWKKIREIVFSIKQNVLSISKGSAHVRKAKSNPRDLDPMMRQKMPATKKSRTKFLSHYQPIFGSGLKTNLLENQELIQFWLSRATTGRMKKGIIAGHEEVVGFHI

SEQ ID NO: 147998 - protein, 70 aa, Glycine max
  Coding DNA Sequence Number=SeqID_31220
  Gene Ontology: Mol. function=ribonuclease H activity
  Homolog annotation: Hit_ID=Q1T293; Match level="QueryCoverage=95%, HitCoverage=11%, E-value=2e-09, Identity=44%"; Hit description =Ribonuclease H
MDVKASSKITMPTLGGVLLLAFRNDKLVSWQLKNGWSNAVNLSKLIIFTIGHIYPEGNTCADRLASHGVN

SEQ ID NO: 147999 - protein, 204 aa, Glycine max
  Coding DNA Sequence Number=SeqID_31221
  Homolog annotation: Hit_ID=O82279; Match level="QueryCoverage=97%, HitCoverage=62%, E-value=2e-69, Identity=64%"; Hit description =Expressed protein
MNCSLEVDLSKELAAPVTGSNRVRYKSAPTRREQEKWDRATKAATGGSDVMFREIRQSREDPKVLAAQAEEQYNKLKRKLQIFTLGIGGVGLVSAYVSYSPEIAASFGAGFLGSLAYIRMLGSSVDSLRTDGAKGFVKGAIGQPRLLVPVVLVMVYNRWNAILVPEFGSMHLELIPMLVGFFTYKIATFAQAIEEAITVATRKT

SEQ ID NO: 148000 - protein, 222 aa, Glycine max
  Coding DNA Sequence Number=SeqID_31222
MSPPTLVAPKAIGAMTHVSRSAKRLRELSETKDDEDGLVFRKRKVAPSLDETIAPQVKKVKPTPQVPPRRVIHLKKKKKTESTTDMDDEVQHQTPPSPIHHQGLPAMEPNLIVEDIARLMPNRLTHLLMKHIQVFTPMSQFVPLFYGHQAIPLTKDDILNVGMIMMQCRLTGQWPSYLPGIHSKPTTTFKFMQKKGKVPPHTKPMPHPGPKDNIVLRPIPYD

SEQ ID NO: 148001 - protein, 74 aa, Glycine max
  Coding DNA Sequence Number=SeqID_31223
MTKTQVVQQSDQKCIRSNTRKPGPVSDSVEVRIVKTGPGRQVNTKSVESDQIIPDQTHDRSNNQIDPVMSLDPD

SEQ ID NO: 148002 - protein, 356 aa, Glycine max
  Coding DNA Sequence Number=SeqID_31224
MTRRHHQSSSECTSYSSATGPTHHRRTTPTQKQKVVSKEDYYNVDDDADASEYSQEDEYESDEEEEEPEQDIDEDDNNVNGISSESVSNNSTPPNVPETSTSISASDLRNPSSNSSSSYVKIAPLPIFRGMSSESPVTHLSRFNKVCRANNASSVDMQMRIFPVTLEDEAALWYDLNVEPYYGSLSWEETKLSFLQAYYDVEPVEELRSKLVGIRQDQRESVRSYFLRLQWILKRWPEHGLGEDVLKGVFVDGLREEFREWVLMQKPGSLNDALKLAFEFEKVWRVRGKEGVGPTCEVRDVLGKDLIVGSCSVGEISSGQERVEDAKGSEGLVGSVKKKQCHKCGKKKDLRNSSIE

SEQ ID NO: 148003 - protein, 357 aa, Glycine max
  Coding DNA Sequence Number=SeqID_31225
  Gene Ontology: Mol. function=DNA binding; Cellular component=nucleus; Biological process=regulation of transcription
  Homolog annotation: Hit_ID=Q8LJS1; Match level="QueryCoverage=99%, HitCoverage=100%, E-value=0.0, Identity=87%"; Hit description=No apical meristem-like protein
  Pfam annotation: Domain name=NAM; Domain location=18-144; Score =310.6; E_value=2.9e-90; Accession=PF02365.6; Description=No apical meristem (NAM) protein
MENVSVLLCNKEKDQMDLPPGFRFHPTDEELISHYLYRKVTHTNFSARAIGEVDLNRSEPWDLPWKAKMGEKEWYFFCVRDRKYPTGLRTNRATQSGYWKATGKDKEIFRGKSLVGMKKTLVFYKGRAPKGEKTDWVMHEYRLDGKFSVHNLPKTAKNEWVICRVFQKSSGVKRTHISGMMMLDSYGNELGYSSSALPPLTDSSPSIDNTKVLSVTDTAYVPCFSNPIDAPRGIFDSLNNINITTTTTTNNNNTLYGVSSNHSFYNTQLHIPPTLPLPSSSNHYLRAFLENQGNGSNMRNNGYETEREMVSVSQETTISTDVNAEISSLGKRQFENQQNPTASSAVVPMDVATLWNY

SEQ ID NO: 148004 - protein, 216 aa, Glycine max
  Coding DNA Sequence Number=SeqID_31226
MAEELSTAIPQSQASSTKKRASKNEKLCLEDYLHLVHSRQTLQLTMNQLNQVIRIHGFKKIHHAPKVFVSRNCKNLSRFSAQKVLVQAVESLDLVDLPRSTVSESVSAFAAVALEDVVADLGELSWQECCVTSVEKISFSDGQSVFPAACSDQSLRVVNHSLSQAQKENRIDETRNPIPEASSKDLKPTKMVLKRKRSNLRDSVASTLDSASLASC

SEQ ID NO: 148005 - protein, 91 aa, Glycine max
  Coding DNA Sequence Number=SeqID_31227
  Subcellular localization annotation: CTP_CleavageSite=56; ConfidenceScore=5.29e-01
MTSLLVIFEPTITPPSHKLHHRHTVFARAPPPSCRPRTRFPGLRCTLSCRPLIHIVAHAVTPTPADPYYLIDVVVLTSASLLGLLSRSFWV

SEQ ID NO: 148006 - protein, 169 aa, Glycine max
  Coding DNA Sequence Number=SeqID_31228
  Gene Ontology: Mol. function=cysteine-type endopeptidase activity; Cellular component=endoplasmic reticulum; Biological process =proteolysis
  Homolog annotation: Hit_ID=Q1T4K1; Match level="QueryCoverage=99%, HitCoverage=48%, E-value=2e-80, Identity=82%"; Hit description =Peptidase C1A, papain; Peptidase M14, carboxypeptidase A
  Pfam annotation: Domain name=Peptidase_C1; Domain location=1-168; Score=238.3; E_value=1.7e-68; Accession=PF00112.13; Description =Papain family cysteine protease
QEVVDCDTKGEDQGCAGGFMDGAFKFIIQNHGLNNEPNYPYKAVDGKCNAKAAANHVATITGYEDVPVNNEKALQKAVANQPVSVAIDASGSDFQFYQSGVFTGSCGTELDHGVTAVGYGVSADGTEYWLVKNSWGTEWGEEGYIRMQRGVKAEEGLCGIAMMASYPTA

SEQ ID NO: 148007 - protein, 179 aa, Glycine max
  Coding DNA Sequence Number=SeqID_31229
  Gene Ontology: Mol. function=catalytic activity; Biological process =auxin mediated signaling pathway
  Homolog annotation: Hit_ID=P33079; Match level="QueryCoverage=51%, HitCoverage=100%, E-value=7e-45, Identity=96%"; Hit description =Auxin-induced protein 10A5
  Pfam annotation: Domain name=Auxin_inducible; Domain location=87-177; Score=170.8; E_value=3.4e-48; Accession=PF02519.5; Description=Auxin responsive protein
MWFIVLYDHVFSIGFLLTFKNLFRAVNLVGLRFTGCYRSHACNHLKKHVRCLKHIHQWISHTTMPEQTLGCQVGNLVATNSEGEKIMGFRIVGIVRRTSFSTTQAASKRVDVPKGYAAVYVGDKMRRFTIPVSYLNEPSFQELLSQAEEEFGYDHPMGGLTIPYKEEEFLNVTAHLNEL

SEQ ID NO: 148008 - protein, 343 aa, Glycine max
  Coding DNA Sequence Number=SeqID_31230
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=100%, E-value=1e-149, Identity=72%"; Hit description =Cysteine protease 8
  Pfam annotation: Domain name=Inhibitor_I29; Domain location=39-96; Score=109.4; E_value=1e-29; Accession=PF08246.2; Description =Cathepsin propeptide inhibitor domain (
  Pfam annotation: Domain name=Peptidase_C1; Domain location=125-342; Score=467.3; E_value=1.9e-137; Accession=PF00112.13; Description =Papain family cysteine protease
  Pfam module annotation: Pfam domain module=Inhibitor_I29::Peptidase _C1; Domain location=39-96::125-342
MATKIQFHHISLALFFCLGFLAFQVASRTLQDASMYERHEQWMARYGKVYKDPEEKEKRFRVFKENVNYIEAFNNAANKPYKLGINQFADLTSEEFIVPRNRFNGHTRSSNTRTTTFKYENVTVLPDSIDWRQKGAVTPIKNQGSCGCCWAFSAIAATEGIHKISTGKLVSLSEQEVVDCDTKGTDHGCEGGYMDGAFKFIIQNHGINTEASYPYKGVDGKCNIKEEAVHAATITGYEDVPINNEKALQKAVANQPVSVAIDASGADFQFYKSGIFTGSCGTELDHGVTAVGYGENNEGTKYWLVKNSWGTEWGEEGYIMMQRGVKAVEGICGIAMMASYPTA

SEQ ID NO: 148009 - protein, 126 aa, Glycine max
  Coding DNA Sequence Number=SeqID_31231
  Gene Ontology: Mol. function=catalytic activity; Biological process =auxin mediated signaling pathway
  Homolog annotation: Hit_ID=P33083; Match level="QueryCoverage=62%, HitCoverage=88%, E-value=6e-40, Identity=98%"; Hit description=Auxin- induced protein 6B
  Pfam annotation: Domain name=Auxin_inducible; Domain location=1-90; Score=161.7; E_value=1.9e-45; Accession=PF02519.5; Description=Auxin responsive protein
MGFRLPGIRKASFSANQASSKAVDVEKGYLAVYVGEKMRRFVIPISYLNKPSFQDLLSQAEEEFGYHHPNGGLTIPCSEDDLCNPIAQWAMMGSIEGERITWHRGMANPLVDMLKTSHMLLQMIAS

SEQ ID NO: 148010 - protein, 54 aa, Glycine max
  Coding DNA Sequence Number=SeqID_31232
MVGTNISGCSMRGEDVVLLIGIREDPCVWSMYSKQFTCQGNLIQPLLGLHKSGL

SEQ ID NO: 148011 - protein, 98 aa, Glycine max
  Coding DNA Sequence Number=SeqID_31233
  Gene Ontology: Mol. function=amino acid transporter activity; Cellular component=membrane; Biological process=amino acid transport
  Homolog annotation: Hit_ID=Q9C6S5; Match level="QueryCoverage=92%, HitCoverage=18%, E-value=7e-31, Identity=68%"; Hit description=Amino acid permease, putative
MTWHLLRVVLGYFFPLLVATGVVPLNRELWTDGYFSIITDIVGGVWLRWWLQAAAAMSNMEMFVAEMSSDSFQLLGMAERGMLLEFFGKRSCYETPYT

SEQ ID NO: 148012 - protein, 91 aa, Glycine max
  Coding DNA Sequence Number=SeqID_31234
  Gene Ontology: Mol. function=catalytic activity; Biological process =auxin mediated signaling pathway
  Homolog annotation: Hit_ID=P33080; Match level="QueryCoverage=59%, HitCoverage=59%, E-value=9e-25, Identity=94%"; Hit description=Auxin- induced protein X10A
  Pfam annotation: Domain name=Auxin_inducible; Domain location=1-53; Score=70.0; E_value=7.7e-18; Accession=PF02519.5; Description=Auxin responsive protein
MKRFVIPVSYLNQPSFQDLLNQAEKEFGYDHPMGGLTIPCKEDEFLTVTSHLNDLYGVVTTMVLPWNYYYIPWYCPKIHSNNRTDRQFCWT

SEQ ID NO: 148013 - protein, 343 aa, Glycine max
  Coding DNA Sequence Number=SeqID_31235
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=100%, E-value=1e-163, Identity=79%"; Hit description =Cysteine protease 8
  Pfam annotation: Domain name=Inhibitor_I29; Domain location=39-96; Score=102.1; E_value=1.7e-27; Accession=PF08246.2; Description =Cathepsin propeptide inhibitor domain (
  Pfam annotation: Domain name=Peptidase_C1; Domain location=125-342; Score=456.2; E_value=4.1e-134; Accession=PF00112.13; Description =Papain family cysteine protease
  Pfam module annotation: Pfam domain module=Inhibitor_I29::Peptidase _C1; Domain location=39-96::125-342
MVAKNQFYQISLALLFCSGFLAFQVTCRTLQDASMYERHEEWMGRYAKVYKDPQERERRFKIFKENVNYIEAFNNAANKPYTLGINQFADLTNEEFIAPRNRFKGHMCSSITRTTTFKYENVTAIPSTVDWRQKGAVTPIKDQGQCGCCWAFSAVAATEGIHALSAGKLISLSEQEVVDCDTKGEDQGCAGGFMDGAFKFIIQNHGLNNEPNYPYKAVDGKCNAKAAANHVATITGYEDVPVNNEKALQKAVANQPVSVAIDASGSDFQFYQSGVFTGSCGTELDHGVTAVGYGVSADGTEYWLVKNSWGTEWGEEGYIRMQRGVKAEEGLCGIAMMASYPTA

SEQ ID NO: 148014 - protein, 137 aa, Glycine max
  Coding DNA Sequence Number=SeqID_31236
MGLLGGGHARLRIVTSEGRRGGRRKGEVGVDVVIPYSYPYLTFDYWGKLKPEPILDQLGYYPSKSERIPTGMGFLAMSKGERGKRRKKKNHVHVVLSFYNSNFAVFSLPALPEDSQKVRVQRPILGGTMGFDANARF

SEQ ID NO: 148015 - protein, 1194 aa, Glycine max
  Coding DNA Sequence Number=SeqID_31237
  Gene Ontology: Mol. function=RNA-directed DNA polymerase activity; Cellular component=chromatin; Biological process=chromatin assembly or disassembly
  Pfam annotation: Domain name=Chromo; Domain location=1077-1123; Score= 29.0; E_value=1.6e-05; Accession=PF00385.14; Description='chromo' (CHRromatin Organisation MOdifier
  Pfam annotation: Domain name=RnaseH; Domain location=643-763; Score= -19.4; E_value=0.0037; Accession=PF00075.14; Description=RNase H
  Pfam annotation: Domain name=rve; Domain location=807-949; Score= -12.8; E_value=0.069; Accession=PF00665.16; Description=Integrase core domain
  Pfam module annotation: Pfam domain module=Chromo::Retrotrans _gag::RnaseH::rve; Domain location=1077-1123::142-232::643-763::807 -949
MKLEVHEDDAAGSCPTVPLVLEFQGFSSCVYHFGALVAMPDSSNTPASLEDAILKLAAQQLSMGETLQTVTFQLNEILHRLPPTSPNTGPATTTSVSSSSPAHHHRIKIDVPRFDGSDPSGWIFKITQYFEYHSTPEAERLTITAFYMDGCALAWFQWMNNNGQFTSWPAFLQAVQTRFAPSQYEDPTSVLFKLTQRGTVAQYLAEFEELANRIVGLPPPFLLSCFVSGLSPDIRREEEKFLDGRTLSRTRHPQPIHTHPQPTHTHPQPNPTHLEPLSPNQNPNSPMPLRSVPTPPMLPPPLRPTPSPVKRLTPEEIASRREQGLCFTCDEKYHRGHRCASRAFLLVAPETLRFMGFIGDRQVVLLVDGGSTHNFIQLQLVSELGLSTRDTSPLRVMVGNGQHLECTRVCEDVTVVIQSTQFTVDLHVLPIAGANVVLGGAMVEVPRTEPPSIQANPIPPPQIQAILDRYHTLFQPPSALPPQRETDHHIHLLPQATPVNVRPYRYPHFQKQEIEQQVELMLQKGMIQPSNSLFSSLVLLAKKQDGSWKFCVDYRALNALNIKDRFPIPTVDELLDELGGAHYFSKLDLLQGRFIRGYATIAAPLVHITTKAHFLWTEKAQAAFEQLKLAVSTAPVLSLPDFEQPFTVETDASGVGMGAILSQQGHPLAFFSKPFPLKLLSASTYVRELFAVTATVKKWRQYLLGHRFTIVTDHRSLKELLTQVIQTPEQHTYLARLMGYDYQIIHHSGALNQAADALSRLPEHNSSLMMLSVPCLTFMEELRRQLEASSEYVNQRQAIGQSPTTFPENFSWPGLRMDVTKFVAQCVDCQLTKYETKKSVGHTPGYVTSFAHSSHGGCPVHGDRGENSWDSAKLSIRSRPPVPQQFLASAYHPQTDGQTEVMNRIIEQCLRAFVHRRPRVWGKLLLWVEWSHNTSWNAAMGSTPYEITFGRKPFNFPDYITGTSKLDAVDEMLQDREETFQCLRKKLLKAQTQMKKPRRQSSVKDNPGVHGKLAKRFYGPFKVLERVGPVAYRLELPENARVHPVFHCSVLKLFQGTPESEIPAQLPDQFLQDQPLISPLSILDYRRTTPADSWQVLVQWKGLTPDDTTWEDWDTLQQEYHLEDKVILQGPPSDSIVMPEVQTADTSVEQTKPHEGESNRPLQFKLKMQDQLHNQFHRLENKKRMQKQQISRCN

SEQ ID NO: 148016 - protein, 265 aa, Glycine max
  Coding DNA Sequence Number=SeqID_31238
  Homolog annotation: Hit_ID=Q9M651; Match level="QueryCoverage=38%, HitCoverage=18%, E-value=8e-34, Identity=65%"; Hit description=RAN GTPase activating protein 2
MKGRDAITNYDLNSYEVNGIMKSKITTTMDGSVTLKREGINNETEACSPETQSIVQHNHQQLIKSSSFCRHYQNYNLFSSNPYALGGFTGVNTSFDPYNFQDNTLNQIPHENLNFSLSDSFQNPSSEPNNSGSQGFIFMELNSQQRPFSIKLWPPSENTRQTLVERMTNNLTTKSLFTQKYGTLDMEEAEENAKRIEDVAFATANLHYEKEPNGDGGSAVQLYAKECSKLLLDVLKRGPSKKDNEVVTSIEVEMEHIDIGEPENT

SEQ ID NO: 148017 - protein, 112 aa, Glycine max
  Coding DNA Sequence Number=SeqID_31239
  Subcellular localization annotation: CTP_CleavageSite=68; ConfidenceScore=5.34e-01
MGIAPTKTPSGPEEVQQGPGVSSSGYGPLSVLQGARTPPSKVMPSQHRDRARKTSSGPEEVQQGPRVSSSNYGPLSFLRSARRPQQVHQAPINRAFIKKYCALRQTQGETPQ

SEQ ID NO: 148018 - protein, 103 aa, Glycine max
  Coding DNA Sequence Number=SeqID_31240
  Subcellular localization annotation: CTP_CleavageSite=20; ConfidenceScore=5.41e-01
MDRLTTMMSALLSAQNSQAAAAAVEQPLVSTTPLSTVTSPPLFLPPGCTWGMPPPVCGSPQPAVSEVPPPFAQQSAPVPQPSTSFPQAAMTYSAPLIHTIQQE

SEQ ID NO: 148019 - protein, 236 aa, Glycine max
  Coding DNA Sequence Number=SeqID_31241
  Gene Ontology: Mol. function=DNA binding
  Homolog annotation: Hit_ID=Q1SFS3; Match level="QueryCoverage=97%, HitCoverage=44%, E-value=8e-51, Identity=46%"; Hit description =Lambda repressor-like, DNA-binding
MTRDPSDIVWYQAASDVGEIIVNSGEYPNVPLLGMRAGISYNPLLARRQFGYPIKTKPNNLALTNEFYLNHGDHSNKRERFAQAWSAIRRLNRSQLGKKSDYVHESYTQWIIDRTKSFGLPYRLPRYLSSTIPPSSLPIPFDTKEEFHEQLTKERQEKETWKRRCQELEQENETLKGKIAQQSRELFIQNQRMIEKDDLLRRKDVLLHQDARRKRNFMDLFSRAHSDSEDPSTPGV

SEQ ID NO: 148020 - protein, 122 aa, Glycine max
  Coding DNA Sequence Number=SeqID_31242
  Subcellular localization annotation: CTP_CleavageSite=70; ConfidenceScore=5.82e-01
MTLSSWQNKLNRPMATPPSSPAPPPPSPPTKATSQSPSTLKRTGKATRLRSLATRPAGADRPVVHVDPPTGKAEGPHKKKLRAYLGIVARDKVDVTYKNWKQVPATQKDLIWEDIQAKFIIY

SEQ ID NO: 148021 - protein, 203 aa, Glycine max
  Coding DNA Sequence Number=SeqID_31243
  Gene Ontology: Mol. function=nucleic acid binding
  Pfam annotation: Domain name=zf-CCHC; Domain location=134-151; Score =19.3; E_value=0.00064; Accession=PF00098.13; Description=Zinc knuckle
MSIIQGLNQALEDERSASRTETEWTKIQRKVVSMIRLGLAPEIKHNVLKETTSKALWEKLENINVSKSLTNHFCLKMELYQLKIEMGGDLYDHINKFNQQLWWSLSEGEIIQGDMMSQERSKSQLHPQLDMSNMQCYYCSESGHVQARCKQMNENLKKLRYMNKDGVNSQANEVMMDSPVGPCGLNNLKRDRLRIQKKQQQSI

SEQ ID NO: 148022 - protein, 83 aa, Glycine max
  Coding DNA Sequence Number=SeqID_31244
  Gene Ontology: Mol. function=amino acid transporter activity; Cellular component=membrane; Biological process=amino acid transport
  Homolog annotation: Hit_ID=Q9C6S5; Match level="QueryCoverage=77%, HitCoverage=13%, E-value=1e-21, Identity=75%"; Hit description=Amino acid permease, putative
MRIAISGGVDCYWALFEGYFSIITDIVGGVWLRWWLQAAAAMSNMFMFVAEMSSDSFQLLGMAERGMLLEFFGKRSCYETPYR

SEQ ID NO: 148023 - protein, 90 aa, Glycine max
  Coding DNA Sequence Number=SeqID_31245
MNLLAVTTWVTCSYKEEEKEKKQTNNNRNKKKNKSLYREVAKNKTIYKSLYHEVAKKKKKRRRRRKLEREEEEENWSARKKKKNRVRERN

SEQ ID NO: 148024 - protein, 138 aa, Glycine max
  Coding DNA Sequence Number=SeqID_31246
MTLRTSMPLQAWRSSQREWVHVVPVEHLDAMPAIIDYIISCYISWGFTYLLELRYYEGVRLYFGLEESPHNLEFKLILEEYDEQDNILSYRMEPMSIAEVIKDRGDYSNMVFEEYKKVLWQLKPSSEVEYDDPREDMP

SEQ ID NO: 148025 - protein, 74 aa, Glycine max
  Coding DNA Sequence Number=SeqID_31247
MAKFGTSSLVDMFATAGDEDGDAVDVGTENGPCASIRDEDDVDVGVGDGPPTSIGDGDGLTSIRGEDGVGATLK

SEQ ID NO: 148026 - protein, 64 aa, Glycine max
  Coding DNA Sequence Number=SeqID_31248
MALNNHGFNGGSWSSNNHIQILESTMRIITQGHGMNHAKKREIYFSVAHHLRNPRLSMFDLEWL

SEQ ID NO: 148027 - protein, 107 aa, Glycine max
  Coding DNA Sequence Number=SeqID_31249
  Pfam annotation: Domain name=zf-CCHC; Domain location=55-72; Score =8.7; E_value=0.036; Accession=PF00098.13; Description=Zinc knuckle
MDKAVDIWKDLKPQYLQGDLLRISNVQQELASIKQGGRGGRGSYGRGNTGGRSNKICTHCGTTNHTVDECYKKHGYPLGYILYKPQGVTINNTVAEVENNDNQMQEK

SEQ ID NO: 148028 - protein, 107 aa, Glycine max
  Coding DNA Sequence Number=SeqID_31250
MQTQQRQRFDVEDVSLHLDERSPQVSAGSRGTGTGMGSRELVFSTQGLKVARCKGLAPCMRIGRGARISTSTTTMESREGNSAVGKKCIGKRRKRGKGMGHSGVGVV

SEQ ID NO: 148029 - protein, 69 aa, Glycine max
  Coding DNA Sequence Number=SeqID_31251
MMNVTNRLGALVRSLRVNILKGVFGINTCEQMLDKSSYICAFFSRSTAGLGLGQTDSTFLKFRKNLGMI

SEQ ID NO: 148030 - protein, 94 aa, Glycine max
  Coding DNA Sequence Number=SeqID_31252
METRLGYNSTTEQIVTIDDEWKKLCEKYKYAKQFKKKGCLHYDKLCIIFRDRIVAGIDVAHFTKAVKALKDDPCWRAVFLAISDDQKKDIVLNL

SEQ ID NO: 148031 - protein, 132 aa, Glycine max
  Coding DNA Sequence Number=SeqID_31253
  Gene Ontology: Mol. function=GTPase activity; Cellular component =intracellular; Biological process=translational initiation
  Homolog annotation: Hit_ID=Q8RWP3; Match level="QueryCoverage=75%, HitCoverage=22%, E-value=1e-28, Identity=85%"; Hit description=GTP -binding protein LepA homolog
  Pfam annotation: Domain name=EFG_C; Domain location=61-132; Score =49.5; E_value=1.1e-11; Accession=PF00679.14; Description=Elongation factor G C-terminus
MKSESLVIAGQPYGGEFVPGPCTHRPSHYGSCLNLRHRVPWDLALDVGFWAFFIWKLFSCVQIEMLTPKDYIGSLMELAQERRGQLKEMKFIAENRASIMYELPLAKMVGDFFDQLKSRSKGYASMEYTFVG

SEQ ID NO: 148032 - protein, 423 aa, Glycine max
  Coding DNA Sequence Number=SeqID_31254
  Gene Ontology: Mol. function=nucleic acid binding; Cellular component= nuclear pore; Biological process=DNA integration
  Pfam annotation: Domain name=rve; Domain location=16-179; Score =139.3; E_value=1e-38; Accession=PF00665.16; Description=Integrase core domain
  Pfam module annotation: Pfam domain module=RVT_2::rve; Domain location=283-423::16-179
MASESKGSFPSGRAWRASESLKLLHVDLCGPMQTVSLGGSKYFLLITDDYNRMSWVYFLKAKSEAFENFKIFKAIVDKQFGLCKKALRTGHGGEFLSNEFITFCEEQGIRRELISPYTLEQNGVTERKNRTVVEMARSMLKARGVPNNFWCEVVATVVYILNVSPTKAVINMTPFEAWRVKKPSQRESCDSIQQKTVGIDSSGEDLIVPTNDQQSLSPPTTPSSSNRSSSSFSSPSSSSSLNDSAPKRYKTLADLYANYDFALMAADPTSFDEAKDEVEWQDVMKEEIKSIQKNGTWKLVDLLEEKIVIGLKWVFRTKFNTDESIQKHKARLVAKGYAQQEGINFEETFSPVARFETVRVVLALVAQWKLDVFQLDVKSAFLNRDLQENVFVKQPLGFVKDGEEGKVYKLQKALYGLKQAPRA

SEQ ID NO: 148033 - protein, 257 aa, Glycine max
  Coding DNA Sequence Number=SeqID_31255
  Gene Ontology: Mol. function=DNA binding; Biological process=DNA integration
MVWDTLKQEYLGDKKVIAVRLQSLRREFETALMTDKESVEEYLSRVSIVVQKMWSYGETMTNEHVVGKVLRSLTSKYDHVVAAIEESKDMADYTFDELMGSLQAHEERLNRNGPLKCYWKKEEDEQKGDQKSNFVENEKNLFLAQSAAGNDAGGGVWYIDSGCSNHMSSAKSMFRELNESLKSKVRLGDGKQLEVEGRGTIAIKTEQGNTKLLYDVQYVPNLAHNLLSVGQLLCGSNVFQDYFDDAKESKVKQVPKN

SEQ ID NO: 148034 - protein, 142 aa, Glycine max
  Coding DNA Sequence Number=SeqID_31256
MDFDSKVFLLLPLPNNLNPDSEAYTGKTAHPFIPVREVCPREVQFATLTFSKDGGSFDIDTSFLQSSNKSCLNLERGYIYLGCYTENKRGYISCGLVQVEGTSTWLFKENKGGYIPNGSLACKGFYKVERNLKNCWLLGDWM

SEQ ID NO: 148035 - protein, 86 aa, Glycine max
  Coding DNA Sequence Number=SeqID_31257
MIKTVDKDADNAFECLKERITLQELACQAPNNWGIASHCHKMFYTLGADVDRRRWMDKRGEKGNGYRKRVSHIRDAQTLDVFIREL

SEQ ID NO: 148036 - protein, 131 aa, Glycine max
  Coding DNA Sequence Number=SeqID_31258
DKKSKVDPKDIYNYYKELGHWKEDYPKKAKKDFVVALVQNDSSLENNLVMAIDRHWFVAYEKKFGGNVLIGNDVPCKSVGFLAGLNVEYVDQRKREVCGNVGNQARKFVYPSGVDCDKLCLCYFIIWKSCV

SEQ ID NO: 148037 - protein, 69 aa, Glycine max
  Coding DNA Sequence Number=SeqID_31259
MVVSLFLTHLLLELASLIIFLFLLHSAAIDIKEAKDSTDEEDPRPTNSTWSYVMWYQEHLRLGSIIFES

SEQ ID NO: 148038 - protein, 76 aa, Glycine max
  Coding DNA Sequence Number=SeqID_31260
MEILILGLEVLGQKACRTVGHDVCQGVGLASGSGIKGMSHIYFDDTHTTMMIWKFHAKLLMHAPMWTLKHQVFMVT

SEQ ID NO: 148039 - protein, 75 aa, Glycine max
  Coding DNA Sequence Number=SeqID_31261
MRTHSPLKARACSPLQARMCSPLMARTYSPLKVIGTSTQIDCPFEKDDNSCNLIIPFANLPGNSFRVYVLFDLVT

SEQ ID NO: 148040 - protein, 100 aa, Glycine max
  Coding DNA Sequence Number=SeqID_31262
MEVVVIIKKGENVNHEDFDDIKKNLLEKEGDVNHASFDGVEKKSHVCHHQKGGECESLFQDSLKTKPCLKTMCFQDMQGSGNRLPGSVIDYQKTGLRNSC

SEQ ID NO: 148041 - protein, 36 aa, Glycine max
  Coding DNA Sequence Number=SeqID_31263
MELYDSGTTILYCTVAFIMEEKAQKQKQKVIIMISH

SEQ ID NO: 148042 - protein, 94 aa, Glycine max
  Coding DNA Sequence Number=SeqID_31264
MNIIAGAFKPPCKISICLADGSTPKQSIHVKVGPLYEYLNKKIFIKEAPSGPFHHKGVSESEYRTYPVKHFTYHCHKWFATAIVDAIVKIFGYL

SEQ ID NO: 148043 - protein, 119 aa, Glycine max
  Coding DNA Sequence Number=SeqID_31265
MAVVDEDAATKLAKLANTPILTAAVTSQIGMVGGGGGVGVAAATVAGVGALRVDKAGGLHHGPTIRVKLGKGHVQVLKNSTLKSGQGKNETHDLKQTSVHEEEGCTTGCHPQKWKVIHP

SEQ ID NO: 148044 - protein, 63 aa, Glycine max
  Coding DNA Sequence Number=SeqID_31266
MHALLGSFNSGNWSDSKVLDSTGLSCCAITRNRVLQEESANEAWSGLGYAIMRNRGLAVQETT

SEQ ID NO: 148045 - protein, 208 aa, Glycine max
  Coding DNA Sequence Number=SeqID_31267
  Gene Ontology: Mol. function=transferase activity, transferring glycosyl groups; Cellular component=integral to membrane; Biological process=cell wall biogenesis
  Homolog annotation: Hit_ID=Q9M5Q1; Match level="QueryCoverage=41%, HitCoverage=15%, E-value=3e-29, Identity=72%"; Hit description =Galactoside 2-alpha-L-fucosyltransferase (EC 2.4.1.69) (Xyloglucan alpha-(1,2)-fucosyltransferase)
MKRHWRNWSHDDEGEGLPDSDSDTRSSRRFSLTRLMAIFLFSLFLFSLIFLLPHPPIQSASTAKTLHQFKQTQQVLFRRMYALHKSMNVGDPTFTKDDMIKILTPCRGNVADSVELHKDKLLGGLIADGFDEQSCLSRYHSVTYSKGLSGNPSSYLISRLRKYEALHKECGPYTESYNKTVKDLRSGHDIDLSFCVSIRSPHRSSSIG

SEQ ID NO: 148046 - protein, 368 aa, Glycine max
  Coding DNA Sequence Number=SeqID_31268
  Gene Ontology: Mol. function=metal ion binding; Cellular component =intracellular; Biological process=protein amino acid phosphorylation
  Homolog annotation: Hit_ID=Q1SLC5; Match level="QueryCoverage=92%, HitCoverage=62%, E-value=2e-37, Identity=31%"; Hit description =Tetratricopeptide-like helical
  Pfam annotation: Domain name=PPR; Domain location=11-45; Score=32.1; E_value=1.9e-06; Accession=PF01535.11; Description=PPR repeat
  Pfam annotation: Domain name=PPR; Domain location=120-154; Score =14.4; E_value=0.15; Accession=PF01535.11; Description=PPR repeat
  Pfam annotation: Domain name=PPR; Domain location=203-237; Score =23.4; E_value=0.00083; Accession=PF01535.11; Description=PPR repeat
  Pfam annotation: Domain name=PPR; Domain location=241-275; Score=4.8; E_value=2; Accession=PF01535.11; Description=PPR repeat
  Pfam annotation: Domain name=PPR; Domain location=293-327; Score=7.7; E_value=0.92; Accession=PF01535.11; Description=PPR repeat
  Pfam annotation: Domain name=PPR; Domain location=50-84; Score=5.0; E_ value=1.9; Accession=PF01535.11; Description=PPR repeat
  Pfam annotation: Domain name=PPR; Domain location=85-119; Score=50.9; E_value=4.3e-12; Accession=PF01535.11; Description=PPR repeat
  Pfam module annotation: Pfam domain module=PPR::PPR::PPR::PPR::PPR::PP R::PPR; Domain location=11-45::120-154::203-237::241-275::293-327::50- 84::85-119
MAKFDVVPNGHAYNSLIHGYCKAGDLLEAMWLRLEMERLEEAMGLMEKMDEVEVFANSVIQCGNVRAAMGLYTEMVIKGIVPDVVTYTALIDGHCKVGNTKEAFRLHKEMLDAGLSPNMFTVSCVIDGLLKDGRTNDAIKMFLEKTGAGYPGDKMDSSVNKLVHGDISTWHQKAETPISLKPPKANQTLKKHLECNIHTKDVTTWISMIVGHAVHGQAREALQLFSEMRDKDDCVLTPNDVTFIGVLMACSHAGMVEEGKLHFRSMSEVYEVGGHLRDSYDFIMEMPVPPNAVVWRTLLGACSVRGELELAAEVRQKLLKLDLGYVVDSVAMSNIYANKGMWNKKIVVKNQIKQSRAPGCSSIEVGSG

SEQ ID NO: 148047 - protein, 114 aa, Glycine max
  Coding DNA Sequence Number=SeqID_31269
MRSWVRGQWIPFDADALSQFLGDPLVLEEGQECEFSQRRNRANGFDEEAITQLLCTPGQNFAWTAAGDGCGSCREGCCPCSYVSSSAMRNSDLCSSLKSKLTLQDEKRLLMVEE

SEQ ID NO: 148048 - protein, 80 aa, Glycine max
  Coding DNA Sequence Number=SeqID_31270
MVFERPEGFFDETWLAESECENAECLGREVLEDMRMWMMAVVSEVDVENNNEEGCVRAMLIMGMPFRRTRFNIARMNRWC

SEQ ID NO: 148049 - protein, 79 aa, Glycine max
  Coding DNA Sequence Number=SeqID_31271
MGQKVMNKTRHSKKDNNTEQLNSNYAHDESRDSSPAAGLVILHLTQTRRRAESLDREDERVSASLFSQPWQSGVKLVSD

SEQ ID NO: 148050 - protein, 153 aa, Glycine max
  Coding DNA Sequence Number=SeqID_31272
  Gene Ontology: Mol. function=sodium:dicarboxylate symporter activity; Cellular component=membrane; Biological process=dicarboxylic acid transport
  Homolog annotation: Hit_ID=Q9LT83; Match level="QueryCoverage=57%, HitCoverage=17%, E-value=4e-34, Identity=78%"; Hit description =Arabidopsis thaliana genomic DNA, chromosome 3, P1 clone: MLD14
MVGSYVHFSDMTTGAKQGLEWVQKRPMKTMVMARRQCGDGKAALEIHAPNRRAYCNGAVLVKEVIVSFFILMEQGKATRQDLDQWCEELIKEEFDEECNFDVDDAVEKLEKLGIVTRDSVGRYQCVGLKRANDIIGTTTEELVLKAKQGSMTS

SEQ ID NO: 148051 - protein, 75 aa, Glycine max
  Coding DNA Sequence Number=SeqID_31273
MAESYGLLSEVSVGEGGLQVVSQQCYEVASRLRVNFHKSSLGGVMVPQEGINLGFGVGKISKDLIVAAKETFYWW

SEQ ID NO: 148052 - protein, 81 aa, Glycine max
  Coding DNA Sequence Number=SeqID_31274
MVAQGMVVATQESNVGGSTGGREGKMKLERWKGKEDSGVGWGSGKGKCEEGERFWLEKKRGGEVGKEERWRSGKDNMEKGE

SEQ ID NO: 148053 - protein, 168 aa, Glycine max
  Coding DNA Sequence Number=SeqID_31275
MVIENRSKRTKIYASGAYSLSSNPETLVEDSKADTPSPIVRLMGKKEPMREINILNTRLAVLREKELEKEYYNILMKDTSTMFESQLQDHQRLNSNVGSECDDNCYFQLSMPLVITMNISIIVGRMGLSSLQECIAAICILHTDHLLIVWMSTLELTNTLELNAYKNL

SEQ ID NO: 148054 - protein, 111 aa, Glycine max
  Coding DNA Sequence Number=SeqID_31276
MGMAKPELRFHSYQRPSQGFINEKDPLKEAKFTKLDVRSDCQAKIRFKVEMVTKDKGNCIDDMVNSGISVIDAFNYMSQGVEGTENVGFTKRDCYNHMNKQKMMMIEAGDA

SEQ ID NO: 148055 - protein, 79 aa, Glycine max
  Coding DNA Sequence Number=SeqID_31277
  Subcellular localization annotation: CTP_CleavageSite=46; ConfidenceScore=5.51e-01
MELPRVKMGLCFSFFLTPSRLFRHSITTVRLRKRRQGAPCSCVVVMTTMRSGSMSGRDTECVFLAQDREHESAWWPRRR

SEQ ID NO: 148056 - protein, 79 aa, Glycine max
  Coding DNA Sequence Number=SeqID_31278
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=55%, HitCoverage=11%, E-value=1e-10, Identity=72%"; Hit description =Protein phosphatase 2C
MAVLVVRIRNGNLVVLNVGDCRTMISRWGVAEALISNDKPFREDERDKIETQEWEWSYVIMPSSMEAGIVKPKANGGIS

SEQ ID NO: 148057 - protein, 87 aa, Glycine max
  Coding DNA Sequence Number=SeqID_31279
MTFSTHNIPTPCCRLVVQMLHKNWVQENRGEDEGSCSWVQENKGEDEGLAIKKQNHGKTIFDPLALRMSKALAAWRLQTDTREVIQA

SEQ ID NO: 148058 - protein, 70 aa, Glycine max
  Coding DNA Sequence Number=SeqID_31280
MGGAVTMMDITGGKNIVVKEFSTSLEEDDLEFLIIHGKCIDDAHVSYFILHGNSINLVNHHEGSFMYTTR

SEQ ID NO: 148059 - protein, 151 aa, Glycine max
  Coding DNA Sequence Number=SeqID_31281
MGMENGEEEIVGHGVNVGTEMHLNSIDEGGDTDDTSGDNSYDKEEDVATIEQNGFCMHKSNLLKNFKGEKVQYTFVCSREGHRKDRGLGVENQKHDAKNETKCDCKAFFRVHIQQRMRLSAISLVSNEIKEAYVWLLDQFLEVMKGKTLVS

SEQ ID NO: 148060 - protein, 352 aa, Glycine max
  Coding DNA Sequence Number=SeqID_31282
  Homolog annotation: Hit_ID=Q9SJN3; Match level="QueryCoverage=60%, HitCoverage=73%, E-value=3e-22, Identity=38%"; Hit description =Expressed protein
MPLALTLLSYSFDDSFSFSLSLEEKQHSERTEKIEYSQIPSYKYNTATTKSMDLETLVSACAGGCSDQKIACEPHADEGDHGGRLPDSPPESFWLSGDAEYDWWDRNAVYERNESTKGNSIISSTNLNSNSNNNSQRFSKNLKSKAAIIGLPKPQKATFADAKSRRNHRPPGNARLFPKRSASVGGKLEGSVVEPSSPKVSCIGRVRSKRDRNRRLRTRQRSISSSTATAATTGSISSAVTRQKSTRSQRKKTGFFESVRAIFRHGRRGKPVQKPDLPQEDSSSSKMKKKRSYGKKARGSTTSSTTNRNDASFEESFSSAAPPPGLGSVNRFASGRRSESWGVGDSEIRVLH

SEQ ID NO: 148061 - protein, 282 aa, Glycine max
  Coding DNA Sequence Number=SeqID_31283
  Homolog annotation: Hit_ID=Q10RR9; Match level="QueryCoverage=32%, HitCoverage=25%, E-value=7e-07, Identity=35%"; Hit description =Expressed protein
NSAEEFEEDTSATSPNVSGEFHRALEAHSYNEIRSMVQAPPQVHHIDDEDSHHRHVLSQVLQPDSHSVHEALAKAKPKSNLTRLVSTYFYHSETASDFCLRLSRSVHRARHLYAPLSDLLAVLPASAPPLSQPQCDRAYELFLQFDREEILSRSPASTASATTSPTSSATSSATSKRRELARLKQLEAVENGTLVVNDINTIDSLVDRLQTAVEGDKAFVRFALDRGRERHPIQEVLNQLRKNQPVLEHLLGDLEQHIYFCFYSVNMARYALLKAICSHQTP

SEQ ID NO: 148062 - protein, 104 aa, Glycine max
  Coding DNA Sequence Number=SeqID_31284
MSGLSEYDDDHALSIRFALNVPLGFFVGILRAKLELIAKRIDELASYPTLVIYSHIRFDYLIHTKMLSCFDFRVSAFSGIAGPSPKAKASSFLTTFRMKKALWL

SEQ ID NO: 148063 - protein, 47 aa, Glycine max
  Coding DNA Sequence Number=SeqID_31285
MSTNGVNWTTLEVAQLAYVDVDDYDVVVNVLSGELSRLRAKHGNDEP

SEQ ID NO: 148064 - protein, 156 aa, Glycine max
  Coding DNA Sequence Number=SeqID_31286
MVDIEVDQTLKNDTEVSDSQFKATKLDCIYDDSNLDFEKPSSQVMKKLEVQDPLEKVNLGDEVNQKQTYFLGFVIHKKGIEMDKNKTKVVLETSPPRNKKELQSLLGKDESDFKWDNIHQKEFEEIKQTLANSPIMTPQSEAEYFSIKIYYCKCLD

SEQ ID NO: 148065 - protein, 385 aa, Glycine max
  Coding DNA Sequence Number=SeqID_31287
  Gene Ontology: Mol. function=protein serine/threonine kinase activity; Cellular component=membrane; Biological process=protein amino acid phosphorylation
  Homolog annotation: Hit_ID=Q8RYK7; Match level="QueryCoverage=85%, HitCoverage=91%, E-value=8e-88, Identity=52%"; Hit description =Putative disease resistance protein kinase
  Pfam annotation: Domain name=Pkinase; Domain location=104-349; Score =15.5; E_value=1.7e-09; Accession=PF00069.15; Description=Protein kinase domain
  Pfam annotation: Domain name=Pkinase_Tyr; Domain location=104-353; Score=22.5; E_value=7.5e-14; Accession=PF07714.7; Description =Protein tyrosine kinase
  Pfam module annotation: Pfam domain module=Pkinase::Pkinase_Tyr; Domain location=104-349::104-353
GGELVHMREGGGGLWVNLDFREWHWKLLQSVIALFGGAAGAVALVGIAIILIWFCLSRQRNVSRTSETGSSDPSQVGRHGAIELPIRDTRRFEMEELSLATKNFSDKNLIGEGKFGEVYKGLLQDGMLVAIKKRRGLASQEFVDEENNLQFLIYEYVPNGSVSSHLYGAGQNPQEKLEFKHRLSIAQGAAKGLAHLHSLSPRLVHKNFKTTNVLVDENFIAKVADAGLRNFLGRVDIAGSSSQVATDEIFLASEVREFRRFSEKSDVYSFGVFLLELLSGKEAIEPPFPDSNQNLVEWVLSNQDRGMMSYIIDRRLESSFTAEGMEEYILLIIRCLDPSSERRPAMSYVEMELDRILEKEMNLTTVMGEGTPTVTLGSQLFKSTK

SEQ ID NO: 148066 - protein, 319 aa, Glycine max
  Coding DNA Sequence Number=SeqID_31288
  Gene Ontology: Mol. function=transferase activity, transferring hexosyl groups; Cellular component=integral to membrane; Biological process=metabolic process
  Homolog annotation: Hit_ID=Q9FN26; Match level="QueryCoverage=97%, HitCoverage=67%, E-value=7e-92, Identity=54%"; Hit description =Flavonol 3-O-glucosyltransferase-like protein
SLAIVLVPARNVPKDRPITVEELSQPPEGYPSSKVVLTGLEAESLMFISVPFGEDNITFYDRITSALRESDAIAIRTSREIEGNFCDYIASQFGKKVLLTGPVLPEEAEGKLEENWANWLDAFANESIVYCAFGSQINLEKDQFQELLLGFELSGLPFLVALKTPRGCESVEEALPEGFEERVKGRGVVSRGWVQQLLILKHPSVGCFVNHCGFGSMWESLMSDKQIVLVPQLGDQVLNTKLLVEELGVAVEVERGGNGWVSKESLSKAIKLVMDGDSEVGARVKKNHMEWKKTGGSPNLMNGYMDRFVQNLQDFPLHG

SEQ ID NO: 148067 - protein, 61 aa, Glycine max
  Coding DNA Sequence Number=SeqID_31289
MAFHLHLRRLLAALSLLQILVLVLNAIQLVSGHNRWGVASHVDEEACGKGGRLCLPGADLA

SEQ ID NO: 148068 - protein, 136 aa, Glycine max
  Coding DNA Sequence Number=SeqID_31290
  Gene Ontology: Mol. function=kinase activity; Cellular component =alpha-glucosidase II complex; Biological process=protein kinase cascade
  Homolog annotation: Hit_ID=Q9SLC0; Match level="QueryCoverage=67%, HitCoverage=43%, E-value=2e-40, Identity=75%"; Hit description =Expressed protein
MIKCKDESKSFSRDRLNDNFCDCPDGTDEPGTSACPNGKFYCRNLGSKPQFIVSSHVNDHFCDCCDGSDEYDGTICCPNTCVMGGNAESTFRNCKSKASKNGVKSEESVHTVFVAAPDLEGDVTGELKETLQFTWH

SEQ ID NO: 148069 - protein, 182 aa, Glycine max
  Coding DNA Sequence Number=SeqID_31291
MVLWELQRVTWVELPLGKRSKLWCFEAKGGHEDLPRGCMPRREGCEKQHAAVAKRRKHAKWKPTSFLLLHHQQSHHHQPQNHNNPTPNLNLKHESPCPKPQQSHHHPQTSKLEIPIINNQTRWGPKPFLGRVKLIFKVQSVQCTVTWFEKFRKAMKARTTMVLAEGNDGVENTWCITDENEV

SEQ ID NO: 148070 - protein, 114 aa, Glycine max
  Coding DNA Sequence Number=SeqID_31292
  Gene Ontology: Mol. function=cysteine-type endopeptidase activity; Cellular component=endoplasmic reticulum; Biological process =proteolysis
  Homolog annotation: Hit_ID=Q1SLM3; Match level="QueryCoverage=99%, HitCoverage=33%, E-value=5e-42, Identity=68%"; Hit description =Peptidase C1A, papain
  Pfam annotation: Domain name=Peptidase_C1; Domain location=1-114; Score=-45.1; E_value=2e-08; Accession=PF00112.13; Description=Papain family cysteine protease
MDTTFAFIKKNGGLTTSKDYPYEGVDGSCNKEKALHHAVNISGYERAPSKDEAMLKVAAANQPISVAIDAGGYAFQLYSQGVFSGVCGKKLNHGVTIVGYDKGTFDKYRTVKNS

SEQ ID NO: 148071 - protein, 66 aa, Glycine max
  Coding DNA Sequence Number=SeqID_31293
MEAKFGACFEATIQANWLRNFISELGIVDNIARSLQMYCDNSTVGLPPKTFIEHVESMYIIVIDDH

SEQ ID NO: 148072 - protein, 100 aa, Glycine max
  Coding DNA Sequence Number=SeqID_31294
MASYLWRKYADYLYTKWEKTFLWDMVEPYRRPKSFTPLVTIYIAAFYSGVIGAAITEQLYKEKNGEALLRVPSGSCCLGTLLDIDSNLYDFFISSVMQLF

SEQ ID NO: 148073 - protein, 62 aa, Glycine max
  Coding DNA Sequence Number=SeqID_31295
MRVSGGHFGTLAGVVFTPSLSSRLFDEEKYWEEHPGKAVPLMRPKFYGGPWRVMGGNEPPSK

SEQ ID NO: 148074 - protein, 186 aa, Glycine max
  Coding DNA Sequence Number=SeqID_31296
  Gene Ontology: Mol. function=protein binding; Cellular component =integral to membrane; Biological process=protein amino acid phosphorylation
  Homolog annotation: Hit_ID=Q9ZTJ6; Match level="QueryCoverage=99%, HitCoverage=62%, E-value=7e-33, Identity=40%"; Hit description=Hcr2 -5D
  Pfam annotation: Domain name=LRR_1; Domain location=102-124; Score =13.2; E_value=0.95; Accession=PF00560.23; Description=Leucine Rich Repeat
  Pfam annotation: Domain name=LRR_1; Domain location=126-148; Score =16.9; E_value=0.074; Accession=PF00560.23; Description=Leucine Rich Repeat
  Pfam annotation: Domain name=LRR_1; Domain location=150-172; Score =15.0; E_value=0.28; Accession=PF00560.23; Description=Leucine Rich Repeat
  Pfam annotation: Domain name=LRR_1; Domain location=30-52; Score =18.5; E_value=0.024; Accession=PF00560.23; Description=Leucine Rich Repeat
  Pfam annotation: Domain name=LRR_1; Domain location=54-76; Score =15.0; E_value=0.27; Accession=PF00560.23; Description=Leucine Rich Repeat
  Pfam annotation: Domain name=LRR_1; Domain location=6-28; Score=12.1; E_value=1.5; Accession=PF00560.23; Description=Leucine Rich Repeat
  Pfam annotation: Domain name=LRR_1; Domain location=78-100; Score =18.5; E_value=0.024; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=102-124::126-148::150 -172::30-52::54-76::6-28::78-100
MTAFPNLEVLYLYGMSLRGSIPKEISTLTKLTDLYLSNNHLQGSIPVELGSLTQLVLLSLYNNSLTGSIPSTLSQLVNLRYLLLSFNQLEGAIPAELGNLTQLIGFYLSNNSITGSIPSSLGQLQNLTILLLDSNRIQGPIPEEFGNLKSLHILYLSNNLLTSTIPPTLGRLENLTHLFLDSNQIE

SEQ ID NO: 148075 - protein, 346 aa, Glycine max
  Coding DNA Sequence Number=SeqID_31297
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=94%, HitCoverage=98%, E-value=1e-116, Identity=61%"; Hit description =Peptidase C1A, papain
  Pfam annotation: Domain name=Inhibitor_I29; Domain location=44-101; Score=95.2; E_value=2e-25; Accession=PF08246.2; Description =Cathepsin propeptide inhibitor domain (
  Pfam annotation: Domain name=Peptidase_C1; Domain location=131-345; Score=394.6; E_value=1.4e-115; Accession=PF00112.13; Description =Papain family cysteine protease
  Pfam module annotation: Pfam domain module=Inhibitor_I29::Peptidase _C1; Domain location=44-101::131-345
MITTAPFPYITGIIEGWRKQRLSLTLVFLTYELWLSEVCTSERHEKWMAQYGKLYTDAAEKEKRFQIFKNNVQFIESFNAAGDKPFNLSINQFADLHNEEFKASLINVQKKESGVETATETSFRYESITKIPVTMDWRKRGAVTPIKDQGNCGSCWAFSIVAAIEGIHQITTGKLVSLSEQELVDCVKGKSEGCNFGYKEEAFEFVAKNGGLASEISYPYKANNKTCMVKKETQGVAQIKGYENVPSNSEKALLKAVANQPVSVYIDAGALQFYSSGIFTGKCGTAPNHAATVIGYGKARGGAKYWLVKNSWGTKWGEKGYIRMKRDIRAKEGLCGIATNASYPTV

SEQ ID NO: 148076 - protein, 373 aa, Glycine max
  Coding DNA Sequence Number=SeqID_31298
  Gene Ontology: Mol. function=cysteine-type endopeptidase activity; Cellular component=endoplasmic reticulum; Biological process =proteolysis
  Homolog annotation: Hit_ID=Q6F6A4; Match level="QueryCoverage=87%, HitCoverage=89%, E-value=1e-112, Identity=61%"; Hit description =Cysteine protease
  Pfam annotation: Domain name=Inhibitor_I29; Domain location=38-95; Score=105.3; E_value=1.8e-28; Accession=PF08246.2; Description =Cathepsin propeptide inhibitor domain (
  Pfam annotation: Domain name=Peptidase_C1; Domain location=126-338; Score=403.1; E_value=4.1e-118; Accession=PF00112.13; Description =Papain family cysteine protease
  Pfam module annotation: Pfam domain module=Inhibitor_I29::Peptidase _C1; Domain location=38-95::126-338
MAFTGQKQHMLALFLFLAVGISQVMPRKLHQTALRERHENWMAEYGKMYKDAAEKEKRFQIFKDNVEFIESFNAAGNKPYKLGVNHLADLTLEEFKDSRNGLKRTYEFSTTTFKLNGFKYENVTDIPEAIDWRVKGAVTPIKDQGDQCGSCWAFSTIAATEGIHQISTGNLVSLSEQELVDCDSVDDGCEGGFMEDGFEFIIKNGGITSETNYPYKGVDGTCNTTIAASPVAQIKGYEIVPSYSEEALQKAVANQPVSVSIHATNATFMFYSSGIYNGECGTDLDHGVTAVGYGTENGTDYWIVKNSWGTQWGEKGYIRMHRGIAAKHDTKNEVTLSKNGNRNEEKEEILKQAQPNSGAKRASGAKRATKCRR

SEQ ID NO: 148077 - protein, 69 aa, Glycine max
  Coding DNA Sequence Number=SeqID_31299
MAPASGWIKVNTDGAAQGSPGVAASAGLFKDDQGSFLGGYVYKGSKYCLYKHKDKIEGKETPRQSSDHA

SEQ ID NO: 148078 - protein, 155 aa, Glycine max
  Coding DNA Sequence Number=SeqID_31300
MNQSKKQKYYVVFIGKKLDIYYSWDECKAQTDEYPNNCHHSFKLYDKAQFHWLDHCRKYGIEASQANVKPQKYARVPPLNSFSPTEGQLCLNISLPPLSTRYKSLGSLVARNFKEDVDNDIGMQTMKNDKLWLQMQLSIVSDQAQALNAQLRGGQ

SEQ ID NO: 148079 - protein, 123 aa, Glycine max
  Coding DNA Sequence Number=SeqID_31301
MELYVIRVGKQRTNYIYIKRTIQDDDKYNWWSKPAHNHHIGFKIEGVVAIVHYDGDMVSTCDGILLECPNDPKFIKISEEMLRVTLRKAVIDAIRVGRSLFEVFYHKLVYVSNGYVEYDGMEL

SEQ ID NO: 148080 - protein, 65 aa, Glycine max
  Coding DNA Sequence Number=SeqID_31302
  Gene Ontology: Mol. function=cysteine-type endopeptidase activity; Cellular component=endoplasmic reticulum; Biological process =proteolysis
  Homolog annotation: Hit_ID=Q6J270; Match level="QueryCoverage=96%, HitCoverage=18%, E-value=1e-22, Identity=67%"; Hit description =Putative cysteine protease
KCGTAPNHAVTVIGYGKARGGAKYWLVKNSWGTKWGEKGYIKMKRDIRAKEGLCGIATNASYPTV

SEQ ID NO: 148081 - protein, 299 aa, Glycine max
  Coding DNA Sequence Number=SeqID_31303
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=98%, HitCoverage=47%, E-value=4e-76, Identity=56%"; Hit description =Timing of CAB expression 1 protein
  Pfam annotation: Domain name=Response_reg; Domain location=30-142; Score=45.2; E_value=2.2e-10; Accession=PF00072.14; Description =Response regulator receiver domain
MESGDEINLNIESGNNGKSGGDGFVDRSKVRILLCDNDSKSSQEVFTLLLRCSYQVTSVKSARQVIDALNAEGQHIDIILAELDLPMKKGMKMLKYIAQDKEFRRIPVIMMSAQDEVSVVVKCLRLGAADYLLLWEMLKILEEPHCIPIIRLPHLCNSLGAMPNTLGLVEKNILNYDFDLVVSDPSDANTNSTTLFSDDTDDKSKRSTNPEVGISVQQEQEVGFFFQLWAFFANNSTFQSVNIDIHSTIAIAAAVEEPPDAHASECGPDVDGVNDHQTAHFSSGPKKSELRIGESSAFF

SEQ ID NO: 148082 - protein, 288 aa, Glycine max
  Coding DNA Sequence Number=SeqID_31304
MDNVTILSDDDRHYSPVKKNKKVHRRRLEAEGEKFSVMLVGDVSCDLCKNFMRRGLTWGKHWRKGIGESAKQGSKSRAVLFIAKKGCVKNAGSLSPKSKAENVVGYADLRQRSCVWVCMKHWLRRLEMDRSTFDELNGGVFVGSPATNDKGDHRISFVDSAFTYVNQYMIEPLDIPTNPLILASMRSFNGDFPPWRCSGRQMRRGERRRHPLGNKPWKKELHHQDEPWIRSLEGCFNEGKERGRERERGEHEIEGIKEGEKWNFEVCLTRLSFIKVTTSVTHASIYRL

SEQ ID NO: 148083 - protein, 36 aa, Glycine max
  Coding DNA Sequence Number=SeqID_31305
MQNPQNCKNNKVFWYNNIDFSVKDLHLLLFLGNDLL

SEQ ID NO: 148084 - protein, 270 aa, Glycine max
  Coding DNA Sequence Number=SeqID_31306
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=89%, HitCoverage=43%, E-value=3e-85, Identity=65%"; Hit description =Timing of CAB expression 1 protein
  Pfam annotation: Domain name=CCT; Domain location=196-234; Score =67.9; E_value=3.2e-17; Accession=PF06203.4; Description=CCT motif
MEVMHQTCAQQGVNDLQIRENGEAYESQSQDDLPSSTSIPDSLSIERSCTPPASMEVSQQKHYREENLHQGVMHPRNGTHCSELEVSGMASQQVYPYYISGVVNHVMMPSSAQMYHQKNIQDLQNHPSSAMISQYSHLPQGGPHGTGMTSFPYYPMSICLQPGQIPNPHSWQSFGNSSSSEAKLSKVDRREAALMKFRQKRKERCFDKKIRYVNRKRLAERRPRVRGQFVRKLKGANADLNGQPASIDYDEDDEEDEDDQGARDSSPEDA

SEQ ID NO: 148085 - protein, 148 aa, Glycine max
  Coding DNA Sequence Number=SeqID_31307
  Gene Ontology: Mol. function=cysteine-type endopeptidase activity; Cellular component=vacuole; Biological process=proteolysis
  Homolog annotation: Hit_ID=Q9AUC7; Match level="QueryCoverage=95%, HitCoverage=42%, E-value=3e-35, Identity=53%"; Hit description =Cysteine proteinase
  Pfam annotation: Domain name=Inhibitor_I29; Domain location=38-94; Score=75.1; E_value=2.2e-19; Accession=PF08246.2; Description =Cathepsin propeptide inhibitor domain (
MAFTSKIQQNLALFLLLSIEISQVMSRKLHETSLREEHENWIARYGQVYKVAAEKETFQIFKENVEFIESFNAAANKPYKLGVNLFADLTLEEFKDFRFGLKKTHEFSITPFKYENVTDIPEALDWREKGAVTPIKDQGQCGKIKKII

SEQ ID NO: 148086 - protein, 98 aa, Glycine max
  Coding DNA Sequence Number=SeqID_31308
  Gene Ontology: Mol. function=ATPase activity, coupled to transmembrane movement of substances; Cellular component=integral to membrane; Biological process=transport
  Homolog annotation: Hit_ID=Q9LZB8; Match level="QueryCoverage=100%, HitCoverage=15%, E-value=1e-25, Identity=58%"; Hit description=ABC2 homolog 12
MMMQMLVISPTLSLISAMIVPCMVLVVTFLGQELRKISKEAHVSIAALSAYLNEVLPAILFVKANNAQSCENTRFKRLALMDYNARLKKKKMKALIPQ

SEQ ID NO: 148087 - protein, 102 aa, Glycine max
  Coding DNA Sequence Number=SeqID_31309
MSNRTCLTVQPCPVTAEATDTASHQSRTRMRVWCESDAGHADDEPCSCFLALQFQGEIEFCSRSTAKSIIANPSPWIPSSCWREDFLTSRSSTSKIDTLGKS

SEQ ID NO: 148088 - protein, 609 aa, Glycine max
  Coding DNA Sequence Number=SeqID_31310
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=86%, HitCoverage=54%, E-value=3e-72, Identity=41%"; Hit description=Chromo
MAKNTRLKDLQTEICTHWDDICRISQTMDMRYQEQNDKMLQIQNSMDQIQLAMNLLLQNASQPPGSSSNNGSPMVQPINASLLVKEISLGFPHFDGTTPVMEWIFKAEKFFNYHNTPDASRVDIAAMHFDKDVVAWFQMSQKLYLVSTWSELIRALESQFDPSPFDCPMAELFKLQQTGSVSDYYLKFMSLANRSLGLSNEALLNCFISGLNPNIRRDVVAMCPLTLLREVALAKLFEEKYGPVLKPFRNSYNHKYSQISCTPVSINAQQKTQIKSSLPPLLPTPPGPPIRSSNVKRFTPAEMQLRREKGLCYFCDEKLPFNHKCPNRQFLLLLMEDNNEDLISTIVPQGTQEDEIVESEDHHLSFNALKGGRGVGTIRVMVGNGNYMSAEGLVKQLKFLRKGKFTTLQGDCELVPEQAQLHFIRRMVATNSIAEVYSLQLMEPDVAPKAFNAITIKDSFLIPTMDEFIDELFGASFFSKLDLRSGYHQILLNSDDRHKTTFRTHHGIAMEGTKLEAIQKWLEPSNLKQLRAFLGLTDTFQQLKIVMTSAPVLTIPNFKEIFVLETDASRSGVSVVLSQNKHPIAYFSKKLCLRMQKQSAYIREFYVIT

SEQ ID NO: 148089 - protein, 310 aa, Glycine max
  Coding DNA Sequence Number=SeqID_31311
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=28%, E-value=9e-57, Identity=32%"; Hit description=Chromo
  Pfam annotation: Domain name=zf-H2C2; Domain location=5-46; Score =33.1; E_value=9.5e-07; Accession=PF09337.1; Description=His(2) -Cys(2) zinc finger
MEEFHSSKIGGHAGVNRTTTRIGAQFYWNGMRSDISKFVRECAICQQAKVDHVLPAGLSKFGYFIPLKPEFNNKVVDELFITNIVKIHGTTLAMSSSYHPQSDGQTENLNKTIEIYLRCFVFEHPKTVFGRPPPAVMHYEVDPKDPDPLKDLLQLRDQLLSKLKVKLQPYRQHSVALRKHQKLGLCYFGPFPVIERIGTVAYKVQLLESAKIHPVFHIALLKPFHGKSSPPYLPFPLTSSELGPTLCPWKVLDVRVVKRLEATFNLKDKVVFDEEDNVTEGHVAHEPHSEGGRRSTRLRRKNIRLEDYTL

SEQ ID NO: 148090 - protein, 105 aa, Glycine max
  Coding DNA Sequence Number=SeqID_31312
MTVTYMCVPTSWEQGGRKGEGRQERRWVKTEEVSERGWSNKSKQEGQKEEGGRMEVEDTGGSHYTGGGSSSRSCCIHLQGGASGGWRVHGNGEGFRVLEKEKGSK

SEQ ID NO: 148091 - protein, 609 aa, Glycine max
  Coding DNA Sequence Number=SeqID_31313
  Gene Ontology: Biological process=nuclear mRNA splicing, via spliceosome
  Homolog annotation: Hit_ID=Q2R240; Match level="QueryCoverage=99%, HitCoverage=100%, E-value=1e-120, Identity=44%"; Hit description =Expressed protein
MGRGLSPMLQREIQNLDKDGDSRKSAMRALKSYVKDLDMKTIPIFLAQVSETKETGSLSGEFTISLYEVLARVHGVKIVPMIDSIMQSIVQTLASSAGSFPLQQACSKVVPAIARYGIDPTTPEEKKRQIIHSLCKPLSDSLLSSQESLTCGAALCLKALVDSDNWRFASDEMVNRVCRNVAVALEGKSAQTNSHMGLVMTLAKRNALIVEAYARLFIQSALRILNAGSEPLEGNSQKRFVAIQMVNFLMKCLDPRSLFSEVEQIIEVMELCQSDKMAYVKGAAFEALQTAKIIVTDKKSRGVKSPASMTGSNFSRKDYMEGESFSGDGDRSLSSISPESQTLDFFNGYASPIESPISTSRPSHNFYERSVNRKLWSHENGGVDVSLKDGLFSKSGHRNASLDHSHYTMDHEFSNGGGDLTGEFAGFMHKSPWHGASRSASTSPLRSCTQGNIKIFMTPRKLIHSLQEDLNDEISDCSEKPNRRIKSLSSGNIKWSPASYSKYDQNGIADHVNYDSKESGSLYGNGDIQFQGGPESVSSTDDIPGNTDLQRPSEVGPESRNGTETVLMEKPFQKTTHKLVCGISFALLAIATPLLWINSQDEGHFLVPT

SEQ ID NO: 148092 - protein, 84 aa, Glycine max
  Coding DNA Sequence Number=SeqID_31314
FEEVTKTHGLRKTPPFDFRHLTEFSWIAVIQQWKLGIANNTLHQDPNLYPWPTPEQFRATVTWPGDRPNFQHMIHGSDLGIPSF

SEQ ID NO: 148093 - protein, 172 aa, Glycine max
  Coding DNA Sequence Number=SeqID_31315
  Gene Ontology: Mol. function=RNA-directed DNA polymerase activity; Cellular component=chromatin; Biological process=RNA-dependent DNA replication
MGNQNRGEDAQYQSGNWIRDIEKIFQAMACLEGQKAEGQVVTWETFKRAFMEKYFPEDVRNMKKMKFLELKQGNIIVAEYAVEFEELVSYFPRYKGRDGESSKCVTFLNGLQPEVKQVVNYQGFAGGSGSKPTTFSTQIICFRCGKLGYILMQSYPARALDRRLQADWARDP

SEQ ID NO: 148094 - protein, 178 aa, Glycine max
  Coding DNA Sequence Number=SeqID_31316
  Homolog annotation: Hit_ID=Q69L69; Match level="QueryCoverage=37%, HitCoverage=8%, E-value=8e-07, Identity=45%"; Hit description =Calcineurin-like phosphoesterase-like protein
MPSPDPRIEPLLVQAGFSDAAKLKQVKIDDALVIALVEGIVPPENALVGSTLKLKWLKVNMFNLPAEHTPQQLATHYKAYILGLIGVVLMLDKSGDRVHLMYLPLLAYLDRVGRYIWVVVWYQTDKVMLQFELFQDIPNPLHNLDKVHYTDMRGHSDTNWAGNTNSGLQFGRKYANMC

SEQ ID NO: 148095 - protein, 336 aa, Glycine max
  Coding DNA Sequence Number=SeqID_31317
MTNPIPETQIPDETLNPNATTEHYPQQEPPPPHTDPQFPETLSLPNPNSPNPNQDQDSTMQDSIPITLTVVDDDDDPEPGAATGGGGGTTTRRTTKRKKKGPKRTALERKSREKLQVIVETLKPIPFTPAKTLDFEKHQSLLQRLGLWDFVHVEFDSALRGDLIAQLIASYVPNYRCGYVNGVRINVNRADLGRALKLPVKKSGGGGAATVDSIDSAESIAFVEEVVYSWMLLHDDEAYIMPNDVLGWLSLIQDGNFEKVDWAGIIWFMVEKELKAPQLVSCYYASHLQHLIKTQHEELFNEGVEAVEEVVEEENDVKEEGEEVEEEEEEEGLKEV

SEQ ID NO: 148096 - protein, 86 aa, Glycine max
  Coding DNA Sequence Number=SeqID_31318
MPRQIVFAIVVEELLFEQQGRVTKNGNHHHWESDDRRGPSTGTLSFNHRREKIVRENSSRVVEGHLVIGVVELRLGVIWGFNWGVE

SEQ ID NO: 148097 - protein, 82 aa, Glycine max
  Coding DNA Sequence Number=SeqID_31319
MAACRSSSPVSAAPSSPYPYLENMAGILGLNASYYLKIGVNMASNDSNVGSRSDNFGSDVVASRSGSGYLSFLIPNENAAPL

SEQ ID NO: 148098 - protein, 578 aa, Glycine max
  Coding DNA Sequence Number=SeqID_31320
  Gene Ontology: Mol. function=RNA-directed DNA polymerase activity; Cellular component=chromatin; Biological process=chromatin assembly or disassembly
  Subcellular localization annotation: CTP_CleavageSite=38; ConfidenceScore=5.52e-01
MTHKLDTLISTLTTKSPAPSPSSPPHVSPTSPSSPHPRVKLDVPRFDGSDPLGWIFKITQYFEYHHTPDQDRLTIASFYMDGRALAWYQWMAGNGQLSSWQSFLHALQIRFAPSHYEDPTGALFKLTQKTTVQAYLSEFEDLANRVVGLPPHFLLSCFVSGLNADIRREVLPLQPLTVTQAAGLARLQEEKLIEARRAFHPRVPPSPSQPLPTNPFSPSLPSLPSNPTTKPLSVIPLKRLTPKELTTRRERGLCFNCDERYHRGHRCNSRVHLLVVDDDERSVEDYTLLGLEPEPPDPSLVNEAQLNLHSLTGPLAPETLRFSGLIADQQVLTLVDGGSTHNFVQDSMVAELGLTPCSTTPLKVMVGNGQFLQCQQVCQAVPLTIQNIVFIVDLHVLPLCGAHGRIIEFQGEDTSTLQPLTSTQVRRLVRTAGATIYLHLSVTPSDTPDTPNPPYPLEIQSLLSRFASLFQPPNALPPSRPTDHHIHLTSNAQPVNVRPYRYLHYQKAEIESQVASMLQKGIIRPSTSPFSSPVLLVRKHDGTWRFCVDYRALNALTIKDCFPIPTIEELLDELGGAS

SEQ ID NO: 148099 - protein, 150 aa, Glycine max
  Coding DNA Sequence Number=SeqID_31321
  Gene Ontology: Mol. function=GPI anchor binding; Cellular component =membrane; Biological process=carbohydrate metabolic process
  Homolog annotation: Hit_ID=Q9M2K6; Match level="QueryCoverage=52%, HitCoverage=44%, E-value=2e-31, Identity=72%"; Hit description =Glucan endo-1,3-beta-glucosidase-like protein 1 precursor
  Pfam annotation: Domain name=X8; Domain location=31-111; Score=126.5; E_value=7.7e-35; Accession=PF07983.3; Description=X8 domain
MPTPKSLVLSLLLLLGLCSGDGGGGAPPQELWCVAKNNAEDAALQAALDWACGAGGADCRPIQRGGPCYDPTSVQNTASFAFNDYFLKHGMTDDSCDFNNNAAVTSLNPIRVGAMGVFLDQRPLHLLDWDPVKISVGAREFLGDGGGFGL

SEQ ID NO: 148100 - protein, 615 aa, Glycine max
  Coding DNA Sequence Number=SeqID_31322
  Gene Ontology: Mol. function=RNA-directed DNA polymerase activity; Cellular component=chromatin; Biological process=chromatin assembly or disassembly
  Pfam annotation: Domain name=RnaseH; Domain location=174-289; Score= -33.1; E_value=0.07; Accession=PF00075.14; Description=RNase H
  Pfam annotation: Domain name=rve; Domain location=371-527; Score =96.0; E_value=1.2e-25; Accession=PF00665.16; Description=Integrase core domain
  Pfam annotation: Domain name=zf-H2C2; Domain location=312-353; Score =28.9; E_value=1.7e-05; Accession=PF09337.1; Description=His(2) -Cys(2) zinc finger
  Pfam module annotation: Pfam domain module=RnaseH::rve::zf-H2C2; Domain location=174-289::371-527::312-353
MPFGLCNAPSSFQATMNSIFRPYLRQFIIVFFDDILIYSTTLEDHVLHLEQAFRILLQEQFVLKLSKCTFAQPQVEYLGHVVSAQGVEPVMDKVQAIQQWPEPNSGRTLRSFLGLAGFYKRFIRGYATIAAPLTKMVTMEPFQWTDQARAAFDHLKQVLTSTPVLRLPNFSLPFTVETDASGTGMGAVLTQQGHPIAYFSKVFPPKLMAASTYVRELFAITAAVKKWRQYLLGRRFHILTDHRSLKEFLTQVIQTPEQQMYLARLMGYDYTIMYRPAAHPDFSVTNDLILHKGRIWLPQALPFISTLLSEYHSTPTGGHMGITKTLARLTENFYWKGLRQDVERFIASCVDCQHTKYETRKPAGLLCPLPIPSKPWEDLSLDFITGLPAFQGHTVILVIVDRFSKGIHLGMLPTRHTAYTVAVLFMDLVGKLHGMPRSLVFDRDPLFLSRFWQELFRLSGTKLRLSSAYHPQSDGQTEVLNRVIEQYLRAFVHKKPSFLGKLLRWVEWSYNTSWNSSSGISPYEITFGKKPANFPRYLEGNSPIVAVEDMLVERQAVFEQIKKKLEKAQNRMKHFADARRRDVHFSVGDMVLVKLRPHRQRTVTGQPSGFSKLDK

SEQ ID NO: 148101 - protein, 99 aa, Glycine max
  Coding DNA Sequence Number=SeqID_31323
  Gene Ontology: Mol. function=chromatin binding; Cellular component =chromatin; Biological process=chromatin assembly or disassembly
  Homolog annotation: Hit_ID=Q1SAV4; Match level="QueryCoverage=70%, HitCoverage=18%, E-value=2e-09, Identity=40%"; Hit description =Integrase, catalytic region
  Pfam annotation: Domain name=Chromo; Domain location=21-66; Score =30.9; E_value=4.6e-06; Accession=PF00385.14; Description='chromo' (CHRromatin Organisation MOdifier
PDTTPYCSTLPSLYENDQLVVTPLAILDTRHSAGSALEVLVQWQGLTPDDTTWENWDQLREEYHLEDKVLPEVVKDDSKEAEGRPKRKKKIPTYLRDFV

SEQ ID NO: 148102 - protein, 42 aa, Glycine max
  Coding DNA Sequence Number=SeqID_31324
MPPGMVKCNMDAAIFVEQESDYEAPTQTRTPDTTLTRTRGHL

SEQ ID NO: 148103 - protein, 243 aa, Glycine max
  Coding DNA Sequence Number=SeqID_31325
  Gene Ontology: Mol. function=metal ion binding; Cellular component =integral to membrane; Biological process=ubiquitin cycle
  Homolog annotation: Hit_ID=Q9SLC4; Match level="QueryCoverage=49%, HitCoverage=54%, E-value=3e-27, Identity=52%"; Hit description=RING -H2 finger protein ATL2K
  Pfam annotation: Domain name=C1_4; Domain location=119-163; Score= -12.7; E_value=0.093; Accession=PF07975.2; Description=TFIIH C1-like domain
  Pfam annotation: Domain name=zf-C3HC4; Domain location=120-161; Score= 36.8; E_value=7.6e-08; Accession=PF00097.15; Description=Zinc finger, C3HC4 type (RING finger)
  Pfam module annotation: Pfam domain module=C1_4::zf-C3HC4; Domain location=119-163::120-161
MNVFDNDHDEEPFGQYHSNVNRTILYVSMVSFAMVLFLVFVLYLYARCVLRGRSRHRAAIRRLTIAALHVSDLDAVAATHRHAEPPNSGLDPAIIASLPTFAVKAKVLEGGCSGATVVECAVCLSALEGEEKAKLLPNCNHFFHVDCIDTWLDSHSTCPLCRAEVKPRLEPQDREGPVGLAIDGAPPLGVGVDGGGESSKINGSNSRISSFRRILSRERSSRRIQPSGYDDEDGGVDQDLERQ

SEQ ID NO: 148104 - protein, 219 aa, Glycine max
  Coding DNA Sequence Number=SeqID_31326
MEVETLEDRITWELGYNVRTKFLGDDMVLLPGMSDDKAQLLIQSETESDDSLFYSLEKWTPKCRPNNRVVWLQLWGFLIQVWEMKNLRRAVAAIGDVIESDDDTEDRRRLDRARVLVRTPLLPLIRSEVIVRVGELEYRVWIVEETGFEGGSNRKGSSPSDGWSEMITSDDEGEVGDVLDDTNTNFSFSPELPNQKLSPSRTQRAEGGTDVRCCDLRPL

SEQ ID NO: 148105 - protein, 269 aa, Glycine max
  Coding DNA Sequence Number=SeqID_31327
CAEKGTGHPEAKHYPHVLSRGGYEYLEKKLMDEKKKKKLEETAQSESNDTMIDPSSPIKRHVKWKMARTKKTGQMMSKAAKQIAEKIDSLEEQASHGSFVAHGRQDVLTAAMGQPEHPGRVCATGANVTIKQYFGTAPRTSRTSSSMAPEDLEQLTQQIRDQLEESITEKSQMQSQGLALLPEPEVGPSAARVSTKESCVDPLGNDLYTGDLDKCGLYIEENSPRLVALGRVYEGSTTVHNIPLLHDQVKVGVEEVKDADALIPVPTEE

SEQ ID NO: 148106 - protein, 77 aa, Glycine max
  Coding DNA Sequence Number=SeqID_31328
MLHSLNQRLLLGGLSSRQKGSTKCGYYVMHWMSTIILGTFRNNWEAYFNDPRPLEPERLKALRIQWTQYYLRVRDQT

SEQ ID NO: 148107 - protein, 92 aa, Glycine max
  Coding DNA Sequence Number=SeqID_31329
MRRLGFSEEGRGSNAKAAARRNRGKFYYTKHSKAVFNNRLRMLKCARCMGIDIGSEGSRPLGVYGVKAMYWIFGVLGKFSKKTYDTNVFYKW

SEQ ID NO: 148108 - protein, 116 aa, Glycine max
  Coding DNA Sequence Number=SeqID_31330
  Gene Ontology: Mol. function=chitin binding; Cellular component =extracellular region; Biological process=chitin metabolic process
  Homolog annotation: Hit_ID=Q86AI8; Match level="QueryCoverage=94%, HitCoverage=29%, E-value=8e-13, Identity=37%"; Hit description =Similar to Homo sapiens (Human). Mucin 2
MTGPLNESISCFLIRVDPWILEPIAFIGLHVLAFRGLHALTFRGLHVLTNRGLHALTFRGLHVLAFRGLHALTFRGLHVLTFRGLHVLAFRGLHTLSFSGLYALAFRGLDTLAFKG

SEQ ID NO: 148109 - protein, 104 aa, Glycine max
  Coding DNA Sequence Number=SeqID_31331
  Homolog annotation: Hit_ID=Q94AL9; Match level="QueryCoverage=31%, HitCoverage=6%, E-value=2e-08, Identity=72%"; Hit description =Alanine--glyoxylate aminotransferase 2 homolog 2, mitochondrial precursor
MKIVTHQNIRQHEVLHSHPPIHLLPRTQVQDHHRIQTQQHTGTHVTSPLRHSKFTFQSSITLHKNLTLQSRYYGNVFRITPPLCFTKEDADFVADAMDLTLSRM

SEQ ID NO: 148110 - protein, 166 aa, Glycine max
  Coding DNA Sequence Number=SeqID_31332
  Gene Ontology: Mol. function=cysteine-type endopeptidase activity; Cellular component=endoplasmic reticulum; Biological process =proteolysis
  Homolog annotation: Hit_ID=Q6Y1E4; Match level="QueryCoverage=73%, HitCoverage=36%, E-value=2e-42, Identity=62%"; Hit description =Cysteine protease 12
  Pfam annotation: Domain name=Peptidase_C1; Domain location=1-126; Score=65.0; E_value=2.4e-16; Accession=PF00112.13; Description =Papain family cysteine protease
IKNGGITTKANYPYKGVNGTCNTTIAASTVAQIKGYETVPSYSEEALQKAVANQPVSVSIDANNGHFMFYAGGIYTGECGTDLDHGVTAVGYGTTNETDYWIVKNSWGTGWDEKGFIRMQRGITVKHDTKNEDTLSNNGNRKEEKEEILKQAQPNSGAKRATNCRR

SEQ ID NO: 148111 - protein, 58 aa, Glycine max
  Coding DNA Sequence Number=SeqID_31333
  Homolog annotation: Hit_ID=Q153F8; Match level="QueryCoverage=94%, HitCoverage=16%, E-value=9e-20, Identity=80%"; Hit description =Pectin acetylesterase
MKGFRNQMLNAIKGFSRSPQNGLFINSCFAHYQSERQDTWFADNSPVIGNKVGALSCL

SEQ ID NO: 148112 - protein, 52 aa, Glycine max
  Coding DNA Sequence Number=SeqID_31334
MSVKNLIGRLRVHDKTNHTLVSQVTLTRLKGAFKPGVFTLKAYTSKSPSGPL

SEQ ID NO: 148113 - protein, 604 aa, Glycine max
  Coding DNA Sequence Number=SeqID_31335
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=96%, HitCoverage=48%, E-value=0.0, Identity=72%"; Hit description =Putative phospholipid-transporting ATPase 9
MRGGRRGKIKLQFSKIYSFACGKTIFKREHSKIGGHGHSRVVFCNEPDRFEGGIFNYADNSVRSTKYTVATFLPKSLFEQFRRVANFYFLVAGILAFTKLTPYTAVSAILPLSIIIGATMVKEGIEDWRRKKQDIEVNNRRVKLHEGDGIFKYTEWKNLRVGNIVKIMKDEFFPADLLLISSSYEDAVCYVETMNLDGETNLKIKQGLDVTSSLQEDFKFHDYRAVIKCEDPNANLYSFVGSMEFGEQKYPLSAQQLLLRDSKLRNTDYVFGAVIFTGHDTKVIQNSTDPPSKRSKIEKKMDKIIYFLFCVLFLIAFVGSILFGIATKGDLDNGLMKRWYLRPDSSTIFFDPKRAAAAAIFHFLTALMLYNFFIPISLYFSIEMVKVLQSIFINQDIHMYYEEADKPALARTSNLNEELGQVDTILSDKTGTLTCNSMEFIKCSVAGVAYGRGVTEVEQAMGRSNGSPIFHEHINGLESKSNEIRDSLDRKEPSKGFNFTDERIMNGNWVNEPYADVIQKFFRLLAICHTAIPEVDEETGNVSYEAESPDEAAFVIAAREVGFKFYKRTQTCLSIYELDPVSGNEVERTKHVDPEVLPHMGPRV

SEQ ID NO: 148114 - protein, 115 aa, Glycine max
  Coding DNA Sequence Number=SeqID_31336
  Gene Ontology: Biological process=cell division
  Homolog annotation: Hit_ID=Q9SZA4; Match level="QueryCoverage=96%, HitCoverage=27%, E-value=3e-12, Identity=41%"; Hit description=WD -repeat protein-like protein
MDAGPLSFSPIIETRSRYPFQQQFQKKSSKGNCEHHQLDRFIPPNRSAMDFDYAHYLCLLRGTKLAELFNMNRLRILAFKNKPSKPVDLLHPQISTLIRQNKPAKPRRVIPQVHY

SEQ ID NO: 148115 - protein, 366 aa, Glycine max
  Coding DNA Sequence Number=SeqID_31337
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SAF5; Match level="QueryCoverage=97%, HitCoverage=27%, E-value=1e-133, Identity=70%"; Hit description =Putative phospholipid-transporting ATPase 11
MSVIVKDEEGKIFLLCKGADSVMFERLANNGRKFEGKTVEHVREYADTGLRTLVLAYCELDEQEYKEFDDKFSEVKNSVVADQETLIEEVSDKIERNLILLGATAVEDKLQNGVPDCIDKLAQAKIKIWVLTGDKMETAINIGFSCRLLRQGMKQIIIHLEIPDIQALEKVGDKMAIAKAHPSSASIDSCHLPFVTCFVLSAAHGESATHASRESVHHQISEAAQLLSASRGTCQTSALIIDGKSLTYALEDNMKNMFLELASHCASVICCRSSPKQKALVTRLVKYGTGKTTLAIGDGANDVGMLQEADVGIGISGVEGMQAVMSSDIAIAQFRYLERLLLVHGHWCYRRMSSMVLPLKLEPNIL

SEQ ID NO: 148116 - protein, 111 aa, Glycine max
  Coding DNA Sequence Number=SeqID_31338
MGFKHLHAFNLVMLRNIHASHVVIKQGVLRRIGNGESIHVWTLPWLNNDLNPFVSTNSNNDNFDFTVSDLIEHDNFAWRNDILAICEILGTTSHGHPRLSSTERSEISVIH

SEQ ID NO: 148117 - protein, 96 aa, Glycine max
  Coding DNA Sequence Number=SeqID_31339
  Gene Ontology: Mol. function=structural constituent of ribosome; Cellular component=ribonucleoprotein complex; Biological process =translation
  Homolog annotation: Hit_ID=P49200; Match level="QueryCoverage=54%, HitCoverage=43%, E-value=3e-11, Identity=66%"; Hit description=40S ribosomal protein S20-1
  Pfam annotation: Domain name=Ribosomal_S10; Domain location=6-73; Score=-24.0; E_value=0.0085; Accession=PF00338.12; Description =Ribosomal protein S10pS20e
MTRCMTLKNLVLENILVCTDLVRGAKDKRLKVKRPVRMPTKVFHITTRKSLCGEVLNMHALCIRSSFAIYLLVCKVWNALSGKFGRRLLKEKGRLS

SEQ ID NO: 148118 - protein, 36 aa, Glycine max
  Coding DNA Sequence Number=SeqID_31340
MTLGIGEVDLEELGIEQGEVQLHNNSQSIIDLAKNQ

SEQ ID NO: 148119 - protein, 409 aa, Glycine max
  Coding DNA Sequence Number=SeqID_31341
  Gene Ontology: Mol. function=nucleic acid binding; Cellular component= chromatin; Biological process=DNA integration
  Homolog annotation: Hit_ID=Q1T4S3; Match level="QueryCoverage=74%, HitCoverage=27%, E-value=4e-81, Identity=43%"; Hit description=Zinc finger, CCHC-type
MKRRSDDDERLMLARMVSNSFFLLPEYAQQGFSVVEEGAMEIAKPEAVLEDEVLMRSQFPELKLKGKHFLLGGGIDKDQGEYEALMRNHTSNLVPLPPDRKPIGCKWVFQEKESADGSINDYKARLVAKGFNQVASFDFSETFSPVWPLAQFDVNNAFLNGFLNETVYMSQPPGFQKSNSTLHLTFQLNSKFSLKQLGSLEYFLGIEVKTLFDKSLTQSKYIKDLLKKTNMAEAQSISFPMASSCKFTKIDSDIFSDPTLYMSVVGALQCLTITRPEISYYVNKVCQFMATPLESHWVAVMRILRYLKGTILHGLHLRPATLGQSYPIRAICDTDWASDVDDRSLAQITAEISWIQTLLTELQVPFDTPVVFCDKQNGVAIAYNEAFLFKHVPTLDQKGRCSYQALFSN

SEQ ID NO: 148120 - protein, 309 aa, Glycine max
  Coding DNA Sequence Number=SeqID_31342
  Gene Ontology: Mol. function=unfolded protein binding; Cellular component=cytosol; Biological process=cellular protein metabolic process
  Homolog annotation: Hit_ID=Q75HJ3; Match level="QueryCoverage=90%, HitCoverage=50%, E-value=1e-135, Identity=87%"; Hit description =Putative TCP-1/cpn60 chaperonin family protein
  Pfam annotation: Domain name=Cpn60_TCP1; Domain location=1-293; Score= -15.1; E_value=6.7e-09; Accession=PF00118.14; Description=TCP-1cpn60 chaperonin family
MLELLIGNNFERLNLNLIRQWFYFLPDAVLLENYSKTEEAKVEELIKAVADSGAKVIVSGGAVGEMALHFCERYKLMVLKISSKFELRRFCRTTGSVAMLKLGQPNPDDLGYVDSVSVQEIGGVRVTIVKNEEGGNSVATVVLRGSTDSILDDLERAVDDGVNTYKAMCRDSRFVPGAAATEIELAKRVKDFSFKETGLDQYAIAKFAESFEMIPRTLAENAGLNAMEIISSLYAEHASGNAKVGIDLEEGVCKDVSTLSIWDLHVTKLFALKYAADAACTVLRVDQIIMAKPAGGPRREQPAGGMDED

SEQ ID NO: 148121 - protein, 55 aa, Glycine max
  Coding DNA Sequence Number=SeqID_31343
MVATTTIVVTVIKIVATDHYITPLSLLAHKSNGGCTNNDSGSDMVVVTMSIIMML

SEQ ID NO: 148122 - protein, 67 aa, Glycine max
  Coding DNA Sequence Number=SeqID_31344
VYSQQSSINKNVEEGGWLVKKCSEEDSKEDLEEDMHGISSQESDCLDPFDCWLLTLPLCNFLPRIGF

SEQ ID NO: 148123 - protein, 52 aa, Glycine max
  Coding DNA Sequence Number=SeqID_31345
MDLALKIDSCQDPTLEMGSRGPDGVGGRVGGRGRGRFVWEEDKGKKGFEWEI

SEQ ID NO: 148124 - protein, 62 aa, Glycine max
  Coding DNA Sequence Number=SeqID_31346
MAKIPRLKDEMLRPEYKYVGQGQVKDTLAKAKLKMLWLRHRQIYSSRGQVKVILDKAMAPTK

SEQ ID NO: 148125 - protein, 32 aa, Glycine max
  Coding DNA Sequence Number=SeqID_31347
MVAGGDMAYIGEKGVNLSSGQRAHLALASQSH

SEQ ID NO: 148126 - protein, 105 aa, Glycine max
  Coding DNA Sequence Number=SeqID_31348
  Gene Ontology: Mol. function=oxidoreductase activity, acting on the aldehyde or oxo group of donors, NAD or NADP as acceptor; Cellular component=mitochondrion; Biological process=metabolic process
  Homolog annotation: Hit_ID=Q9SAK4; Match level="QueryCoverage=63%, HitCoverage=11%, E-value=3e-20, Identity=76%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
MVFSLPPPPIQPSIQRSWRVAEALEYGLVGVNEGVISTEVAPFGGFKQSGLGREGSKYGMDEYLEHAILTIYTTCRGPRRMHCVMDSIPATAIEIGGVAPIQTVG

SEQ ID NO: 148127 - protein, 81 aa, Glycine max
  Coding DNA Sequence Number=SeqID_31349
NDQTLVSACQRTRLCLNGKGVRITNDQTWSLLVNGHDCSEWQRGADNRKGQYDKDYGAADKSKALAPTYPPMRNSDLRSSG

SEQ ID NO: 148128 - protein, 244 aa, Glycine max
  Coding DNA Sequence Number=SeqID_31350
  Gene Ontology: Mol. function=oxidoreductase activity; Cellular component=intracellular; Biological process=lignin catabolic process
  Homolog annotation: Hit_ID=P93366; Match level="QueryCoverage=88%, HitCoverage=31%, E-value=3e-75, Identity=64%"; Hit description =Diphenol oxidase
  Pfam annotation: Domain name=Cu-oxidase; Domain location=72-241; Score=155.7; E_value=1.2e-43; Accession=PF00394.12; Description =Multicopper oxidase
  Pfam annotation: Domain name=Cu-oxidase_3; Domain location=1-62; Score=-19.9; E_value=0.00072; Accession=PF07732.5; Description =Multicopper oxidase
  Pfam module annotation: Pfam domain module=Cu-oxidase::Cu-oxidase_3; Domain location=72-241::1-62
MAEFGIRIMLLLAACLLPLSGEAMVRYYKFNVGQRGTLWWHAHILWLRATVHGALVILPKLGVPYPFPKPNREQVIILSEWWKSDTEAVINEALKSGLAPNVSDAHTINGHPGPIQGCVLHKAKSKNQNLTFDVIRPSQCDSNSNKFSTVAKAKEKMEKKKSGGFKLDVQPGNTYLLRIINAALNEELFFKIAGHELTVVEVDAVYTKPFKTDTILIAPGQTTNVLLTTKHETGKYLVAASPFM

SEQ ID NO: 148129 - protein, 201 aa, Glycine max
  Coding DNA Sequence Number=SeqID_31351
MENMLMQFMETSQASFKANQNSIQNLEIQVGESYSMENCCWEQELQPYNQYEEERISNLENVLMQFMETSEANQHAFQNLEIQVGKLAKEVAELPFLVTKEENFVEVEVHEESLVEEHDSREKYDEKKSILEVNTLPHQLIGKEERHGERDKSLSVILSLITNTSLAMMWKAFLGYMSFMESLAKRRKCKEDVFYVIFMPP

SEQ ID NO: 148130 - protein, 732 aa, Glycine max
  Coding DNA Sequence Number=SeqID_31352
  Gene Ontology: Mol. function=binding; Cellular component =intracellular; Biological process=protein amino acid phosphorylation
  Homolog annotation: Hit_ID=Q2QNV4; Match level="QueryCoverage=94%, HitCoverage=56%, E-value=3e-92, Identity=28%"; Hit description =Pentatricopeptide, putative, expressed
  Pfam annotation: Domain name=PPR; Domain location=180-214; Score =33.3; E_value=8.5e-07; Accession=PF01535.11; Description=PPR repeat
  Pfam annotation: Domain name=PPR; Domain location=282-316; Score =36.4; E_value=1e-07; Accession=PF01535.11; Description=PPR repeat
  Pfam annotation: Domain name=PPR; Domain location=317-351; Score=8.7; E_value=0.7; Accession=PF01535.11; Description=PPR repeat
  Pfam annotation: Domain name=PPR; Domain location=383-416; Score =13.0; E_value=0.21; Accession=PF01535.11; Description=PPR repeat
  Pfam annotation: Domain name=PPR; Domain location=448-482; Score=4.9; E_value=2; Accession=PF01535.11; Description=PPR repeat
  Pfam annotation: Domain name=PPR; Domain location=511-545; Score =39.8; E_value=9.3e-09; Accession=PF01535.11; Description=PPR repeat
  Pfam annotation: Domain name=PPR; Domain location=613-647; Score =27.7; E_value=4.2e-05; Accession=PF01535.11; Description=PPR repeat
  Pfam annotation: Domain name=PPR; Domain location=648-682; Score=5.6; E_value=1.6; Accession=PF01535.11; Description=PPR repeat
  Pfam annotation: Domain name=PPR; Domain location=684-717; Score=2.2; E_value=4.1; Accession=PF01535.11; Description=PPR repeat
  Pfam annotation: Domain name=PPR; Domain location=80-114; Score=45.6; E_value=1.7e-10; Accession=PF01535.11; Description=PPR repeat
  Pfam module annotation: Pfam domain module=PPR::PPR::PPR::PPR::PPR::PP R::PPR::PPR::PPR::PPR; Domain location=180-214::282-316::317-351::383- 416::448-482::511-545::613-647::648-682::684-717::80-114
MSCHGHGFRHGQLLLNLLEACCTLRSLDATKCLHALSITMGHIPKQSIFIHNNIISSYIALGEVLNARKLFDALPHRTVVSYNTLITAYCRRGNVDDAWNLLCHMRGSGFAPTQYTLTGLLSCELLNHSRGVQLQALSIRNGLLDADAFVGTALLGLFGRLGCWDELFLAFEDMPQKSLVTWNSMVSLLARNGFVEECKILFRDLVGTGISLSEGSVVAVLSGLVDSEEDLEYGEQIHGLMVKCGFGCEITAANSLISVYVRCKAMFAVERLFEQVPVENVVSWNTVIDALVKSERPMMALDLFLNMARRGLMPSQATFVAVIHSCTSLRNSVCGESVHAKIIRSGFESDVIVGTALVDFYSKCDKFISAHKCFDQIEEKNVVSWNALITGYSNICSSTSILLLQKMLQLGYSPNEFSFSAVLKSSSMSNLHQLHGLIIRSGYESNEYVLSSLVMAYTRNGLINEALSFVEEFNNPLPVVPSNIIAGIYNRTSLYHETIKLLSLLEKPDAVSWNIVISACARSNSYDEVFALFKHMHSACIHPDSYTFMSIISVCTKLCLLNLGSSLHGLIIKTNLSNYDTFLGNVLIDMYGKCGSIDSSVKVFEEIMYKNIITWTALITALGLNGFAHEAVMRFQNLELMGLKPDALALRAVLSSCRYGGLVNEGMEIFRQMGTRYGVPPEHDHYHCVVDLLAKNGQIKEAEKIIACMPFPPNANIWRSFLEGYSRQEIAN

SEQ ID NO: 148131 - protein, 124 aa, Glycine max
  Coding DNA Sequence Number=SeqID_31353
MAKRKNPIKLTMVGRIEWDIHLPPTTSISAFAFSGIGSGSSKCKVNGAPTKEDGVSSIICLLCRLVIVTFGLGLSEPEGEPIWIGQSGSQKRMQEAIFGCRKQQPEVHGVASFNWARACHLIGP

SEQ ID NO: 148132 - protein, 72 aa, Glycine max
  Coding DNA Sequence Number=SeqID_31354
MACVVELSHYAEDLVLLVQVYLQVLVGDHHQMEYAHALIGEYPICGESFGCQQLFCERIMDCGHGDYELAKS

SEQ ID NO: 148133 - protein, 65 aa, Glycine max
  Coding DNA Sequence Number=SeqID_31355
  Gene Ontology: Mol. function=protein serine/threonine kinase activity; Cellular component=cytoplasm; Biological process=protein amino acid phosphorylation
  Homolog annotation: Hit_ID=Q1SK93; Match level="QueryCoverage=84%, HitCoverage=10%, E-value=8e-21, Identity=91%"; Hit description=EPS15 homology (EH); Protein kinase
MEHPINLDLDVVVLSRMKQFRAMNKLKKVALKVIAENLSEEEIIGLKEMFKSMDTDNSGTITLKS

SEQ ID NO: 148134 - protein, 89 aa, Glycine max
  Coding DNA Sequence Number=SeqID_31356
MGQNEWCWRKATQRVPPIALARYPHAIHPSSLAHSCMLGSASQIGEITLSWFRQSRLQDTLGPLVPPIEVAGWPWSIGSASDTGEIQPV

SEQ ID NO: 148135 - protein, 144 aa, Glycine max
  Coding DNA Sequence Number=SeqID_31357
MVVPRVSHVNIISAFAMHNINMPESFIFMRCGRSIGDQNCYSLDYGVEPSTCFLRKGSSSQGQVWKKECVLQHPYRTRARARVMGEIDEVQEQMKTDMEALKEQIATMMEVMMSMKKMMEVNVAAVAAPSAVAEMDPIAPSGLN

SEQ ID NO: 148136 - protein, 67 aa, Glycine max
  Coding DNA Sequence Number=SeqID_31358
MRLHCHQASQRPSMNTDRPPLLMAHIDPGVGPNISMCVRGAEGSSPKRADNFILKQLARPGEMVTSS

SEQ ID NO: 148137 - protein, 67 aa, Glycine max
  Coding DNA Sequence Number=SeqID_31359
MSALRMVPLSKLLFQRLRHEERWDDERKRMQRNWFQGKALLTPGSVTDQNSKLEKNVDKKSPEWFLP

SEQ ID NO: 148138 - protein, 165 aa, Glycine max
  Coding DNA Sequence Number=SeqID_31360
MEWHVLKTWCHALAYVSLMEWHYWRRNIMLLHTCHSGVTHTGDVVFCSCIGVTCGVTRTRDVEWRVHETWSCTRLATRSSSFHSPLGLLSLVQIEDDSVGCLCLSIGLGIFDRGDKEWSLYVHSPHGKWPKGPQTMEIVRRGVLMQSYPARALDRRLKVDWSKDP

SEQ ID NO: 148139 - protein, 333 aa, Glycine max
  Coding DNA Sequence Number=SeqID_31361
  Subcellular localization annotation: CTP_CleavageSite=50; ConfidenceScore=5.36e-01
MSSFMSNFAIDMGGNDSEGSIQQPPGTMRSFPLGVPPQMILPMGRARPSMASLTKELVPVMMILPPFASGEEGEVIGMLGHLLACIVAITLGHHRPYLPLLAMKLANLEDSYKVVVYAYRSDAPFLKGSHLNVTPTQIHPNSRAMMKLISKIGWVSLNSMSKKLFEFDSNVFRCFKDYFFKVLATNVAADGSVDPCGTAPQSIVSSVAGEGGQPTIEVGPVVSAAEIACSVHSSILTERKQAARLTPDAGRPSSLQDLPPAPSVVEAPASSIVVAATPASLPPLATPAAEVDAPATSTDLVVIPSPTITAPLLSAGVTTISAPEMPPPPSSVP

SEQ ID NO: 148140 - protein, 290 aa, Glycine max
  Coding DNA Sequence Number=SeqID_31362
  Subcellular localization annotation: CTP_CleavageSite=77; ConfidenceScore=5.19e-01
MSLWIIHTPPVMLIHCGNATDSAKVFLQRSLAILGRMDNDTKRFCTRRRPWRQSQTASCLRRLVVLLPSCYAPEWMMMSYLSTVRACSGRKLTWLARMEESELRAAKEKEANNELEEELIMYKKEAVEQHEKGFNKAIRQVGCFAKDLDLGLFDHFKNVKDGVLLDNEGIATKEKEARPWQCMKQGLGNVGINASIVLCGVEKYEIISGLVNHFGGRSFSLMEPKPLAMVVVVLKEWADQGGLPRIDLGFCIPVRLTKDSPKVDLGFDEPGVCSARVVLLHTCHLWSGTY

SEQ ID NO: 148141 - protein, 330 aa, Glycine max
  Coding DNA Sequence Number=SeqID_31363
  Gene Ontology: Mol. function=pectinesterase activity; Cellular component=cell wall; Biological process=cell wall modification
  Homolog annotation: Hit_ID=O04887; Match level="QueryCoverage=96%, HitCoverage=61%, E-value=1e-106, Identity=59%"; Hit description =Pectinesterase-2 precursor
  Pfam annotation: Domain name=Pectinesterase; Domain location=16-316; Score=653.8; E_value=1.3e-193; Accession=PF01095.10; Description =Pectinesterase
MNDLQSSWSSGTSNADFTVAQDGSGTHKTIIEAIDALAAMDSSRPSRPVIYVKSGVYNEKVDIGINLKNVMSVGDGIDQTIVTGNKNVIQGYSTISSATFDVSGDGFWARDMTFENTAGPSGHQAVALRVSSDLSVFYKCSFKGYQDTLLVHSNRQFYRDCHIYGTIDFIFGDASVVFQNCDIFLRRPMDHQTNFITAQGRDDPNKPTGISIQSCQVKPAYDFDSYKDSIRSYLGRPWKQYSRTLFLKTDLDGLIDPKGWGEWNGDFALSTLYYGEYMNTGSGASTQNRVTWPGFRVLNNDDEATPFSVSQFLQGEQWIPATGVPFWSGI

SEQ ID NO: 148142 - protein, 68 aa, Glycine max
  Coding DNA Sequence Number=SeqID_31364
PTYKHPAEMQKCVPRTSFAIDVEQTTATMNTDTFTFTESSPSARKYLTEERNARKKSSAAKITVHPTF

SEQ ID NO: 148143 - protein, 76 aa, Glycine max
  Coding DNA Sequence Number=SeqID_31365
MKRYYRLKAHCSDSIFAFAHHMQPIIEKMDYADEVAANPNAMVVSIYDSSPSRAYVKLIKAELPRTQEALTKALED

SEQ ID NO: 148144 - protein, 114 aa, Glycine max
  Coding DNA Sequence Number=SeqID_31366
MDPKSTLRLMRINVKGSRERIIPSPIFLESLSHGSGDGSPPWEDCIRMIGGASTLMAHRTNVKGSRERIILEGLNNVTLEQALKLNFETSNNQVEYEALIASLILAREVWARKL

SEQ ID NO: 148145 - protein, 120 aa, Glycine max
  Coding DNA Sequence Number=SeqID_31367
MEETHEAPRDHNLVDFKPHLGCAIDGQAFGGIPLPNTLGGPQLPPTVVEKEKFDHIEERLRAIEGGRDYAFTDMEELCLVPDVVIPLKFKVPDFDKYKGTACSKNHLKNVQQENGGILKK

SEQ ID NO: 148146 - protein, 112 aa, Glycine max
  Coding DNA Sequence Number=SeqID_31368
  Homolog annotation: Hit_ID=Q1SAZ0; Match level="QueryCoverage=45%, HitCoverage=3%, E-value=2e-08, Identity=60%"; Hit description =Integrase, catalytic region
MAACPDEVWGRIIDSWKASKLEKGGSDGCALQVSMSNQEKQSPSSPLPFTKEQLDQLYKLLKSQTCRNLPFGGRATRGLMGASCKKGKCVESPPMFIRGKCRKNQKGVVYEL

SEQ ID NO: 148147 - protein, 129 aa, Glycine max
  Coding DNA Sequence Number=SeqID_31369
MMIRNKRILEDLEEREDFFPKAADDILTKKDQAPKHIEVSTDGNPVLNKEGEKKVLTPPQMLGLADEEEVFRVFDLVINVSSSLTCNFVQATNKMKTVVAKPHPSVGKEDLSRKKVIPKDPVWSKKRGR

SEQ ID NO: 148148 - protein, 184 aa, Glycine max
  Coding DNA Sequence Number=SeqID_31370
MKNCRCNLCETLCALRILPRHYSNTMPIRNPVGSQCKHCACQKSCRITIQSLCTPGILSDHCTNTVHQEFCRITVQTLCTLGILSDHYANTVRVRNSARSLCKHCAHKESCQITVHVKNPAGSLCKHYAKYCANTVRVRNHVETLSKHCSWYCALKIPVQTWLLPSLTMRILTTSSMSITKINA

SEQ ID NO: 148149 - protein, 73 aa, Glycine max
  Coding DNA Sequence Number=SeqID_31371
MQLPSEASMNVETGQCSRPTNIVQTESNPVYGPILSNMDYIPPSPLNMDYAPPIVQVDEFMSNETLWHASISS

SEQ ID NO: 148150 - protein, 116 aa, Glycine max
  Coding DNA Sequence Number=SeqID_31372
  Homolog annotation: Hit_ID=Q1S1N3; Match level="QueryCoverage=49%, HitCoverage=17%, E-value=4e-08, Identity=53%"; Hit description =Calcineurin-like phosphoesterase family protein, related
  Pfam annotation: Domain name=DUF1723; Domain location=18-67; Score =50.1; E_value=7.5e-12; Accession=PF08330.1; Description=Protein of unknown function (DUF1723)
MGNEANNINMETRLSSIFKDTKHVTALVERWRPESHIFHFLVGECTITLEDVTLQHGIRVGGRCLGPLTMRQKPWAARVNRNPMYSLVTSGGLSFLGTPNGDVVAYRIRLDNMTPE

SEQ ID NO: 148151 - protein, 246 aa, Glycine max
  Coding DNA Sequence Number=SeqID_31373
  Homolog annotation: Hit_ID=Q84VH5; Match level="QueryCoverage=99%, HitCoverage=42%, E-value=2e-94, Identity=68%"; Hit description =Envelope-like protein
MEWNEMLSNGASGTFPGTFFPDFLALLMSGTSSSTSLSESDEEISFLFLEGIATLLHLDVVGVIGVLFFCAVVLIRPDLVMGVFPFLLCNLSAMPGANFLAMGSSSDSTSSRSMKSPGADRTSAFGVEDVGTSLSASGTEAFFKMLFTKLRIFLSISVSSSLGLVAKLGFSEIFTPCCLLGTSFSGTGPGPGIICMDWILSAGCSWFDGVLEDDGDDGTEGETGDEVSFGEVAMEKQSFGSGFVNI

SEQ ID NO: 148152 - protein, 254 aa, Glycine max
  Coding DNA Sequence Number=SeqID_31374
  Gene Ontology: Mol. function=GTP binding; Biological process=Mo -molybdopterin cofactor biosynthetic process
  Homolog annotation: Hit_ID=Q8ZKV0; Match level="QueryCoverage=46%, HitCoverage=69%, E-value=3e-44, Identity=72%"; Hit description =Molybdopterin-guanine dinucleotide biosynthesis protein B
  Pfam annotation: Domain name=MobB; Domain location=2-96; Score=61.8; E_value=2.3e-15; Accession=PF03205.4; Description=Molybdopterin guanine dinucleotide synthesis protein B
MDVDKPGKDSYELRKAGASQTIVASKQRWALMTETPDEPELDLQWLVSRMDPDKLDFVLVEGFKHEPVPKILLFRQNSGHLVEELVIDEHTIAVASDVPIVTSLPLLDLNNIPQIATWDFPGGGAAHLFRATGSVAPVSAAPPGKMAVRLTAKHKNKRPGLPAEPFVYVAMTAAFPGGGAAHLFRATGSVAPVSAAPPGSRRSAWPQNTKTKGPVFRLSLSFYLMPGSSLLSHGETPHYHRRYGVSLLSSAWGQ

SEQ ID NO: 148153 - protein, 330 aa, Glycine max
  Coding DNA Sequence Number=SeqID_31375
  Gene Ontology: Mol. function=glyceraldehyde-3-phosphate dehydrogenase (phosphorylating) activity; Cellular component=cytoplasm; Biological process=glucose metabolic process
  Homolog annotation: Hit_ID=P34783; Match level="QueryCoverage=98%, HitCoverage=90%, E-value=1e-154, Identity=83%"; Hit description =Glyceraldehyde-3-phosphate dehydrogenase
  Pfam annotation: Domain name=Gp_dh_C; Domain location=153-310; Score =387.7; E_value=1.7e-113; Accession=PF02800.10; Description =Glyceraldehyde 3-phosphate dehydrogen
  Pfam annotation: Domain name=Gp_dh_N; Domain location=4-148; Score =278.4; E_value=1.4e-80; Accession=PF00044.14; Description =Glyceraldehyde 3-phosphate dehydrogen
  Pfam module annotation: Pfam domain module=Gp_dh_C::Gp_dh_N; Domain location=153-310::4-148
MAEGFGRIGRLVARVAMQNDDVELVAVNDPFITTDYMTYMFKYDTVHGQFKNCEIKVKDSKTLLFGSSSVTVFGIRNPEEIPWGEAGADYVVESTGVFTDQDKAAAHLKGGAKKVIISAPSKDAPMFVVGVNEKEYKSDITVVSNASCTTNCLAPLAKVIHDKFGILEGLMSTVHSMTATQKTVDGPSMKDWRGGRAASCNIIPSSTGAAKAVGKVLPSLNNKLTGMSFRVPTVDVSVVDLTVRLEKGASYDEIKAAIKEASEGSMKGILGYTEDDVVSTDFVGDNRSSIFDAKAGISLNNNFVKLVSWYDNEWGYSTRVVDLIRHMASV

SEQ ID NO: 148154 - protein, 307 aa, Glycine max
  Coding DNA Sequence Number=SeqID_31376
  Gene Ontology: Mol. function=helicase activity; Biological process =viral genome replication
  Homolog annotation: Hit_ID=Q9LTU4; Match level="QueryCoverage=96%, HitCoverage=30%, E-value=1e-61, Identity=49%"; Hit description =Helicase-like protein
  Pfam annotation: Domain name=DUF889; Domain location=229-307; Score= -91.6; E_value=2.8e-05; Accession=PF05970.5; Description=Eukaryotic protein of unknown function (DUF889)
MDSNQRYPQGRNLTYAQYLTKFVYVSRRRCWQPRKQGYTIGRLIWVPPSTGDLFYLRMMLSSTKGPQSYKDIRIVENVVYGTFREACLAKDEQCVIFDNIMRVVTTQSGGVYFLYGYGGTGKTFIWKTLSSAIRSNGGIVLTVASSGIALLLLPGGRTTHFKFVIPVSATQNSTCNIHQGGDLTELLKITKLIIWDEASMCHKFSFEALDKSLKDIMHNDKPFGGKVIVFGGDFRQILPVVPRGSHSDIVHTSLNASYIWDHCQILKLTKNMRLQTNAAETNSHDLKQFSDWLLDIGDGKLGEPNDV

SEQ ID NO: 148155 - protein, 254 aa, Glycine max
  Coding DNA Sequence Number=SeqID_31377
  Gene Ontology: Mol. function=DNA binding; Cellular component=nucleus; Biological process=regulation of transcription, DNA-dependent
  Homolog annotation: Hit_ID=Q2HUH8; Match level="QueryCoverage=54%, HitCoverage=46%, E-value=2e-16, Identity=31%"; Hit description =Histidine triad (HIT) protein; Homeodomain-like
MEDAGGGRKKEEWEGGRRGRGREEEREGGRGVAEGRRKGGRLSEGVKVVTVYTMTIIVYTVIFEKLDKGSANEDTHLISSWLNISTDPIVGVGQGKEAFWLRVMESYNKFQAVSLKKTSCTDNDVMLNAYVIWKEDKGTDFGLEHAWQLLKDQSKWLEQFIENCSKRTKISTSRAYSSSSNPKTPSPIVRPMGQKAIERKSKGKRVGISTNPMDLISLEEAMRERNVVDTKLVALREKELEKYYYDILMKDTST

SEQ ID NO: 148156 - protein, 86 aa, Glycine max
  Coding DNA Sequence Number=SeqID_31378
MKEKKELVLWVLQKVRGRGGQQQRWWRKILCASSMILSFDEVLMNFNWWVNFGGGGGASVAHYCDASPCACLGVQYFSMKALLIGA

SEQ ID NO: 148157 - protein, 134 aa, Glycine max
  Coding DNA Sequence Number=SeqID_31379
MHTGARFHPDAARRRVWIVCINIWMMLLLSNLLTSDHHSDLPLPRDHARKTPSGPEEVQQGPRVLALIRGLCRFYDVTTTLISPCRNVSWFMPSRHRDHAYKTLSVPREVQQGPKVSRFDYEPPSILRSARRPQ

SEQ ID NO: 148158 - protein, 80 aa, Glycine max
  Coding DNA Sequence Number=SeqID_31380
MECYLQHLVRQQAANHWGQGFASFACPTLEKFGAEVAWPRDWTEAQAREEPAGSPGAAEEARMDEEMTDLLGFLGGSGAT

SEQ ID NO: 148159 - protein, 177 aa, Glycine max
  Coding DNA Sequence Number=SeqID_31381
MADDNMLSLRVIGFAGADNHVGRWMSLDLPSLDDKGETKVVSVDRCRVLDKGCRQPHDHVGRRMSSDLPSLDDKGDTKVVSVDRRHVFDKGCRRPYDHVGRCMSSNLPSLDDKGETKVVSVNRRRVFEKGLTANGSSFLGDPSIPSSKGKGGNSYPRSRFMDGELRFWLNRLVEGRA

SEQ ID NO: 148160 - protein, 44 aa, Glycine max
  Coding DNA Sequence Number=SeqID_31382
MISPKIRDVDSLASVERAYNAPMGSDVACCVCFTRWWEGLMWAL

SEQ ID NO: 148161 - protein, 300 aa, Glycine max
  Coding DNA Sequence Number=SeqID_31383
  Subcellular localization annotation: CTP_CleavageSite=48; ConfidenceScore=5.11e-01
VKGAAQALFVAHWPSMCGWSHTFCAKRGGTFVHYKVTTRVPKRGRISKCSLDGNKVCINYNPVLAIRQLGYPMRGAPSEENLTPFITRGFNDPSVRLRAVREEEAKAPEESKEVQAIKVELEKTQAVKEKFKAWKEEHDRNKFRGALWGSNSELKLRRDERDQSRVEGLILKDELKACIRSKRSLSQQLSETEGNMLAIIDKYREELNLATAHEHRLVDEYAKVSVEKEARGRVIDSLHREAIMWMDRFTSTLNGSQELPRLLARAKAMTNVYSTPEEIHGLLNYCQHMIDLMAHIIRSR

SEQ ID NO: 148162 - protein, 983 aa, Glycine max
  Coding DNA Sequence Number=SeqID_31384
  Gene Ontology: Mol. function=histone acetyltransferase activity; Cellular component=histone acetyltransferase complex; Biological process=positive regulation of transcription factor activity
  Homolog annotation: Hit_ID=Q1SVS0; Match level="QueryCoverage=94%, HitCoverage=95%, E-value=0.0, Identity=47%"; Hit description =Bromodomain
  Pfam annotation: Domain name=Bromodomain; Domain location=614-703; Score=107.3; E_value=4.4e-29; Accession=PF00439.15; Description =Bromodomain
EKQRFGERKVYTRRKVKKDPKAVASAIENNGTATSTVTNDNSVSNSTVQKSNTGEAKSKSDNVSVQPPARQQAVLEDGDSAQPKVGSGLEDGNSGQPQLEDQNMVQTEVGSGLEDGNKAQPRGEDQNMAQTQEGSRLEDENTAQPPGEDHNLAQTQVNSRLEDGDMAQPQLDDQNMVQPQSEDQNMAQSQSEDHIMAQPQSEDQNMAQPQSEDPNMVHPQSEDQNMAQPLMEDENTALPQLEDENTAQPQLEDENTAQLQGSSKLEDENTAQPQVTSRSEEGNTAQPQMSSRSEEGNTAQPQMSSRSEEGNTAQPQVSSRSEDGNTAQRQVSSRSDDGNTVQLQVSSRTEDGNTAQPQVSSKLEGRKSPQPEVNSRLEDGNSPRPQVNSSLDGNTVQPSAVLVSDDSRSRQPDEPSSLNVQQQDDGPSSPNRQQEAVPSSRDLILGNGVAEPWRRDRIKINLASKSKQQMRELRWKLESELGVVRSLVNRIEVKQRQVGGFGNSDVLIDSGINNVGGAKRAHSEVASACVPREPASTRPLHQLSLSMLENGQGICETVEKEKRTPKANQFYRNSEFLLAKDKFPSAESNKKSKLNWKKQGGGEMGHGFGMGSKFFKSCSSLLEKLMRHKHGWVFNSPVDVETLGLHDYFTIITHPMDLGTVKTRLNKNWYKSPKEFAEDVRLTFRNAMTYNPQGQDVHIMAELLSKIFEDRWAIIESDYNREMRYGFDYRAAPPAPSPLSRRVSAFTPPPLDMRRILDRSDSMTQTPRLMSITPSSRTPAPKKPKAKDPHKRDMTFEEKQKLSTNLQSLPSEKLDAIVQIIKKRNSALNQHDDEIEVDIDSVDAETLWELDRFVTNYKKSLSKNKRKAELARARAEALQQNAIQKSQAPAMAEIPKETQTGELLRISIGMKGVFPNPCLCKGEIKRIMGVGQAVPVAPAVILVLLQVILIVTVPQHLDLMQGRKGPDYALSALLPFHSEDGCV

SEQ ID NO: 148163 - protein, 156 aa, Glycine max
  Coding DNA Sequence Number=SeqID_31385
MCKGWDPGPTGVECIDRNSHSAAPDPSGWLPTGQPHVVCSTQTSVGELRWTPGLTVVHQLPVAGRLRAAVVPRPTPAWGCSTSCLPVELVEARDQSRKPQGPVGLLRVHRVSRGCNTCKLINGVRNQLSHMHTHLCKNGINQLTLRQGKVKVVVAG

SEQ ID NO: 148164 - protein, 96 aa, Glycine max
  Coding DNA Sequence Number=SeqID_31386
MAKFDPKIVMEFYANAWPTEEGVHDMRSWVRGQWIPFDADALSQFLGHPLILAEGQQCKYGQRRRQVSGFDEEAIAQLLCILGQDFTRSAEVSVAT

SEQ ID NO: 148165 - protein, 86 aa, Glycine max
  Coding DNA Sequence Number=SeqID_31387
AALREKLNKIMSSEYFTTTPEMKAPVEVAAAAAGGNYVSFHVPVHGSVVPVEVEQPVFQSQEKGHGYVTFSVAGYGVATFVVGKAL

SEQ ID NO: 148166 - protein, 56 aa, Glycine max
  Coding DNA Sequence Number=SeqID_31388
MVLHLFCDMNSTDTLQFSLLVAFGTAIQGHGSEEDPSDPEGELLKDEVEAEAGKCR

SEQ ID NO: 148167 - protein, 87 aa, Glycine max
  Coding DNA Sequence Number=SeqID_31389
MEIPSATETQMPKGCILSSILSAIDEYPETLIRELVPPPFINRSLIVNLMSEKGVRPQPVRKTNYLIFIYMIESIAHQPAFQASYSL

SEQ ID NO: 148168 - protein, 229 aa, Glycine max
  Coding DNA Sequence Number=SeqID_31390
  Homolog annotation: Hit_ID=Q6AVI7; Match level="QueryCoverage=93%, HitCoverage=43%, E-value=4e-40, Identity=43%"; Hit description =Putative glycine rich protein
MAATASNNDVAAANDGPVMSLINKRLRALRKKLNRILAMEEAVTLGKPLNKEQEEVLRSKPSVLALIDELDKLRQPLATALSEELQINGTSSQNPRHETETENETLAESSGSTEPNSNSRNDVVVEDLLNLLYFGSLFDVKSDFASTMLTRTHERGCCLTYDYVTDDATDLLGEKDLDSISALRGLLVSRPADSSFSHKNALHRCVEHAKLWLAKSEQPIGPDADVTCM

SEQ ID NO: 148169 - protein, 75 aa, Glycine max
  Coding DNA Sequence Number=SeqID_31391
MWGYRMVIRTFRQPGENEPVDAQRLTSSSTPFIILTHEVSFRQPGANKLVDAQGLTSSSAPFVNQGQTSPLTRRD

SEQ ID NO: 148170 - protein, 60 aa, Glycine max
  Coding DNA Sequence Number=SeqID_31392
MKFLELKQGNMVVADYTLKFEELSRIYDEDSRERTAHYKNVDPMKDDVGLKTLFRSNQST

SEQ ID NO: 148171 - protein, 1881 aa, Glycine max
  Coding DNA Sequence Number=SeqID_31393
  Gene Ontology: Mol. function=RNA-directed DNA polymerase activity; Cellular component=chromatin; Biological process=chromatin assembly or disassembly
  Pfam annotation: Domain name=Chromo; Domain location=1580-1626; Score= 23.4; E_value=0.00082; Accession=PF00385.14; Description='chromo' (CHRromatin Organisation MOdifier
  Pfam annotation: Domain name=Peptidase_M17; Domain location=1599 -1874; Score=400.7; E_value=2.1e-117; Accession=PF00883.11; Description=Cytosol aminopeptidase family, catalytic domain
  Pfam annotation: Domain name=Peptidase_M17_N; Domain location=19-155; Score=97.1; E_value=5.2e-26; Accession=PF02789.7; Description=Cytosol aminopeptidase family, N-terminal domain
  Pfam annotation: Domain name=RVP_2; Domain location=536-659; Score= -39.4; E_value=0.0012; Accession=PF08284.2; Description=Retroviral aspartyl protease
  Pfam annotation: Domain name=rve; Domain location=1275-1430; Score =95.3; E_value=1.8e-25; Accession=PF00665.16; Description=Integrase core domain
  Pfam annotation: Domain name=zf-H2C2; Domain location=1216-1257; Score=18.2; E_value=0.0014; Accession=PF09337.1; Description=His(2) -Cys(2) zinc finger
  Pfam module annotation: Pfam domain module=Chromo::Peptidase _M17::Peptidase_M17_N::RVP_2::RVT_1::Retrotrans_gag::rve::zf-H2C2; Domain location=1580-1626::1599-1874::19-155::536-659::761-930::336 -427::1275-1430::1216-1257
VSFAAKELDVAEWKGDLLAVGVTEKDVARNVESRFENAILSALDSKLGGLLGQVSSEEDFSGKLGQSTVLRIASGLGFKRVALLGLGASASTTSAFKSLGEAVAAAAKSAQAGHVAVALASPDALSTESKPKTASAIASGTLLGTFEDNRYKSESKKSVLSSVDIIGLGTGPELEKKLKYAADISSGIILGRELVNSPANVLTPGVLAEEASKIASTYNDVFTAKILDAEQCKELKMGSYLGVAAASANPPHFIHLCYKPPTGPVNVKLALVGKVIDTNAQTEAQAGGTREEREVQVLVPRQPEGVNLTIGALVASMADSSPQLTEVLARLGDMMHSMSLKLDEILHRFSPSSPSSASPNPTPHHQPPALQTRFVPSQYDDLTSMLFKLTQTSTVADYLFEFENLANRIIGLPPPFLLACFISGLAPDIRREVQAHQPLTLVQAAGLACLQEEKISSCRSTPRAPPQHLLPAPSRTTPLPPLLSSPPRSPPPPKYHRGHRCASRVLLMIAKEDDPSWSNIDLGDPNPNPDPPDSPNPLQAQISLNSLSGHLAPKALHLVGFISDHRVTVLIDGGSTHNFVQPQVVTSLSLPCQTISTPLRVMVGNGQYLECASVCEDVLVCIQNNTFTLDLYILPISGANVILGGNMRPARVLTQHQFHRLYRHQPIASYFHITLVPETPTAATTHKLPPEIQHLLASYEFLFQHPQSLPLPRTTDHHIHLLPHSLPVNVLPYRYPHYQKHEIELQVDSMLQQGLIQPSTSLFSSPVLLVQKPDGTCRFCVDYRALNVVTVKDRFPIPIIDELLDELGGATCFSKLDLLQGYHQIRMNEADVPKTAFRTHHGHYEFRVMPFGLCNAPSSFQTTMNMIFRPYLRHFIIVFFDDILIYSTSLEDHLLHLQTAFQILLDNQFALKLSKCFFAQPQVEYLGHLVLGRGVEPVASKVTAIHQWPTPRSTRAVRSFLGLAGFYRRFIRGYATIAAPLVAVTTVEPFKWTTQAQMAIEQLKQALASAPVLALPKFELPFTVETDASRVGMGAILSQQGHPIAFFSKPFSQKLLWSSTYVRELCAITTAVKKWRQYLLGHHFIILTDHRSLKELLTQTIQTPKQHMYLARLMGYDYEIHYRSGSHNQAADALSRLPEIASSLSLILSVPTLTFLEELRKPLEANSEYTALRQSIRDKPQDHPQFSLSQNLVLHSGRIWLPRGIPLINTLLTEYHATPTGGHAGVTKTLASILENFQWPGLRDDVKQFVAKCVDCQVTKYEARKIAGLLCPLPVPNRPWEDLSLDFIVGLPPYQGNTTILVVVDRFSKGIHLGMLPATHTAHMTASLFINIVVKIHGIPRSLVSDRDPLFISRFWQDLFHASGTLLRMSSPYHPKTDGQIEVLNRVIEQYLRAFVHRPSFWGNLLPWVEWSHNTSWNVGTGATPYEVTFGRKPFNFAEYISGSSKVDAVEEMMIDRDTTFQAIRSKLFKAQAAMKSQADNKRRAVNYQMGDWVLLKLRPRWQVTARGAQALTGKLAKRFYGPFQVVERIGPVAYKLQLPEGVQIHPIFHCSKLKPFRGSSENMVGIPLPIELLHDQPLVFPLAILDTRRASNGDTWEVLVQWNGLSPDDTTWEDWEQLCHNYHLEDKVVFQGPRDYTNAQTEAQAGGAGSSKTRGGGYNIKTGPGCLIELMKFDMGGSAAVFGAAKALGQIKPLGVEVHFIVAACENMISGTGMRPGDIVTASNGKTIEVNNTDAEGRLTLADALVYACNQGAEKIVDLATLTGACIIGLGSSIAGVFTPSDDLAKEVFDASEASGEKLWRLPLEESYWESMKSGVADMVNTGGRPGSAITAALFLKQFVDEKVQWMHIDMAGPVWNEKQRCATGFGVATLVEWVLRNAS

SEQ ID NO: 148172 - protein, 190 aa, Glycine max
  Coding DNA Sequence Number=SeqID_31394
  Gene Ontology: Mol. function=transporter activity; Cellular component= membrane; Biological process=oligopeptide transport
  Homolog annotation: Hit_ID=Q9CAS0; Match level="QueryCoverage=99%, HitCoverage=29%, E-value=3e-48, Identity=52%"; Hit description =Putative peptide transporter; 37139-33250
MVMVTLTAWLPELHPPPCTPQQQALNQCVKASTPHQGALLTGLCLLSIGSAGIRPCSIPFGVDQFDPTTDEGKKGINSFFNWYYTTFTVVLLITQTVVVYIQDSVSWKIGFAIPTVCMFCSIIMFFVGTRIYVHVKPEGSIFTSIAQVLVAAYRKRKVELPSEKHVDGVFYDPPLTGTQVFSKLPLTNQF

SEQ ID NO: 148173 - protein, 182 aa, Glycine max
  Coding DNA Sequence Number=SeqID_31395
MVGRGKRSLMVIIFRARRRIGTATRADELTLEHNVHLPFDFLLLVVRVLVGADIDEFRIWFKVNGMGHNSLCGHHTLNLAMSDPEWAWCDAALDNDGLSVEKQEGRSSRAHHPRKQRKGRICHDNDGSGHNAHRNCSIGRARGGGRGGEGRRVTAEIGGGSGGGRGREERRASLIFILLKSG

SEQ ID NO: 148174 - protein, 779 aa, Glycine max
  Coding DNA Sequence Number=SeqID_31396
  Homolog annotation: Hit_ID=Q9FM25; Match level="QueryCoverage=99%, HitCoverage=100%, E-value=0.0, Identity=62%"; Hit description =Arabidopsis thaliana genomic DNA, chromosome 5, P1 clone:MNF13
MTMDREKEREIELESAMYTNCLLLGLDPAIIGVGASNATPRVGHFRHSNPKLGEQLLYFILSSLRGPIQSAKDFDKVWPIFDSAQSRDFRKVVQGIISELESQGALPRSNSRVSSLATCCGPRLVLTVLIPGSKGILRGKSECSLRVCLFGKLTRLRVNSFGRRFVELLWQLSLHALREVHRRTFTADISSNPLPAPLTDVAFSHAATLLPVTKARIALERRKFLKNAEMAVQRQAMWSNLAHEMTAEFRGLCAEEAYLQQELEKLHDLRNKVKLEGELWDDLVSSSSQNSHLVSKATRLWESLLARKSQHEVLASGPIEDLIAHREHRPNLPANLLIQNFRYRISGSSLLAAMDQSSQAPYSDVLSAQSGDLSAMDNKEENDGSHFSNETLTRVDDRTGRAHQTVDVAEVIRRWTHALQRIHKQSLHLAKANDGEGPDILRSAQEGDSSGHAESLAATLAEHQQHLASFQVLINQLKDVAPTIQKSISECTEKVNCIASNLPPMNRPNGRSTSPIQTQSSGRMDNSTDDVSEVTSRISNIQLDKVSVSPPTLKLPQLFSLTPSSGKAGNVQRRHNNSPQTSQTENLSDRKSLDPPSNNEVASSAEDSDSSYVHNLKRSVREAALSLRSCNSESSRDSQSDESSEHFFVPLSETSFSNLDADKRGASLRSKRLFVSQMDDSLLESHASGGHGERKFDEFPDMLNDLERLSVSDYDNVNGFLSYPGSNSTSDARRSIFDFEDAQDQVFSPPLLMDSSLLTDPFEDLLAPLSETETALIDH

SEQ ID NO: 148175 - protein, 129 aa, Glycine max
  Coding DNA Sequence Number=SeqID_31397
MKLDDSLSEVVLENNTTRANLWWVLPPMGTVQTKILLRNLEIHSHANDAIQMVKGLANPNQHEKLILDAIQASIMPAMTVQFSHVYRECNKVADLLAKKGLSLDEGIVYFLDILGFVVSAFHADIVSLG

SEQ ID NO: 148176 - protein, 272 aa, Glycine max
  Coding DNA Sequence Number=SeqID_31398
  Gene Ontology: Mol. function=RNA-directed DNA polymerase activity; Cellular component=chromatin; Biological process=RNA-dependent DNA replication
MVGNGTEIACDKVCRDVAVLIQGHEFNLDLYVMALGGTDLVLGVAWLKLLGPITTDYSHLTMSFMYHGQPIIIQGSITPGPFGITHGQRQLIRPSRSPYSSPVLLVKKKDGTWRFCVNYRALNIITIKDRFPLPTIDELLDDLGHSSWFSKMDLAQGFHQIRMVEHDVPKTAFHTHQGHYEYFVMPFDLCNAPSTFQATMNALFRQYIRKFVLVFFNDILVYSHDLQSHLDNLDCVLRTLQQGDFHLKQFKAKKNYKKALRMGGVHSLSSYQ

SEQ ID NO: 148177 - protein, 142 aa, Glycine max
  Coding DNA Sequence Number=SeqID_31399
MILKNKQALGCLISSLFFEKRKGLSLFNLKDWNLALLSRILWDFHCKKDSLWVRWVHHYYFKGYNTSSSDSVLIKKIIQIRDFIISKELSTEEAKKRIQSWSTNKQLLVGKVYEYIRGVKPTVSWCSIIWNPAIPPKMSFIL

SEQ ID NO: 148178 - protein, 111 aa, Glycine max
  Coding DNA Sequence Number=SeqID_31400
MLRNFMDYATMLFLASGMLRNFTDCATMFLFYFQNVAELYGLPNCRNMPFCRRARRGSRSGALAPTYPPSKRKSDLRSSFLRVNQAIIFTWKVIILRRWTLKMIHLLGKEN

SEQ ID NO: 148179 - protein, 158 aa, Glycine max
  Coding DNA Sequence Number=SeqID_31401
  Gene Ontology: Mol. function=DNA binding; Cellular component =intracellular
  Homolog annotation: Hit_ID=Q2HUC6; Match level="QueryCoverage=60%, HitCoverage=15%, E-value=3e-12, Identity=42%"; Hit description=ELM2; AT-rich interaction region; Homeodomain-related
  Pfam annotation: Domain name=ARID; Domain location=22-128; Score =12.6; E_value=8.7e-06; Accession=PF01388.11; Description=ARIDBRIGHT DNA binding domain
MAGRSVLNAGVRVEDSGSIVGCSNDGSQRRFEELVSEFTSEICGSDYFLPFPPMLGDGKPVDLYKLFLVVRGKGGYDAVCNCKLWDIVGEESGLGVSVGSSVKLVYSKYLSALDAWLKKVAESKVSPECGVVDDRDKFGRRLMELQAEVEGLLSGCGE

SEQ ID NO: 148180 - protein, 90 aa, Glycine max
  Coding DNA Sequence Number=SeqID_31402
MKNTEERSKTFAKSLTETLRKRYESASAWIFFTELIFLSKFERERKNWGRSLPPSSPRRARLLPPEATAFWRNLLEGPSGPGCYLHPYFY

SEQ ID NO: 148181 - protein, 80 aa, Glycine max
  Coding DNA Sequence Number=SeqID_31403
MDSSTHLETSVHREEAPQSKYVGRRKRSDGAIKDVANGGVVREGMRIRSRKGEGCEKKQEKEKVGHCCRKSHLRVMHHGE

SEQ ID NO: 148182 - protein, 86 aa, Glycine max
  Coding DNA Sequence Number=SeqID_31404
MDNASSCSDIHEVLKGIGPPLIHLLPTYVKYRIIIGTNNTCNKARIQSSYTIVIITMIHLSNIIIISPSIIDTKDRLDSMEISPFE

SEQ ID NO: 148183 - protein, 75 aa, Glycine max
  Coding DNA Sequence Number=SeqID_31405
MAENLHGITHRNVSDTLRKRLGVDFLHGNDFFSLISSDPKIPGGLNENEGGACHPTRPGELGCFLQKQPPSGGTS

SEQ ID NO: 148184 - protein, 341 aa, Glycine max
  Coding DNA Sequence Number=SeqID_31406
  Gene Ontology: Mol. function=metal ion binding; Cellular component =integral to membrane
  Homolog annotation: Hit_ID=Q10GD6; Match level="QueryCoverage=98%, HitCoverage=67%, E-value=3e-23, Identity=27%"; Hit description=Zinc finger, C3HC4 type family protein, expressed
MNRSDPCLQDLRDKIFPFEEQNASVKLNIYRKKNSLSSLKKNAKIDKAASKPDKAEDENRGEVEVLEEASSSTIGSARRAKAAARLKFTCSAPPAACQLDKVAGEDKKDGGHPRGGETSNGSLKIKIPNSSKANSSQQSDTNKRDNSEFRNETADMLEPLNSLVEPGSKKSRKKSTMRSNDNAADQNESTPSNSDSVQHQRPLSNQEKTLRISEDLNFPAQPEIGSNIEGNKEFGPIWFCLVAAEEKKASARLPQLYSSYLRVKDGSVTVSYIKKYLVKKLGLASEDEVEITLQGRALLSSLQLRNLVDMWLHTVPKNKIQTFVGSSAKDFIMALSYGRKT

SEQ ID NO: 148185 - protein, 141 aa, Glycine max
  Coding DNA Sequence Number=SeqID_31407
  Pfam annotation: Domain name=zf-CCHC; Domain location=59-76; Score =12.7; E_value=0.0079; Accession=PF00098.13; Description=Zinc knuckle
MTLEELIVILKVQESNDDDFNEEDDELSLITRKMWKNKNSSRFNSSSKRSFHEKEKSRVICYECKMPRHFKLECPDLEKSKDKKKKFFKSKKKSLITTWEDLDDSSFDTDSEEEANLCLMVDASTSKAEPALDACLEDEDP

SEQ ID NO: 148186 - protein, 155 aa, Glycine max
  Coding DNA Sequence Number=SeqID_31408
MQERVKSLTIALKDSKEKPKEMLKQKLLLQKECTFANNELYKLKKKNSDLWTKCQHYKKISYDLNYKLKGHEIWKELPLEIEKLYKEIEALRNNISKFVGGHETLTKKIKVQRIPKDKSAHGFKGKKVGHETYKFKDLPEKGNPSKGPSSAYQHL

SEQ ID NO: 148187 - protein, 56 aa, Glycine max
  Coding DNA Sequence Number=SeqID_31409
MAVVGTTGSYGGHDGGQGTAIDITCHVSYELYNNPTSVYLKRTFMRSVKGNCRIPS

SEQ ID NO: 148188 - protein, 73 aa, Glycine max
  Coding DNA Sequence Number=SeqID_31410
  Gene Ontology: Mol. function=actin binding; Cellular component =intracellular
  Homolog annotation: Hit_ID=Q9XEN2; Match level="QueryCoverage=66%, HitCoverage=35%, E-value=6e-18, Identity=89%"; Hit description=Actin depolymerizing factor
  Pfam annotation: Domain name=Cofilin_ADF; Domain location=1-73; Score= -12.2; E_value=0.046; Accession=PF00241.10; Description =Cofilintropomyosin-type actin-binding pr
MELFRYFQAKLNFNYSNTLLNWGPSPSVARIRPKMLYATSKDRFRRELQGIHYEIQATDPTEMDLEVLRERAN

SEQ ID NO: 148189 - protein, 211 aa, Glycine max
  Coding DNA Sequence Number=SeqID_31411
  Gene Ontology: Mol. function=pepsin A activity; Biological process =proteolysis
  Homolog annotation: Hit_ID=Q05929; Match level="QueryCoverage=57%, HitCoverage=25%, E-value=4e-24, Identity=56%"; Hit description=EDGP precursor
  Subcellular localization annotation: CTP_CleavageSite=40; ConfidenceScore=5.31e-01
MATSFRLLFLSIFSLFIACSIVQTSFKPKALVLLVTKDVSASEGYVSHSPLNQSVVALLIAYFSGNTVAVKTKFGVTFQRIVWSPYSCTCGSIWDLLCNQDIGFSRMGPGVPTINLVLQNEEVVWSIIGANSMVQFNDVICLGFGDAGSDPSADQVGAVVGGFHLMTSITIGANQLENNMLQFDLATSRLGFCSLFLEHTDCANFNFTSSA

SEQ ID NO: 148190 - protein, 60 aa, Glycine max
  Coding DNA Sequence Number=SeqID_31412
MTKPYMHPERNADLVGPNRVMMQSYPARTLGRRLQVDWARDPREGPRVLTSLRVDFEPIG

SEQ ID NO: 148191 - protein, 77 aa, Glycine max
  Coding DNA Sequence Number=SeqID_31413
  Subcellular localization annotation: CTP_CleavageSite=20; ConfidenceScore=5.45e-01
MTSSTSLASFFLRAMLLSPQASEKRILGRRFKPNTRSGKGNTRFDSKPTLDLENAPLTVHRRSLLQRPTLWASPVAT

SEQ ID NO: 148192 - protein, 70 aa, Glycine max
  Coding DNA Sequence Number=SeqID_31414
MIAATKTDFPVIVVTTATNNRLSGGGGGGGGSGSGVDDSVDGNDDYGSGCSGDHGGGSDCHDGDGLNEIF

SEQ ID NO: 148193 - protein, 101 aa, Glycine max
  Coding DNA Sequence Number=SeqID_31415
  Gene Ontology: Mol. function=RNA-directed DNA polymerase activity; Biological process=DNA integration
  Homolog annotation: Hit_ID=Q1SA33; Match level="QueryCoverage=67%, HitCoverage=6%, E-value=7e-23, Identity=71%"; Hit description =Integrase, catalytic region
MDDIIFDATKDSLCKDFSKLIQAEFEMSMMGELKFFLGLQVKQIDEGIYIHQTKYVKELLKKFKMDNAKCEVLWMERKSTSGGCYFISGCLVSWTRKKKEQ

SEQ ID NO: 148194 - protein, 188 aa, Glycine max
  Coding DNA Sequence Number=SeqID_31416
  Gene Ontology: Mol. function=RNA-directed DNA polymerase activity; Cellular component=intracellular; Biological process=RNA-dependent DNA replication
MVKKSNGKWKMCIDYIDLNKACSKDSYPLSSIDRLINGASVFPVLSFLDAYSGHNQIPMLNQDEEKMTFMTDTTYYYYSIRSFGLKNARATYQRLMDKIFKDQLGRNLEVYMDDIVVKSASTITHAKDLEEIFAKIQKHNMRLNLEKCVFGVQGGKLLGFMITSRGIQPNLEKFMTIIEMRSPNNLKE

SEQ ID NO: 148195 - protein, 77 aa, Glycine max
  Coding DNA Sequence Number=SeqID_31417
MIARGFSRGGSSNLAREHYVHSLKSVTAVEAEMKPTRNMPLINGTGMERRKGDWRCHFKEKMSQEQAYHHRKPWIRA

SEQ ID NO: 148196 - protein, 83 aa, Glycine max
  Coding DNA Sequence Number=SeqID_31418
  Subcellular localization annotation: CTP_CleavageSite=23; ConfidenceScore=5.35e-01
MTTTTKHAQPQIFYMYPSSMRLRREAGMSRTWTKKVLFSNISMRGWVNFTSWVRIGPQMSSEMTRWRWDIFGRISPNKSLSEK

SEQ ID NO: 148197 - protein, 46 aa, Glycine max
  Coding DNA Sequence Number=SeqID_31419
MSQSKAASSSSTSNNELHDTVMQSSQGGDPSTGSWLGDSKKTGLEM

SEQ ID NO: 148198 - protein, 126 aa, Glycine max
  Coding DNA Sequence Number=SeqID_31420
  Gene Ontology: Mol. function=transferase activity, transferring glycosyl groups; Biological process=pyridine nucleotide biosynthetic process
  Homolog annotation: Hit_ID=Q6XQM5; Match level="QueryCoverage=80%, HitCoverage=18%, E-value=1e-47, Identity=86%"; Hit description =Nicotinate phosphoribosyltransferase-like protein
MLCTAAPVGVEDVSTLMKCLKPGFPSRVGERILCRHPFQESKRAYVVPQRVEELLRCYWSGSTDIKKDTLPALRDIRERCINQLEQMRPDHMRRLNPTPYKVSVSAKLYDFIHFLWLNEAPVGELQ

SEQ ID NO: 148199 - protein, 80 aa, Glycine max
  Coding DNA Sequence Number=SeqID_31421
  Gene Ontology: Mol. function=transferase activity
  Homolog annotation: Hit_ID=Q1RT79; Match level="QueryCoverage=60%, HitCoverage=12%, E-value=2e-10, Identity=61%"; Hit description =Terpenoid cylases/protein prenyltransferase alpha-alpha toroid; Bacterial adhesion
MDPNIDLDEVLDQMIDEELEGNTEEIIRLILERVDALHRKGLSLLHKCTTALRILAYGSHADNVDEYVRIGETNAVECLK

SEQ ID NO: 148200 - protein, 359 aa, Glycine max
  Coding DNA Sequence Number=SeqID_31422
  Gene Ontology: Mol. function=RNA-directed DNA polymerase activity; Biological process=RNA-dependent DNA replication
  Pfam annotation: Domain name=AT_hook; Domain location=286-298; Score =14.9; E_value=0.061; Accession=PF02178.9; Description=AT hook motif
  Pfam annotation: Domain name=NAPRTase; Domain location=13-195; Score=- 98.0; E_value=0.025; Accession=PF04095.6; Description=Nicotinate phosphoribosyltransferase (NAPRTase) family
  Pfam module annotation: Pfam domain module=AT_hook::NAPRTase; Domain location=286-298::13-195
MDLPVNILCVSFLQLSNGVFGETNQSELAAFTSYALAFPDGFLALVDTYDGIYITGKMSEPLCAYKSVSRYWEVMRSGIPNFCAVALALSDLGYKAVGIRLDSGDLAYLSCEVRKFFYSIENEFGVPGFGKLQITASNDLNEETLDALNKQKLVIEGDVNHRIQAGWMKWRKASGVLCDAKVPIKLKGKFYRTAVRPAILYGTECWAVKSQHENKVGVAEMRMLRWMCDKTRQDKIRNEAIRERVGVAPIVEKMVENRLRWFGHVERRPVDSVVRRVDQMERRQTIRGRGRPKKTIREVIKKDLEINGLDRSMGHEVDAFGIGTYLVTCYAQAALGVVFKLVEINNQPRIKLSEDVSKV

SEQ ID NO: 148201 - protein, 55 aa, Glycine max
  Coding DNA Sequence Number=SeqID_31423
  Gene Ontology: Mol. function=transferase activity, transferring glycosyl groups; Biological process=pyridine nucleotide biosynthetic process
  Homolog annotation: Hit_ID=Q6XQM5; Match level="QueryCoverage=94%, HitCoverage=10%, E-value=7e-15, Identity=69%"; Hit description =Nicotinate phosphoribosyltransferase-like protein
NPFGGEYTVFAGLEECIRFIANFKLTEEEIDFVRQCLSSSCETKGMKDDDVAVNP

SEQ ID NO: 148202 - protein, 102 aa, Glycine max
  Coding DNA Sequence Number=SeqID_31424
MSMFVVFGALHVKSILFINRYRIQQLIRGRGKPPMGFTKYNIDVALFSKSGLMGMAACLRDHHGHFISVLMTGTVKRICTPQEAEAKAMQMAIAWTKNLGLK

SEQ ID NO: 148203 - protein, 227 aa, Glycine max
  Coding DNA Sequence Number=SeqID_31425
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=93%, HitCoverage=32%, E-value=1e-115, Identity=85%"; Hit description =Photosystem I P700 chlorophyll a apoprotein A1
  Pfam annotation: Domain name=PsaA_PsaB; Domain location=1-223; Score=- 169.1; E_value=0.00084; Accession=PF00223.9; Description=Photosystem I psaApsaB protein
PGTTAPGATTSTSLTWGGDNLVAVGGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIA

SEQ ID NO: 148204 - protein, 176 aa, Glycine max
  Coding DNA Sequence Number=SeqID_31426
MYRLESRPQDAQWTRRSPTGPWGFQLWLRASVVLQGARSPPTRSRHQDIGIVPTRRPVDPKKSKRALGFPALVTGLCSPIGCSFPPARSHHHDMGIAPARHPVDPKKSNRVLELSSSNYGSLKVIRPPTNRAFIKKYCVPRQAQGETPQQHEDGRQRATNALPSPLEFTSAHPQKG

SEQ ID NO: 148205 - protein, 83 aa, Glycine max
  Coding DNA Sequence Number=SeqID_31427
MLLNSNIIHIHVRLVMLVRMIRTRLFAAARVKSCPGMHSRCVIVSLSGCARTVGCPPISRGAPGTDKGNYWPLNRERKSRLSI

SEQ ID NO: 148206 - protein, 212 aa, Glycine max
  Coding DNA Sequence Number=SeqID_31428
  Gene Ontology: Mol. function=nucleic acid binding; Cellular component= mitochondrion; Biological process=DNA integration
MDFRMYQTGVKSVFLNEYIEEEVYVSQPPSFENHKNPTHVYKLKKALYGLKQAPRQCYVILTNFLLDKKFEREQVYADDIIFGSTNKSLCKDFVHKMQGEFQMSMMGVLNYFLNLQVKQMNHGTFLHQTKYCKEILKKFDMDKSKEVATPIATNCYLSVEISLVGYSDSDFAGCKLDRKSTSGTCHLLGNSLISWNSKKQACVALSTTEAEC

SEQ ID NO: 148207 - protein, 173 aa, Glycine max
  Coding DNA Sequence Number=SeqID_31429
MKGTYYTNLVNFFYTIAHIDGDTKFLCAEVKGKQIVMTPKVWLDIVGISLKRVMANQVSKLVIQLEATNPTTSLDDSVLNVVLTAKVGFLCGDYCCVWFWFCHTLISSGDLGLVACNLYLVILRCLAPIIRPTWALQKIPPEGCCFWRKQPCSPGQAELAWASWVAGFSPNFL

SEQ ID NO: 148208 - protein, 114 aa, Glycine max
  Coding DNA Sequence Number=SeqID_31430
  Homolog annotation: Hit_ID=Q5W7C9; Match level="QueryCoverage=50%, HitCoverage=21%, E-value=2e-20, Identity=79%"; Hit description =Unknow protein
MDKRLVGLHEGWGGYIFWERTPVEYEAPGYKLCLGMEENSESALSTNKEAISNATRNLMESSILAQDERWRHALHMQVGREVVFPVADGWKRLLIPRRLRSKRRNPPEEGLASD

SEQ ID NO: 148209 - protein, 115 aa, Glycine max
  Coding DNA Sequence Number=SeqID_31431
MFSSNKHWSRLHAPSSLGRRTREPRVALPPKALGPSWPIRKLLHEATISLGRACYFRLKPPARLGELGGRLLPYFGYKRAWEDEGKGSTPWESIFHLKLVKRRRKKKKIKVEALP

SEQ ID NO: 148210 - protein, 90 aa, Glycine max
  Coding DNA Sequence Number=SeqID_31432
  Subcellular localization annotation: CTP_CleavageSite=3; ConfidenceScore=5.17e-01
MARRDKYGHLFSLTKTQCLSTVTIEVSPVNRRLNVFRLRLLKSHLRYPKTSESDSTQRQIMVIRTFAIQRQSSPMTHRDKLWSSSPFQRP

SEQ ID NO: 148211 - protein, 114 aa, Glycine max
  Coding DNA Sequence Number=SeqID_31433
  Homolog annotation: Hit_ID=UPI0000D9BA39; Match level="QueryCoverage =94%, HitCoverage=94%, E-value=8e-13, Identity=42%"; Hit description =PREDICTED: similar to Snf2-related CBP activator protein
MIEDFESYEGEDFESSEGEELEPSEGEDFEPSEGEDFESSEGEDFKPNKGEDFESSECEDFEPSEGADFESSEGEDFEPSEGKDFESSEGKDFEPSKGEDFESNKGEDFESSEG

SEQ ID NO: 148212 - protein, 133 aa, Glycine max
  Coding DNA Sequence Number=SeqID_31434
  Gene Ontology: Mol. function=chitin binding; Cellular component =extracellular region; Biological process=chitin metabolic process
  Homolog annotation: Hit_ID=UPI0000612705; Match level="QueryCoverage =76%, HitCoverage=93%, E-value=2e-12, Identity=28%"; Hit description =UPI0000612705 related cluster
MTGPLNESISWVDPWVLVPSLSKDYTSSPSEDYTSSPSEGYTPSHLEDYTSSPLEDYTPSPSEDYTPSPSEDYTPSPSEGYTSSPLEDYTSSPSEGCTPSPLVGWTPSPSKGDTPLTLEGYASSFSVCSISTP

SEQ ID NO: 148213 - protein, 69 aa, Glycine max
  Coding DNA Sequence Number=SeqID_31435
MWVFSGHVMVLRANCCAIPLGPFRPIRKLLHEATSSPGRACYFRLKPPARPGHERLKERVQHPGKAHFT

SEQ ID NO: 148214 - protein, 107 aa, Glycine max
  Coding DNA Sequence Number=SeqID_31436
MGGGGCNTAPLVELVASPLSYLMGPVALEKLFGILKVDEQELAQEEETKKWKSLALTVQRPKCNSASKESSPKALAINDASEEEFDDNDSDEEDDELILITRKIRKM

SEQ ID NO: 148215 - protein, 138 aa, Glycine max
  Coding DNA Sequence Number=SeqID_31437
RGGRCKTQGASPGGAVVGADLGGTGEARLIALCARTPKGNRPAHPGNGSAGGRVQRLEEHRTSRGVRIGSEGWARGSQSRTRRLSGGLLELLSAGESGSSRAGLGDGIPQRGPFGGFFPRAAEQSTQKLGTGQGGNPN

SEQ ID NO: 148216 - protein, 190 aa, Glycine max
  Coding DNA Sequence Number=SeqID_31438
  Gene Ontology: Mol. function=RNA-directed DNA polymerase activity; Biological process=RNA-dependent DNA replication
MAEKGKLDQIEERLKVIEEGRDYAFADMEDLCLVPDMVIPQKFKVSDFDKYKGTTCPKNHLKGHKSFKEYAQRWMDLATQVAPPMTEKEMITMIVDTLPMFYYEKMVGYTPSSFANLVFVGERIEVGLKRGKFDHPALMNGKRGANREDENKEGTHAVAAISTWPNFPPAQQCHYSANISSFHYPSPNQP

SEQ ID NO: 148217 - protein, 119 aa, Glycine max
  Coding DNA Sequence Number=SeqID_31439
MCDSVIDMLLNIQGKTKDGLNTHQDLAKTGEQHEQHEDYNLKLEEKLEDDRLRQLVTPPGTVRELGHSVYVSHKEWRSICGLAGSPTHLMTVKPHLEFSSFIDALSLIVPIATMCYLRG

SEQ ID NO: 148218 - protein, 56 aa, Glycine max
  Coding DNA Sequence Number=SeqID_31440
MTNKVRRCDNRCKRKMSKFINKLSKAPSPLTTAVDETDHHVDDAQVDRSHYMSKDH

SEQ ID NO: 148219 - protein, 303 aa, Glycine max
  Coding DNA Sequence Number=SeqID_31441
  Homolog annotation: Hit_ID=Q1SKD7; Match level="QueryCoverage=64%, HitCoverage=58%, E-value=1e-08, Identity=24%"; Hit description =Ankyrin
MAPRKLPAKRSRKDTVGEGSSAAPQANMDFDRHWFWSAEHQQRFETIKGWSFLRERRVQLRDEEFVEFREEIARRHWAPLVSPMAKFDPEIVIEFYANAWPTEEGVRDMPSWCEYSQRRGQASGFDEEAISQLLCVSGQDFSWNAAGRWVRIIRTSMTTLTQIWMMLLLSNILPSDHNSDLPLPKWIMPTRHPMDPVKSNRALGFLALITGLCQFYGVSPEDGQQQAAANAPPSSLESTSTHLQRLERCIRHVADQKAANHRGARPTGTSGDGDEAQEDKDMADVMDFFLGGGGVTRPGSPNL

SEQ ID NO: 148220 - protein, 80 aa, Glycine max
  Coding DNA Sequence Number=SeqID_31442
MISPGTNGLNEHKSRFLLNSCARNALLWALSQEEYSKVYNFRSIEQMWDTLAITYEGSSEGDARLTGASSKEGKRAESPP

SEQ ID NO: 148221 - protein, 187 aa, Glycine max
  Coding DNA Sequence Number=SeqID_31443
MARRDNYGHLLPLLKTQCLSTETIIVSLCYPETIKSDGTQRHIWSSAPFVKDSMSFDRDYCSLPLLSRENQVRWHAETNMVIYSLCRRLNVFRPKLLKSPLRHPETIKSDGMWRPTCSPAFVILRLFFSLLYHPETSKSDDKRVRWHKETLMVIHFSFDFKTIVVSVAIQRQSNPIACRDRHDRPLS

SEQ ID NO: 148222 - protein, 328 aa, Glycine max
  Coding DNA Sequence Number=SeqID_31444
  Gene Ontology: Mol. function=glucose-6-phosphate 1-dehydrogenase activity; Cellular component=cellular_component; Biological process =carbohydrate metabolic process
  Homolog annotation: Hit_ID=Q9LK23; Match level="QueryCoverage=86%, HitCoverage=56%, E-value=1e-144, Identity=85%"; Hit description =Glucose-6-phosphate 1-dehydrogenase, cytoplasmic isoform 1
  Pfam annotation: Domain name=G6PD_C; Domain location=40-320; Score =612.2; E_value=4.6e-181; Accession=PF02781.6; Description=Glucose-6 -phosphate dehydrogenase, C-terminal domain
MPTCQVVIEGSDDSVMQLRNIRKQLILVGGHVLLLRSLLLVLRFANRLFMPLWNRDNIANVQIVFRENFGTEGRGGYFDQYGIIRDIIQNHLLQVFCLVAMEKPVSLKPEHIRDEKLKVLESVLPIKDDEVVLGQYEGYKDDPTVPDNSNTPTFATVILRVHNERWEGVPFILKAGKALNSRKADIRVQFKDVPGQKQGRNEFVIRLQPSEAMYMKLTVKKPGLEMETVQSELDLSYRQRYQAVTIPEAYERLILDSIRGDQQHFVRRDELKASWEIFTPLLHRIDKGEFKSTPYQPGTRGPVEADKLLLEKAGYVQTHGYRWIPPTL

SEQ ID NO: 148223 - protein, 75 aa, Glycine max
  Coding DNA Sequence Number=SeqID_31445
MPFREIHFQKKLFPETFRKTIFLETFRKNLLPEEESVIPEVLRNPFRKNVIRNFSGRSFFWKISFYFQKKDLPKS

SEQ ID NO: 148224 - protein, 167 aa, Glycine max
  Coding DNA Sequence Number=SeqID_31446
  Homolog annotation: Hit_ID=Q1STP5; Match level="QueryCoverage=98%, HitCoverage=26%, E-value=3e-13, Identity=30%"; Hit description=IMP dehydrogenase/GMP reductase
MYDQLDETSRTTTRQIGRYLTLLQCWIYEYFSSVHQCVTDDAYEETSPRASRWLTTKAHMKGIIGASYRARCDALTVIDVCWLPYTEMGPMVVTVQPERVLCQFRYIQSIPPPPVSASLSYDDMDDRWMHFSDHVAAVGDICVMPRQVSADYMEWFFQISHPFIIPT

SEQ ID NO: 148225 - protein, 311 aa, Glycine max
  Coding DNA Sequence Number=SeqID_31447
  Homolog annotation: Hit_ID=A0ELV1; Match level="QueryCoverage=38%, HitCoverage=44%, E-value=3e-29, Identity=56%"; Hit description=Non-S- locus F-box-like protein 2411
  Pfam annotation: Domain name=F-box; Domain location=205-252; Score =17.1; E_value=0.063; Accession=PF00646.23; Description=F-box domain
MDSVGESSFLVPQEKGSCPSIGSVLDGYLINCCSLCGFNEKLEGETCFEMINALLGDLDDTEEVVIEDDVLDRLPMDPFGMNITAFSDWIEDFEWGFRPLDVEFEVDETHEKIGDHDHLHFLGLSWDFNGPENLQPQTVDAKGNDMLVSGDVFNGYQNFDVVFDEGIVADGSTRGFLSVSQRHGDYRVQSKEAEESRNYTKIECDAEGGFPHDALFFVLGYLGVRDLLSVEGVCKSLCDAVRGDPLLWRTMHIDQPLNERITDDSLVKLTNRAQGTLQHLALVNCLWITDSGLGRVLQSNPRLMKVCIYML

SEQ ID NO: 148226 - protein, 248 aa, Glycine max
  Coding DNA Sequence Number=SeqID_31448
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=8e-38, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=66; ConfidenceScore=5.38e-01
MTCSPLKAWMCSPLKARTCSPLKARTCSPLKGRVALRRYPLNVWACSPLKWRTCNPLKARTCSPLMATIYSPLMLSTCTPLKVRVCNPTKARACSPLKGRMCTPLKARASSPRKARLCSPLKVRTCSPVKARACSPLNGRSCSPLKWRTCNPLKARTCSPLMATMYSPLMLSTCTPLKVRVCNPTKARACSPLKGRMCTPLKARASSPRKARLCHPLKVRTCSPLKVRTLNPLKVRACSPQKVKPCSP

SEQ ID NO: 148227 - protein, 263 aa, Glycine max
  Coding DNA Sequence Number=SeqID_31449
MAELMKRRKGSSITTAVAGHRRHRPSEAPITPVPPSLIILDPKYLDIAFFDDETFDYYQADMTGRLLVGSLTFDCRIMHYIIVRILLPRSSNLAQAFEEDLILMWAFLTDRQIDWAHLVKYRMHKALRTNAPLPYPQLVTLFLRHFQIPLDDEPFVQVKTSFAIGVGVVTSFGYRKDIDGQWIRKQDLPPLIPDERTSSPLPQRDASSTLMHEVLSELCGLRAFVGDRLDAMDAHFEGMDTWITHLEDDMGFIRRCFDPPAAP

SEQ ID NO: 148228 - protein, 138 aa, Glycine max
  Coding DNA Sequence Number=SeqID_31450
  Homolog annotation: Hit_ID=Q8L720; Match level="QueryCoverage=61%, HitCoverage=18%, E-value=6e-14, Identity=44%"; Hit description =Expressed protein
HLRNGGLAGVCHVTDQQFEELKELLDASKYLQQQDQKPQFYGEYSHITCEDDRAIDIEVCPRCEKLRPVYDCPAESCQPKHQASQLSAPGLHGLLTYIGSESAHLVVCGDAEEGHMVVLAVDLLSSVHCVKENVAIVG

SEQ ID NO: 148229 - protein, 123 aa, Glycine max
  Coding DNA Sequence Number=SeqID_31451
  Gene Ontology: Mol. function=ferric iron binding; Biological process =aromatic compound metabolic process
MVLETLNEGPMQLMINDAFRLSIMGANKESLPSSPKHSGGGERGISELHHGEAKELFDLLKDGEQPLYDGSKRMLMSSKETKSMVWHGEKNNNDEVMRHPRDPEAWKTFDLRYLNFASDPQNV

SEQ ID NO: 148230 - protein, 287 aa, Glycine max
  Coding DNA Sequence Number=SeqID_31452
MEDEVVKPQPQPWCLAKDAEGEYVEFQVEIARRCWTQLAEPMPKYDPKIVMGFYANAWPTEEGVMDKHSKVRGQWIPYHTNAINQFLGNPLILEEGQQWRNFVWSMAGKRLQIINILPSDHNYDLTLPKCQLVYSIMGQISVQVAHLILDVIHQFVGIEPPRHPVDPEKSNRALGFPTLITGTATSARSATSAGSRCTTTTSTLATILGVHLSHTYMHHLANQTHPSPYPWPTPKQFRATIAWPGDRPIFQEEAGPASAQGAAQGDGGRVEDDEDMADLVDYLIGGA

SEQ ID NO: 148231 - protein, 125 aa, Glycine max
  Coding DNA Sequence Number=SeqID_31453
  Gene Ontology: Mol. function=RNA-directed DNA polymerase activity; Cellular component=chromatin; Biological process=RNA-dependent DNA replication
MAPEDMEKTTFITLWGTFCYKVMSFGLKNAGATYKRAMVALFHDMMHKEIEVYVDDMIAKSKTEEEHLVNLRKFFERLRKYQLGLNPAKCTFRVKSGKLLGFIVSEKRIEVDPDKVKAILEMPEP

SEQ ID NO: 148232 - protein, 111 aa, Glycine max
  Coding DNA Sequence Number=SeqID_31454
MGSNQVFSFTKRFTHVKVPTLDLSGLKALKQLMTPQQHQDFVGTYGKILDLAMIEVPTAAITALVQYYDPRMRCFTFQDFHLVLILWEEPSLSSPWDTLHSYLDYPKCWEF

SEQ ID NO: 148233 - protein, 693 aa, Glycine max
  Coding DNA Sequence Number=SeqID_31455
  Gene Ontology: Mol. function=metal ion binding; Cellular component =membrane; Biological process=guanosine tetraphosphate metabolic process
  Homolog annotation: Hit_ID=Q6K5G3; Match level="QueryCoverage=83%, HitCoverage=81%, E-value=1e-165, Identity=53%"; Hit description =Ankyrin repeat-like protein
  Pfam annotation: Domain name=Ank; Domain location=18-48; Score=3.0; E_ value=12; Accession=PF00023.20; Description=Ankyrin repeat
  Pfam annotation: Domain name=Ank; Domain location=187-219; Score =10.5; E_value=0.94; Accession=PF00023.20; Description=Ankyrin repeat
  Pfam annotation: Domain name=Ank; Domain location=221-253; Score =20.5; E_value=0.0059; Accession=PF00023.20; Description=Ankyrin repeat
  Pfam annotation: Domain name=Ank; Domain location=254-287; Score =24.6; E_value=0.00035; Accession=PF00023.20; Description=Ankyrin repeat
  Pfam annotation: Domain name=Ank; Domain location=336-370; Score =24.1; E_value=0.00049; Accession=PF00023.20; Description=Ankyrin repeat
  Pfam module annotation: Pfam domain module=Ank::Ank::Ank::Ank::Ank; Domain location=18-48::187-219::221-253::254-287::336-370
MPPTYFPLRWESTGDQWWYASPIDWAAANGHYDLVRELLRMDSNHLFKLTSLRRIRRLEVVWDDEEQFNDVAKFRSEVAQKLLLESESKRGKNSLIRAGYGGWLMYTAASAGDLGFVQVLLERNSLLVFGEGEYGVTDILYAAARSKNCEVFRLLFDFAVSPRFLSGKGGMVEEHVGDIPSVYRWEMTNRAVHAAARGGNLKILEELLANCSDVLAYRDADGSTVLHAAAGRGQVEVVKYLTSSFDMINSTDHQGNTALHVAASRGQLPTAEALVSAFPSLISLRNNSGEIFLHKAVSGFKSHAFRRLDKQVELLRNMLSGKNFHLADIINVKNNDGRTALHMAIIGNIHTDLVQLLMTAPSINVNICDVDGMTPLDYLRQHPKSASSDILIKKLISAGGMFGCQGHSSRKAIASHLRMQSIGSSPGTSFRVSDTEIFLYTGIENVSDASAADHGSGGMSSSSSEHIPYDPNPTENRVPIATKRHSTVNHAAARLKRVLLWPRVKDRKSEGFKKPCTTDEGSVDSCRKWNNSFDETPTPLRQRFSRPSSLPNNKRTLSVRSHQSSPNAKKRFASGLVHGVMQSLPHAKVSGRSRSSSFSKSSISSPRSIDKQKGIFIDNDIAGPSCSSEQQLPPPPPPQPDDDESPKLVKRTSVGRKLRGHYFCFGAPGLNVKNSVHRQQESQSYKAHVVAVA

SEQ ID NO: 148234 - protein, 72 aa, Glycine max
  Coding DNA Sequence Number=SeqID_31456
MFQGVKGVVCLSLNFSQCFVKMDEDQWMHDNIMFEKVYMNEENEEEPSVNGETGEEPSVHQNVDCFDAFNTS

SEQ ID NO: 148235 - protein, 85 aa, Glycine max
  Coding DNA Sequence Number=SeqID_31457
  Homolog annotation: Hit_ID=Q851B2; Match level="QueryCoverage=79%, HitCoverage=18%, E-value=5e-12, Identity=45%"; Hit description =Putative ATP synthase subunit
MSKVEGSKYKELRRHMKERSLTNKVNRSKQEIKSIIGTKSIMQKAFEMKEDSKSGEWPDAVEVWKATHMRSNGIWCIPKGEEMMD

SEQ ID NO: 148236 - protein, 96 aa, Glycine max
  Coding DNA Sequence Number=SeqID_31458
MTSSSSLVCLFYFMLVAASSPAAASSCWVHLLPSRPHDTSILRYYENHITLRTWNGEERPELKVSSHGRKMAKFRRLAPEIEGLVGTSRLSPLIKD

SEQ ID NO: 148237 - protein, 202 aa, Glycine max
  Coding DNA Sequence Number=SeqID_31459
  Pfam annotation: Domain name=Transposase_23; Domain location=1-67; Score=-13.7; E_value=0.036; Accession=PF03017.5; Description =TNP1ENSPM transposase
MSDSKKCGLYVEENPSCLVALGRLYEGSTTVHNMPLRHDQLKVDVEEVKDIFVPTQEVQLVGQTLNTFVTWPIHLVKRLLEQVMWDATMFGKFNDDFHLYIKHEDLSEIAHGGRCLNISVIQLLIFAHWQMVVILPKENVVIWFCSFHNRPDNYLKGIINSALKGLDDTPQSKSKTATKWIVVKDKKEALNVGITSCTGCQL

SEQ ID NO: 148238 - protein, 700 aa, Glycine max
  Coding DNA Sequence Number=SeqID_31460
  Gene Ontology: Mol. function=RNA-directed DNA polymerase activity; Cellular component=chromatin; Biological process=chromatin assembly or disassembly
  Pfam annotation: Domain name=Chromo; Domain location=550-601; Score =35.7; E_value=1.6e-07; Accession=PF00385.14; Description='chromo' (CHRromatin Organisation MOdifier
  Pfam annotation: Domain name=rve; Domain location=276-432; Score =110.3; E_value=5.5e-30; Accession=PF00665.16; Description=Integrase core domain
  Pfam module annotation: Pfam domain module=Chromo::rve; Domain location=550-601::276-432
MLKKDNFIWSDAAKLAFQQLKKKLTETPVLALPDCSKTFVVEVDASSLGIGAVLMQDHHPIAYISRHLNHQQKSYSTYEKELLAVVMAVQKWRHYLLNTHFIIRIDHRSLKFISDQWTTAFQQRWLGHDNVAVDALSRVEPVACQALAVHQVVSELVIKIKTSWDSDPAVQRLISELQANSSSHKHYSWKNGELMRKGRLVVGRDDALRQDILLHFHASAAAGHSGRNATLQRLKSVVYWKGMSKDVRALVQQYSVCQKCKYETKTSPGLLQPLPIPDLIWQHITMDFIEGLPSSFGKQVIFVVVDRLSKAAHFMALSHPYSAADVAQSFLDHVFKLHGFPDFITSDRDSIFLSQFWQDLMTFQGVQVQLSTAYHPQTDGQTEIVNRCLETYLRCMCADSPSQWSKWLPLAEWWYNTTFHSSIRAAPYEVVYRQSPPVNLPYLAGASKIELVDRSLLKREEMLKLIKFHMKRAQDRMKQLADKHRSERQFNIGDMVYVKLHPYRQISVAARSNMKLSPKFYGPFQLKKHVGEAVTSSSLPCLVEGDPLIKEPEAILDRMTVKRRGRAVTKVLVKWKHSLPEDATWEFFFDLKQMIVVWQTDKASMLDEAIEYLKQLQFQVQMCRQDSFLHQHLNANHSDTNPLGCSQGTLATASLSFDMQPSAVKDNSTSQNFITGSDQSGVILRNSEPNIVLTPRLSGM

SEQ ID NO: 148239 - protein, 297 aa, Glycine max
  Coding DNA Sequence Number=SeqID_31461
  Gene Ontology: Mol. function=transcription factor activity; Cellular component=nucleus; Biological process=regulation of transcription, DNA-dependent
  Homolog annotation: Hit_ID=Q1SMR9; Match level="QueryCoverage=45%, HitCoverage=48%, E-value=5e-25, Identity=50%"; Hit description =Pathogenesis-related transcriptional factor and ERF
  Pfam annotation: Domain name=AP2; Domain location=100-164; Score =148.1; E_value=2.3e-41; Accession=PF00847.10; Description=AP2 domain
KKKKKQLEGELVSKVDRRQGKRSLPPHEEKKEAFNFPIIHPTPSQNRKEQASPSPFSLLMSNNKNNTFFPTPHGQISTSEFVNSQNPPQATNQGIDDIRKKHYRGVRQRPWGKWAAEIRDPKKAARVWLGTFDTAEAAAMAYDAAALRFKGNKAKLNFPERVVMPIPSQTNTNYNNNNTTSSSSAPTTQPSSLPPPPSQSLQNSSNNNSSLSSEGFPNLEEYARLLNCSDDDDFQRVALGLYQHHNNEDYIYGSSQPPPVPFFVSSYSSSSSAMASSFSDFLGQGGSGFDEENKRGS

SEQ ID NO: 148240 - protein, 255 aa, Glycine max
  Coding DNA Sequence Number=SeqID_31462
MGNNEGLIHITEEGKGGKNNPSYANGSVKGDWLESRRSDWLFRSNDDDDAGKGGSWKVSYDPMDKEVVLKSYFELGACLPNFHEQGWIKEVGKKEKERKHEKGESTSTEASQTGKLSPKTDMIVRGKDIHGEGDWDSLQNGPCKTNGGPNHVEMGKCGNNEQEGTCSHTKGSANDKWLPWVGKKFTRARAGGGAISRLDKALGMLTIIIHIHSCERKPNGRILGKKMHKTRRAANTIPILGGCKRIKWVGQRSGK

SEQ ID NO: 148241 - protein, 84 aa, Glycine max
  Coding DNA Sequence Number=SeqID_31463
MVALLKAQGILHVSLYNADEAMLHNWVARNVIAHVPVTLVKFLQSTGISLTIHSGTPKQPGIALSTYIYELYIENIRSDLSENN

SEQ ID NO: 148242 - protein, 81 aa, Glycine max
  Coding DNA Sequence Number=SeqID_31464
MIILRVDNGNVSISTLGLLYRSRVPDGCAYAPTAWDGLFWLLTNSEVVIWPCGRGKKVVFWLVLMRSEKGDDDGEACSFRF

SEQ ID NO: 148243 - protein, 72 aa, Glycine max
  Coding DNA Sequence Number=SeqID_31465
MKTPFTAFRHSITVNERKRKTLEKELWKVEMREMNGGVLEVRMRNGIKGKVCVGQRWRHSSLIYVFSLTPHA

SEQ ID NO: 148244 - protein, 68 aa, Glycine max
  Coding DNA Sequence Number=SeqID_31466
MSKHTTCQTTMDRLEEAVNCLTQDQHTLTHNLSTLITKSQELAAKLDVILDRLSTFTTTPSSPKSPRL

SEQ ID NO: 148245 - protein, 70 aa, Glycine max
  Coding DNA Sequence Number=SeqID_31467
GYTYSPRDANKNTEENKKWRRNVRHLAPLRDVNKMRGIQQGTTAMRERGLPITTVEENTPCTTIAGEKNV

SEQ ID NO: 148246 - protein, 551 aa, Glycine max
  Coding DNA Sequence Number=SeqID_31468
  Gene Ontology: Mol. function=nucleotidyltransferase activity
  Homolog annotation: Hit_ID=Q1S118; Match level="QueryCoverage=84%, HitCoverage=87%, E-value=1e-141, Identity=52%"; Hit description =Uncharacterized Cys-rich domain
  Pfam annotation: Domain name=PLAC8; Domain location=325-457; Score =139.0; E_value=1.3e-38; Accession=PF04749.7; Description=PLAC8 family
MTRDTIGGSLQEGLQDAASVGNTNGFKINVNSVLQISSSQRGLLSDESHHIRKQKMLTSIANIFKLQRLTLTPHANSASPSAKLRKKTEERYEFSHFVPSSIRENLRKPFNCFFAKKIDWPSLRRSCKQWIKNPLNMAILLWITCVAVSGAILFLVMTGMLNKILNKQSQRNSWFEVNNQFLNALFTLMCLYQHPKRFHHLVLLCRWKPKDIIILRKLYCKNGTCKPHEWFHMMVVVVLLHVNCFAQYALCGLNWGFNRSERPVVGVGICISIAIAAPALAGVYCIASPLGKEYETEEAAQNHIPTSNTFASRNDHSLVEYTPQWRGGLFDLWDNLSVACLTLFCSFCVFGRNMERQNFGNKYVHIATFLLFCVAPFWIFNMATINIDDEPVRLVLGLLGIFLCVFGLLYGGYWRIQMRERFNLPPNKLCCGKPAVTDCIQWLFCCWCSLAQEVRTAESYDIVEDKFFCKKQTQSCVQLALNSLPPEDKAPQVTSMSTSSFWSSHSFNKIWSEESKDHSSLSEIEFSRERKQNVMEVPIPLTIQIDDNDIK

SEQ ID NO: 148247 - protein, 273 aa, Glycine max
  Coding DNA Sequence Number=SeqID_31469
  Gene Ontology: Mol. function=serine-type endopeptidase activity; Cellular component=small nucleolar ribonucleoprotein complex; Biological process=proteolysis
  Homolog annotation: Hit_ID=Q9LFE2; Match level="QueryCoverage=99%, HitCoverage=30%, E-value=3e-68, Identity=53%"; Hit description=WD40 -repeat protein
  Pfam annotation: Domain name=Utp13; Domain location=209-273; Score= -41.8; E_value=0.0085; Accession=PF08625.1; Description=Utp13 specific WD40 associated domain
  Pfam annotation: Domain name=WD40; Domain location=14-52; Score=34.6; E_value=3.5e-07; Accession=PF00400.22; Description=WD domain, G-beta repeat
  Pfam annotation: Domain name=WD40; Domain location=56-94; Score=41.3; E_value=3.2e-09; Accession=PF00400.22; Description=WD domain, G-beta repeat
  Pfam annotation: Domain name=WD40; Domain location=98-134; Score=9.8; E_value=2.6; Accession=PF00400.22; Description=WD domain, G-beta repeat
  Pfam module annotation: Pfam domain module=Utp13::WD40::WD40::WD40; Domain location=209-273::14-52::56-94::98-134
MDGLSDNMTMPINLKAKAVVAAHDKDINSVAVAPNDSLVCSGSQDRTTCVWRLPDLVSVVVFKGHKRGIWSVEFSPVDQCVVTASGDKTIRIWAISDGSCLKTFEGHTSSVLRALFVTRGTQIVSCGMRLSVADFVLYNILVVEKARIRRIIEAEGIPYTYLCCHAFTGHNGQFIQEFFYNIYLYLSDIGVFQAKSITCSICEEGVVKGQELENAVSDADYTKAIQIAFELRRPHRLFELFAELCRKRVAENHMDRALKGLGGEELRILFNYI

SEQ ID NO: 148248 - protein, 168 aa, Glycine max
  Coding DNA Sequence Number=SeqID_31470
  Homolog annotation: Hit_ID=Q1S2Y9; Match level="QueryCoverage=86%, HitCoverage=96%, E-value=1e-64, Identity=80%"; Hit description=Wound- induced protein WI12, putative
  Pfam annotation: Domain name=WI12; Domain location=68-168; Score =148.8; E_value=1.5e-41; Accession=PF07107.2; Description=Wound -induced protein WI12
MKHISSSIEISEMGAERHEKEEMHNKATVEALYKALLGQGQMDTVATNMLASDLEWWFHGPPQCQHMMRVLTGETTLDNNGFRFEPRSVTAIGDCVIAEGWEGKAYWVHVWTVRNGLITQFREYFNTWLVVRDLRSQRWENKLDNMTLWQSQPRDLYRRSLPGLVLAI

SEQ ID NO: 148249 - protein, 147 aa, Glycine max
  Coding DNA Sequence Number=SeqID_31471
  Gene Ontology: Mol. function=transmembrane receptor activity; Cellular component=membrane; Biological process=defense response
  Homolog annotation: Hit_ID=Q8W2C0; Match level="QueryCoverage=82%, HitCoverage=14%, E-value=5e-30, Identity=47%"; Hit description =Functional candidate resistance protein KR1
  Pfam annotation: Domain name=TIR; Domain location=18-118; Score= -21.6; E_value=0.0065; Accession=PF01582.10; Description=TIR domain
MAMRPSSSSFSYRFTYDMFLSFRGEDTRCGFSGNLYNALQDRGIHTFVDYKELQRGHEITSALEKGIEILRMCDTTEVVFGEALANHEKKFNANKMGFKHNMEKTEAWKMALHQVANLSGYHFNGYHYNLLTYFLHSFINFNSSNDI

SEQ ID NO: 148250 - protein, 84 aa, Glycine max
  Coding DNA Sequence Number=SeqID_31472
MDEIIVGEMLAVGDIDEDAKVAKSPTARESREDGVMRVRARLWGLRRGFEPREGWWLRGVDAEEVDDGEDYQVGTWGSEEKNVS

SEQ ID NO: 148251 - protein, 41 aa, Glycine max
  Coding DNA Sequence Number=SeqID_31473
  Homolog annotation: Hit_ID=Q4JEZ7; Match level="QueryCoverage=63%, HitCoverage=5%, E-value=3e-07, Identity=92%"; Hit description =Sialyltransferase-like protein
MQVGTTVDTFLKQNLRDPKTGELEALSFDFNLCQAVATWEQ

SEQ ID NO: 148252 - protein, 92 aa, Glycine max
  Coding DNA Sequence Number=SeqID_31474
MIFVQVKGKGKSSKHLHVEEKEDFITMDDNKKWMHKETERCYPSSKEIVDLSPAYLGDDVFHYQSMKFGEGPTSGILVHVELTDATDNLHIG

SEQ ID NO: 148253 - protein, 248 aa, Glycine max
  Coding DNA Sequence Number=SeqID_31475
  Gene Ontology: Mol. function=RNA-directed DNA polymerase activity; Biological process=RNA-dependent DNA replication
MAQRVSTNIKKVAKMIDEGTAMEDSLKDIHGLFWNIRGDNSKRTWRLIHDIVRCHKRSLLLLYETYVAFVVTEARRKAIDYKHIFCKRLEGTLMNASWRCTVVYASLIPSIRASLLDHLLHLHQSFSIPWAIQGDMNEILLASEVMGSSFSYNRVVVLANFMSDCGLIDLDSVGGVFTWHRHTSNGVHIHKRLDRCMTWNNVLGNAIVKLGKITEESNYFNKETFGNIFRHKCHLEARLRGVHRVLDT

SEQ ID NO: 148254 - protein, 58 aa, Glycine max
  Coding DNA Sequence Number=SeqID_31476
MEIDRDQVVVHDKNHRVMDLIAGVVVVWVSCRCRTLTWTRVEHQTRQEIEVSMLHRFL

SEQ ID NO: 148255 - protein, 105 aa, Glycine max
  Coding DNA Sequence Number=SeqID_31477
MEEGRAGTVQILWKKSMEQGGTFENVDTGVRGAVSDEVGVCVGYNWMAENVNPLFYEFGWESGIKGEDYEVICFLSDTLMLDVISFLIEIIMLSSIIIIIFRITV

SEQ ID NO: 148256 - protein, 401 aa, Glycine max
  Coding DNA Sequence Number=SeqID_31478
  Homolog annotation: Hit_ID=Q9M644; Match level="QueryCoverage=14%, HitCoverage=27%, E-value=4e-08, Identity=54%"; Hit description =AP2/EREBP-like transcription factor LEAFY PETIOLE
  Pfam annotation: Domain name=AP2; Domain location=48-112; Score =114.7; E_value=2.7e-31; Accession=PF00847.10; Description=AP2 domain
MEEAMRRLNGVAPILGPDPKADGGVVADNPKRSSAVNKRALREDGGGAMRYRGVRRRPWGRYAAEIRDPQSKERRWLGTFDTAEEAACAYDCAARAMRGLKARTNFVYPTSPQPSSATTEHFLPNFNNSNNFHKHSVFNHHHGNRHITGSTTCFDQPHAVDFLAPRNSSSSALNMLLFRDLVHSNPSLLSSSTTHNFHDQFYSKGASTFSSLPGVSSSSSSLVPCYSVNNSCGGSSSVKMNTHCGTNFSEKGDDGDGSGFFSRESSDSGLLEEIVNKFLPKTKPNKCESLPKMETFRNPQEESLLLPPLVSESTLVSTAQECYDDVTKKGFLKNDSLGVFSSDHQGFPMQQFDAFNGFSSVQAMALGNEQIMMNHAENCVVEDVFQYHELLNAFAIRMQNT

SEQ ID NO: 148257 - protein, 350 aa, Glycine max
  Coding DNA Sequence Number=SeqID_31479
  Gene Ontology: Mol. function=binding; Cellular component=integral to membrane; Biological process=transport
  Homolog annotation: Hit_ID=O80412; Match level="QueryCoverage=85%, HitCoverage=80%, E-value=1e-138, Identity=78%"; Hit description =Mitochondrial phosphate transporter
  Pfam annotation: Domain name=Mito_carr; Domain location=150-238; Score=91.8; E_value=2e-24; Accession=PF00153.17; Description =Mitochondrial carrier protein
  Pfam annotation: Domain name=Mito_carr; Domain location=251-334; Score=4.9; E_value=0.0012; Accession=PF00153.17; Description =Mitochondrial carrier protein
  Pfam annotation: Domain name=Mito_carr; Domain location=53-141; Score= 83.4; E_value=7e-22; Accession=PF00153.17; Description=Mitochondrial carrier protein
  Pfam module annotation: Pfam domain module=Mito_carr::Mito_carr::Mito_ carr; Domain location=150-238::251-334::53-141
  Subcellular localization annotation: CTP_CleavageSite=56; ConfidenceScore=5.06e-01
MAPVDSDTLGRHSLIPSYLYSSPSPQKKKMEASSFAIHSPRENRNIEMFSPSFYAACTVGGSLSCGPTHTGITPLDVVKCNIQIDPVKYKNTSTGFGVMFEEQGLRGFFRGWGPTLVGYSAQGAFKYGFYEFFKKYYSDIAGPEYATKYKTLIYLAGSASAELIAGVALCPFEAVKVRVQTQPGFARGLADGLPKLVRTEGVSGLYKGIVPLWGRQVPYTMMKFASYENIVEMIYKHAIPKPKYECSNSLQLGVSIVSGYMAGILCATVSHPADNLVSFLNNSKGATVGDAVKKLGLWGLFTRGLPLRILMVGTLTGAQWGIYDSFKVFVGLPTTGGVAPAAVLAPASAA

SEQ ID NO: 148258 - protein, 124 aa, Glycine max
  Coding DNA Sequence Number=SeqID_31480
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q2HUJ7; Match level="QueryCoverage=81%, HitCoverage=29%, E-value=4e-38, Identity=74%"; Hit description=V -ATPase subunit C
MERIYAQNITMQNLQIAGRNQADDEKNNGQLLDYLHPVFSSWMHFCAVRVFTESILRYGLPPSFLACVLAPSVKAEKKVRSILEGLSDSSNSAYWKTEDEGVGMAGLAGDADAHPYVSFTINLV

SEQ ID NO: 148259 - protein, 123 aa, Glycine max
  Coding DNA Sequence Number=SeqID_31481
MLAYPGYLIKKFSTFIGFKSHVFTDVKGKREKNNFKININQLGKQGEQKEELRRYQRGIHSASGTRLARHPTCLANGETLEEDKPEMYSSNTQPACPARMLSLLALDAPTRAKRKFTNSRLTS

SEQ ID NO: 148260 - protein, 288 aa, Glycine max
  Coding DNA Sequence Number=SeqID_31482
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q0PGG3; Match level="QueryCoverage=100%, HitCoverage=65%, E-value=1e-108, Identity=71%"; Hit description =Vacuolar H+-ATPase subunit C
  Pfam annotation: Domain name=V-ATPase_C; Domain location=2-288; Score= 346.9; E_value=3.4e-101; Accession=PF03223.5; Description=V-ATPase subunit C
MATRYWVVSLPVQNSASTLWNKLQEQISKHSFDTPLYRFNIPNLRVGTLDSLLSLSDDLVKSNSFVEGVSHKIRRQIEELERVSGVMSSGLTVDGVPVDSYLTRFVWDEARYPTMSPLKEIIDGIHGQVAKIEDDLKCLSYTCINSTELLMPIMPNGFSLESHQPSGLLLLVAFFMKFSVRVSEYNNIRSQLNAINRKQTGSLAVRDLSDLVKPEDIITSENLTTLLAIVPKYSQKDWLSSYEILTNYVVPRSSKKLYEDNEYALYTVTLFSRVADNFRTSAREEGFQ

SEQ ID NO: 148261 - protein, 573 aa, Glycine max
  Coding DNA Sequence Number=SeqID_31483
  Gene Ontology: Mol. function=protein binding; Cellular component =nucleus; Biological process=response to molecule of bacterial origin
  Homolog annotation: Hit_ID=Q0Z845; Match level="QueryCoverage=99%, HitCoverage=100%, E-value=0.0, Identity=70%"; Hit description=Auxin -responsive factor TIR1-like protein
MNCFPDEVIGHIFGCVTSQRDRNAVSLVCKNWHRLERCCRKSLFIGNCYTISPERVIERFPELRSLTLKGKPHFPYFSLVPSGWGGFVAPWIEALARSRVDLEELRLKRMVVSDESLELLSRSFVNFKSLVLVRCEGFTTEGLAAIAANCRFLKDLDLHENVVTDLKGQWLSCFPDCCTSLVSLNFACLKGQINAGDLERLVARSPNLKSLRLNHTVPLSALQRILMQAPQLVDLGIGSFVFDPRSEVYNNMKNAILKCMSITSLSGFFWVYPHCLSALYPVCMNLTTLNLRFAAGIQNTELIKLICCCGKLQRLSIMDCIGDNGLGVVAATCKDLQELRVFPVVRVGGNGPTRVTEKGLVAISMGCPELHSLLYFCQQMTNAALITVAKNCPNFIRFRLCILDPTKPDPDTMQPLNEGFGAIVQSCKQLRRLSLSGQLTDQVFLYIGMYAEQLEMLSVAFAGESDKAMLYVLNGCKKIHKLAIRGSPFGDSALLMDVGKYETMQFLWMTSCNVTVGACKALAEKMPRLNVEIFNENKKVDRDVDDGQKVEKMYLYRTLAGRRKDAPELVWTL

SEQ ID NO: 148262 - protein, 146 aa, Glycine max
  Coding DNA Sequence Number=SeqID_31484
MFTIKNIIATLPGELDLKGNNKQSHEDRLAHSKQKSQTAKIKINKSLAGMKSTRAHRGGDDDPRAGNGSAAAEVAVDARCRSSPGRSHTADAAADAVEGTHHIPEAAAAEGTLHEAAPMGNPVGVEGKEIRALFRIQLNKLIRQSH

SEQ ID NO: 148263 - protein, 84 aa, Glycine max
  Coding DNA Sequence Number=SeqID_31485
MSQVMPKGRNMLSHADQSRLGGGSSVVVVEVTNDVECGGNSDDNGGGDDSGMVMLCSEVMSSSKISHGSSRWTLASIINNKCNM

SEQ ID NO: 148264 - protein, 100 aa, Glycine max
  Coding DNA Sequence Number=SeqID_31486
MTNFARCFQIIIVTRALWSDMGVRPETDTLTPKFVLPQISRLGSHDKRPHWNTTLDFFEPWPIKRILILSPKQRVAESPQGRANRMLKPDFPKKGMEKEK

SEQ ID NO: 148265 - protein, 120 aa, Glycine max
  Coding DNA Sequence Number=SeqID_31487
ALGFPALITDLCQSFGVPVTPSKAADATPPPHQADPAGSFGMERYFQHLVRQQAANHRGQGFAPFACPTLDQFRAEVAWPGDWPEDQTEEAPAGVPDGAEDARMDEEMTDLLGFLGRSGA

SEQ ID NO: 148266 - protein, 53 aa, Glycine max
  Coding DNA Sequence Number=SeqID_31488
MDVSVDVGVVSDTEHGKGLECLCFIACSESASFSASSSGLPSSLLSSGSNTDE

SEQ ID NO: 148267 - protein, 299 aa, Glycine max
  Coding DNA Sequence Number=SeqID_31489
  Homolog annotation: Hit_ID=Q9LSE0; Match level="QueryCoverage=74%, HitCoverage=45%, E-value=8e-76, Identity=59%"; Hit description =Genomic DNA, chromosome 3, P1 clone: MOJ10
  Subcellular localization annotation: CTP_CleavageSite=70; ConfidenceScore=5.42e-01
MRYGGGKRRRVALKPFFVLCVSVTGFGLLVLSLRLLDAPASSTVPLSRASSSSSEFNTSSKNGSRVKGVVAVRRVGEKPCKTVEEMGEDFTSGVGKKESLRVRRMIQNHFLANGASRVRDLPPEQFCRHGFVLGKASEAGFGNEMYKVLTAAALSIMLNRSLIISQTRHIEIKHLWRHKGCESKYGRKLVIRIDDFMKPVETNVICSNWKKWKQPIIWFHGTVDSVAAQFFLKNIHSQMRTAALNLFSDPQVLGIRPNVFGELMRVLIFPSEDVEAAVNWVIGGGENPDISLHMRMLMN

SEQ ID NO: 148268 - protein, 105 aa, Glycine max
  Coding DNA Sequence Number=SeqID_31490
MVAKDPRLRDPFLSIVSNRRNENNAHRPHCNLSFASPNLELLHFSVQTSDKYSLPPIFTTPVFTNLLRRYPNQRIWKYKYQEKTCIVIGANSRIGYAIVVEGLAK

SEQ ID NO: 148269 - protein, 197 aa, Glycine max
  Coding DNA Sequence Number=SeqID_31491
ALGFDGCLKDADWEVGYGPSCIVQTTDGLRCQEGIVRQRKGLKRMTGLECCYHRKKCHDALLWQLKWNFTSRGCDVWCGEPSSLLQERAAMRLAAEDSSFVVRAKYWHAAIGRLMKSQRLNWKKSDTFIRVWHELAGDSVTAHWAVPRGGEPSSLLDRVNLGALWLAFRPSSLPPLVHPKDLPPLLPEWTAFEQDGT

SEQ ID NO: 148270 - protein, 104 aa, Glycine max
  Coding DNA Sequence Number=SeqID_31492
MTPLMKTIQGLQAPHGATSFCFDLFWRSTHRVYIREGDARLTGASSKKGKCVESPPTFIRGKRRKNRKGCGLRTLIVKGSGVFFTHGEGISIPHVCHKGRQPLI

SEQ ID NO: 148271 - protein, 97 aa, Glycine max
  Coding DNA Sequence Number=SeqID_31493
ADILTARFPDPNNGVKMGSSRCGVATENNSGLWWLMVAVGDGESAWDVRNGFGRKKEEEMVFFLSYTKAKAENAQVRNGLGHENLPHTPEIFSKIPK

SEQ ID NO: 148272 - protein, 284 aa, Glycine max
  Coding DNA Sequence Number=SeqID_31494
MSSRKRKSVGSRPTPQYDTRRFQSFEAWTRYTDNVLGRYILVERKVEIYHTELGEFKGEMERRNFHKRLTNLADSSIDLALVKEFYANLYSPEGPSPKQVRIQSHLITIDADNLNAFLETPVVLAEGHPRKILRKDLTTLAQLDMKVGALISGQITSMAQSNSSRLGFPALIISLCRSRGVTSDSLVFESLSLVINLAYMRKNCWNPDDPTIIIRGARRPRARPAETSSTSATPHLAFTSAALPPARIPPPHRDDEDPTAQVPHQPVDESSKSSTLEPLIRKRR

SEQ ID NO: 148273 - protein, 72 aa, Glycine max
  Coding DNA Sequence Number=SeqID_31495
GLVGACTLSATLARLARISKFRLSAHLFAQWMDSSGALTGISPRLENMHNSSFFQILSRTQPKECCAQRMAR

SEQ ID NO: 148274 - protein, 129 aa, Glycine max
  Coding DNA Sequence Number=SeqID_31496
  Homolog annotation: Hit_ID=Q6CQE6; Match level="QueryCoverage=46%, HitCoverage=49%, E-value=2e-11, Identity=70%"; Hit description =Kluyveromyces lactis strain NRRL Y-1140 chromosome D of strain NRRL Y- 1140 of Kluyveromyces lactis
MRDEPEAGFTVPNLRANLDPTKGVGRLRQQDGGHGSRNPLRSVLPTLETAQPEVGSSGWKSTARRVVSGAPPAALENPEDRVPPTPGRTHNRIRSPRQGKSAKWIRNLGKRIGSEGWARGSQSRTRRLS

SEQ ID NO: 148275 - protein, 46 aa, Glycine max
  Coding DNA Sequence Number=SeqID_31497
MVRTEYRTLGELVLSGKLFRKIGVWYLNYLGKKKENHAREILCKNK

SEQ ID NO: 148276 - protein, 85 aa, Glycine max
  Coding DNA Sequence Number=SeqID_31498
MEVLELKIKSSLETIKISTKTFIVRERILCDHVFHASQLTKHIAKMKKPLSEKILHMIDIHLRSVVAPQSCIRIRGRIGKKKGHL

SEQ ID NO: 148277 - protein, 97 aa, Glycine max
  Coding DNA Sequence Number=SeqID_31499
  Homolog annotation: Hit_ID=Q39889; Match level="QueryCoverage=43%, HitCoverage=4%, E-value=5e-10, Identity=76%"; Hit description=Heat shock protein
  Pfam annotation: Domain name=Clp_N; Domain location=10-60; Score =10.8; E_value=0.069; Accession=PF02861.11; Description=Clp amino terminal domain
MNLMKAIKRAQGAQKSCGNTHLAIDQLILGILEDSQIRELLKEAESTEDPAFHAISRLIAEFEYHLCLIHTKFDACLMLHPGSIGVLTREMENNPEV

SEQ ID NO: 148278 - protein, 84 aa, Glycine max
  Coding DNA Sequence Number=SeqID_31500
MRRCKSLIGLVSKLLKILEGARDVDGEVETDVVGDGGVEGPGFGEGVEDQGPGEGRGEVVGGGGSELVAESKSQRGSAREWMEK

SEQ ID NO: 148279 - protein, 68 aa, Glycine max
  Coding DNA Sequence Number=SeqID_31501
MMIWKQRSKLVMATARWVLKHPVYGIVILRLGIYASYDHNMPTFEDDVPKGKLYKVPEFQQTLSTITK

SEQ ID NO: 148280 - protein, 49 aa, Glycine max
  Coding DNA Sequence Number=SeqID_31502
  Homolog annotation: Hit_ID=Q84LM4; Match level="QueryCoverage=94%, HitCoverage=6%, E-value=9e-12, Identity=63%"; Hit description =Acylamino acid-releasing enzyme
MVGFLYARASREKGVQVKVFPNDVHGIERTQSDFESYINIVMWFNKYCK

SEQ ID NO: 148281 - protein, 146 aa, Glycine max
  Coding DNA Sequence Number=SeqID_31503
  Homolog annotation: Hit_ID=Q9SZ53; Match level="QueryCoverage=21%, HitCoverage=8%, E-value=3e-08, Identity=83%"; Hit description =Protein phosphatase 2C-like protein
  Subcellular localization annotation: CTP_CleavageSite=59; ConfidenceScore=5.31e-01
MTNTTTNKSFYDIGITTVVSKSSLLQWVFSQELKAKVVAKARQFSQELRRFSWSHNHSSCMLSSSSTPNDGGAGFKMALAMLWLTCTFVFLDPGTHKTLRNLKFINNRSSGIDAWNEAYSLSRDHKPDLEIEKERILKSGGFIHTG

SEQ ID NO: 148282 - protein, 92 aa, Glycine max
  Coding DNA Sequence Number=SeqID_31504
MQYAQLLWSRDDDDLQRVASGLHHQQHHHHHHHPNEAFYDSSSSTLFSSSSTTSSMAVSDQQQIGDDTSTAPKRGEYYDSCFFRGNDFHDKN

SEQ ID NO: 148283 - protein, 344 aa, Glycine max
  Coding DNA Sequence Number=SeqID_31505
  Gene Ontology: Mol. function=ATP-dependent helicase activity; Cellular component=membrane; Biological process=phosphorylation
  Homolog annotation: Hit_ID=Q2KCR9; Match level="QueryCoverage=80%, HitCoverage=33%, E-value=1e-117, Identity=76%"; Hit description=ATP -dependent RNA/DNA helicase protein
  Pfam annotation: Domain name=DEAD; Domain location=83-263; Score =121.8; E_value=2e-33; Accession=PF00270.19; Description=DEADDEAH box helicase
  Pfam annotation: Domain name=ResIII; Domain location=79-259; Score= -25.2; E_value=0.006; Accession=PF04851.6; Description=Type III restriction enzyme, res subunit
  Pfam module annotation: Pfam domain module=DEAD::ResIII; Domain location=83-263::79-259
MACSTPSPSFIGLFHVLLLRYHGHYLSMIMFSCQAALFRPSFSQVFHYVKGVKHTESPISGIDVGTLPLSFQKWFVEKGWSPRAHQLELMARARGGENMLLIAPTGAGKTLGGFMASLTDLTERGKIPPGSGFVGVHTLYISPLKALAVDIERNLTKPVSEMGLPIVIETRTGDTPQAKRQRQKVRPPDILLTTPEQVSLLLANKEAERFFRDLKYVVLDELHSLVTSKRGHLLSLALARVRRHAPDVRFIGLSATVAEPMDLRRYLAPQGQGKPPAGLITVEGGAKPDISILHTEERIPWSGHSARYAGRGLIRSVEATSDDAGVCQHTLAGGKGLSGSLDDQ

SEQ ID NO: 148284 - protein, 93 aa, Glycine max
  Coding DNA Sequence Number=SeqID_31506
MEAYAKDEKLLMHFFQESLTRAGDTWYTNLELSRVHSWKDQMVAFVRIQLQNMCKKEHESFKEYAQRWRDLATHVAPPMMEREMMMEACLWGF

SEQ ID NO: 148285 - protein, 279 aa, Glycine max
  Coding DNA Sequence Number=SeqID_31507
  Gene Ontology: Mol. function=transporter activity; Biological process= transport
  Homolog annotation: Hit_ID=Q8AAA5; Match level="QueryCoverage=91%, HitCoverage=61%, E-value=1e-42, Identity=38%"; Hit description=Outer membrane efflux protein
  Pfam annotation: Domain name=OEP; Domain location=31-229; Score=-3.0; E_value=0.015; Accession=PF02321.8; Description=Outer membrane efflux protein
MYKNAQKYLLVFVLGCASTTSFKSQLQSLSLEECYQLAKDNYPLIRKKGMIAKTAGYNTENANKKYLPQVSFSGQATYQSQTISFSDALGALPINAALPSLSKDQYKIQGEIDQVLYDGGTTHNQKELIKANTELQQQNIETSLYTLKQRVNNLFFSILLMDAQLKQNDLNKSNLHTQIQKTEAALKYGVAYRSNLDELKAEIINIDMMATEYKANREAYLKMLSIFIGKELSDSTKLETPDSDYFQTEIRRPELKAFDLQNSIYDLQKKQLKSDFLPR

SEQ ID NO: 148286 - protein, 285 aa, Glycine max
  Coding DNA Sequence Number=SeqID_31508
HLEERVKALADQGEWVLFIDVLALLIFGVILFPNVDGLVDLTAIDAFLAYHHSKESPVVTVLADAYDTFDRRCEKNSARIGHPLIGSPDGRKEEPGFCPHDKELRGSNNGIIDDYHKWLKAQTQELVWLPKLKASSEEEAETPEESEEVQALKAKLERVQAVKEKFKMKAIKWGRNKFRGALWDSNSKLKLRRAETDQSRVEGMILEDKLKACQRSKRSLSEQLSRTEENMWAIIDQYKEKLSLAATHEQRLEDEFAFTLNGSQELPSLLAKAKTMADMYLAPEE

SEQ ID NO: 148287 - protein, 55 aa, Glycine max; identical to SEQ ID NO: 125990
  Coding DNA Sequence Number=SeqID_31509

SEQ ID NO: 148288 - protein, 82 aa, Glycine max
  Coding DNA Sequence Number=SeqID_31510
MLEVVSNPWRFTVGNWLCDSDLVSPTGIERVLTEKDLLADSYSDLEASILDEKEFLLLKVISTFPELSCLICSMVGAGRGID

SEQ ID NO: 148289 - protein, 198 aa, Glycine max
  Coding DNA Sequence Number=SeqID_31511
MSCLVIITPISLCRSVSWCMPPTRHPLDPDKSNRALGFSALIMGLYQSLGVPVTPIKVIRPPITRAFIEKYCMPRQAEGDAPRATDAPPPPHQADPAGSLGMERYLQHLVRQQAANHRGQVQIHECLYRFSLSQQGQGFTPFACPTPEQFRVEVARPGDWPEAQEGEALAGSPGDAEEARMDEEMMDLLDFLGGSGAT

SEQ ID NO: 148290 - protein, 67 aa, Glycine max
  Coding DNA Sequence Number=SeqID_31512
MGHWGRWLSDIICRRRIVWLANHSNSMRYSHSQIGVGKIWTMHCIGHHSRRERIWSQVLGPTLAMKK

SEQ ID NO: 148291 - protein, 96 aa, Glycine max
  Coding DNA Sequence Number=SeqID_31513
MQTIITRSKRETMVKDEGRNSDEEELVVEEEKEKEEDQMREKKNDGEEEEKNEKKRKNEEEKKIKRELAREKKKEVVSYRGKEAPYPLVPSKKDME

SEQ ID NO: 148292 - protein, 65 aa, Glycine max
  Coding DNA Sequence Number=SeqID_31514
MGCYNTTPLKRSFIPETSPKERQEKDYTSGSQYQAVYPPKALFDHPTPLYLATKPDGSRFLKDSI

SEQ ID NO: 148293 - protein, 56 aa, Glycine max
  Coding DNA Sequence Number=SeqID_31515
  Homolog annotation: Hit_ID=Q5DW42; Match level="QueryCoverage=67%, HitCoverage=3%, E-value=5e-12, Identity=89%"; Hit description =Phototropin
MLESIIYRDLKPENILLQKDGHVVLADFDLSFMTSCKPQMSKSGFYEPNPTLQNQH

SEQ ID NO: 148294 - protein, 62 aa, Glycine max
  Coding DNA Sequence Number=SeqID_31516
  Subcellular localization annotation: CTP_CleavageSite=32; ConfidenceScore=5.18e-01
MGNQKYLANSSLKIFIGCLSSKANNSPPGKKSATQLGALIFKNWESCSLGRIKPPLGHLSAT

SEQ ID NO: 148295 - protein, 112 aa, Glycine max
  Coding DNA Sequence Number=SeqID_31517
MVSTLTYLPSLKWRHPNSMTCIKRSAPSKDHINLQDYIDSFCEEDKGLTVDVLKVEHYEKNVKAGCFDCDGDLCRVKELFKHECAKFNKTISLGFQDPKKGKIVRGDNEQAI

SEQ ID NO: 148296 - protein, 114 aa, Glycine max
  Coding DNA Sequence Number=SeqID_31518
  Homolog annotation: Hit_ID=Q5DW42; Match level="QueryCoverage=53%, HitCoverage=5%, E-value=2e-20, Identity=80%"; Hit description =Phototropin
MVKATAENVDEAVRELPDANLVSCHLKKSGKRPEDLWAIHSQPVFPRPHKKDNPSWIAIQKEGSSLSSVVQLPLFRILTALYLTILGFVGEFLKGFRRLRDFGLVRENKVVATK

SEQ ID NO: 148297 - protein, 512 aa, Glycine max
  Coding DNA Sequence Number=SeqID_31519
  Gene Ontology: Mol. function=protein serine/threonine kinase activity; Cellular component=membrane; Biological process=two -component signal transduction system (phosphorelay)
  Homolog annotation: Hit_ID=Q5DW42; Match level="QueryCoverage=98%, HitCoverage=58%, E-value=0.0, Identity=66%"; Hit description =Phototropin
  Pfam annotation: Domain name=PAS_3; Domain location=212-308; Score =20.9; E_value=0.00093; Accession=PF08447.1; Description=PAS fold
MEKLKVSAKNDPAGSSDQADSFPIFELWESENVGQKSSRRDEDDTKAVRLDGDSVIAPSNSANNSKEPVNKWMAFAKKPGFTVDGNSATKDKSTTEDNYSRNHLKEKPSSGQNFLSEATIAERTAEWGLAVDSGNFKALGGENTSGGSFDGDKSRNLSDRFVESTRTSGESNYGSESSLGVFPRVSQELKEALATLQQTFVVSDATKPDCPIMYASSGFFTMTGYSSKEIIGRNWSLRSRFLQGPETDKNEVAKIRDATRNGRSYCGRLLNYKKDGTPFWNLLTVTPIKDDHGNTIKFIGYYYRMQVEVSKYTEGMNEKALRPNGLPKSLIRYDARQKEKALGSITEVVQTVKDPKSIINDRNGDTATMPEEQEKFNFDFVLPKSADIGNTSTPGRQASPLNIQRMSSSQDKSKTSSRSGRISFKGLKGRSPSSAEEKPIFEPEVLMTKEIEWSNNLEHSLRERDIRQGIDLATTLERIEKNFVISDPRLPDNPIVRQFFSSLEQQGAFFFP

SEQ ID NO: 148298 - protein, 59 aa, Glycine max
  Coding DNA Sequence Number=SeqID_31520
MFDLVTDSDELAILLTRVVNTGWPNPFWPGLLLDRHKQASSAHPAKQNGLPFLARPVSS

SEQ ID NO: 148299 - protein, 236 aa, Glycine max
  Coding DNA Sequence Number=SeqID_31521
  Gene Ontology: Mol. function=protein binding; Cellular component =membrane; Biological process=defense response
  Homolog annotation: Hit_ID=Q6SQJ2; Match level="QueryCoverage=99%, HitCoverage=19%, E-value=1e-107, Identity=82%"; Hit description=NBS -LRR type disease resistance protein RPG1-B
  Pfam annotation: Domain name=LRR_1; Domain location=141-160; Score =3.4; E_value=65; Accession=PF00560.23; Description=Leucine Rich Repeat
  Pfam annotation: Domain name=LRR_1; Domain location=164-186; Score =8.7; E_value=6.9; Accession=PF00560.23; Description=Leucine Rich Repeat
  Pfam annotation: Domain name=LRR_1; Domain location=18-41; Score =12.4; E_value=1.4; Accession=PF00560.23; Description=Leucine Rich Repeat
  Pfam annotation: Domain name=LRR_1; Domain location=189-212; Score =7.6; E_value=11; Accession=PF00560.23; Description=Leucine Rich Repeat
  Pfam annotation: Domain name=LRR_1; Domain location=61-84; Score=2.7; E_value=89; Accession=PF00560.23; Description=Leucine Rich Repeat
  Pfam module annotation: Pfam domain module=LRR_1::LRR_1::LRR_1::LRR _1::LRR_1; Domain location=141-160::164-186::18-41::189-212::61-84
MEEWEEWEYKGVTGAFPRLQRLYIEDCPKLKGHLPEQLCHLNDLKISGCEQLVPSALSAPDIHKLYLRDCGKLQIDHGFTLKELTITGHTVEAALLEQIGRNYSCSNNNIPMHSCYDFLLRLEISSGCDSLMTIQLDIFPMLRRLDIRKCPNLQRISQGQAHNHLQCLRIVECPQLESLPEGMHVLLPSLNYLYIGDCPKVQMFPEGGVPSNLKRMGLYGSSKLISLKVPWEAITL

SEQ ID NO: 148300 - protein, 85 aa, Glycine max
  Coding DNA Sequence Number=SeqID_31522
MQWFFMISHSFMTPTLPVDSARHPPVTQDDTYVEPHIPEVPVAPVAAPAHAPSDAEQPRHEVEACQAIAERLEHLLNLRIVTVGT

SEQ ID NO: 148301 - protein, 118 aa, Glycine max
  Coding DNA Sequence Number=SeqID_31523
MEQPDIDGLNIEDEVDMEFNIPESGESEIDLSLFLEQMAEVWRPIEGIAIDELNPTLFIFSFYHKVDVQQVLNGGPWHFDKHMLILGPWHFEALGTRNTCGDAKTWWKWRVTVAPRGR

SEQ ID NO: 148302 - protein, 81 aa, Glycine max
  Coding DNA Sequence Number=SeqID_31524
MENAGFSWDGENNNTKIDPLLQFQVNVLKSEEFKTSSWQEEQILTQNLIDFTNYPLMSLSEDLTGANFDVFQQISLDDDYC

SEQ ID NO: 148303 - protein, 574 aa, Glycine max
  Coding DNA Sequence Number=SeqID_31525
  Gene Ontology: Mol. function=RNA-directed DNA polymerase activity; Cellular component=chromatin; Biological process=chromatin assembly or disassembly
  Pfam annotation: Domain name=Chromo; Domain location=524-574; Score =35.0; E_value=2.7e-07; Accession=PF00385.14; Description='chromo' (CHRromatin Organisation MOdifier
  Pfam annotation: Domain name=Fve; Domain location=124-240; Score= -8.7; E_value=0.093; Accession=PF09259.1; Description=Fungal immunomodulatory protein Fve
  Pfam annotation: Domain name=RnaseH; Domain location=65-165; Score= -33.3; E_value=0.073; Accession=PF00075.14; Description=RNase H
  Pfam annotation: Domain name=rve; Domain location=280-438; Score =40.8; E_value=4.8e-09; Accession=PF00665.16; Description=Integrase core domain
  Pfam module annotation: Pfam domain module=Chromo::Fve::RnaseH::rve; Domain location=524-574::124-240::65-165::280-438
EYLGHFISKVSTDPAKVLAVEQWPLPKTLKQLRGFLGLAGYYRRFVKGYEVNALGLGIGAVLMQDHHPIAYISRHLNHQQQSYSTYEKELLAVVMVVQKWRHYLLNTHFIIRTDHRSLKFILNQKWTTAFQQRWLVKLMEFDFSIEYKQGHDNVVVDALSRVEPVACKALMDHQVVSELVIKIKASWDSDHAIQRKISELQANSSFHKHYSWKDGELMRKGRLVVDRDDALRQDILLHFHVSAAVGMSKDVKAFVQKCSVCQKCKYETKASPGLLQPLPIPDLIWQHITMDFIEGLPSSFGKQVIFVVVDRLSKAAHFMALSHPYSTTDVAQSFLDHVFKLHGFPDSIIRDKDSIFLSQFWQDLMAFQGVQVQLSTAYHPQTNDQTEIVNRCLETYLRSTPYEVVYGQPPPVNLPNIAGASKIELVDRSLLRREEMLKLIKFHMKRAQDRMKQLADKHRSERQFSVGDMIYVLEQIGAVAYKIMLPSGSRLHDVFHVSQLKKHVGEAVTSSSLPSSVEGDPLIKEPEAILDRMTVKIRGRAVTKVLVKWKHSLPEDATWEFFFDLKQRYPHFQP

SEQ ID NO: 148304 - protein, 415 aa, Glycine max
  Coding DNA Sequence Number=SeqID_31526
  Gene Ontology: Mol. function=RNA-directed DNA polymerase activity; Cellular component=chromatin; Biological process=chromatin assembly or disassembly
MAELMQLRQKGSIVEYHEAFEAIVARLDLIEEHRLSCFLGGLKQEVQMLNKQSKPEASSKPSLLPTPPKTLSKTQDIPKTKQQTSKTLTPAYISDRRAKGLCYFCDEPFMPEHGLSHKTLQLQVMEVDELQEGAEEEVFLENSMGSSSIDPQIFVHALTGIANFHTMRVTGYYQKKPLHVLIDSGSTHNFLDIEVAKRLGCKSNVFDSVSVVVVDGTQLNVSAVVRGFQWIIQQTKFTSDMLLIPLGCCDLVLGMEWLVSLGDIVRNFNKLQMELYVRGRRNVLRGASTGLKTVKRQQLGKAMSTGVHLSILQVCDGQKGYLNLLTTQVVDKEVPPTLAKLLDEFSDLFQEPSGLPPRKPGHDHRIPLVQGVRPISKRPYRDLNKHTVKNMFPIPLVDDLLDELEGSSIFSKIDL

SEQ ID NO: 148305 - protein, 154 aa, Glycine max
  Coding DNA Sequence Number=SeqID_31527
MKDHSMLIRNAKDTKRRGKKGVREAERWVPWSKSEGIGRNKREEEENKAEALPNRDRNRLLHRSSFGILHSSSASMRSFNGDFPPWRCSGRQRKRGERRRHPLRNKPWKKDLHHQDEPWIRSLERMLQWRKRKRERKRGGSTKLKEEKGREVEL

SEQ ID NO: 148306 - protein, 65 aa, Glycine max
  Coding DNA Sequence Number=SeqID_31528
MDGILISSVVLLADSRFTRPDMGFHPTKLNFVPSDADEAPLDVSICLHAFGIVGCGSFSGVKSAN

SEQ ID NO: 148307 - protein, 87 aa, Glycine max
  Coding DNA Sequence Number=SeqID_31529
MKILPLYKMIVGLQGCVYKIDSLYGGSLKLEDRDFPSYLSSLSKRLSNFLAFSLQGVDSLLSLGSTHSTVAHSSLRIETSQAIYLLS

SEQ ID NO: 148308 - protein, 166 aa, Glycine max
  Coding DNA Sequence Number=SeqID_31530
MLSHSLPIDTQSIAFLGETSSQTIVNSRLAFIFPNGSIIHNDAGVYFQTSTPVPIRVPNNCDFASLKTRIHNTLQLSDKQFLDEIHYRKLFTDTGNQIRFQCMKLINDDDVNTMLMSNDQFSCVGPIELLCTVGRTPDGIINLLQRTRPRTHDAILYYNEKWNMPP

SEQ ID NO: 148309 - protein, 185 aa, Glycine max
  Coding DNA Sequence Number=SeqID_31531
  Homolog annotation: Hit_ID=Q47336; Match level="QueryCoverage=25%, HitCoverage=53%, E-value=1e-20, Identity=100%"; Hit description=LacZ- alpha peptide
MGLVLSHFKPWRFGAINACWSCLRMRRVQVHRIRFGYCGYWGSLKEGVFKEVEKKRLDCDAKVHKANILIIAHTCVLSMFYESSDQGNLRPRSIDPPSHSHHKVLWKASAYDMVALSQSGRHRGGAPIRPIVSRITIHWPSFYNVVTGKTLALPNLIALQHIPLSPAGVIAKRPAPIALPNSCAA

SEQ ID NO: 148310 - protein, 166 aa, Glycine max
  Coding DNA Sequence Number=SeqID_31532
MVTSKKSRRGIGGSILYQILELSFKDFIPIKVFLSVQGSCCKQQRLLAVIGGRWWWKMRLGVLGEGLGEKMGAKCMFYVVGRICMLQDSSKQNFSRLGELAQLRLAWVSSVRILLQHILLLLLKCHISHSDVIWKIPMVKTCKRGLFWVNLRITQFQRRSIKLHIT

SEQ ID NO: 148311 - protein, 164 aa, Glycine max
  Coding DNA Sequence Number=SeqID_31533
MGAKYLKVVKRGLHPNNGWSLDKIRWKSQVGCLRTGRRHEKFETFSGVTSDATLLVESKGKEGGDRQVTSKVANACCDDRSTEKTNKYQNEVTTGGPGGEKDKVNIERCLALLSFKRLAKILLKHKHLDNEGKLELLHMMSNLMSRNKIGLHNARGKIKCQVKN

SEQ ID NO: 148312 - protein, 162 aa, Glycine max
  Coding DNA Sequence Number=SeqID_31534
  Gene Ontology: Mol. function=ribonuclease H activity
  Subcellular localization annotation: CTP_CleavageSite=66; ConfidenceScore=5.43e-01
MYNLQIVARSPLCFLQKIKSKSNRFFQQRFPKPMQCRPQLNGISFSNIGQQQNQMLVSNFYEEEIRAFNKELLGKWRWDMLQQSNKLWSKILHSKYGGWRSLVEGSRRNNESGWWKDLMEVTHDQQMNSILQDGTTWRVGCGDKIKFWEDSWAGHGKAQKIK

SEQ ID NO: 148313 - protein, 403 aa, Glycine max
  Coding DNA Sequence Number=SeqID_31535
  Gene Ontology: Mol. function=nucleoside-triphosphatase activity; Cellular component=membrane; Biological process=transport
  Homolog annotation: Hit_ID=Q1H207; Match level="QueryCoverage=99%, HitCoverage=28%, E-value=1e-166, Identity=72%"; Hit description=ATP -dependent helicase HrpA
YARVVAKIDPDWIEPIANEGGSRDLTQSDYTDPRWDRKPAQVVAWERVSLYGLTIVPKRRVHYGPINPTEAREIFIREALANMEFDTRAPFFEANRRLIAEVEALEHKARRQDVLVDEYQLFVFYDKVVPPIAGPGDQEPYRIYNGASFEKWRQDAEKINPKVLYLTRESLMRHGASAITEVQFPEQMTIAGETVPLKYRFEPGHVLDGVTATIPLALLNQLDATVTEWLVPGMVRDKVTALIKALPKTLRRVCVPVPEFVTGFLEAKNPQHPLLPALAEFIQHKTGLKLKPEEFDLAGLDAHHLMNFSVVDEKGRELGMGRDWHLLKKQLGSAAQLTFRTGSPGIEKSGLKQWDFGDLPDTLTFSTDGRQLTGYPGLEDNTDSVAVKLFDTPEAATVAHRQG

SEQ ID NO: 148314 - protein, 236 aa, Glycine max
  Coding DNA Sequence Number=SeqID_31536
  Homolog annotation: Hit_ID=Q1S2A8; Match level="QueryCoverage=54%, HitCoverage=20%, E-value=8e-19, Identity=44%"; Hit description =Remorin, C-terminal region, putative
  Subcellular localization annotation: CTP_CleavageSite=29; ConfidenceScore=5.66e-01
MKKSSSSSFQNLGSFPSPGAPYYRERNIRSQKGWCSERVSNSKLSTSASSISRRHTMAGLITTPFCGGRTLPSKWDEAERWICSPVSAYAESRSCSHAQLQRRPKSISGPIVPPGVASFYSNQGLVVRNLVVGSPFSTGVLAPVAVSVHHFDAHDGNVFGYDLDSGMQFSRPGINENGVVLSSLSSAEPTCSEQPCDQSSPISQDSRVKGFVFMLESMLHTLRLWYFKSTMTLMPG

SEQ ID NO: 148315 - protein, 120 aa, Glycine max
  Coding DNA Sequence Number=SeqID_31537
  Subcellular localization annotation: CTP_CleavageSite=71; ConfidenceScore=5.36e-01
MATVGRRCLLLDPHTKRNTLIGAKSSKSSSKIRWRKSFNPPFQSFSENTKHPSALYVLTERLALDRQARTREGSLSDAKRNRWGVHDRSGECEPQAWKTYLYAECDSLLMLLLVTLIDMW

SEQ ID NO: 148316 - protein, 341 aa, Glycine max
  Coding DNA Sequence Number=SeqID_31538
  Gene Ontology: Mol. function=protein kinase activity; Biological process=protein amino acid phosphorylation
  Homolog annotation: Hit_ID=Q2QZ78; Match level="QueryCoverage=58%, HitCoverage=51%, E-value=3e-30, Identity=53%"; Hit description=AT hook motif-containing protein, putative
  Pfam annotation: Domain name=DUF889; Domain location=105-285; Score= -39.4; E_value=7.9e-09; Accession=PF05970.5; Description=Eukaryotic protein of unknown function (DUF889)
MSKLEELGNHTSQWFRKNLDVENINFDIKKSVTDCFNSGFKWNNIIVVTWRALPGGQTAHSKFKIHVSTFDDSICNIHQGSELAELLKVTKLIIWDEAPMAHKFCFEALDKSLGDIMGLGNESLQYLEETSLFLVEIFIKSYQLFQEEADLILFIQRLMHHIYGIIVRAILASTIDTVDEINDFFLSLVPGGEKEYLSLDMIYKSNAADNQAWKALTPKFLNSLGTSGLPNHKIKLKVGSLIMLLRNIDQSEVLLQFSSSTFRNVMDDFGDVLSNLSVSHSSKNNLPFHVVNILMQAKSDSVILEFLGGVITECKGLIHQLHKNTMKIEKGWKRYCKYNKL

SEQ ID NO: 148317 - protein, 168 aa, Glycine max
  Coding DNA Sequence Number=SeqID_31539
  Gene Ontology: Mol. function=triacylglycerol lipase activity; Biological process=lipid metabolic process
  Homolog annotation: Hit_ID=Q1SH82; Match level="QueryCoverage=95%, HitCoverage=33%, E-value=3e-51, Identity=59%"; Hit description =Lipase, class 3
MLMMHDERLLLERLEGVYTFGQPRVGDENFANYMEKNLKYYGIKYFRFVYCNDIVPRLPFDDDIMKFEHFGTCLYYDRFYRGKKVKEEPNKNYFSWPWKGMMIQKKVNAFRELVRSFTIVHKHGPEYQEGWLLRFIRVLGLLFLAGLPAHCPQDYVNVTRLGLPSHLD

SEQ ID NO: 148318 - protein, 144 aa, Glycine max
  Coding DNA Sequence Number=SeqID_31540
  Gene Ontology: Mol. function=RNA-directed DNA polymerase activity; Biological process=RNA-dependent DNA replication
  Homolog annotation: Hit_ID=Q1T5K4; Match level="QueryCoverage=79%, HitCoverage=14%, E-value=7e-14, Identity=33%"; Hit description=RNA -directed DNA polymerase
MGLGWMNLARLKSGLKAFFGERYMEMDNNLSNRFKKALPNVIDCRQSVIISGRSLLHSALITNEAVEEAIRGKKRRLGFNDKWISKVICLESSNVSILVHGSPTNEFKLSKGLRQQNPLVPFLFNVVANGLWTNERSNKKGSFH

SEQ ID NO: 148319 - protein, 120 aa, Glycine max
  Coding DNA Sequence Number=SeqID_31541
MHPYYNELDKMKKKNSNLWTKCYHYKKISSDLNYKLKGRETIHVRFNHNKPDTTTSELDESFVEMKIENFVKSTATSSQDKHVSNSPVDDQPKEVREPIGRILRKHHPVSQIISNPKDKV

SEQ ID NO: 148320 - protein, 73 aa, Glycine max
  Coding DNA Sequence Number=SeqID_31542
  Gene Ontology: Mol. function=cysteine-type peptidase activity; Biological process=lipid metabolic process
  Homolog annotation: Hit_ID=Q9FHA8; Match level="QueryCoverage=82%, HitCoverage=12%, E-value=1e-09, Identity=50%"; Hit description =Arabidopsis thaliana genomic DNA, chromosome 5, TAC clone:K21H1
MPYQCKQILDKNSEYYKSIVGHLDNRLELLDNSIKRDDPTKYNAALSMMASKVSYENQAYVHAVVVNRWTVYT

SEQ ID NO: 148321 - protein, 309 aa, Glycine max
  Coding DNA Sequence Number=SeqID_31543
  Gene Ontology: Mol. function=nucleic acid binding; Biological process= DNA integration
  Homolog annotation: Hit_ID=Q1SDG1; Match level="QueryCoverage=76%, HitCoverage=24%, E-value=6e-23, Identity=29%"; Hit description =Integrase, catalytic region; Zinc finger, CCHC-type
  Pfam annotation: Domain name=zf-CCHC; Domain location=220-237; Score =13.1; E_value=0.0069; Accession=PF00098.13; Description=Zinc knuckle
MIAFFESTHIDMWDVVEKGNHIPLEAQRNEIPRDRWMDELMSRFLLNSRARNALFTYEGSSEVKRNKLNLFTRKYELFSMEEGEDIQTMFGGFQTIMNELRSLALRAIKNLDSMTLEELVGILKVHEQELAQDKGTKKGKSLALAAQRPKCSTTLKESSSKALAVNETSKEEFDDDDCDKEDGELSLITRKIRKMWKNKNSSRFNGSSRRSFHKEEKISINFYECKKPRHFKSECPELEKPKDKKKKFFKSKKRSLMSTWKNLDNSSSNEDSKEESNLCLMVDASTNKAEPALDPSSNDEDSQSDRRIN

SEQ ID NO: 148322 - protein, 162 aa, Glycine max
  Coding DNA Sequence Number=SeqID_31544
MKNGEKREVVAAQLAQASWVASTRRHRLLLEPSGRPKMLQNFTNYATIGVKHFEVVKRRSRWSPDEIRFQLLVIDYNTYVIDYMFSKTSKNILKAFQEVFWPLVVVEGRSTDEDNSLSQRALHGRARAGLTGALPKGGKMHGVATNVYLWKTSGKPKETGQK

SEQ ID NO: 148323 - protein, 78 aa, Glycine max
  Coding DNA Sequence Number=SeqID_31545
MDTKLCEGSLPKFYQGHRNTTVLDLPLTGQAHDASVKLGKLKLFKVKFRVRCRLEVDNLGASNDIRISSSSCKLKLRL

SEQ ID NO: 148324 - protein, 141 aa, Glycine max
  Coding DNA Sequence Number=SeqID_31546
MCHFQGFFKGSVKTSNNGSQWWWRRSLGVLREGLGEEKEEEDGSFTLLDVFVACNTRPGEPNLPRRADPQLKFFASGVTTSPSSSASEEEKGKESSEEIYSQEEGQPLMVKGECKETLVSTATPLGLEVIPQVKKLLDGGL

SEQ ID NO: 148325 - protein, 377 aa, Glycine max
  Coding DNA Sequence Number=SeqID_31547
  Gene Ontology: Mol. function=triacylglycerol lipase activity; Biological process=lipid metabolic process
  Homolog annotation: Hit_ID=Q1SH82; Match level="QueryCoverage=97%, HitCoverage=75%, E-value=1e-116, Identity=57%"; Hit description =Lipase, class 3
  Pfam annotation: Domain name=Lipase_3; Domain location=109-274; Score= 142.5; E_value=1.1e-39; Accession=PF01764.16; Description=Lipase (class 3)
KQILDKNSANYISFIGHLDKRVGLLDNGIKREDPNKYNAALSMMASKVSYENQANVHAIVVDQWKMELLECGDYWNGKKLKRQAIDYQEKATTQAFVMLDKSEDQDNYVVAFRGTEPFDADAWSTDIDISWFEIPGVGRTHAGFMKALGLLLDFNKEELRWPKEIETDENRPRVYYSIRDLLKKCLNRNDKAKFILTGHSLGGALAILFPAMLILHAETFLLERLEGVYTFGQPRVGDETFAKYMENQLKHYGIKYFRFVYCNDIVPRLPFDEDIMKFEHFGTCLYYDRSYTCKKVQEEPNKNYFSWKALIPKKVNAFWELVRSFTIVRKYGPEYQEGWLLRFIRLVGIVLLAGLPAHSPQDYVNVTRLGLPSLDLD

SEQ ID NO: 148326 - protein, 280 aa, Glycine max
  Coding DNA Sequence Number=SeqID_31548
  Pfam annotation: Domain name=Transposase_23; Domain location=179-235; Score=-11.2; E_value=0.019; Accession=PF03017.5; Description =TNP1ENSPM transposase
  Subcellular localization annotation: CTP_CleavageSite=41; ConfidenceScore=5.60e-01
MATPPNSPPPPPPHESSTPSPSTSKKTRKTTQLKSLATRPVGTERPVVHVDPATWKVDGPHRKKLRTYLGIVACDKVEFDIPETFDLWTKKKVLKIVGGRWRQFKSDLTSKRALTDDKEGEDDQDVLTTAIGRPEHPGHVCAARVNGLALPPEPKVGPFATRGNTKESCVISLGQDPDTGDLEKSGLLYEGLTTVYNVPLGNDQVKVNVEESRDADARVPAPTQEVQLVGNALNIFLIWPTHLDKQRVEGPVKPIDRLDPDVDLLYLMTLTIPQIFLKPL

SEQ ID NO: 148327 - protein, 129 aa, Glycine max
  Coding DNA Sequence Number=SeqID_31549
  Homolog annotation: Hit_ID=Q2HUE7; Match level="QueryCoverage=68%, HitCoverage=16%, E-value=7e-14, Identity=47%"; Hit description=PSP, proline-rich
MATETILYQNDIVANSNDFTATTKKPQESDCHRQKQKKKNKASDEESDDLVEQIEIEYVLEKAELVKGMDEEFRKIFDKFTFTDAIALEFMAAARLSGHELSDLCLGKPPLRSLSVRDTIADNLSLSLF

SEQ ID NO: 148328 - protein, 114 aa, Glycine max
  Coding DNA Sequence Number=SeqID_31550
YLKALGPLTEKIDAIRDVSLIKDVFVFYAEGSRKEFTSITQQESPTEDLAFHSVETYPSAAGRRGAHGCVFQGRKMRGVATNVYSRKTSEKPERCGLRTKCERFGSCFYTRGRY

SEQ ID NO: 148329 - protein, 67 aa, Glycine max
  Coding DNA Sequence Number=SeqID_31551
MQIVGRAFAEPLILRIGHAYQQHCKLAEVEGALPYKMEELVSSLDYARQMAAIAEKHGQRLRRSTWP

SEQ ID NO: 148330 - protein, 170 aa, Glycine max
  Coding DNA Sequence Number=SeqID_31552
  Gene Ontology: Mol. function=transporter activity; Cellular component= outer membrane-bounded periplasmic space; Biological process=transport
  Homolog annotation: Hit_ID=Q4K4G9; Match level="QueryCoverage=65%, HitCoverage=37%, E-value=5e-56, Identity=94%"; Hit description=Amino acid ABC transporter, periplasmic amino acid-binding protein
  Pfam annotation: Domain name=WRKY; Domain location=79-121; Score= -16.1; E_value=0.067; Accession=PF03106.6; Description=WRKY DNA -binding domain
MTAKDSGIKSFADLRGKNVVTTAGTTNERYLKSYNVDNKMDMFVISAKDHGEAFQMLQSGRAAAFYMDDALLYGERAKARDPHNWVVVGEEQSREIYSCMVRKDDPQFLALLLLPAHTHEDYGPAGTCERGTAKSRYCVSVTTTVATTPPLVSRKLYPSPRFEDCYSPIR

SEQ ID NO: 148331 - protein, 106 aa, Glycine max
  Coding DNA Sequence Number=SeqID_31553
  Gene Ontology: Mol. function=calmodulin binding; Cellular component =integral to membrane; Biological process=cell death
  Homolog annotation: Hit_ID=Q56BA4; Match level="QueryCoverage=69%, HitCoverage=13%, E-value=7e-30, Identity=79%"; Hit description=MLO1
VSFFRRFFGSVNKVDYLTLRHGFITAHLAPGSDARFDFQKYIERSLEEDFKVVVGISPIIWFFAVLFLLTNTHGCIPIIASIYPIICKHRLILILFMMLVYISLLH

SEQ ID NO: 148332 - protein, 323 aa, Glycine max
  Coding DNA Sequence Number=SeqID_31554
  Gene Ontology: Mol. function=helicase activity; Biological process =viral genome replication
  Homolog annotation: Hit_ID=Q2R0W4; Match level="QueryCoverage=99%, HitCoverage=20%, E-value=1e-76, Identity=42%"; Hit description=AT hook motif-containing protein, putative
MMLSTAKGAQSYSDIRTVNDLVYPTFREACFAKGFLGSDQEFISALQEANNWGTAHYLRKLFVKFLFMNTMDRPKYVWQQAWQWMADDIIFNHRKQGIRLTEKETIHLCLTEIENMLQANRRSLRDFPSMPYPIGYARNQHHNNLIHNEMAYDKEMLAEQYNTAYQLLTATVYFLYGYGGTGKTFVWIALSSGIRSNGGIVCTVASSGITSLLLPGGRTTHSKFAIPVPATENSTCNIHQGSELAELLKVTKLIVWDEAPMCHKFAFEALDKSLKDIMQNNLAFGGKIIVFGGDFRQILPIVPKGNRSDIVHATINASYIWDH

SEQ ID NO: 148333 - protein, 262 aa, Glycine max
  Coding DNA Sequence Number=SeqID_31555
  Gene Ontology: Mol. function=chitin binding; Cellular component =extracellular region; Biological process=chitin metabolic process
  Homolog annotation: Hit_ID=UPI000044A8F0; Match level="QueryCoverage =68%, HitCoverage=99%, E-value=3e-26, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
YPHLQRTTPSPSEDYTSSPLGDCTSSPPESYMPSPLEDNTSSPLEGYMSSPSEGYTSSPSEDYTSFPSKGYTSSPSEDYMPSPFEGCTGLHALAFRGLNVLLFRGLHVLGFRGLHVVAFKGLHALAFKGRLTLAFRGLQALAFRGLHAPAFKGLHALAFRGLHALAFRGLHALAFRKGGYRATTMHIEARFRPDRHREMSADHAHHHNSDLPFPKCQLDHAHKTPSRPGKVQQGPGVSSSGYGLLSVLEGARPPQQGHVIVT

SEQ ID NO: 148334 - protein, 73 aa, Glycine max
  Coding DNA Sequence Number=SeqID_31556
  Gene Ontology: Mol. function=amino acid transporter activity; Cellular component=membrane; Biological process=amino acid transport
  Homolog annotation: Hit_ID=Q9LZ20; Match level="QueryCoverage=78%, HitCoverage=15%, E-value=1e-12, Identity=44%"; Hit description=Amino acid transport-like protein
DDESDEQNDGDSDEVYFIEALRKRRDREAPFGRGDSDCGDAEVTKVAASDGHVDYKLGVAEGGVEGAKAGNGN

SEQ ID NO: 148335 - protein, 79 aa, Glycine max
  Coding DNA Sequence Number=SeqID_31557
MSFTKGKMFVNEMAPKKLSTKRSRRDAIGEGSSTALEFDSHRFRSAEHQQRFEAIRGWSFHKERRVQLGKMSTQTSRRR

SEQ ID NO: 148336 - protein, 200 aa, Glycine max
  Coding DNA Sequence Number=SeqID_31558
MEEPSKKQKGTSSRSQRHSESQETPIPSSIPSASLFSFEEQQIRYTNLFSSCSIIDPKFIDMDFFSNESFECIQAFENSNLIPFMSLKLPVYSDLVKAFYSNLEIQEGTLISEVYGIKMVIDQSLFYDLTQLPSEGVPFEGTLIDDWKFDFSVHDARRLVCTNQADMTGRLLAGSLAFESRILHYLIVHILLPRSSNLAQ

SEQ ID NO: 148337 - protein, 62 aa, Glycine max
  Coding DNA Sequence Number=SeqID_31559
MADSGRGPRRREPLLVSPEKEATKASWRLNVKEFRLPNQTNDHQNHQSFTFRGFLREPMVTC

SEQ ID NO: 148338 - protein, 57 aa, Glycine max
  Coding DNA Sequence Number=SeqID_31560
MLTKYENGSSSSSPYRFPQAASIVARRRLCFPAQVWQIDTAKFIESRRYAVEIPADQ

SEQ ID NO: 148339 - protein, 265 aa, Glycine max
  Coding DNA Sequence Number=SeqID_31561
MDEFLSSIWNSDDNNQVNPPLSTLDEAGKANNSLARNEPLLKRQQTLGEMTLEDFLVKAGVVQESSSLFESSLLYQNQIGNIASNGPLSASYRFRHDVTTNGAVEKCPSLGESSGKGNRKRIIDGPPKVVVERRAFKFQSSTMTRTSSPAQQHDIDDKDHHDASSSAPEPNLNKADMQQKLKNTRPPQSSLATRDGETSTSSPLPCCAAARAPHPYPRESPLIPHSVSDSQHLTGAVRDSSRWTSPSLHGPQVLFSIHPPQAQAV

SEQ ID NO: 148340 - protein, 119 aa, Glycine max
  Coding DNA Sequence Number=SeqID_31562
  Homolog annotation: Hit_ID=Q6YWQ2; Match level="QueryCoverage=77%, HitCoverage=56%, E-value=7e-09, Identity=33%"; Hit description =Acidic 82 kDa protein-like
  Pfam annotation: Domain name=Fcf2; Domain location=12-91; Score=77.5; E_value=4.1e-20; Accession=PF08698.1; Description=Fcf2 pre-rRNA processing
MALISSSMAYLHLLSFIASSKFNMPAQTITPELQKDLKLLKLRAALDPKRHYKKDSPLDFFSGRLTKKKRKARLADELLSDQNLAAYRKRKVREIEEQNRPAGNEKWKIKGSNSRRHKL

SEQ ID NO: 148341 - protein, 78 aa, Glycine max
  Coding DNA Sequence Number=SeqID_31563
  Homolog annotation: Hit_ID=Q1SAP1; Match level="QueryCoverage=93%, HitCoverage=24%, E-value=6e-12, Identity=65%"; Hit description=Amino acid/polyamine transporter II
MESRITQSTSGEQGSVQEHLHGELPTGQCSFLQTVFNATNVMTGVGILSTPYALKEAGHPYEIDTALKAGKESLATQL

SEQ ID NO: 148342 - protein, 157 aa, Glycine max
  Coding DNA Sequence Number=SeqID_31564
  Homolog annotation: Hit_ID=O80668; Match level="QueryCoverage=59%, HitCoverage=17%, E-value=8e-30, Identity=67%"; Hit description =Expressed protein
  Subcellular localization annotation: CTP_CleavageSite=27; ConfidenceScore=5.17e-01
MYGGGAIMGFPMFGDGTLSQITLNMPRGALASKVTLWTTVINPFTKYALLMNPLARSLEELLPDRISNNYGCFILLKTTLVVSTFCVVFLIFFWVCDDFNWVSLPCTFVIDSSRDPRGEDSSSNSHEPSPQMNKDEPEPARPARIAHKPTYLNDYVT

SEQ ID NO: 148343 - protein, 88 aa, Glycine max
  Coding DNA Sequence Number=SeqID_31565
MWYWNVFWAEFSASALFSWFWILGGIDGDPVQRGTRIRATWESVSSVEGGQLGMVGSCVICGYGEFICTIARSPPSTTCDGYPIILQA

SEQ ID NO: 148344 - protein, 198 aa, Glycine max
  Coding DNA Sequence Number=SeqID_31566
  Gene Ontology: Mol. function=protein-tyrosine kinase activity; Cellular component=integral to membrane; Biological process=protein amino acid phosphorylation
  Homolog annotation: Hit_ID=Q1SSH9; Match level="QueryCoverage=97%, HitCoverage=44%, E-value=2e-35, Identity=40%"; Hit description =Tyrosine protein kinase, active site
  Pfam annotation: Domain name=LRR_1; Domain location=102-124; Score =1.4; E_value=1.6e+02; Accession=PF00560.23; Description=Leucine Rich Repeat
  Pfam annotation: Domain name=LRR_1; Domain location=126-149; Score =13.2; E_value=0.92; Accession=PF00560.23; Description=Leucine Rich Repeat
  Pfam annotation: Domain name=LRR_1; Domain location=151-173; Score =15.0; E_value=0.28; Accession=PF00560.23; Description=Leucine Rich Repeat
  Pfam annotation: Domain name=LRR_1; Domain location=27-49; Score=0.6; E_value=2.2e+02; Accession=PF00560.23; Description=Leucine Rich Repeat
  Pfam annotation: Domain name=LRR_1; Domain location=3-25; Score=14.3; E_value=0.44; Accession=PF00560.23; Description=Leucine Rich Repeat
  Pfam annotation: Domain name=LRR_1; Domain location=51-76; Score=8.6; E_value=7.1; Accession=PF00560.23; Description=Leucine Rich Repeat
  Pfam annotation: Domain name=LRR_1; Domain location=78-100; Score =14.9; E_value=0.29; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=102-124::126-149::151 -173::27-49::3-25::51-76::78-100
MSSLTHLDLSYTGFYGKIPPQIGNLSNLVYLDLSSDVANGTVPSQIGNLSKLRYLDLSANYLLGGGMSIPSFLGTMTSLTHLNLSHTGFMGKIPPQIGNLSNLVYLDLSSVSANGTVPSQIGNLSKLRYLDLSYNDFEGMAIPSFLCAMTSLTHLDLSHTGFMGKIPSQIGNLSNLVYLDLGNYFSEPLFAENVEWVS

SEQ ID NO: 148345 - protein, 54 aa, Glycine max
  Coding DNA Sequence Number=SeqID_31567
QSVSITGDHDPLLRISLTPTKHVSSDELDDEPKNFQISPAQVSSNKLAKHSQAE

SEQ ID NO: 148346 - protein, 62 aa, Glycine max
  Coding DNA Sequence Number=SeqID_31568
  Subcellular localization annotation: CTP_CleavageSite=58; ConfidenceScore=5.29e-01
MYFREENPSRGASVMLPRRFRKRFCGNSSSFFIFLHRSSSFFGLQPSLLKQNLTDRSRCNLD

SEQ ID NO: 148347 - protein, 227 aa, Glycine max
  Coding DNA Sequence Number=SeqID_31569
MQQNAAPAVQPVWHAPAPACRAEISLSPASIRALGELTDHLPAAGLLLMLLVLSIVMVRVGRVFTARQADRADAFSVRHGTSVPVPAPFGSPAMAARALAHEETAYWQQLLAAFAAAIEAEGYTFGTDARAKVALPHAVRARAGGAIVKARSRHITPLRSEAALEDLQLQAAEDGYAGSWADWCQRGAEAAGWYVIRREVNQLSDGAVTATDEPKPDNRIQTDGLLP

SEQ ID NO: 148348 - protein, 173 aa, Glycine max
  Coding DNA Sequence Number=SeqID_31570
  Gene Ontology: Mol. function=transferase activity; Biological process= DNA integration
MDVKTAFLNGDLREEIDVEQPEGYVIQGQENKVWSVMFLMNCTRPDIAYAVSRLSRYTHNPGGGAISWKSSKQTCIARSTMESEFIALDLAGQEAEWLRNLLADVPLWGKRSIPVSLHCDFEAAIGIAKNSVYNGKRRHIRIRHSSVRELLKNGVISLQFVRSENNLADPFTK

SEQ ID NO: 148349 - protein, 67 aa, Glycine max
  Coding DNA Sequence Number=SeqID_31571
MTLFWTRLPIESKIKRGVGYRQSRTTLNGNLKGRDTKMGFPLPAVPYLAENLSGLKIFRSLSFIDRE

SEQ ID NO: 148350 - protein, 96 aa, Glycine max
  Coding DNA Sequence Number=SeqID_31572
  Gene Ontology: Mol. function=fibroblast growth factor receptor activity; Cellular component=internal side of plasma membrane; Biological process=positive regulation of peptidyl-tyrosine phosphorylation
  Homolog annotation: Hit_ID=Q59F30; Match level="QueryCoverage=93%, HitCoverage=8%, E-value=7e-51, Identity=100%"; Hit description =Fibroblast growth factor receptor 4 variant
SSQDVVSPRTCVPAAAHLITEKRRPVWEHTVILGAFPCPPAPYWTHPQRMEKKLHAVPAGNTVKFRCPAAGNPTPTIRWLKDGQAFHGENRIGGIR

SEQ ID NO: 148351 - protein, 42 aa, Glycine max
  Coding DNA Sequence Number=SeqID_31573
MGTTDDVVKTPKKGIVFVEDLPKEVVVVVNFDERPSIGHESL

SEQ ID NO: 148352 - protein, 163 aa, Glycine max
  Coding DNA Sequence Number=SeqID_31574
MVVKLLILKRSELVSLAVSSLTMARTFIWNGKLSCFCDGFDDGSSGRQKLEGFTWQIFIEVEGGSKKRSNKVEGEKEELKRVVENEEADTHGEPVRPLKRLRSRGQEVPESSSKLQPQSMAALSDGNVKIGAQPTIEAGVAPLANNKMPHPFILIKPKDELVD

SEQ ID NO: 148353 - protein, 84 aa, Glycine max
  Coding DNA Sequence Number=SeqID_31575
  Homolog annotation: Hit_ID=Q93XQ3; Match level="QueryCoverage=85%, HitCoverage=3%, E-value=2e-28, Identity=83%"; Hit description =Putative beta-1,3-glucan synthase
IKAAVSALWNTRGLNWPYSFEQQRQKTGDLDMLDWLRAMFGFQRDNVRNQREHLILLLANSHIRLHPKPKPFNLARICLSLFLF

SEQ ID NO: 148354 - protein, 103 aa, Glycine max
  Coding DNA Sequence Number=SeqID_31576
  Gene Ontology: Mol. function=structural constituent of ribosome; Cellular component=ribonucleoprotein complex; Biological process =translation
  Homolog annotation: Hit_ID=P61841; Match level="QueryCoverage=56%, HitCoverage=38%, E-value=4e-26, Identity=100%"; Hit description =Chloroplast 30S ribosomal protein S7
  Pfam annotation: Domain name=Ribosomal_S7; Domain location=7-97; Score=16.8; E_value=5.2e-07; Accession=PF00177.11; Description =Ribosomal protein S7pS5e
MIRSTLHYFGNPRTQSYGYVKYRISNPSRKRGGTDTQFQDPHKEKALAIRWLLGASRKRPGRNMAFKLSSELVDAAKGSGDAIRKKEETHRMAEANRAFAHFR

SEQ ID NO: 148355 - protein, 113 aa, Glycine max
  Coding DNA Sequence Number=SeqID_31577
MSILTLGSKKEKKGNSQSKSGRKRKKKRKEIPNQRVGEREKKEKKGNSQSKSGRKKKEKKENSHQRMGESKKRRKLLVKETRRNVQKGLWTGQYLNNTELSPNEQKEGKGTTT

SEQ ID NO: 148356 - protein, 416 aa, Glycine max
  Coding DNA Sequence Number=SeqID_31578
  Gene Ontology: Mol. function=alcohol dehydrogenase activity; Cellular component=membrane; Biological process=electron transport
  Homolog annotation: Hit_ID=Q9I1K7; Match level="QueryCoverage=99%, HitCoverage=95%, E-value=1e-106, Identity=47%"; Hit description =Probable cytochrome c
  Pfam annotation: Domain name=Cytochrom_C; Domain location=308-396; Score=30.1; E_value=7.7e-06; Accession=PF00034.11; Description =Cytochrome c
MKLKSLLIAHAVLLGSCAVQAQAADDASLIKKGEYLARLGDCMACHTVAGKADYAGGLAIESNLGTIYSTNITPDKQHGIGNYSEQQFSDAVRKGVLPDGSRLYPAMPYPDYAKISDEDLHALYVYFMQGVKPDSAQPPETKLSFPFSQRWGMRFWNWAFTSDKPFQPIGGASAEVNRGAYIVESLGHCGSCHTPRGIGMNEKALDSSDDRFLAGGSLNNWEVPSLRGVPRWSEQEIVDYLQTGRNDKAAVGGEMTSVVEHSSSHMTDADLQAIAAYLKFLGGNPPLQAYDVQAQQKTEAKLTAAKNLSEGERLYLDNCGACHFVTGKGAPGIFPELDQATIVNAQDPSGLIHTILAGAQQPSTEKAPSTLAMPPFAYRLTDDEVAQLATFIRQGWSNHAPAVTKEQVADVRKTLH

SEQ ID NO: 148357 - protein, 68 aa, Glycine max
  Coding DNA Sequence Number=SeqID_31579
MQGLWLWAKLRALRSVWQGYTTNCLLFSGVFKARLEVGSIVVGYFMCPPYGLRDRCMTRSRLLALNEY

SEQ ID NO: 148358 - protein, 83 aa, Glycine max
  Coding DNA Sequence Number=SeqID_31580
MNRGRNGDNGHRKRVPFLEILRLRMYSLESFEYLGWNAIKCVFCGKYVEAIIDLVRDSNVAPPFLAVQYSRLRPCGALTRGMN

SEQ ID NO: 148359 - protein, 87 aa, Glycine max
  Coding DNA Sequence Number=SeqID_31581
MEEGKVYILQNVSVMKNGAEFRLGNHEYKLKLTRFSVVEDIAGWTSTISSVEHFLKDGKNIQRIFTQLSGGQYDSFNLLASASFCHK

SEQ ID NO: 148360 - protein, 165 aa, Glycine max
  Coding DNA Sequence Number=SeqID_31582
  Homolog annotation: Hit_ID=O24097; Match level="QueryCoverage=98%, HitCoverage=42%, E-value=3e-47, Identity=53%"; Hit description=MtN19 protein precursor
  Pfam annotation: Domain name=SURNod19; Domain location=2-165; Score= -61.3; E_value=6.5e-10; Accession=PF07712.3; Description=Stress up -regulated Nod 19
MVSLRYKISWVDWNIYQIPVKVYILDSTDKVRSNGSKILHDCLAEYTIPAGGGGDSPHVQKANIPMENGGYLIYGTAHMHSGVVNATLYGQDGRTLCTSTPKYGTGKEAGNEKGYLIGMSVCYPQPGSIKIHDGEILTLESRYKNEFRTGAMGHFYIYLAEELPQ

SEQ ID NO: 148361 - protein, 184 aa, Glycine max
  Coding DNA Sequence Number=SeqID_31583
MWMDRFALTLNGSQDLPRLLAKAKAIAEGSGTVLQPAINLGRDRNTTGFNRRYSPQAYPYGLPPDFIPRTGLDDLSQVPTFEGQLPPHADYPLQEDDEGDAHLGPLLPLKEPAPHELPQPNIVRHVPSPSTPVKELIPIAKDKGKIDLLEERLRAVEGLGNYSFSDLADLCLVPDIIISPNCLY

SEQ ID NO: 148362 - protein, 77 aa, Glycine max
  Coding DNA Sequence Number=SeqID_31584
  Subcellular localization annotation: CTP_CleavageSite=66; ConfidenceScore=5.36e-01
MKFVKTCSWCLAKRGLCAYASSANSTRRLSLPALSAPSSLSGYSLTQAKRENGAKLAFEDRKPFLRLKLEKSRKRLE

SEQ ID NO: 148363 - protein, 295 aa, Glycine max
  Coding DNA Sequence Number=SeqID_31585
  Homolog annotation: Hit_ID=Q1GZV0; Match level="QueryCoverage=46%, HitCoverage=97%, E-value=2e-53, Identity=80%"; Hit description =Flagellar motor switch FliN
  Pfam annotation: Domain name=FliO; Domain location=205-281; Score =17.1; E_value=0.00012; Accession=PF04347.4; Description=Flagellar biosynthesis protein, FliO
  Pfam annotation: Domain name=SpoA; Domain location=77-153; Score =111.2; E_value=3e-30; Accession=PF01052.11; Description=Surface presentation of antigens (SPOA) protein
  Pfam module annotation: Pfam domain module=FliO::SpoA; Domain location=205-281::77-153
MAMDPATNGADDDMEAAMAAMGVSDPGDVQTIAEDDWGAALAEQTQAESSALQEQTSKTAVFNEFSANNKLEGTQNDIDFILDIPVQLTVELGRTKISIKNLLQLAQGSVVELDGMAGEPMDVLVNGCLIAQGEVVVVNDKFGIRLTDIITPAERIRKLNRMMTTGVAWAAAPAVAASSVPTPGDSLGRMVFGTVIVLLVIAAVAWLLRRVMPGQTMAQRGVIKQVGGLQLSPRERVVVLEVAGRWLVVGINAGQMTALGEVDPMVTETKATETLAEEGASISAATGVDPEASFA

SEQ ID NO: 148364 - protein, 74 aa, Glycine max
  Coding DNA Sequence Number=SeqID_31586
MQAFCKAYGKILDLTIAEISTEAVVSLTQYYDQPLRCFTFGDFQLVPTIEELRRFKDVLLGEGNRIFSPSFFPP

SEQ ID NO: 148365 - protein, 102 aa, Glycine max
  Coding DNA Sequence Number=SeqID_31587
  Subcellular localization annotation: CTP_CleavageSite=35; ConfidenceScore=5.77e-01
MKDCRNTSSGDVSSTSRTSQSLTNSSQALRTASSSSSAVSAILNHLARISEFWLSVAFLAQRDAILPRKGPITRTMSKRLQEDWARAAEEGPRVLMNLRVDF

SEQ ID NO: 148366 - protein, 98 aa, Glycine max
  Coding DNA Sequence Number=SeqID_31588
MTNTRLGMYRATYNSDKRDFDLIWETHDAKLFQAACNGKFFIPFPVEHNNKLVQFFQKEKKDKEIYEASGCHGQQTPPFPSIDLSMEDSSDIFYSENV

SEQ ID NO: 148367 - protein, 46 aa, Glycine max
  Coding DNA Sequence Number=SeqID_31589
MAKSSIHLKLGITYLSYKPSPLWGTFSRWKALISVSGTCPEETAGV

SEQ ID NO: 148368 - protein, 89 aa, Glycine max
  Coding DNA Sequence Number=SeqID_31590
MQSTLVPKGVYEELERLQCHFVWNDNQYGKGWHIISSEKFYRAKVDGVRSLSQNHLSPGFMFFNINIIVGMALSCELFALIMIPKLGRE

SEQ ID NO: 148369 - protein, 245 aa, Glycine max
  Coding DNA Sequence Number=SeqID_31591
  Gene Ontology: Mol. function=aspartic-type endopeptidase activity; Biological process=proteolysis
  Homolog annotation: Hit_ID=Q8H6Q8; Match level="QueryCoverage=57%, HitCoverage=43%, E-value=2e-21, Identity=45%"; Hit description=CTV.20
MVTRSTSKLINVINEDSDQNLDNTTEIGSVSEKNINPLNSKHWKTPSKLYYQRPTAPDLLLEERGENNFKSFSANNIYEWNIDAQTEYNIMNTLQHMTMVATAYQTSHECSEETIIDILVAGFSGQLKGCAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKSVVNLPMETFHMKT

SEQ ID NO: 148370 - protein, 228 aa, Glycine max
  Coding DNA Sequence Number=SeqID_31592
  Gene Ontology: Mol. function=DNA binding
  Homolog annotation: Hit_ID=Q1RUD8; Match level="QueryCoverage=89%, HitCoverage=46%, E-value=3e-23, Identity=31%"; Hit description=IMP dehydrogenase/GMP reductase
MGTNQNGKRFYQVKIKGLDVTGLKELGRLMGPLQRQAFRKVYGKILDLTTAEVFTEAVVSLTQYYDQPLRCFTFGDFQIVPTVEEFEEILGCPLGGRKPYLFSGFLPSLSKIAAVVRDSTRELDRMKQIRNSVVGLPRKYLEGKARDMASQEEWVPFADIVALLIFGVVLFANVDGLVDLAAIDAFDRRCEKNSAWIVCCLPALCVWFVSHLFQQDKRHPCPLQSYHS

SEQ ID NO: 148371 - protein, 57 aa, Glycine max
  Coding DNA Sequence Number=SeqID_31593
MGEKKKEQLQEATKFESSDIVIDVPSPIKRHVKWKMVCTKKSDQMTSEASNEIAEKI

SEQ ID NO: 148372 - protein, 118 aa, Glycine max
  Coding DNA Sequence Number=SeqID_31594
MELPTVATYPLAGGRREGSRVCLPREEGAQSRHQVYSRKTLEKPERCGLRTLSVKGLGVVFMHGEVIKRDYNANDRLKFILSFSRRDNGLNDRLKLVKMEEKKIESERNKDESQQNKK

SEQ ID NO: 148373 - protein, 211 aa, Glycine max
  Coding DNA Sequence Number=SeqID_31595
  Homolog annotation: Hit_ID=Q9SLA6; Match level="QueryCoverage=27%, HitCoverage=20%, E-value=7e-23, Identity=79%"; Hit description =Expressed protein
  Pfam annotation: Domain name=Sel1; Domain location=106-141; Score =29.1; E_value=1.5e-05; Accession=PF08238.2; Description=Sel1 repeat
MGDPEAQYALGCHLRVEVRSNSISISDMYRIGLDTHIVSMHHSCAILLDFDDVHIIEYFGKYGDPENSLVLFYHLFLQHFWRQNDYVQSDQQAFYYLEKAVDQLHPGALYLLGAVYLTGDCVRKDIASALWCFHRASEKDHPMCYPAFRIFGVGYYVPLFRIDNKKWIELGDDDVNARLLPGGWKQCIVWLKYKCQRSKGVTASLRRCSEK

SEQ ID NO: 148374 - protein, 96 aa, Glycine max
  Coding DNA Sequence Number=SeqID_31596
  Subcellular localization annotation: CTP_CleavageSite=26; ConfidenceScore=5.42e-01
MNLANKALGSILSAKKQSNNGYSFPTSSKKFGKKKKLERRLCTQIEGLSEDVEENTFEVRFRIHSVSLGEHRRNPAKPNGGATQTTVEVRRRRVEA

SEQ ID NO: 148375 - protein, 97 aa, Glycine max
  Coding DNA Sequence Number=SeqID_31597
MERFEFGNLPVEDRRTTKNERRTMKNDEKPSRNRPRKRLGSVTEAPRLGFSSRKQFFSLILREKREVVAAQLAWASWVASTRRHRLLLEHPGRPKWA

SEQ ID NO: 148376 - protein, 72 aa, Glycine max
  Coding DNA Sequence Number=SeqID_31598
MRCTGSLSAPLHLTKRTALVHPLSEKGTLNQKSQMRHPDEDMTKSKGKDPLEGLGGPMTRARARKAKEDLQQ

SEQ ID NO: 148377 - protein, 73 aa, Glycine max
  Coding DNA Sequence Number=SeqID_31599
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=89%, HitCoverage=17%, E-value=8e-27, Identity=83%"; Hit description =Protein phosphatase 2C
MGGYVDVCRGVWRIQGSLAVSRGIGDRNLKQWVIAEPETKVIKIEPQHDLLILASDGLWEKLLTNETSISNLV

SEQ ID NO: 148378 - protein, 95 aa, Glycine max
  Coding DNA Sequence Number=SeqID_31600
  Subcellular localization annotation: CTP_CleavageSite=36; ConfidenceScore=5.51e-01
MIGPNLGPWAQKSTLRFMRTLGPSSAALALSSWSLLLMALVTSPFLGRITSYVLAEFSPTRGICRRCLIRIRLDYHEESGFSISGDTIEHIRIVK

SEQ ID NO: 148379 - protein, 66 aa, Glycine max
  Coding DNA Sequence Number=SeqID_31601
MVTHLEHLNQRLLLGGLSSSVIDKKGSTECGYYVNLGTFRNNWEATIGARENKGIADLVGTVLSPS

SEQ ID NO: 148380 - protein, 80 aa, Glycine max
  Coding DNA Sequence Number=SeqID_31602
DFLSVVSLVTIFQRNERGFEAFSPHGQDHLGLPSGVETKHERQKPIKALKDERKRGWGHDRPIVALLCAKQAGNVAARQP

SEQ ID NO: 148381 - protein, 51 aa, Glycine max
  Coding DNA Sequence Number=SeqID_31603
ICSLIDWTICNGEWRIVNKEKKDKREREREYPPFWKRAFEFVDLAKAKAAV

SEQ ID NO: 148382 - protein, 207 aa, Glycine max
  Coding DNA Sequence Number=SeqID_31604
  Pfam annotation: Domain name=Transposase_23; Domain location=93-157; Score=-8.3; E_value=0.0093; Accession=PF03017.5; Description =TNP1ENSPM transposase
MTGQIREELRTQIKEELRAQLEEENKRSLEIMTMALKEAIKKELSHKGSPESPQIQPDIQQLGARVSTKGSNVVINVQPSQEHDADVIPMMGLYVQRKDGTLGLVAMGKIMEGDSIIHIVAYADDVVRVTVETIIDPEAEVLYATSEIQYMKQAVDTFVAWPTHLVKADVEIIPHNEDAHVPKPANVDADDPLRGLIKYSFDIYEKP

SEQ ID NO: 148383 - protein, 157 aa, Glycine max
  Coding DNA Sequence Number=SeqID_31605
  Gene Ontology: Mol. function=protein binding; Cellular component =nucleus
  Homolog annotation: Hit_ID=Q2QNJ0; Match level="QueryCoverage=87%, HitCoverage=67%, E-value=2e-30, Identity=44%"; Hit description =Expressed protein
  Pfam annotation: Domain name=DUF538; Domain location=2-148; Score =211.2; E_value=2.3e-60; Accession=PF04398.3; Description=Protein of unknown function, DUF538
MASVGKERAGAEIVYGSEECYRQSIELLEELGFPKGVLPLQDLVECGRVRETGFVWMKQKAPYEHFFEGTNTRVSYAVEVTGYVEKFRMKKMTGIKSKQMMLWVPIAEMSIEDPKGQKIHFKTPMGIGKSFPIMAFMTPEEKEKHLLLQDKEIQENN

SEQ ID NO: 148384 - protein, 504 aa, Glycine max
  Coding DNA Sequence Number=SeqID_31606
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=99%, HitCoverage=99%, E-value=0.0, Identity=80%"; Hit description =Putative receptor-like protein kinase 3
  Pfam annotation: Domain name=Pkinase; Domain location=182-453; Score =163.4; E_value=5.9e-46; Accession=PF00069.15; Description=Protein kinase domain
  Pfam annotation: Domain name=Pkinase_Tyr; Domain location=182-453; Score=139.1; E_value=1.2e-38; Accession=PF07714.7; Description =Protein tyrosine kinase
  Pfam module annotation: Pfam domain module=Pkinase::Pkinase_Tyr; Domain location=182-453::182-453
MASDLNSGLSKETSVFGLKAWELMGIIVGLFIIIILVVISICLTSRKKSRRVNGMLPLSHMLSISDEIKEIRVDQVSANNHPQNGAFVSLYDRFSDRDSEKVLIQTNNNGENSSQSGSFVHLKKDDGSQSGEESGAKSVSTYWSSSHPITAPSPLCGLPEFSHLGWGHWFTLRDLELATNRFSKDNVIGEGGYGVVYQGQLINGSPVAVKKLLNNLGQAEKEFRVEVEAIGHVRHKNLVRLLGYCIEGTHRLLVYEYVNNGNLEQWLHGAMQQYGFLTWDARIKILLGTAKALAYLHEAIEPKVVHRDIKSSNILIDDDFNAKISDFGLAKLLGAGKSHITTRVMGTFGYVAPEYANSGLLNEKSDVYSFGVLLLEAITGRDPVDYNRPAAEVNLVDWLKMMVGNRRAEEVVDPNIETRPSTSSLKRALLTALRCVDPDSEKRPKMSQVVRMLESEEYPIPREDRRRRKSLAGNIELGDQKETSDTEKTENPDSKSNGRRNQRK

SEQ ID NO: 148385 - protein, 105 aa, Glycine max
  Coding DNA Sequence Number=SeqID_31607
MGLCCQSQKWTFSEQHHSPSSSHTLHKQKEKVKARLSPTLVCCEVVGGNWRTQEAHEIVRRGKWCGWVNNKAWNYQWFLQTVTDKQMLQWYYLTLNTQVWKTKNK

SEQ ID NO: 148386 - protein, 360 aa, Glycine max
  Coding DNA Sequence Number=SeqID_31608
  Gene Ontology: Mol. function=pseudouridylate synthase activity; Cellular component=signal recognition particle, endoplasmic reticulum targeting; Biological process=tRNA processing
  Homolog annotation: Hit_ID=UPI00005F77F0; Match level="QueryCoverage =68%, HitCoverage=96%, E-value=1e-110, Identity=75%"; Hit description= COG0564: Pseudouridylate synthases, 23S RNA-specific
  Pfam annotation: Domain name=BiPBP_C; Domain location=21-111; Score =88.0; E_value=2.9e-23; Accession=PF06832.3; Description=Penicillin -Binding Protein C-terminus
  Pfam annotation: Domain name=PseudoU_synth_2; Domain location=114 -274; Score=191.6; E_value=1.9e-54; Accession=PF00849.12; Description= RNA pseudouridylate synthase
  Pfam module annotation: Pfam domain module=BiPBP_C::PseudoU_synth_2; Domain location=21-111::114-274
MANVFAQAGLPKRAPPVNRCKDNGIAVGGNAPRITSPLKNTTYTLRQSQQGRDKIAFNAVTDADSKTVYWFVDDIYLGSSASKKPIDWRPIDNGRYRIRAVDDRGRADMRLDEHLVAVNKPSGWLVHRSWLDRHETRFMMQTVRDQLGQHVFTVHRLDRPTSGVLLMALSSEVARLLSQQFEQHQVQKTYHAVVRGYVQEGATLDYPLTAELDKIADKHADADKGPQPAVTHYRPLAQVEMPVAVGRYDSARYSLVELQPETGRKHQLRRHMAHLRHPIIGDSKHGDLRQNRGMAQHFGCPRLMLHASHLQLTHPVTGEALRVTARWDEDWQGVMTQFGWAGVFPELAGVEFSAANGQDS

SEQ ID NO: 148387 - protein, 813 aa, Glycine max
  Coding DNA Sequence Number=SeqID_31609
  Gene Ontology: Mol. function=hydrolase activity; Cellular component =intracellular; Biological process=metabolic process
  Homolog annotation: Hit_ID=Q2QUQ5; Match level="QueryCoverage=93%, HitCoverage=95%, E-value=0.0, Identity=46%"; Hit description =Pentatricopeptide, putative, expressed
  Pfam annotation: Domain name=PPR; Domain location=104-137; Score=8.7; E_value=0.69; Accession=PF01535.11; Description=PPR repeat
  Pfam annotation: Domain name=PPR; Domain location=204-238; Score =20.6; E_value=0.0058; Accession=PF01535.11; Description=PPR repeat
  Pfam annotation: Domain name=PPR; Domain location=308-342; Score =38.1; E_value=3e-08; Accession=PF01535.11; Description=PPR repeat
  Pfam annotation: Domain name=PPR; Domain location=409-443; Score =33.9; E_value=5.6e-07; Accession=PF01535.11; Description=PPR repeat
  Pfam annotation: Domain name=PPR; Domain location=444-478; Score =11.6; E_value=0.32; Accession=PF01535.11; Description=PPR repeat
  Pfam annotation: Domain name=PPR; Domain location=509-543; Score =39.9; E_value=8.6e-09; Accession=PF01535.11; Description=PPR repeat
  Pfam annotation: Domain name=PPR; Domain location=610-644; Score =40.7; E_value=5.1e-09; Accession=PF01535.11; Description=PPR repeat
  Pfam annotation: Domain name=PPR; Domain location=645-679; Score =27.1; E_value=6.2e-05; Accession=PF01535.11; Description=PPR repeat
  Pfam annotation: Domain name=PPR; Domain location=746-780; Score=9.8; E_value=0.52; Accession=PF01535.11; Description=PPR repeat
  Pfam module annotation: Pfam domain module=PPR::PPR::PPR::PPR::PPR::PP R::PPR::PPR::PPR; Domain location=104-137::204-238::308-342::409 -443::444-478::509-543::610-644::645-679::746-780
  Subcellular localization annotation: CTP_CleavageSite=46; ConfidenceScore=5.70e-01
MIFHSHVVNKLPSITTPLTKNTHFSSFFSTSLQTSNPPNLLQLCTLCDTLSQTKQVHAYSLLHGFLPRSVSLCASLILQYASFGHPSNSLLLFQHSVAYSRSAFLWNTLIRANSIAGVFDGFGTYNTMVRAGVKPDECTYPFVLKVCSDFVEVRKGREVHGVAFKLGFDGDVFVGNTLLAFYGNCGLFGDAMKVFDEMPERDKVSWNTVIGLCSLHGFYEEALGFFRVMVAAKPGIQPDLVTVVSVLPVCAETEDKVMARIVHCYALKVGLLGGHVKVGNALVDVYGKCGSEKASKKVFDEIDERNVISWNAIITSFSFRGKYMDALDVFRLMIDEGMRPNSVTISSMLPVLGELGLFKLGMEVHGFSLKMAIESDVFISNSLIDMYAKSGSSRIASTIFNKMGVRNIVSWNAMIANFARNRLEYEAVELVRQMQAKGETPNNVTFTNVLPACARLGFLNVGKEIHARIIRVGSSLDLFVSNALTDMYSKCGCLNLAQNVFNISVRDEVSYNILIIGYSRTNDSLESLRLFSEMRLLGMRPDIVSFMGVVSACANLAFIRQGKEIHGLLVRKLFHTHLFVANSLLDLYTRCGRIDLATKVFYCIQNKDVASWNTMILGYGMRGELDTAINLFEAMKEDGVEYDSVSFVAVLSACSHGGLIEKGRKYFKMMCDLNIEPTHTHYACMVDLLGRAGLMEEAADLIRGLSIIPDTNIWGALLGACRIHGNIELGLWAAEHLFELKPQHCGYYILLSNMYAEAERWDEANKVRELMKSRGAKKNPGCSWVQVGDLVHAFLVGEKIDSLDDDFWVSDCC

SEQ ID NO: 148388 - protein, 148 aa, Glycine max
  Coding DNA Sequence Number=SeqID_31610
MAEEEKDEKIVDGDKQQRESEPALEPVDPFCELEEVEDEEDDQEDETPIILSEKEIKDEKKKEKEKEREREKEKEKNEKNEKEEKKEEKKKSKSELAGEKKKEVALAEGREVPYPLVPSRKDKERHLARFLDIFKKLEITMPFGEAPQ

SEQ ID NO: 148389 - protein, 242 aa, Glycine max
  Coding DNA Sequence Number=SeqID_31611
MASRDQVWSFCTQDTRRYLTVICTPLLGRHSCVRWQAETKFGHSAPKIRGDTLRLSAPFCHPEAAGPMTSRDQVWSFCTQDTRRYLTVIRTLLSSRGGGPDDKQRPSLVILHPRYAEIPYGYLHPFARQTQLCPMASKDQVWSFCTQDTRRYLTVIRTLLSSRGGGPDDKQRPSLVILLPRYAEIPYGYLHPFARQTQLCPMASRDQSLVILHPRYAEIPYGYLHPFARQMQCVRWQAKTKF

SEQ ID NO: 148390 - protein, 173 aa, Glycine max
  Coding DNA Sequence Number=SeqID_31612
MLPNNIIIHEFEEEKEVVVDCWTMDDQDSIKKVVNTIKIENFTGKNSFNLWCIKMQALLKEQGIWAPLSEQLSKIGKPMLELQEEKTHSLILLSLSDKDTSFVVQVEGTSTWVVVTENKRGYISCGLVQVEGTSTWLFKENKGGYIPCGSLLVKVFTRLKRNLKDRRLLGDWM

SEQ ID NO: 148391 - protein, 822 aa, Glycine max
  Coding DNA Sequence Number=SeqID_31613
  Gene Ontology: Mol. function=DNA binding; Biological process =transposition, DNA-mediated
  Homolog annotation: Hit_ID=Q9FFJ8; Match level="QueryCoverage=79%, HitCoverage=62%, E-value=2e-13, Identity=22%"; Hit description =Arabidopsis thaliana genomic DNA, chromosome 5, P1 clone:MJJ3
  Pfam annotation: Domain name=DUF528; Domain location=750-799; Score= -9.8; E_value=0.09; Accession=PF04384.3; Description=Protein of unknown function (DUF528)
MDKCLTKVLAEQVKKGNKVDNILKPAAFAGALKTLNEKYGLYLTKEHIKNRLKTWRKQFGVLKELLAHSGFMWNETKKMVVADNSVWNDYIKAHPDARIFRAKSIENYDQLCTILGNDQAIASLSDNVTDIDVTFAVDKGDPDLAIVSEIQTDGNQTKNFRWTVAMDHWLGKILVDQVRKGLKVDKVFLTEAYNTAVSAEILSHTGFKWDGTKKMIIANDSTWNDYIREFGLEGLSERQLWARVGHAGIKDGGGGLRDRGWRMVLEEVGTAAEVGEGGRRGGAGGVKEGGGKGSGRWCSAMEVLHGGGEGSGVVVMETHLDARTFRGRVFENYDQFCIIFGHFYEPLHWDESGTCDETVEALSVYPVNYDISVGRHIRWTSDMDSCLSAILVQQIKQGNRSKFDYTLRPDAFEASVLAINEKFQLYLTKEHVKNRLRTWKKQYAILKELMTQSGFEWDEKRKMVIANDSVWTEYIKKNPDARILKGRVIRNYNELCIILGHCDPADSSINGACANMGMTTDDGVMEVQETKEKEKVKNVVTWTDEMDHCLTELLVNQVMLGNRLEKFFKTSAYIAALTALNERFDLNLTKENIINRLKIWKKQYDVLKEMLSQGRFEWDEGCKMVVATDLAWDEYIKKHPYARHLRDRHIENYHELGMIVGDEQGSGNWSENFERFDVNLTPNYEEHAEAPALVLADVQISPDANASDEVQGSSEQTRARPSSSQSHSKQPSKRRRTSDVMLEMMSVMAADISRIADALSENNKTVCLEEVVEKVQNMPDFDDDLIIEACEYLCFDEKRALMFLKLDERLRKKWLLKRLRGQ

SEQ ID NO: 148392 - protein, 91 aa, Glycine max
  Coding DNA Sequence Number=SeqID_31614
MGNGIGGGSKWWWCGGGIKSDVGCGNNVSGDGDVGGHHGGSSISGSCNDFGGSDNDYMMVILVVDVVEMVVVVAMIMMVVVDNEKSVIIKI

SEQ ID NO: 148393 - protein, 92 aa, Glycine max
  Coding DNA Sequence Number=SeqID_31615
MENITERWVALPIHEVPSYQEATPSDHNGGGDEGGISCGVGAMVVAAMTGDVGCGNNVSGDGDVGSHHGDIGGGSGGNDCDSRNDNDGSSGQ

SEQ ID NO: 148394 - protein, 176 aa, Glycine max
  Coding DNA Sequence Number=SeqID_31616
  Gene Ontology: Mol. function=identical protein binding; Biological process=Mo-molybdopterin cofactor biosynthetic process
  Homolog annotation: Hit_ID=O22827; Match level="QueryCoverage=98%, HitCoverage=92%, E-value=4e-65, Identity=63%"; Hit description =Putative molybdopterin synthase large subunit
  Pfam annotation: Domain name=MoaE; Domain location=11-127; Score =179.5; E_value=8.4e-51; Accession=PF02391.7; Description=MoaE protein
MAAEDDRNLVEIMETLNPIDVAKYMNFVGAPQAGAIATFSGTTRDTFEGKTIVELRYEAYVPMAIRCIKSICSSARASWNIHSVAVAHRLGTVPVGETSVFVAVSSVHRADALEACRLLIDEIKAQVPIWKKEVYSNGEAWKENSEFLERRSELEIKEYNKKSCCRTKVRADDECS

SEQ ID NO: 148395 - protein, 163 aa, Glycine max
  Coding DNA Sequence Number=SeqID_31617
MDPVAVAEDNSNAAGPEYGKEDRINSVEISQPIDELGQFETSPIILKGSGLKELIDWEEQSSERKMSRTERELNLLEKGDERQLSAQEIRLKKRLSQGPNGLKKGTATPTSSTSQLMGTEDIGKRRGPSVLYEEISGGGGGQTKAEWVWECGSDKCPGPDGLT

SEQ ID NO: 148396 - protein, 173 aa, Glycine max
  Coding DNA Sequence Number=SeqID_31618
  Gene Ontology: Mol. function=DNA binding; Biological process=DNA integration
  Subcellular localization annotation: CTP_CleavageSite=29; ConfidenceScore=5.11e-01
MAYLNRGRDELVCSSCSFNGSGSFISAVSSSHRVRKKEKGEKGMASTKPFGTPLTVSIRLIELNATQSQSEREYISHVPYASVVGSVMYAMGITDIGLVYQDDTSCAFVGYSNSNYIVHLDFTVTLCTTEAEYMALAKAAKEGIWLQGLISILGFPQDKAIIFCDSLSAICLA

SEQ ID NO: 148397 - protein, 60 aa, Glycine max
  Coding DNA Sequence Number=SeqID_31619
MYKRMRYHSLKTQTQSKGVAQIGLTWGGSREGTCHKTKYDFFVTRYQENETTMASQQNVG

SEQ ID NO: 148398 - protein, 213 aa, Glycine max
  Coding DNA Sequence Number=SeqID_31620
  Gene Ontology: Mol. function=RNA-directed DNA polymerase activity; Cellular component=chromatin; Biological process=chromatin assembly or disassembly
MSTAYHPESDGLTEVLNRTLETYLSYQGAAKCTPFEVAYGRAPPSLARFIPGEILVEAVAQDLMERDEALQQLKFHLRRAQDHMSKYANAHRVPFKIKGDWEYLKIRPYRQSSMPIRLHPKLAAKYYGPCLVNKQVGAVAFQLQLPEGARIHPGKSDEEATWEEKATIQEQFPDFNLEDKVSFEGENIVRKEGRGQSPAGPKPFLVYRRRQTI

SEQ ID NO: 148399 - protein, 92 aa, Glycine max
  Coding DNA Sequence Number=SeqID_31621
  Gene Ontology: Cellular component=integral to membrane; Biological process=protein insertion into membrane
  Homolog annotation: Hit_ID=Q42191; Match level="QueryCoverage=82%, HitCoverage=17%, E-value=1e-26, Identity=72%"; Hit description=Inner membrane protein OXA1, mitochondrial precursor
MAEKMPSFKHGGAYWFVDLTTPDSLYILPVLTALSFLITVECNMQEGLEGNPVAGTMKKFSRGLAVLTVPFTMGFPKFASPLTENFMPGSLG

SEQ ID NO: 148400 - protein, 149 aa, Glycine max
  Coding DNA Sequence Number=SeqID_31622
MLLQMQSQGLILPPKQKVAPIATHVSTKGSCIDPSRKDPDKGESNKCGLYVDDNHPYLVALGSVYEELTIVNKVSLSNDQVKVGVEEVHHITDYTNLDFHMNELIPRSGNDSVYGFLELESIQRSEQSQFESEDYIKKWMQNSKKDVYL

SEQ ID NO: 148401 - protein, 74 aa, Glycine max
  Coding DNA Sequence Number=SeqID_31623
MLTSPERVQMTTLVSACQLDLGSPNDMVRITVKYLYMPPDYWVTVTKGGVVDKSRDFSPTYPQFVMRNSDLRSS

SEQ ID NO: 148402 - protein, 78 aa, Glycine max
  Coding DNA Sequence Number=SeqID_31624
MAKASSIIDGGCEVTSINRAQLPCHDLEPKDTDQERMDDAILPRKGPITRTMSKRLQEDWARAAEEGPRVLMNLRVDF

SEQ ID NO: 148403 - protein, 174 aa, Glycine max
  Coding DNA Sequence Number=SeqID_31625
  Subcellular localization annotation: CTP_CleavageSite=79; ConfidenceScore=5.22e-01
MDKATKGKKATRCGKRAASKGKKPTDRGNKDSSGGKKPTAKGKKAEQNFLNVNGNFFVAPSLPKNDIEMGMLVNSCAVMTQMKSCWSSTGPLNVVKGGTEGVEKANTEGASQGGNEGALAGVQTKQVNVVKGGTKGAADGGIEGEGGGVQRKKCVAIYKKSSYSSTTSTGKTSK

SEQ ID NO: 148404 - protein, 119 aa, Glycine max
  Coding DNA Sequence Number=SeqID_31626
  Subcellular localization annotation: CTP_CleavageSite=34; ConfidenceScore=5.03e-01
MSNHKSTKSALKNLEVQVGQLAKQIVDKSSNSFVANTKQNPKEECKAVMTRSKRFVEVEDEDSVVHKKKTADKKAPRPIWALQKIPPEGGCFWRKQPCSPGRAELAWASWAATTSPILL

SEQ ID NO: 148405 - protein, 100 aa, Glycine max
  Coding DNA Sequence Number=SeqID_31627
  Subcellular localization annotation: CTP_CleavageSite=64; ConfidenceScore=5.04e-01
MGVASCVFSTVVQLLLLGVVFASVDRGSGLVKVKLIAVVFFLGGAFYGRTSVIGKCLLRKNDFRKNLRKNFFHKLFTEEGSSVSFLQKFFRNKLTEDFLP

SEQ ID NO: 148406 - protein, 77 aa, Glycine max
  Coding DNA Sequence Number=SeqID_31628
ASSTIESGVPRIDYLALFTYPPPSNLIRSPNELIVIHVSSTIEAGAPQIDCLALPTWAFQILPPEGGCFWRKQPGSP

SEQ ID NO: 148407 - protein, 122 aa, Glycine max
  Coding DNA Sequence Number=SeqID_31629
MASRKRKATTTLSQASYDSSRFVSRDAWDRYADNILGRNILSERNVKLYINEFDDFRREVERRNWHRELTIFSEGSIDVVIVKEFYANLYVPEDKEPNQVRVRGYLIKFNANSLNTFLKTPV

SEQ ID NO: 148408 - protein, 141 aa, Glycine max
  Coding DNA Sequence Number=SeqID_31630
MVMGDPISRLSFPGRRIVFHSKSICWNICLFAKACLHFSGENTETFSSLTSYPELRRSEFLIGGYVGARASLLSTTPPFVVMTQELVARGDTLRLSAPFCHPEAAGPMTSRDQVWSFCTHDTRRYLMVIRTPFVIQRRRAR

SEQ ID NO: 148409 - protein, 120 aa, Glycine max
  Coding DNA Sequence Number=SeqID_31631
  Subcellular localization annotation: CTP_CleavageSite=56; ConfidenceScore=5.24e-01
MGSVMTWMPPLLPAGKLVPPLTTAGTRIPPLATAGLSLNRQYERRDRLSRRERGCTADRAGGTRREAMPPFLLAGHANVAVPPLPPAEHLDGTRASVHMHAESFLCRLGMLNHFYAVYAG

SEQ ID NO: 148410 - protein, 119 aa, Glycine max
  Coding DNA Sequence Number=SeqID_31632
MNSIITVLYFNGRVYEDNDGVIFEGSKKAIQIKRGISFNALKKKLEIRFLVSGKYVALQICDDEDVETMIESFQQQQQMSVLELYVEKDVAGGSMFHAANSVTSCGRNVSHHDRNCQEI

SEQ ID NO: 148411 - protein, 34 aa, Glycine max
  Coding DNA Sequence Number=SeqID_31633
MHSPNTEKGYSIGRLSYIPNGVGDLYYMRIHLTM

SEQ ID NO: 148412 - protein, 564 aa, Glycine max
  Coding DNA Sequence Number=SeqID_31634
  Gene Ontology: Mol. function=hydroxymethylglutaryl-CoA lyase activity; Biological process=metabolic process
  Homolog annotation: Hit_ID=Q2PF06; Match level="QueryCoverage=71%, HitCoverage=93%, E-value=0.0, Identity=79%"; Hit description =Putative hydroxymethylglutaryl-CoA lyase
  Pfam annotation: Domain name=HMGL-like; Domain location=142-413; Score=273.3; E_value=4.8e-79; Accession=PF00682.9; Description=HMGL -like
MSSLEEPLGLDKLPSMCTIDRIQRFSSAACRPRVDNLGMGNCWIEGRSCSTSNSCDEDNEEYTAETFPWRRQTRDLSRGDSFSQKTMTMGRNSMKFGMIDNSFYASDYQYSPQSNNKNVQDMPYKFMKGIPKFVKIVEVGPRDGLQNEKNIVPTDVKIELIHRLASSGLSVIEATSFVSPKWVPQLADAKDVMQAVHNLGGIRLPVLTPNLKGFEAAIAAGAREVAVFASASESFSKSNINCSIEESLVRYRAVTHAAKELSIPVRGYVSCVVGCPVEGPIPPSRVAYVAKELYDMGCFEISLGDTIGVGTPGTVVPMLLAVMAVVPAEKLAVHFHDTYGQSLANILVSLQMGISAVDSSVAGLGGCPYAKGASGNVATEDVVYMLNGLGVKTNVDLGKLMSAGAWHSFSLSQGAWHSSSSASVTLLPFIFFFRNFFRSSSSSTTSSHSSSSVRLFVLPQGAWHSFSLSQGAWHSSSSARCLVSVFSATVPVRLLSRPFPLAFVCSSPASSLGASMEWRQGASMEYGRSLSYGRTSSVSGIQNNLLLRKNFFDKCLQKNFFLVL

SEQ ID NO: 148413 - protein, 71 aa, Glycine max
  Coding DNA Sequence Number=SeqID_31635
  Subcellular localization annotation: CTP_CleavageSite=34; ConfidenceScore=5.22e-01
MCDKGKSSFGLGTSRVSFSSAFALLGNTQDSEVVCFARYPSSNQAYPGSLGSLTTESPIHIERLRICKCRP

SEQ ID NO: 148414 - protein, 370 aa, Glycine max
  Coding DNA Sequence Number=SeqID_31636
  Homolog annotation: Hit_ID=Q2HSY4; Match level="QueryCoverage=99%, HitCoverage=83%, E-value=1e-111, Identity=53%"; Hit description =Cyclin-like F-box
  Pfam annotation: Domain name=F-box; Domain location=21-68; Score =42.4; E_value=1.5e-09; Accession=PF00646.23; Description=F-box domain
MSLVRKSLTSRVENVEDSHDMSVLDLPELALDCILERLPPSALCRMAAVCRSLRERCVSDHLWERHMRQKWGRVIGPAAYREWKWHVASKRNVGGLKHGRQKGLMRFMSLRWPLQWIRPKADANNNSPKQGSSLPVDSVMNWYLALESGNFWFLAQVYNRENGHIGFLLSCYDAELSYDPQTDTFQARYPPHGRRAGARECGIPWERLRAPPIDTSPHDLHFSDCLNDLYPGDHIEIQWRRNKEFPYGWWYGVVGHLESCNGSENYCRCHSSDQTRPQVWLGLSLDSNISKHGPPAMLFGWSPRPFMVNTVVLEFNHYTPGSQWRQTTISRKDHREEGNEADGFYGGIRKIKSEAEITTWKHLWPLEVLE

SEQ ID NO: 148415 - protein, 255 aa, Glycine max
  Coding DNA Sequence Number=SeqID_31637
  Gene Ontology: Mol. function=nucleic acid binding; Cellular component= intracellular; Biological process=DNA integration
  Homolog annotation: Hit_ID=Q1S9T9; Match level="QueryCoverage=86%, HitCoverage=18%, E-value=3e-47, Identity=43%"; Hit description =Peptidase S8 and S53, subtilisin, kexin, sedolisin; Integrase, catalytic region; Zinc finger, CCHC-type
MGSGIKNVFGRKELIGITTNVPVVIGAASQLTLINRCPSTALDMRTLEEVWLGHPPNLIRLKVFGCVEYAHIRHHKLEPRVVKCMLIGYPYEIKGYRLRCLELGHKKCLISCDVVFNVTHMDYKTNTEMAKPSTSQSKTSELERLNLEVEPKDKNDEVQTEEDGYMLARDKTRREIKPPNRYGYENLIAASEVLEDEPTSVKTALASKENEKWKVDVQEKMKSLSDNNTWDLIKRPIGFRVANCKWIFKRKEGIK

SEQ ID NO: 148416 - protein, 112 aa, Glycine max
  Coding DNA Sequence Number=SeqID_31638
  Gene Ontology: Mol. function=drug transporter activity; Cellular component=membrane; Biological process=multidrug transport
  Homolog annotation: Hit_ID=Q6Z493; Match level="QueryCoverage=68%, HitCoverage=15%, E-value=6e-18, Identity=57%"; Hit description =Putative MATE efflux protein family protein
MKSRSLDGTVTHFTPLLDVSHHKENTRQYRWWNSKILDLEEAKHQLLFSLPMFLTNLFYYLIVLVSVIFAGHLGDLQLAGATLANSWFSVTGLAVMIGASYFNNEAQEFRWH

SEQ ID NO: 148417 - protein, 266 aa, Glycine max
  Coding DNA Sequence Number=SeqID_31639
  Gene Ontology: Mol. function=sequence-specific DNA binding; Cellular component=nucleus; Biological process=regulation of transcription, DNA-dependent
  Homolog annotation: Hit_ID=Q1ST32; Match level="QueryCoverage=94%, HitCoverage=96%, E-value=1e-99, Identity=74%"; Hit description =HSF/ETS, DNA-binding
  Pfam annotation: Domain name=HSF_DNA-bind; Domain location=23-215; Score=172.6; E_value=9.8e-49; Accession=PF00447.8; Description=HSF -type DNA-binding
MAFTLDRFEENMVFTFESQKSVPAPFLTKTYQLVDDPHTDHIVSWGEDETTFVVWKPPEFARDLLPNYFKHNNFSSFVRQLNTYGFKKVVADRWEFANEYFRKGAKHLLCEIHRRKAPQQHHQLFHDQLPSQILQKDESLCWLDTPLPSSKPNTDILTALSEDNQTLRRKNFMLLSELSHMKSLYNDIIYFIQNHVKSPPFEQRSSSVIPKLVELDSLHESPNDMGVLRTAKSCVVDKSLVTSTEESNSSVKLFGVTLSGRKIAPR

SEQ ID NO: 148418 - protein, 184 aa, Glycine max
  Coding DNA Sequence Number=SeqID_31640
  Gene Ontology: Mol. function=structural constituent of ribosome; Cellular component=ribonucleoprotein complex; Biological process =translation
  Homolog annotation: Hit_ID=P29344; Match level="QueryCoverage=96%, HitCoverage=46%, E-value=1e-60, Identity=65%"; Hit description=30S ribosomal protein S1, chloroplast precursor
  Pfam annotation: Domain name=S1; Domain location=75-143; Score=68.1; E_value=2.9e-17; Accession=PF00575.13; Description=S1 RNA binding domain
MGAFFTQIKGTVFYTDANGAVVDITAKSSAYLPLQEACIHRVKHVEEAGLVWVQRGVFDRWALQFDLAWERCRQLQAEDVTVKGKIVGVNKGGVVAELEGLRGFVPLSQISTNSNVEELLDKELPLKFVEVDEEQSRLVLSNRKAVAGNQAQLGIGSVVTGSVQSLKPYGAFIDIGGINGLLHA

SEQ ID NO: 148419 - protein, 137 aa, Glycine max
  Coding DNA Sequence Number=SeqID_31641
  Gene Ontology: Mol. function=oxidoreductase activity; Biological process=response to oxidative stress
  Homolog annotation: Hit_ID=O65161; Match level="QueryCoverage=45%, HitCoverage=32%, E-value=2e-21, Identity=82%"; Hit description =Ascorbate peroxidase
MDLWVNGTLLEPLTRAQTLVDPSDIAIRLLEPLKAEFPILSYADFYLLASVVAVEVTGGPEVPFHPGREVLCSKTLLLYCFLLLQVLCFKTLLRSASLEIVPLEEVFQTLMCDSNGLTIASAERVRDVEPYVLIKCY

SEQ ID NO: 148420 - protein, 76 aa, Glycine max
  Coding DNA Sequence Number=SeqID_31642
MLYSGSREHSPNERKNKTGKQIIRGIIGKGNASGESIFEEVLAARRGGRRRREAEAALMHRNGKEDTHAQDLKGNW

SEQ ID NO: 148421 - protein, 433 aa, Glycine max
  Coding DNA Sequence Number=SeqID_31643
  Gene Ontology: Mol. function=ubiquitin-protein ligase activity; Cellular component=intracellular; Biological process=protein modification process
  Homolog annotation: Hit_ID=Q9LUV3; Match level="QueryCoverage=95%, HitCoverage=41%, E-value=4e-97, Identity=47%"; Hit description =Arabidopsis thaliana genomic DNA, chromosome 3, P1 clone: MGD8
MLMGVNIIHVSCKLLTDSSYRNASEGEKLSELNNLRNSFGPDSNFLYQFLYFFKAENIDDFLVLVQICRLLWWSVQDNGVDYSSTRALVNFRVKRFVQACVCALHQNRNQLKDQLLLTPEELNVSAIPLLEVLVLLIDPKLPWSCKIVEYLIQNNAVGLLREIILTGKDNAENYFSIGKGSSLERVLIAVICHVGQKPLISDIFSLNAGGSFIFAADDLNQCYIHQMAMFGQNLINLLPKDISTEFPSHACMLGNVLETAGIALSHPNCSFDMAIDLAAVTTFLLEALPSVKTSNSRESPMIAEDDMTGDNEVMEIALDRKLEQQIYNAINPRFLLQLTNILFKEISSVNGSDYGPNDRDVTAVDGVCGFLNVTFNKLPLERIMTVLAYRTELVPTLWNFMKRCHENQKWSSHFSNDAPGWLLPLAVFCPVYK

SEQ ID NO: 148422 - protein, 93 aa, Glycine max
  Coding DNA Sequence Number=SeqID_31644
  Homolog annotation: Hit_ID=Q9LUV3; Match level="QueryCoverage=56%, HitCoverage=5%, E-value=2e-17, Identity=83%"; Hit description =Arabidopsis thaliana genomic DNA, chromosome 3, P1 clone: MGD8
MFFSGDPSTRKRVDLGGRSSKERDRKNLLEQTRVERNRRLWLRQQNSAVLKIQLPPAIYVVFVKYCSTVSNSVMLENRSLETQMCIDAHMCIY

SEQ ID NO: 148423 - protein, 160 aa, Glycine max
  Coding DNA Sequence Number=SeqID_31645
  Gene Ontology: Biological process=response to biotic stimulus
  Homolog annotation: Hit_ID=Q9C523; Match level="QueryCoverage=68%, HitCoverage=59%, E-value=4e-32, Identity=61%"; Hit description =Dirigent protein, putative
  Pfam annotation: Domain name=Dirigent; Domain location=1-151; Score =108.2; E_value=2.4e-29; Accession=PF03018.5; Description=Dirigent -like protein
MITKFLTFSILSIITLTSVTAEDGAGIQIIPSLPKYNTTTSFGLVRILDNPLTLGPELSSKQVGRAEGLYASASRTELSLLMVMNFALTAGKYNGSTITIMGRNRPLMTKVREMPVIGGSGIFRVARGYALDEELGQGEMSDLLHWMNVAYKWDKGKTSP

SEQ ID NO: 148424 - protein, 551 aa, Glycine max
  Coding DNA Sequence Number=SeqID_31646
  Gene Ontology: Mol. function=protein kinase activity; Cellular component=chromatin; Biological process=protein amino acid phosphorylation
  Homolog annotation: Hit_ID=Q1RSZ9; Match level="QueryCoverage=70%, HitCoverage=32%, E-value=8e-89, Identity=46%"; Hit description =Polynucleotidyl transferase, Ribonuclease H fold
MSCPHTPAQNGKAERKHRHITETSLAMLFHSHMPTMYWLDAFCCAVYIIIRLPTPLLKASCTKVFGGWTSQHPGSTLLVMPNLMNFTFPSPTQDLFLRSHTWDSLSLMNLLSLSLSLRLLLPNRLRNRLCHFCLALVAYVLQKTLPLFRSPYGDSSKAGIYKPRHFADITTCRPSSLLHALLTTSEPKGFGSAAKHLGWLATMNDELTALHSNKTWELVPRPPNTNIVGSKWVFRTKYLSDGYIDRFKARLVAQGFTQTPGLDYDHTFSPVVKASTVRVILTLAVMQHWPLHQLDVNNAFLKGLLSNPVYMEQPPGFIDPRFPHHVCCLRKALYGFKQAPIAWFQRFCSFLLHLGFIGSKANPSLFSYHHNTATLYLLVYVNDIILTGNNQFAIQTILAKIRAEFAIKDSGHLSYFLGLQVHYGANGIFLSQAKYAHDILDRANLLDAKPIATPLVGALQYPPSLVRISHMLLTLSANSCRLPPLSFPSCQANIALCQGHLVSWSAKKQPIVAHSGCESEYQAMANAAAELMWFTHLMRNLHVYSTPRTHL

SEQ ID NO: 148425 - protein, 117 aa, Glycine max
  Coding DNA Sequence Number=SeqID_31647
  Gene Ontology: Cellular component=chloroplast
  Homolog annotation: Hit_ID=Q6Z1V9; Match level="QueryCoverage=49%, HitCoverage=42%, E-value=5e-09, Identity=56%"; Hit description =Chloroplast ORF133; ORF within trnI intron
MSPHGGDMDGGEKRKERDGVSLAFGIAGPGGRPARRAISSVVRSNVDPTFSSLVGSGRSGGDHHGSSLLENSYIPYQYMDSYLSSTGLGLASMEKNGAPNNVSSQTKNYEIAPFILG

SEQ ID NO: 148426 - protein, 60 aa, Glycine max
  Coding DNA Sequence Number=SeqID_31648
MTNQMFIIYLRSNSNDWGGKTARKPHYKRNLKESWASSSKGNNTRKSSLPWIQKENANET

SEQ ID NO: 148427 - protein, 47 aa, Glycine max
  Coding DNA Sequence Number=SeqID_31649
MDNIRFTAPFKVQKNLLQVPFSYHRQWLRNYPKYVLFHCDGEIHFIR

SEQ ID NO: 148428 - protein, 213 aa, Glycine max
  Coding DNA Sequence Number=SeqID_31650
  Gene Ontology: Mol. function=DNA binding; Cellular component=nucleus; Biological process=DNA integration
  Homolog annotation: Hit_ID=Q1SRP4; Match level="QueryCoverage=99%, HitCoverage=45%, E-value=4e-43, Identity=44%"; Hit description =Integrase, catalytic region
  Pfam annotation: Domain name=rve; Domain location=124-213; Score= -6.2; E_value=0.02; Accession=PF00665.16; Description=Integrase core domain
  Subcellular localization annotation: CTP_CleavageSite=56; ConfidenceScore=5.44e-01
MSYDSKQGLLEGTVGADGLYQFKPFKFLTNSGAASNSDSSSMSSSSQFSVFNNPVNCNNIVSVMQNDNVFQMWHLRLGHAHTSAVKNILNLCNIPFSNKTATLPCTFCCMGKSHRLHSPLSNTIYTKPFEVIHCDLWGPAPFVSYYGYSYYITFVDTYTKFTWIYFLKAKSDALKAFTQFKALIQNQFQASIKAIQSDWGGEFRAFTALLNEL

SEQ ID NO: 148429 - protein, 83 aa, Glycine max
  Coding DNA Sequence Number=SeqID_31651
  Homolog annotation: Hit_ID=Q946Z2; Match level="QueryCoverage=47%, HitCoverage=7%, E-value=3e-11, Identity=80%"; Hit description =Putative acyl-CoA synthetase
IYCAVIPREGSNIDDADVLRYCKKNLASFKVPKKVLNTNSRQDHAYAFLLSCSCSLPLVLMKPSIVSLPFKLYIVAKRVHVKE

SEQ ID NO: 148430 - protein, 59 aa, Glycine max
  Coding DNA Sequence Number=SeqID_31652
MSDNLARASSAREYQIELQQVGINTATSPMLNEIAFIFQSFRAKKFERGSLPCHSEGRS

SEQ ID NO: 148431 - protein, 140 aa, Glycine max
  Coding DNA Sequence Number=SeqID_31653
MQDCTSHREKTANPIEQATNRDQLPSQSDACLALSNSPVSQASQADHLVQGFQSEYFQQNVCLDRASNHLDPMIHLQVILCESARQGEKDMPDSQEKDSQCSQNALLSVMPELMFRRVPVGSLMPMQGESTAKGKFNHWE

SEQ ID NO: 148432 - protein, 343 aa, Glycine max
  Coding DNA Sequence Number=SeqID_31654
  Gene Ontology: Mol. function=transcription factor activity; Biological process=regulation of transcription, DNA-dependent
  Homolog annotation: Hit_ID=Q3BVE4; Match level="QueryCoverage=98%, HitCoverage=100%, E-value=1e-144, Identity=76%"; Hit description =Transcriptional regulator, LysR family
  Pfam annotation: Domain name=HTH_1; Domain location=10-64; Score =62.3; E_value=1.6e-15; Accession=PF00126.17; Description=Bacterial regulatory helix-turn-helix protein, lysR family
  Pfam annotation: Domain name=LysR_substrate; Domain location=88-300; Score=158.9; E_value=1.3e-44; Accession=PF03466.10; Description=LysR substrate binding domain
  Pfam module annotation: Pfam domain module=HTH_1::LysR_substrate; Domain location=10-64::88-300
MSHDLNETLIFVKVVEQGSFIAAAKSLGLPKTTVSRKVQELETRLGARLLHRTTRRLGLTEAGSIYHEHCQRIARELEEAESAVSQLQSGPRGWLRFTVPYSIGITWIAPLLGQFHAQYPEIRLDMHMGNEKLDLIAGEADLALRVGALPDSNLVARKLGSLRTQVFASPAYIERYGEPLHPEELQFHRILAMRKPYHTGNSPRFTWQLGENGGELRDFPVTPLMTANDMSALNGALVCGECLLLTGDVMAKPFVESGMVRRVLAGWTGPEVDFNAVFAGGRLVSPKVRAFVDFLVEKLNFDANYMLAQCPGAKLAQQHKEKEDAALESSGKRILEKVAASAA

SEQ ID NO: 148433 - protein, 82 aa, Glycine max
  Coding DNA Sequence Number=SeqID_31655
MVDAKCSYQNPESSHIKVDMVEWGPKLSALAWRGTFEREGTFKTKDSDAQGCCSLVDNSWVVDNGQELIDNVRHKHLLIDRR

SEQ ID NO: 148434 - protein, 212 aa, Glycine max
  Coding DNA Sequence Number=SeqID_31656
MVSSRSGLRLETPLIDSHPFLTAMTNTGTLQLHQDRIAKMEKRHEKELTKLKADHDQLEAHENLYTNDDTILCHVFPISPKGAALTWYDGLPPSSIDNFNTLVERFSANYDKFGRTTVQIRNLNPEVALDSMLLSLCPNMFVDSLCKKPPDSMDELHERAKGYTQMEEMSRFQNEVCHAGHKFDKHEAHTKANSHKSNKRHKLDKRRPRSKV

SEQ ID NO: 148435 - protein, 112 aa, Glycine max
  Coding DNA Sequence Number=SeqID_31657
MAGLLAEGVPQLALAAPPCPADAISGTHPLSPTHPLPPTATAAHPHPSLLLSTCPATGTSGTHLTTIGTGGSSFPPVSVAAPTSETDPALKRFYDPNMVGSWYRTYATKNVV

SEQ ID NO: 148436 - protein, 392 aa, Glycine max
  Coding DNA Sequence Number=SeqID_31658
  Gene Ontology: Mol. function=transporter activity; Cellular component= outer membrane; Biological process=transport
  Homolog annotation: Hit_ID=Q3BS30; Match level="QueryCoverage=99%, HitCoverage=45%, E-value=1e-150, Identity=63%"; Hit description=TonB- dependent outer membrane receptor precursor
  Pfam annotation: Domain name=TonB_dep_Rec; Domain location=216-384; Score=30.0; E_value=8.1e-06; Accession=PF00593.14; Description=TonB dependent receptor
MEARFKLNGKAFNGTLDQSSRLPSYSFDNPQWLDNSNYAFDRFVLSPKQVNDKEHSAQVNVRFDGDSSSIKFGLLGRWRDRDVNVDERELRVGPKVALSSWSTSSPEHRHGNLGDGMDSAAMRAFWAANGGQYSARPQDVGGNAMTSLEEDYVASEDIFASYAMGTWDVGALRIIGGVRVENTQFKAVGNQVDVAANGRSFTVTPRVANSSYTNVLPGLHLRYDAADDWVLRASANKTVSRPSFGDISPRVGYSRGDEEVRLGNPELDPYESKNIDLSVEKYIGSSGIVSLGLFHKSIDGYIVETVRTNDPAYGGFDVKQPINGRKATVRGAEFNWQQQLAFLPDGLDGVMVGASGTWLDTNFDAGIEDHAGEDFTLPRASRQIYSAPIGYE

SEQ ID NO: 148437 - protein, 145 aa, Glycine max
  Coding DNA Sequence Number=SeqID_31659
MNFAARKPIEFTPIPVSYANLLPYPLDNAVVAINPARFPQSPFFRGYDSNATCARHGEAPGRSIEHCRALKRKDFQVQAIGQFAQATCAPEFGLPRLFNHRLLVLHVGGGAIKQRVVKTKMDTSEPYTGAMRGIVHEPQVNLGAD

SEQ ID NO: 148438 - protein, 41 aa, Glycine max
  Coding DNA Sequence Number=SeqID_31660
MAQPLILRTYQMNTRLIGSKTMIVILTPLPGPKELSLYVLK

SEQ ID NO: 148439 - protein, 93 aa, Glycine max
  Coding DNA Sequence Number=SeqID_31661
  Subcellular localization annotation: CTP_CleavageSite=50; ConfidenceScore=5.08e-01
MLGFTSNSPQISASPHQLDFAPYASRPYNAQRNASGLLHDKHTLCSSRILEEMEVEEPWLGFFSLQNSFLGWCFGFVLEVVSSIGGVVHRLCG

SEQ ID NO: 148440 - protein, 155 aa, Glycine max
  Coding DNA Sequence Number=SeqID_31662
  Gene Ontology: Mol. function=metal ion transporter activity; Cellular component=membrane; Biological process=metal ion transport
  Homolog annotation: Hit_ID=Q1RUP2; Match level="QueryCoverage=91%, HitCoverage=30%, E-value=2e-50, Identity=76%"; Hit description=Mg2+ transporter protein, CorA-like
MVVNLEFIKAIVTAEEVLLLDPLRQEVLPFVEQLRQQLPGKSQPKLLGGTEEQEGEMHVSNGRQWLPTPEAADGLQSELPFEFQVLEIALEAVCTYLDSNVADLERGAYPVLDELARNVSTKNLEHVRSLKSNLTRLLARVQKFVGLVKTPVNSP

SEQ ID NO: 148441 - protein, 63 aa, Glycine max
  Coding DNA Sequence Number=SeqID_31663
MGAKYLEVVKRGSHPNNGWSPDEIRGSKDKTLISFERNTIRLVNLPASGTCKNLKMISTDSSS

SEQ ID NO: 148442 - protein, 74 aa, Glycine max
  Coding DNA Sequence Number=SeqID_31664
MMMNWRLPNRKMSRSQSMVVMVVMIRREHEQENDGGGGGHVYGSDGSVVELHAGCDEDCVESLKLLSKYSEAAY

SEQ ID NO: 148443 - protein, 191 aa, Glycine max
  Coding DNA Sequence Number=SeqID_31665
  Subcellular localization annotation: CTP_CleavageSite=41; ConfidenceScore=5.44e-01
MAEPSKKRKGSSSTAAAAAHRHHGPSEAPTAPFHPSLSSPRSSTLFSSDDQRLRYRSQFSSRIIIDSKYLDVDFFNDETFDCYQVFQNSGLVDFMSLNLPHYPELVKVFYCNLKIQDDIISSEVDGIPMIIDQSLFFSLTHLPSQGAPFEGTIVDDWKFDYSSHDACRMVCNDRLIAGRVINILIIASCTI

SEQ ID NO: 148444 - protein, 83 aa, Glycine max
  Coding DNA Sequence Number=SeqID_31666
  Subcellular localization annotation: CTP_CleavageSite=60; ConfidenceScore=5.63e-01
MDNSLNFGVTPTRTSKLYPHHNCTECFRQTVPVNTFTFVFARKLFLTRPTPSPNQFLCIVGTLRTRNHSSVGPYLNPERGDFG

SEQ ID NO: 148445 - protein, 38 aa, Glycine max
  Coding DNA Sequence Number=SeqID_31667
MEWDEECESMSGTIYSSKNVPSHGWDLGVPLQDLKIWD

SEQ ID NO: 148446 - protein, 153 aa, Glycine max
  Coding DNA Sequence Number=SeqID_31668
  Subcellular localization annotation: CTP_CleavageSite=51; ConfidenceScore=5.02e-01
MSGPGASGVLKATSADPWSASFMVETRTLFVFHKSKNFTSDYEIRMPPTVPVNHYSDPEGQHNRIRILTGGTTRPVKDRSASPAEGTSRPVHTGGGPIDPTQAGITAAAGTRLALQWILVKGFRLYSFQLPDSMSPAPSPESNPNSPSPVTTM

SEQ ID NO: 148447 - protein, 70 aa, Glycine max
  Coding DNA Sequence Number=SeqID_31669
MLRLDMRSHELMTSGSEGKREPRVKREGGVEGGGSKVRRSYVVEVRDTMCVLKGLEDVTPVSVVSSSLDG

SEQ ID NO: 148448 - protein, 172 aa, Glycine max
  Coding DNA Sequence Number=SeqID_31670
MCSATDYKTKSIGGCPSQPLNIHGITLKGKQDENWEQLFTPMIGQWNKQVDFRVDGYPRQEVLLNFNSNYTIFETLQYMVSPQGRNTWTDDDLVPYVEKITILSKEQERITEPVSHGPASEHQFPAQEFHILQSSVETQGIGRRRVVVEAEEYSQQMAERGHGMYYTPPTFS

SEQ ID NO: 148449 - protein, 164 aa, Glycine max
  Coding DNA Sequence Number=SeqID_31671
  Gene Ontology: Mol. function=DNA binding; Biological process=electron transport
  Homolog annotation: Hit_ID=Q1S5N2; Match level="QueryCoverage=79%, HitCoverage=26%, E-value=4e-25, Identity=44%"; Hit description=Viral capsid/hemagglutinin protein
  Pfam annotation: Domain name=DUF659; Domain location=1-128; Score =25.5; E_value=2e-09; Accession=PF04937.6; Description=Protein of unknown function (DUF 659)
MIDVVDKEARSRTIQYMEPFFFLKNNIPFNVVSTMFSKTVDASSYMKIREKVFELLYSFVEEIGDNNVVQVFTYNESNFKLIGKLLEAKRPHLLWTPYVAHCLDLMLKDIDKTTRVKKTIQEGISLVVYIYNHPLVLTNMRRFNNITKLVRYGVTMFATNFLTL

SEQ ID NO: 148450 - protein, 653 aa, Glycine max
  Coding DNA Sequence Number=SeqID_31672
  Gene Ontology: Mol. function=transporter activity; Cellular component= integral to membrane; Biological process=auxin mediated signaling pathway
  Homolog annotation: Hit_ID=Q8GV76; Match level="QueryCoverage=99%, HitCoverage=96%, E-value=0.0, Identity=76%"; Hit description=Auxin efflux carrier protein
  Pfam annotation: Domain name=Mem_trans; Domain location=32-653; Score= 366.5; E_value=4.1e-107; Accession=PF03547.8; Description=Membrane transport protein
KGENDNLGRFLHGDVGGDSAVRGDDLSVRLGAVVEDILAGPMLRHKPLRRDLRRSAPFVSLHLLEQSLRDELPVHRCGHAPEDHHALRPRNLDELLRQREPGVDDYHFLPLHIAEHARDGNPAAHRHCIIWYTLLLFLFEYRGAKLLIMEQFPETAASIVSFKVDSDVVSLDGRDFLETDAEVGDDGKLHVTVRKSNASRRSFMMTPRPSNLTGAEIYSLSSSRNPTPRGSNFNHADFYSMMGYAPRHSNFGAADLYSVQSTSRGVTPRPSNFEENGAPAAATTQQQQQAISSPRFGFYPAVQTVPAAYPAPNPEFSSSGLTKSVSKNSQTQPQPQPQPQIQAQVAPPPQPQVAQPTNSGNKANHDAKELHMFVWSSSTSPVSEAGGLHVFSGADFGASDQSGRSEQGAKEIRMLVADDHPQNGETNKAAAEGEFGGEELKFPGKEGEQADEEGEKAGPGGLNKLGSSSTAELHPKSAVAVAGKHMPPASVMTRLILIMVWRKLIRNPNTYSSLIGVIWSLVAFRWHVQMPKIIEKSISILSDAGLGMAMFSLVQCPRHVGSGLEQRGCAVQGGGLFMALQPKIIACGNSVATFAMAVRFLTGPAVMAAASIAVGLRGTLLRVAIVQAALPQGIVPFVFAKEYNVHPAILSTA

SEQ ID NO: 148451 - protein, 80 aa, Glycine max
  Coding DNA Sequence Number=SeqID_31673
MRTQTLFWCWIVAPRPSPPQPQENGFLIRERDHVRSPRSNNETKQGRMRLEGTRKRQWWCTMVADRRRGEGEKGRRKGAN

SEQ ID NO: 148452 - protein, 86 aa, Glycine max
  Coding DNA Sequence Number=SeqID_31674
MPQRLQGLGKGFFCFWVVFLFVKNCVFWFEKKGKGKVTGGGGRDGVRKVRCGSRGGNNGSNGGLRQRRIGRKETDEGERKDNLGKL

SEQ ID NO: 148453 - protein, 521 aa, Glycine max
  Coding DNA Sequence Number=SeqID_31675
  Gene Ontology: Mol. function=metal ion binding
  Homolog annotation: Hit_ID=Q2HUT4; Match level="QueryCoverage=91%, HitCoverage=94%, E-value=1e-102, Identity=64%"; Hit description =Putative RING zinc finger protein-related
MGKPGEHHPLPSYSAAEDQRRNAAPPPGCAVGLRCLVVMLFSVAVFLSPLFWLPPFAHFADPKDLHLDSKYKDHDIVASFYVQKPVSLLEDNILLLSKDIFEEIGVVILSLDPLPRSNTTKVVFAVDPDGKYSEMSAAAISLIRASFKYLVIRQSYLQLTTSLFGVPSVFEVLKFKGGITIIPQQSVFPLQTVQTLFNFTLNFSIYEIQSIFDELTSQLKSGLHLAPYENLYVILSNSEGSTVTAPTVVQSSVLLAVGIPPSKERLKQLAQTIMGHHSWNLGLNNTQFGRVKQVRLSSIWQHSLHGNGGNGSPSPAPQPHPHPHHHHHHHHHHHHHHHHHSHHHHAHVFPETSPAPAPTPTPTTGEDSTSHNFGAPAAPARSLPAPWRSSYAQPPNCRFEHRKRSPRNTQKHAHLTPAVSPTNVPHYPVASPGVGPPAHHGFHSLVPALSPLPNVAFAHAEPPPKNDSSAERPKSHFQWPSPSFFRNGKLDEVELSTFKACRKRRNLLIVYGLKLTPPHMF

SEQ ID NO: 148454 - protein, 86 aa, Glycine max
  Coding DNA Sequence Number=SeqID_31676
MGKPGEHHLLPSGVAAEDPRRNAASPPGCAVGFRCLVVLLFSVAVFLSALFWLPPFAHFADPKDLHINSKYKGGLLIVFGTEFSMM

SEQ ID NO: 148455 - protein, 127 aa, Glycine max
  Coding DNA Sequence Number=SeqID_31677
MDDIATEQHSAQRPQCRYPPAEVSVGIAPTRHPVDPEKSNRALRFPALVMGLCQSYRVPVPPSKFYGVPVAPSKVIKPRTNQALIKKYYAPKKAQGETPQQPGHGRQRTTDALPPSPKFTSAHPQKG

SEQ ID NO: 148456 - protein, 78 aa, Glycine max
  Coding DNA Sequence Number=SeqID_31678
MQIHECLYQLSLSQQGQGFVPFACPTPDQFRAEVAWPRDWPEAQVGEALAEAPGDAEEARMDEEMTDLLGFLGGSGAT

SEQ ID NO: 148457 - protein, 76 aa, Glycine max
  Coding DNA Sequence Number=SeqID_31679
MSHKNDDIRLIHRWIVVKFKKQVHNSILSILTIGNFKIMEKKEPHEDSKNGGFNPFSFSLTFGNPIRATRGISGTC

SEQ ID NO: 148458 - protein, 170 aa, Glycine max
  Coding DNA Sequence Number=SeqID_31680
  Gene Ontology: Mol. function=RNA binding
  Homolog annotation: Hit_ID=Q9LRZ3; Match level="QueryCoverage=78%, HitCoverage=22%, E-value=4e-21, Identity=41%"; Hit description =Arabidopsis thaliana genomic DNA, chromosome 3, TAC clone:K20I9
MAAKKHDAGDTKKRKRLNTKTHEDPKASKLVASKKHKLDSVAKDNKNKKTTPLTGQERRLHSKELADARKKKRKRHFTLEQELARLWEKMRRHEIAKEDRAKLVTEALQKMKGKIPEIAKTNKMVTTIPRIIIVCQYSLGSVWSVFVETTTLLHLGLAMVLFDYASSVNH

SEQ ID NO: 148459 - protein, 128 aa, Glycine max
  Coding DNA Sequence Number=SeqID_31681
  Gene Ontology: Mol. function=catalytic activity; Biological process =trehalose biosynthetic process
  Homolog annotation: Hit_ID=UPI00000482A4; Match level="QueryCoverage =80%, HitCoverage=32%, E-value=9e-33, Identity=72%"; Hit description =catalytic/ trehalose-phosphatase
  Pfam annotation: Domain name=Trehalose_PPase; Domain location=1-123; Score=-45.6; E_value=0.00056; Accession=PF02358.7; Description =Trehalose-phosphatase
MQTSNSFPPKLACGSTSDINSVSWAALAEKVRLVLNEYPQLRLTQGRKVLEIRPTIKWDKGKALEFLLESLGYKNLNDVFPIYIGDDRTDEDAFRFCAVGVKELGFLFLELQKKQMLPIPCNAGSRDN

SEQ ID NO: 148460 - protein, 84 aa, Glycine max
  Coding DNA Sequence Number=SeqID_31682
  Gene Ontology: Mol. function=transporter activity; Cellular component= membrane; Biological process=sodium ion transport
  Homolog annotation: Hit_ID=Q21ZY3; Match level="QueryCoverage=68%, HitCoverage=11%, E-value=4e-23, Identity=74%"; Hit description=Anion transporter precursor
  Subcellular localization annotation: CTP_CleavageSite=23; ConfidenceScore=5.12e-01
MFAAFFAAGIALGAPPALLGLILAFSSSLMMSLTHYGTGTAPIVFSSGYVTLGEWWKAGWVMSVVNLLIWIVIGGAWWKLLGYW

SEQ ID NO: 148461 - protein, 92 aa, Glycine max
  Coding DNA Sequence Number=SeqID_31683
MWGRGSSPRRASYLALKAKACPGELLFVSLTKTLSDSWLRIVTGVKQRNSTSKDQNIILNDIPQMKLGSDARDAGEGPRVLMSLRVDFEPMG

SEQ ID NO: 148462 - protein, 190 aa, Glycine max
  Coding DNA Sequence Number=SeqID_31684
  Gene Ontology: Mol. function=nucleic acid binding
  Homolog annotation: Hit_ID=Q1SDG1; Match level="QueryCoverage=53%, HitCoverage=9%, E-value=1e-13, Identity=37%"; Hit description =Integrase, catalytic region; Zinc finger, CCHC-type
MEEGFSTNKPPLFKGIKYDYWKECIIAHYKFIHIDLWDVIENGDYIPHDDQLNEIPRGQWIKQQRLKSLLNSKAQNVTVLRALKNLDYMSLEELVDTLKIHEQELQQDEGPKREKSLALSNSDEDKLAFISWKIHKMLRNKGGSKRKNSSRRMSRENKDKDKSSIIKEESAKCRKLPHDGTVKEYKRGVF

SEQ ID NO: 148463 - protein, 104 aa, Glycine max
  Coding DNA Sequence Number=SeqID_31685
MEEKVKLKINGGLRSTYLKLLRRSERRRHLLENKPWKEKLHHQESVLDKKLREEASMEEMNEREGASLRSFLKKLEFSYTPLLIAKLTSLRNFLEKLEFSYTPL

SEQ ID NO: 148464 - protein, 367 aa, Glycine max
  Coding DNA Sequence Number=SeqID_31686
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-57, Identity=32%"; Hit description= UPI00006A17C9 related cluster
GLHVFSFRGLHVLAFRRLDALAFRGLHALAFRGLQVLAFRGLHVLSLKGLHALALRGLHVLAFRGLHVLAMRGLHVLTLRGLHVLAFRGLHDLAFRGQHVLAFRGLHVLAFRGLHVLAFRGLHVLAFRGLQVLAFKGLHVLAFRRLQVLAFRGLHVLAFRRLHVLAFRGLHVFSFRGLHVLAFRRLHALAFRGIQVFSFRGVHVITFKELHALAFRGLLALAFRGLHVLAFRGLHALPIRGLHVLAFRGLHVLPFRGLYALAFRGLHVLPFRGLHVLAFRGLHILPLRGLHALAFRILHALAFRGLHILTFKGLHVLSLRGLHALAFRRLHVLAFRGLHNLTFRGLHVLAFRGLHICAFRELKVLHP

SEQ ID NO: 148465 - protein, 91 aa, Glycine max
  Coding DNA Sequence Number=SeqID_31687
MGGLTSHYHETPNYTKEMKMCGGMERRWAWRLSKQLPHAKPGSFRLSAKRLQRAKRAWCAKREPSGFNFSSIPHLCSSKTKITQNSINLTV

SEQ ID NO: 148466 - protein, 190 aa, Glycine max
  Coding DNA Sequence Number=SeqID_31688
  Gene Ontology: Mol. function=protein kinase activity; Cellular component=thylakoid; Biological process=protein amino acid phosphorylation
  Homolog annotation: Hit_ID=Q9FWF0; Match level="QueryCoverage=94%, HitCoverage=35%, E-value=4e-79, Identity=76%"; Hit description =Protein kinase-like protein
MYQAALPLKLEKGLKVRSHIMLGIPKHEEVPSTPQRPLSAMGEACSRMDLTAIHQILVATHYRDDEGTNELSFQEWTQQMRDMLEARKRGDYAFRDKDFKTAIDNYSQFIDVGTMISPTVFARRSLCYLLCDQPDPALRDAMQAQCVYPDWPTAFYMQSVALAKLDMHKDAADMLNEAAALEEKRQRGAR

SEQ ID NO: 148467 - protein, 1239 aa, Glycine max
  Coding DNA Sequence Number=SeqID_31689
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=99%, HitCoverage=99%, E-value=0.0, Identity=46%"; Hit description=Kinesin related protein
  Pfam annotation: Domain name=Kinesin; Domain location=100-453; Score =383.4; E_value=3.6e-112; Accession=PF00225.13; Description=Kinesin motor domain
  Pfam annotation: Domain name=Kinesin-related; Domain location=529 -1200; Score=757.2; E_value=1e-224; Accession=PF06548.2; Description =Kinesin-related
  Pfam module annotation: Pfam domain module=Kinesin::Kinesin-related; Domain location=100-453::529-1200
  Subcellular localization annotation: CTP_CleavageSite=56; ConfidenceScore=5.48e-01
MRQSSNAETRFSGTISSPSLKKFLPRSLSSKQKPTSNPNIRNSDAENTPPTDPNILINHEQSLLPSTTKQSHSKTSISQNHLKQSKSPLESDPSVKVVVRIRPTNNNGIDGDRTVKKVSSNTLCVGDRQFTFDSVFDSNTNQEDIFQSVGVPLVKSALAGYNTSILSYGQSGSGKTYTMWGPPSAMFEEPSPHSHKGIVPRIFQMLFSELEKEQHVSEGKQFNYQCRCSFLEIYNEQIGDLLDPTQRNLEACICHPFVLQFIIKTLLTNTLMKDDSKNALYIENLTEEYVTSYDDVTQILVKGLSSRKVGATSLNSKSSRSHIIFTFVIESWCKGISSNGFSSSKSSRISLIDLAGQDRNKVEDAGKQCLKENKNVKKSLSQLGHLVDALTKETHSGKAEEISNRNSCLTCLLQESLGGNAKLSLICSISPDNKNNGETLRTLRFGQRVRTIKNEPVINEIKEDDVNDLSDKIRQLKEELIRAKAEVHSSDGSKNGYLQVRNVRDSLNQLRVSLNRSLLLPCIDNDADEEVNVDEEDIRQLRQQIDELYHSCEENPKNISVSEDCVQYYSVAENCDTDMTSGDEIEKEEVCYREAMSKLCLEESEGSTTTLYTSADDFACTANASRTIKSTFRDSISVSSCSRSPILGEPQLSESPKIKNVHRKSVAYSQSCLGSWNNMAEENMSSSNDILKQSFKEGEQMRSSLRSSKVFQGPTQSLAASLQRGLQIIDYHQRNSALNKSSASFSFECLTLTPCPEDKDDSCDQIMQKKKYSVDERTASLLCESCLKRIYDQDSTEVQDSIKSRVETAEAENPDGLTDKVPKDLQSIMEKAITREKELENVCKEQAARIEELNQLVEKLKGEMEVKSSIIVYDPESNKQTRHEEEYNSLKDEDKLPRGTSLDRHLPDIIEENCEIKEVQEEVTQRDSSFNAAEKEELLKEIQNLRSRLQLCSDAPVKKSTDKLRSSLSLMSRSIQLRKSGVFSLDNGGDELEKERERWTEMESEWICLTDELRVDLESIRQRAERVEMELSLEKKCTEELDDALKRAILGHGRMVEHYADLQEKYNDLVAKHNAIMEGVAEVKKAAAKAGKRGHARFAKSLAAELSALRVEREREAKFLKKENMNLKIQLRETAEAVHAAGELLVRLREAEHAVSVTEENFTKVQQDNEKLKKQMDKLKRKHKMEIITMKQYLAESKLPESALQPLIREDSDVVHKDATSRDDQAWRVEFGAIYQQHY

SEQ ID NO: 148468 - protein, 617 aa, Glycine max
  Coding DNA Sequence Number=SeqID_31690
  Gene Ontology: Mol. function=protein kinase activity; Cellular component=integral to membrane; Biological process=protein amino acid phosphorylation
  Homolog annotation: Hit_ID=Q1SS76; Match level="QueryCoverage=94%, HitCoverage=95%, E-value=0.0, Identity=66%"; Hit description=Protein kinase
  Pfam annotation: Domain name=LRR_1; Domain location=102-124; Score =10.9; E_value=2.7; Accession=PF00560.23; Description=Leucine Rich Repeat
  Pfam annotation: Domain name=LRR_1; Domain location=126-148; Score =14.2; E_value=0.46; Accession=PF00560.23; Description=Leucine Rich Repeat
  Pfam annotation: Domain name=LRR_1; Domain location=150-169; Score =12.7; E_value=1.2; Accession=PF00560.23; Description=Leucine Rich Repeat
  Pfam annotation: Domain name=LRR_1; Domain location=77-100; Score =8.3; E_value=8.1; Accession=PF00560.23; Description=Leucine Rich Repeat
  Pfam annotation: Domain name=Pkinase; Domain location=320-571; Score=- 10.5; E_value=6.2e-08; Accession=PF00069.15; Description=Protein kinase domain
  Pfam annotation: Domain name=Pkinase_Tyr; Domain location=329-571; Score=-58.7; E_value=7.2e-09; Accession=PF07714.7; Description =Protein tyrosine kinase
  Pfam module annotation: Pfam domain module=LRR_1::LRR_1::LRR_1::LRR _1::Pkinase::Pkinase_Tyr; Domain location=102-124::126-148::150 -169::77-100::320-571::329-571
MQNTRDFAVFLRRLVFFAIIFFIIDCTRGKSSESESFLNFLRALDPRNELNITWNGSPSHPCLVKLNGVRCNSNATNVVHIRLENLNLSGTIDADSLCRLQKLRVVSLANNNIRGTIPQSILHCTRLTHLNVTSNQLSGRLPNALTKLKHLRNLDISNNNFSGMIPSKQQYYRHLLRYYVTPSNKLESNSTKERLKESDTNTILQEQATPPGALSNSTPNNGKDSSSWRVETLGVFLLGAGLLLSSIYFIVKKSAKLSAEKEVAVVKDHRRVSPIIKATTHEVQEVKLKEGDSELVFFVEDRERFTLEDLLRATADLRSEGFCSSLYKVKLEHNVYYAVKRLKNLQVSLEEFGETLRKISNLKHQNILPLVGYRSTSEEKFIIYKYQSNGSLLNLLNDYIAGRKDFPWKLRLNIACGIARGLAFIYRKLDGEEEVVPHGNLKPSNILLDENNEPLISEHGLSKFMDPNRGFLFSSQGYTAPEKSLTEKGDVYSFGVILLELLTGKSIEVSRIDLARWVRSMVREEWTGEVFDKEVRENDHQWAFPLLNIALLCVSCFQENRPTTVEILEKIEEVMDQHEQHQERYASKCCSNGSNRDECCSLHKIIPETWDSPGSNY

SEQ ID NO: 148469 - protein, 199 aa, Glycine max
  Coding DNA Sequence Number=SeqID_31691
  Gene Ontology: Mol. function=transcription cofactor activity; Cellular component=nucleus; Biological process=abscisic acid mediated signaling
  Homolog annotation: Hit_ID=Q9SEE4; Match level="QueryCoverage=74%, HitCoverage=43%, E-value=5e-49, Identity=65%"; Hit description=Pirin- like protein
  Pfam annotation: Domain name=Pirin; Domain location=30-147; Score =170.1; E_value=5.4e-48; Accession=PF02678.6; Description=Pirin
MPDQDICSYINEPRLVARKFLARPQHEGVGAVVRRSIGRFELKYFDPFIVLDEFSVTAPAGFPDHPHRGFETVTYMLQLSQCKYQLNMVLICVLVVWQHGAITHEDFEGHKGTIEAGDLQWMTAGRGIVHSEMPAAQGTQKGLQLWINLASKHKMLTRVSWNGHSTKHIIIIMGLEDHINETKRNSTLHKETVKSLKTF

SEQ ID NO: 148470 - protein, 258 aa, Glycine max
  Coding DNA Sequence Number=SeqID_31692
  Gene Ontology: Mol. function=zinc ion binding; Biological process =defense response to fungus
  Homolog annotation: Hit_ID=Q9FJ71; Match level="QueryCoverage=66%, HitCoverage=12%, E-value=1e-35, Identity=49%"; Hit description =Arabidopsis thaliana genomic DNA, chromosome 5, P1 clone:MTE17
MLTSVINNLSLQNAVKTIGATTQHCQEHRDVANTKPHRIETRILVVCIKEGFGMKRSRSSSEDEAETEAEVQSLSVSNYHIVDDEDNPVSFAVLPIHWSDSENSEAANKGKVFIDGDTDNGLKKIFMQVTAWRFDLSNVRLEISLLSKDGRWIKLQKPRKGFQNKIRTVLITLHFLHRVKKKRQMSEISVWQDLSKDTELSSSGVKPSQKDLSDHVPLIREAAKRDSVLAKSKRYTVFMWTAKKTTSAVEKFLAVLHQ

SEQ ID NO: 148471 - protein, 397 aa, Glycine max
  Coding DNA Sequence Number=SeqID_31693
  Gene Ontology: Mol. function=zinc ion binding; Biological process =defense response to fungus
  Homolog annotation: Hit_ID=Q9FJ71; Match level="QueryCoverage=87%, HitCoverage=28%, E-value=6e-49, Identity=33%"; Hit description =Arabidopsis thaliana genomic DNA, chromosome 5, P1 clone:MTE17
  Pfam annotation: Domain name=PHD; Domain location=49-106; Score=17.6; E_value=0.001; Accession=PF00628.19; Description=PHD-finger
MVLEKLNSQKLLDKEVNDLAQPGLTVVGIDSDMIDESNEESEERDDLDVCALCDNGGNVTCCDGVCMRSFHATVEAGRENSCVSLGFTQKEVDEIQSFYCKNCEYYQHQCFACGKLGSSDKVKGAEVIKCVSATCDRFYHPHCVAKLLPQLAKPVAEDLERNIADRALSKVISSQMFAKRVDSQIAFIREIAPSNRGNKNIIQRAWEGLLPNNRILIYCLNHKIDRELGTPVRDHIKFPNMEPTVQKINTTIEQKEPATKERVILKKKNVDLDNSSGKSIAKGSKLTGKLSSHKVGSKKTKKIISGSNISRKPKSKETSRCLTENKRSISKKSEMSDSEQNYNQPTIGEIYALQKEGLKRIKHDNKVNNVITNPLSVKPIESLSVELPPLDADSEKR

SEQ ID NO: 148472 - protein, 181 aa, Glycine max
  Coding DNA Sequence Number=SeqID_31694
  Homolog annotation: Hit_ID=Q9FJ71; Match level="QueryCoverage=41%, HitCoverage=5%, E-value=8e-21, Identity=60%"; Hit description =Arabidopsis thaliana genomic DNA, chromosome 5, P1 clone:MTE17
MGKLEYSVNAVQTALRKLESGCSIQDVKAFCDPDDLKQLFKWKDELKIYLAPVLYGNRYTSYGRHFTLVEKLEGLLYPPSSLNHIIDLGLPLSMHHRFLGEADIMDRRNNDDPADAGNEGGFYTVESTVMVAQWFSGSDDVLLGIMHTLHFVFKKIVLIVEARLIVDSDKEKVPAILALIR

SEQ ID NO: 148473 - protein, 86 aa, Glycine max
  Coding DNA Sequence Number=SeqID_31695
MASIMEAICSIKADMSAFICSCTSSRSSIILDLDMVDKSGAFAPTYPPLKRKSDLRSSFFKSESSDSCYLKGDHSKALDLKNDPFT

SEQ ID NO: 148474 - protein, 204 aa, Glycine max
  Coding DNA Sequence Number=SeqID_31696
MDQRNARPPLLSLWSRPDWTTKHKVIAQENGHVCSQHEVLDTTDHTTDGNYAANLKSTDNQEDQASTSEGQKRILHYGNSQLNPIKGKSSGEGLKPKSDEVGDVVPGHGPSWGHSRNNNEQVVSETESSCKTNTPAIGQCEPCLGNLNHVMRSSLVSEPRTFSTSGSLGRSVPQSRYGGGGLLGFASGPNYAYASQHSCGWLEE

SEQ ID NO: 148475 - protein, 83 aa, Glycine max
  Coding DNA Sequence Number=SeqID_31697
MIFHLTLVLTATTCCWMICNSSECESLVRRWRGVDFSSHKSFSVYSGWICMYSCWIMTFQLDLPLPALPHVTIVVFNPRSFHK

SEQ ID NO: 148476 - protein, 104 aa, Glycine max
  Coding DNA Sequence Number=SeqID_31698
  Homolog annotation: Hit_ID=UPI000034EE59; Match level="QueryCoverage =70%, HitCoverage=8%, E-value=9e-14, Identity=54%"; Hit description =transcription factor
MTRMTRDFRDTMQKDAVPAVSADIIFASLRFPNYKIGVNNQIMETKDSPKVLSMKEVVARETAQLLDQQKRLSVRDLASKFEKGLAAAGEGRATVKGKMGLLHF

SEQ ID NO: 148477 - protein, 274 aa, Glycine max
  Coding DNA Sequence Number=SeqID_31699
  Gene Ontology: Mol. function=long-chain-alcohol O-fatty -acyltransferase activity
  Homolog annotation: Hit_ID=Q84XY7; Match level="QueryCoverage=95%, HitCoverage=92%, E-value=4e-58, Identity=54%"; Hit description=Wax synthase isoform 3
  Pfam annotation: Domain name=MBOAT; Domain location=23-251; Score= -17.5; E_value=5.7e-05; Accession=PF03062.9; Description=MBOAT family
MYGNGRRNQELNEGMDFNPSLPMLLLFHIIKGTQRLVEVFDPLPSVVPIHHPTSSTHHCPPNSLSLMSLKDQYKQKLHPTIILGIYCTLLYLLMDVVLGLCNIVVNAAFGIELQLPSDDPYLSTSLRDFWGRRWNLIVTYTLRHTVYKPVRSLLMSKTVLGPQWASVSGVMATFLVSGLMHELIFYYVTRVSPTWEVTCFFLLHGVCAVAEFGAVKWLGAKWRLHWALCGPITVAFVIVTAAWLFFPPLMHDGTDERTIKEFNDVVECVMGKFY

SEQ ID NO: 148478 - protein, 241 aa, Glycine max
  Coding DNA Sequence Number=SeqID_31700
  Gene Ontology: Mol. function=lipid binding
  Homolog annotation: Hit_ID=Q9LTR5; Match level="QueryCoverage=58%, HitCoverage=8%, E-value=2e-09, Identity=34%"; Hit description =Similarity to bactericidal permeability-increasing protein
  Pfam annotation: Domain name=LBP_BPI_CETP; Domain location=36-227; Score=36.7; E_value=8e-08; Accession=PF01273.15; Description=LBP BPI  CETP family, N-terminal domain
MAPSICFLLLSLLFLSSSTSGTDEEGFISVIISDKGLDFAKDILIDQAVASIVQSQLPQIEKTVQVPLVGKAKVVLSDITINHIQVNSSSVNTGETGIALVVSGATADLSLNWRYSVSSWLVPIGISDSGTATVKVNDLQVGLTVNLRNQEGTLKLNLLDSGCHTVGPETGRPDKSVSVIFCNKNYSGEYKAIFQFFCRLVDAFAGNIASAVEEAISKKINEGISLVKNSYHHFEFQPPPA

SEQ ID NO: 148479 - protein, 174 aa, Glycine max
  Coding DNA Sequence Number=SeqID_31701
  Gene Ontology: Mol. function=hydrolase activity; Cellular component =centrosome; Biological process=microtubule cytoskeleton organization and biogenesis
  Homolog annotation: Hit_ID=P48529; Match level="QueryCoverage=90%, HitCoverage=51%, E-value=5e-81, Identity=89%"; Hit description =Serine/threonine-protein phosphatase PP-X isozyme 1
MQAFLVHRNNQKLRDKSLSALIENKIFSVHGGLSPAISTLDQIRTIDRKQEVPHDGAMCDLLWSDPEDIVDSWGLSPRGAGYLFGGSVVTSFNHSNNIDYICRAHQLVMEGYKWMFNNQIVTVWSAPNYCYRCGNVAAILELDGNLTKQFRVFEAAPQESRGTPAKKPAPDYFL

SEQ ID NO: 148480 - protein, 264 aa, Glycine max
  Coding DNA Sequence Number=SeqID_31702
  Gene Ontology: Mol. function=thymidine kinase activity; Cellular component=intracellular; Biological process=metabolic process
  Homolog annotation: Hit_ID=Q9LIE7; Match level="QueryCoverage=61%, HitCoverage=23%, E-value=5e-51, Identity=53%"; Hit description =Selenium-binding protein-like
MLRCGIKPDAVTFVAILSACSYSGLVEEDMLGRVGRVVEAYEFVQRLGEDGNAIEIWGSILGACKNHGYFELGKVIAEKLLNMETEKRIAGYHVLLSNIYAEEGEWENVDRVRNQMKEKGLQKEMGCSWVEIAGCVNFFVSRDEKHPQSGEIYYILDKLTMDMKDAAVTGDEQHIQFMYNTIVQLNSDTSLILPFTPDTRNGVMITVILSKVFWVIVEMLSHEEVYEVDDTFIQDSCHSDVIMTICGKSSGTSMLRQTCNYDYY

SEQ ID NO: 148481 - protein, 463 aa, Glycine max
  Coding DNA Sequence Number=SeqID_31703
  Gene Ontology: Mol. function=transferase activity, transferring glycosyl groups; Cellular component=integral to membrane; Biological process=metabolic process
  Homolog annotation: Hit_ID=Q66PF3; Match level="QueryCoverage=98%, HitCoverage=100%, E-value=1e-123, Identity=51%"; Hit description=UDP- glucose glucosyltransferase
  Pfam annotation: Domain name=UDPGT; Domain location=5-432; Score= -65.7; E_value=2.6e-07; Accession=PF00201.9; Description=UDP -glucoronosyl and UDP-glucosyl transferase
MKKAARVVFIPSPGVGHLVPTIEFAKLLINHDERLWISVLVMDTTSAAYTESLASQRLQFINLPESPSKSEPAMTSLLEQQKPHVKQAVSNLISDDSAPALAAFVVDMFCTTMIDVAKDLKVPSLVFFTSGLAFLGLMLHLHTLREQDKTHFRESQTHLLIPSFANPVPPTALPSLVLDKDWDPIFLAYGAGLKKADAIIVNSFQELESRAVSSFSSHAIYPVGPMLNPNPKSHFQDDNDRDILDWLDSQPPSSVVFLCFGSKGSFGEDQVREIARALQDSGLRFLWSLRKPPPSDSSFMAMPSDYLPSDFVEILPPGFLDRTAGIGKVIGWAPQAQILAHPATGGFVSHCGWNSTLESIYFGVPIATWPLYAEQQTNAFLLVRELNMAVEIALDYRVQFMAGPNTLLSADKIQNGIRNLMDMDLDTKKRVKEMSEKSRTTSLEGGCSHSYLGRLIDYIMNQV

SEQ ID NO: 148482 - protein, 408 aa, Glycine max
  Coding DNA Sequence Number=SeqID_31704
  Gene Ontology: Mol. function=metal ion binding
  Homolog annotation: Hit_ID=Q6H6V3; Match level="QueryCoverage=79%, HitCoverage=65%, E-value=3e-68, Identity=50%"; Hit description=Zinc finger (C3HC4-type RING finger) protein-like
  Pfam annotation: Domain name=zf-C3HC4; Domain location=278-325; Score= 62.2; E_value=1.7e-15; Accession=PF00097.15; Description=Zinc finger, C3HC4 type (RING finger)
MENRGRSVRIIKLACHELQLAAFPWMEKRGVSADAELQLADFGPDPAQTCTGNEKGDKAFRIPQSRRPNLSSLQIPARSLDIALSTFAKTDGPLVSRSSPGSTRGLPPRPNSAKVRSSMRGLLPQRSFKINTCSQDIERTGLIVPNTPPSDAPLDKPSSSTHLSLNNKVISPSTKVSHSLPVTPFATSAAENGHGRHLGCDSGLSTMEVHQHMMRSFSVPVNGKSTNLRVTDSRGLIRVISAKPHRETVGGKSTDGAFVPEIAIEDATEDIPEEQAVCRICLVELGEGGNTLKMECSCKGDLALAHQECAVKWFSIKGNRTCDVCKQDVQNLPVTLLKIYNPETLARQGSNVSQQSEIVYYSVQDTAVKLYPLHLPNFRIHLKKLLVAMGENPRPIKHTKKPSPYAIG

SEQ ID NO: 148483 - protein, 113 aa, Glycine max
  Coding DNA Sequence Number=SeqID_31705
  Gene Ontology: Mol. function=zinc ion binding
  Homolog annotation: Hit_ID=Q1EPH4; Match level="QueryCoverage=54%, HitCoverage=22%, E-value=7e-14, Identity=52%"; Hit description=Zinc finger (C3HC4 type RING finger) family protein
MEYTIKSVSRSFVWAYACFQFAILILLSHLNFNAILSILLSSFTGFGIAVSMNSLIMEFIGWRTSRRVQSSIENVNRTQQQHREHVQQQGQEDEGQHHLQRQQEHHLPQHGNS

SEQ ID NO: 148484 - protein, 56 aa, Glycine max
  Coding DNA Sequence Number=SeqID_31706
MEGSTGLHSETLLIHVSRGLSIKKSLQNFLQRRIRKKRKNPDLHEYNTIWSGTFLE

SEQ ID NO: 148485 - protein, 180 aa, Glycine max
  Coding DNA Sequence Number=SeqID_31707
  Gene Ontology: Mol. function=transferase activity, transferring glycosyl groups; Biological process=metabolic process
  Homolog annotation: Hit_ID=Q9LHJ2; Match level="QueryCoverage=74%, HitCoverage=35%, E-value=3e-21, Identity=47%"; Hit description=UDP -glucose glucosyltransferase-like protein
MQKLGWEFVRQGFEIAKEKDDEIKWVALPDQKEAGHGHGFFSANTGLPQHEGNFSLEPELPVISTEDLPWLVGTDAARKARFKFWKRTLVRSSALKWLLVNSFPDESKLESANNKNKFKGCPRVFPIGPICNCRIDGELLGRRYELLEVASKAEGEVSWVSPIGEAKWHSRLQGGLSFGY

SEQ ID NO: 148486 - protein, 220 aa, Glycine max
  Coding DNA Sequence Number=SeqID_31708
  Gene Ontology: Mol. function=lipid binding
  Homolog annotation: Hit_ID=Q9LTR5; Match level="QueryCoverage=87%, HitCoverage=14%, E-value=2e-30, Identity=32%"; Hit description =Similarity to bactericidal permeability-increasing protein
  Pfam annotation: Domain name=LBP_BPI_CETP_C; Domain location=9-219; Score=-32.8; E_value=0.00052; Accession=PF02886.7; Description=LBP BPI  CETP family, C-terminal domain
MDNPVLSDSAIELEINGLFTGRNEVLVPQAYYRGSGLSLSASCGGSSPKMITISLHESVFKSGSMLYFTADSMQWIVDELPDQALLNTAEWRFLIPQLYKKYPNDDMNLNISVSSPPDIQVTNKDVSVNIFIDITIDVLEDGEVIPVACISVDFSASFAVEILGNNLAGWLKLRKFSTSLKWSKIGKLHMNLIQLAALYFDMKLDEIEQQGNNMSVFCFN

SEQ ID NO: 148487 - protein, 128 aa, Glycine max
  Coding DNA Sequence Number=SeqID_31709
MVFVRHRRTDDFRIKLIHEWMYEIMSERADMDYENAESCGANELHVDCSDAFKTSQVFECREDVLRWARFVAHENGFVAMILRSDTNTGVASISVGKKNLSEETLRLGNVGVPSSFVASQWLEEKAGW

SEQ ID NO: 148488 - protein, 922 aa, Glycine max
  Coding DNA Sequence Number=SeqID_31710
  Gene Ontology: Mol. function=zinc ion binding
  Homolog annotation: Hit_ID=Q9LTR5; Match level="QueryCoverage=49%, HitCoverage=27%, E-value=6e-72, Identity=37%"; Hit description =Similarity to bactericidal permeability-increasing protein
  Pfam annotation: Domain name=C1_3; Domain location=390-420; Score =15.1; E_value=0.0085; Accession=PF07649.3; Description=C1-like domain
  Pfam annotation: Domain name=PHD; Domain location=391-442; Score =30.3; E_value=6.6e-06; Accession=PF00628.19; Description=PHD-finger
  Pfam module annotation: Pfam domain module=C1_3::PHD; Domain location= 390-420::391-442
MEDAVPDPQPEEQPQRPPPLLNGYSDERCAKKPKFDEGAELKRVAEIVLVLSTMATVRAGRKPSDAEVELMREARAKLASLCEGLAPKDIVAGEAIGTVIEDLGLNSKLKDQRLGFRTPKMSIAERYSHAKWKMEEAKKFSASSTPSTTHTSQPLQTNIGGPVDNRVPSHVVRIFPSDKSSHPAIPSMGTVVPIPAHVSAGSSAALQYQVTGNEVRPPVVSGVMPSSHLGRNSSSLALPKVERPQFKVDGGSNGSPYMLQVQANSSANQPLVNAPTWSIQTQAASLARSASENKVPVHNSVKVEGTPDATVSRAGTQITTDSSFRPFITQTAPGNLPSVHQPLQATNIVQAPLIPSHTDIAKIVQKVLQPKLPVHPTWTPPSRDYMNKAFTCQMCELSVNEVDTVLLCDACEKGFHLKCLQPSVLRGIHNRVDWHCMRCLSLSGGKPLPPKYGRVMRSSNTPPKLPSNTGGVQPCSEKKVENIDPKVIPQTLATNGSSVPTVSGGHHNVELPSESKIPDTKDMQGTGISSTIEAIDKKPDPKNSMKSLSAAYSPSPCLLGENSAQQINSKVLTGRETSESESLPKLSELAKCENLQSSQDFQVEHTMSQDNAEVSSDKHVDSNMMNNQQKESHGEENLVYDIKRDDQDAALENSVGTSGTNTDGRQHSALSSDSSHAVEWIGDVVQLVDEKKYYQSCCVDGSMWEDCKTGLKWVKVTNCYFPDDLPGNIGHPCISEVNEVYESNSDRTEMASSIRGPCEVLPSDKFKQENDRRCQLRNEESSRVQPIFLCRVDGKSKGCLWRREREKRRVAVVPSGCSVVLLCPINHLGNSCPEKRSSLVWVGGQEKERGGFWCVAAGGLAKHDKRMQGLCLNHEAHSSHNSRWSCDCGSKEFGNAIALSGYLTTLDVAVVPSGHSAAIVHY

SEQ ID NO: 148489 - protein, 198 aa, Glycine max
  Coding DNA Sequence Number=SeqID_31711
MTHNINSERPQYSLKCAYKSQRLPKEDSCYGKASLVVWIVENLKQTYLLRKKRMQKTNKEGQQQQQQKMGKEVTLEEWLLKSPIIEKGGNCNGDHCGFKHVSGIDYPSVTREGNYFSDFGGYSLSLEQHLDGGDYTDLSVENLLKDEKVDVKEMGFNSLTRSQSSKVRKRLILAELYMCLYVGKSQSLLPPWVSLPDP

SEQ ID NO: 148490 - protein, 398 aa, Glycine max
  Coding DNA Sequence Number=SeqID_31712
  Gene Ontology: Mol. function=RNA binding; Biological process =translation
  Homolog annotation: Hit_ID=Q1SIK1; Match level="QueryCoverage=84%, HitCoverage=93%, E-value=1e-27, Identity=28%"; Hit description =Cyclin-like F-box
  Pfam annotation: Domain name=DUF104; Domain location=1-62; Score= -2.7; E_value=0.048; Accession=PF01954.7; Description=Protein of unknown function DUF104
  Pfam annotation: Domain name=F-box; Domain location=44-91; Score =40.3; E_value=6.4e-09; Accession=PF00646.23; Description=F-box domain
  Pfam module annotation: Pfam domain module=DUF104::F-box; Domain location=1-62::44-91
MEKERYSIYKSGVTKSWIDVKIREARKLGVAAKEKKRSRVVKKDRLSNLPDEVLHRILSSLDAKSAVQTCVLSKRWTHVWTSLPVLNFCDSSFDDSLYFQCFVDHVLSRRDSSSNVYELNFACTDELEDGHIVDSVVDHVSLTSIQVLSILAECVIGKLPQLSLCQSLTTLKLAHISTETTTFDFVSLENLYLLDCRFECGVEELLDPFRGCVNLKHLYLHRCQYYGGIHRFQIFVPQLTHLSISWMGMNEMFDSDCVVELFTPKLQYFRYHDSDLYDFSIEGNLPFIEQVDIDVGCLTNDTDSLLLLIQLFEMMGSARFVSLSPAIIQALAMIPDLLDGRASPFSRVHTFELNMDRPSSSFVIPPNVMAYLFSGSPAFDFHEWEGMKRVQKSAKQSD

SEQ ID NO: 148491 - protein, 204 aa, Glycine max
  Coding DNA Sequence Number=SeqID_31713
  Gene Ontology: Mol. function=phosphatidate cytidylyltransferase activity; Cellular component=membrane; Biological process =phospholipid biosynthetic process
  Homolog annotation: Hit_ID=Q1PE48; Match level="QueryCoverage=98%, HitCoverage=42%, E-value=9e-92, Identity=77%"; Hit description =Phosphatidate cytidylyltransferase/CDP-diglyceride synthetase
  Pfam annotation: Domain name=CTP_transf_1; Domain location=1-164; Score=152.9; E_value=8.4e-43; Accession=PF01148.10; Description =Cytidylyltransferase family
MNDVGAYFFGFYFGRTPLIKLSPKKTWEGFIGASVATMIAAFTFANFLGRFQWLTCPRKDLATGWLQCDPDPIFKPDYIPLPGLISHWLPWKEIAVLPVQWDALWMGLFASIIAPFGGFFASGFKRAFKIKDFGDSIPGHGGFTDRMDCQMVMAVFVYIYHQSFVVGQDYSVETLLDQIMRNLGSEEQLSLYTKLGQILQERRL

SEQ ID NO: 148492 - protein, 162 aa, Glycine max
  Coding DNA Sequence Number=SeqID_31714
MEVDEVYFDCAIELFTPKFQSFTYSVFDLYGFFIKSNLPFVETVHIDVLGCTNDPNLQLKLIQMFEVMGSAEFVALSTGIVEVLSMFPDLLDSRPSPFTKVQTFELNREIPASSVDMPANVMAYLFGKSPGFDFYECRWEGMEMAYETPYCFLLALIIDAEH

SEQ ID NO: 148493 - protein, 115 aa, Glycine max
  Coding DNA Sequence Number=SeqID_31715
  Homolog annotation: Hit_ID=Q1SIK1; Match level="QueryCoverage=58%, HitCoverage=18%, E-value=2e-08, Identity=44%"; Hit description =Cyclin-like F-box
MGELRKISYDGVVWWCQDAKNLNGGGDWWCEGNIVNDGIDGFGKIKFFVLALEVEMVDIGGSVSARQEMVDEGAEEERVVVEGGGVEVEDGKGSPNVPPPLTQNARLKRCFCVQR

SEQ ID NO: 148494 - protein, 213 aa, Glycine max
  Coding DNA Sequence Number=SeqID_31716
  Gene Ontology: Mol. function=RNA-directed DNA polymerase activity; Biological process=RNA-dependent DNA replication
MGETHEMPHHNLVDFEPCLGYATEGQAVGGIPLQNTLEGPQYHPQPHPSHSTAVKNPHAMAEIGKLGHLEERLRAIEGGKDYAFINLEELFLVPNIFTPPKFKVPDFDKYKGTTCPKNHLKMYCWKMGAYAKDEELLIHLFQESLIGVAVTWYTNLEPSRVHSWKDLMVAFVGQYQYNSDMAPDRMQLQNMCKKGHESFKEYAQRWQLKWHFQ

SEQ ID NO: 148495 - protein, 101 aa, Glycine max
  Coding DNA Sequence Number=SeqID_31717
MLTNEGLVPSITSGIPGRGSFHPWCKSSLGWGIVSIHTLRLVALGKLTVVDSASLPFDELASGCRDLCASPSSCYWHELLGFGYILHGPTMDTKIFMSQMD

SEQ ID NO: 148496 - protein, 66 aa, Glycine max
  Coding DNA Sequence Number=SeqID_31718
MALVNMQQEKKDPLRNFMEHFGKMEELADYRNQVWVEAMSAKKDNDKLNSNKAHDDGRCNIPFFRK

SEQ ID NO: 148497 - protein, 47 aa, Glycine max
  Coding DNA Sequence Number=SeqID_31719
MPYEYLLNGPKKSMCEWKEVKSSEFDPVAVLKVELGMGNTKYSKQKT

SEQ ID NO: 148498 - protein, 140 aa, Glycine max
  Coding DNA Sequence Number=SeqID_31720
  Subcellular localization annotation: CTP_CleavageSite=68; ConfidenceScore=5.07e-01
MEGVQPCPSLPYCRNLHFGGRAKRGLTGASSKKGKCAESPPTFIRGKRRKNRKRCGLRTLSVKGSGVVFTHGEGVGPFKRSFDSFERRKMLRCWTINDLFVFERRERLRRWTINDLLGWSTKAGLLLLRILNCDEEIRPT

SEQ ID NO: 148499 - protein, 210 aa, Glycine max
  Coding DNA Sequence Number=SeqID_31721
  Homolog annotation: Hit_ID=UPI0000503967; Match level="QueryCoverage =100%, HitCoverage=94%, E-value=2e-12, Identity=28%"; Hit description= UPI0000503967 related cluster
MRSDCLVQFSILHFCSEPHELIVVHASSTRESGAMRRDYLVQFSILHFCSEPHELIVVNVSSTRESGAMRSDCLVQFSILDFCSEPHELIVVHASSTHESGAMRSDCLVRFSILHFYSEPHELIVVHASSTHEFGTMHSDCLVQFSILAFYSEPHELIVVHASSTHESGAMRSDCLVQFSILHFCSEPHELIVVHASSTHESGAMRSDCL

SEQ ID NO: 148500 - protein, 42 aa, Glycine max
  Coding DNA Sequence Number=SeqID_31722
RNRCLAVDGSLSAALALTLGQLSGPNQPEMQGLSAKRQRLSA

SEQ ID NO: 148501 - protein, 34 aa, Glycine max
  Coding DNA Sequence Number=SeqID_31723
MARTEVRDQLHYQSLNASPQVNRDLISNEMQQVC

SEQ ID NO: 148502 - protein, 165 aa, Glycine max
  Coding DNA Sequence Number=SeqID_31724
MDDFSEDEDQQFFDHINHQSDDQTDDEGIGRPMTPLSPPLQYQQPRCLVDLNFDHLPHYIDRHHFFHQQHNVQPPVGILKVGMTFDDKAQLSMLRQDHRQLDEHVIAQIIQPIVKTNPTVSIKTLIEEIKTFMNYTPSYKKTWLAKQRALKMIQKHKTFVGVIVG

SEQ ID NO: 148503 - protein, 46 aa, Glycine max
  Coding DNA Sequence Number=SeqID_31725
MQPKVVWGSKNRESRVARPATFSACPALGRDDDPSVVTLSSICIRP

SEQ ID NO: 148504 - protein, 214 aa, Glycine max
  Coding DNA Sequence Number=SeqID_31726
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-32, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=66; ConfidenceScore=5.01e-01
LHALAFRGQHTLAFRGLHGLAFRRLHTLTFRGLLALAFRGLRVLAFRGLHVLTFKGLHALAFRGLHAFAFRGLHALAFSGLPVLAFKGLHVLAFRGLHVLAFRGLHVLSFRGLHILAFRGLHILAFSGLHVLTFRGLNVLAFRVLHVLTFKGLHVLPFRGLHIVTFRGLHTVAFIRLHILAFRGVHVLAFRGLHILAFKGLHICPFGELKVLCP

SEQ ID NO: 148505 - protein, 103 aa, Glycine max
  Coding DNA Sequence Number=SeqID_31727
MWVQAIGLFAQATCAPEFGLPRPFNQRLLVLHVGRGAAVASGGSNLARLGELGGKLLPYFAINRGRSEGRRGSAFLALLILSKLLRKIISVKKIQAEALPLQR

SEQ ID NO: 148506 - protein, 385 aa, Glycine max
  Coding DNA Sequence Number=SeqID_31728
  Gene Ontology: Mol. function=cobalamin-transporting ATPase activity; Cellular component=membrane; Biological process=cobalamin transport
  Homolog annotation: Hit_ID=P06610; Match level="QueryCoverage=36%, HitCoverage=76%, E-value=1e-54, Identity=71%"; Hit description =Vitamin B12 transport periplasmic protein btuE
  Pfam annotation: Domain name=ABC_tran; Domain location=161-346; Score= 135.5; E_value=1.5e-37; Accession=PF00005.17; Description=ABC transporter
  Pfam annotation: Domain name=GSHPx; Domain location=1-96; Score =184.6; E_value=2.4e-52; Accession=PF00255.10; Description =Glutathione peroxidase
  Pfam annotation: Domain name=Sigma70_ECF; Domain location=178-348; Score=-84.7; E_value=0.045; Accession=PF07638.2; Description=ECF sigma factor
  Pfam module annotation: Pfam domain module=ABC_tran::GSHPx::Sigma70 _ECF; Domain location=161-346::1-96::178-348
KTTLAQYQGKVLLVVNVASKCGLTPQYEQLESLQKAWQDKDFSVLGFPCNQFLEQEPGSNEEIKTFCSTTYGVTFPLFDKTEVNGEQRHPLYRQLVAAQPEAERPAGSGFLERMESKGRAPKAPGDILWNFEKFLINKQGECHGLRVPGRLSAGELTLCRGERVHVVGPNGAGKSTLLTALAGLLDAEGQLTLAGQPLRSWSGAALAQQRAWLPQQQPAPAALPVWHYLRLHSPPGGDYAQATLTDLLQQLGLQDKLTRPLAQLSGGEWQRVRLAAVVLQIHPAINSRGALLILDEPLTALDIAQQRAVDKLLLQLSEAGIAIVASGHDLNHSLRHADRVWLMHQGRVVSQGGAREVLTAERLAPLYQAEFVQLETPQGPLLYLP

SEQ ID NO: 148507 - protein, 59 aa, Glycine max
  Coding DNA Sequence Number=SeqID_31729
MPAAYNNNDGDEETTNVPSPVIQLSTTGKMAIITYHRGRLPYQDSLKALEADIQHTNAL

SEQ ID NO: 148508 - protein, 108 aa, Glycine max
  Coding DNA Sequence Number=SeqID_31730
MAVMDLSLGYPLYRKSSWRGEATMWKRLTLEGEMCWSTSVRFWVRVWYQVFLCGGSWSTGISLISEHLEAEASQEKGLRGNLTAEGRPSGGGGGGGGGGGSVNRDGGQ

SEQ ID NO: 148509 - protein, 103 aa, Glycine max
  Coding DNA Sequence Number=SeqID_31731
  Gene Ontology: Mol. function=unfolded protein binding; Cellular component=cytoplasm; Biological process=cellular protein metabolic process
  Homolog annotation: Hit_ID=Q70EL6; Match level="QueryCoverage=99%, HitCoverage=19%, E-value=1e-30, Identity=71%"; Hit description =Cytosolic chaperonin delta-subunit
MADLVKDKIFHELNVIDGVIELLHDLDIAEIDHVRLGDIHDEENIVGIKGSDGRGVLADDLAIEGSVGGLHEGVAVEELDGDDHGGENIEGLDGNLVEGIGDN

SEQ ID NO: 148510 - protein, 99 aa, Glycine max
  Coding DNA Sequence Number=SeqID_31732
FFRKCASSGILPDEPLLPESSRKRFSGSLPEEVFFRKTFGYFRKNTSFGNFPEKVLPELPEEPLTGLPEDAVVSLLCHFFRRPLVFSPLVFYPRFRLLP

SEQ ID NO: 148511 - protein, 45 aa, Glycine max
  Coding DNA Sequence Number=SeqID_31733
  Homolog annotation: Hit_ID=Q2PCF1; Match level="QueryCoverage=84%, HitCoverage=2%, E-value=3e-10, Identity=66%"; Hit description =Pleiotropic drug resistance protein 2
MASSLNQEPRRGMVLPFQPLSFAFNHISYYVDMPAEMRSRGINKN

SEQ ID NO: 148512 - protein, 200 aa, Glycine max
  Coding DNA Sequence Number=SeqID_31734
  Homolog annotation: Hit_ID=Q2PCF1; Match level="QueryCoverage=37%, HitCoverage=5%, E-value=2e-26, Identity=73%"; Hit description =Pleiotropic drug resistance protein 2
  Pfam annotation: Domain name=ABC2_membrane; Domain location=31-200; Score=-30.7; E_value=0.045; Accession=PF01061.14; Description=ABC-2 type transporter
MNAKRREDMVGVLPKRRILMQHGKSQGNWDTTTYTNVPDHNIQSTAQGMTQILRAGEHLRCVMDSDSCSPDWQAQFYMSPYAYTRSMLHELRRCFLRKMIIVDFRFYPAWAFGLPIWLLRIPLYIMELGIWIAHTYYTIGFAPSASRFIRQFLALFGIHQMALSLFRFLAAAGRTLVVANTLGTLFLQLVFVLGGFVIAK

SEQ ID NO: 148513 - protein, 594 aa, Glycine max
  Coding DNA Sequence Number=SeqID_31735
  Gene Ontology: Mol. function=RNA-directed DNA polymerase activity; Biological process=RNA-dependent DNA replication
  Subcellular localization annotation: CTP_CleavageSite=60; ConfidenceScore=5.29e-01
MERKVASKVRNPQAGKNKQVVGKGKTKHLSAKNSLLTKNQNKTLTRRAPQVGESSKQNLREEVVQENGIAKESLVADNIMKSLEKKFLHDVTLDKGGTMQLGVDMNSPLGVDGHVVTHNEEVQRIHDNMDVSTSTSGKTVSRLIKDLVQKYHMGLLALFKAQISGQKADSVLCKLGMDYRFKVGACGRAGIPYAQCVHICCIPKDDNPEFLATLVYGNPTPAIHHELWEEMKIFAETVRHQWVVVVYMFSALRGLRSLRKEGSNHKAISFTFDGKTYAASMKPFRFMASWLVDRSFQDVVKEEDFDSWHDAEEEGDTWNLCNNFPRIDDDLLMNVQKAFEDKEIKEVMFSMGQLKALGPDGLHLILFHANWSTVGESVVAIVLKCYDDPSAIEDINSMSLGRHGTDNVVIAGEIFHTMSKKKGKGGLMAVKVDLEKAYDKVCWDFIIDTLKEVGFQEHFCQLILACIPLLPCRWAHLIDREVSCHRWKPTKMSKFGLSISHLFFADDLLLFGEASKVQMETIISVMSKMRMLVSNNVNHSVARKLSEMSGFALTRGLGKHLRIPLIRGRKKKEMEIDIAQGGYCDHAYLHDANY

SEQ ID NO: 148514 - protein, 88 aa, Glycine max
  Coding DNA Sequence Number=SeqID_31736
  Homolog annotation: Hit_ID=Q8L4M1; Match level="QueryCoverage=85%, HitCoverage=18%, E-value=8e-10, Identity=43%"; Hit description =Putative WD-40 repeat protein
MFMSFRGPWGALSPIPENNVIAVNTQGDLFLPHLVILVHIVGMWYVIMYSWKETGKVKMVFKGHMDYLYCIVARNSSNQVLIVDLIVI

SEQ ID NO: 148515 - protein, 148 aa, Glycine max
  Coding DNA Sequence Number=SeqID_31737
  Gene Ontology: Mol. function=potassium ion transporter activity; Cellular component=integral to membrane; Biological process =potassium ion transport
  Homolog annotation: Hit_ID=O22397; Match level="QueryCoverage=67%, HitCoverage=14%, E-value=3e-14, Identity=45%"; Hit description =Potassium transporter 1
MLKFLRATGIEGCMSLDGVVLSITGVEAMYVALGHFSALSIKARPHFSLSTIMTFKKVSTKPYQARNYFKKPQAAKVIYGLSSVIFIVATLAAIVGSQAVIFDNLFHSQACTKIRESEMYGSTSNNGNASSAAVVFFLNSIPDVKLTS

SEQ ID NO: 148516 - protein, 1161 aa, Glycine max
  Coding DNA Sequence Number=SeqID_31738
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=99%, HitCoverage=98%, E-value=0.0, Identity=71%"; Hit description =Putative phospholipid-transporting ATPase 9
  Pfam annotation: Domain name=Hydrolase; Domain location=423-888; Score=28.7; E_value=2.1e-05; Accession=PF00702.16; Description =haloacid dehalogenase-like hydrolase
MSGGRRRKLLLSKIYSFACCKASFEGDHHYSQIGGKGYSRVVFCNEPYTFVEDGVKNFADNSVRSTKYTLATFFPKSLFEQFRRVANFYFLVTGILAFTKLAPYTAVTAILPLIIVIGATMVKEGIEDWHRKKQDIEVNNRRVKVHKADDTFEYTAWKNLRVGNIVKVEKDEFFPADLLLLSSSYEDGVCYVETMNLDGETNLKLKQGLEVTSSLQEDLNFLKFKATVKCEDPNANLYSFVGSMEFEEKNYALSHQQLLLRDSKLRNTDYIFGAVIFTGHDTKVIQNSTDPPSKRSRIEKKMDRVIYFLFCILFLMAFVGSIFFGIITKDDFQNGLMKRWYLRPDGSTIFFDPNRPAAAALFHCLTALMLYGFFIPISLYVSIEIVKVLQSIFINQDIHMYYKEADKPARARTSNLNEELGQVDTLLSDKTGTLTCNSMEFIKCSIAGLAYGHGATEVEKAMDRRKASPSIYEHDIESEADNIRGLLDKRVLIKGFNFADERITNGNWVNEPHADVIQKFFRLLAVCHTAIPEVDEGTGNVSYEAESPDEAAFVIAARELGFEFYKRGQTSLSTYELDPVSHKKVERKYKLLNVLEFNSSRKRMSVIVEDEEGKILLFCKGADSTMFERLAKNRREFEEKTMEHVHEYADAGLRTLILAYRELDAEEYKEFDSKFSRAKNVVSADQDIMIEEVSDKIEKNLILLGATAVEDKLQDGVPECIDKLAQAGIKIWVLTGDKMETAINIGLLRQGMKQIVIHLDSPEIQALEKDGDKMAIAKASMQSVHLQISEGAAQLTAYRGSSHQAFALIIDGKSLVYALEDNMKNLFLELAIRCASVICCRSSPKQKALVARLVKSGAGKTTLAIGDGANDVGMLQEADIGVGISGVEGMQICYFFYKNITFGFTLFLYEVYASFSGQPAYNDWFLSLYNVFFSSLPVIALGVFDQDVSARYCLKFPLLHQEGVQNVLFSWHRILSWMLNGFISAIIIFFFCTKAMELQAFDVEGRTAGKDILGATMYTCVVWVVNLQVALAISYFTMIQHFFIWGSILFWYLFLLVYGAMPPHFSTNAYKVFVEALAPSPTYWIVTFFVVISTLIPYFSYAAIQMRFFPMYHEIVQWIRYEGKIKDPEFCAMVRLKSLQPTTVGSTARLAAKSHHARDKC

SEQ ID NO: 148517 - protein, 116 aa, Glycine max
  Coding DNA Sequence Number=SeqID_31739
MTHRACFRNILPKRVSFQTYYRRGLLWTWMPPLLPAGKLVPPLTTAGTRIPPLATAGLSLNRQYERRDRLSRRERGCTADRAGGTRRDGAMPPFLLTGHANVAVPPLPPAEHLDGT

SEQ ID NO: 148518 - protein, 236 aa, Glycine max
  Coding DNA Sequence Number=SeqID_31740
MGLEIYPEVHENPKVFFNNFSPILLESLAHGSSDWSLPREDCISYKMPEFLKFVGELEKSTIEHEAYFQTEYGDLAIDEFLKIKYSPSSLTTNVFTWFTTLPPNSIYTRAQLERVFHEHSFRGETKRNKGSSSHFKAFEVNDLAFLRGGTTEGSKKGHVLRDYVREDYFDGLFLSPKAICVTQVSRSTPHRNATVFDPPTDAMRCHMKPLYLPTMEEEQIINKILVDGGVAINILP

SEQ ID NO: 148519 - protein, 298 aa, Glycine max
  Coding DNA Sequence Number=SeqID_31741
MAEPSKKRKGSSSTTVVASHRHQGTVEDPTAPIPPSLSSPRPYILFSSDDQRQRYNSQFCNRVILDPKYLDLDFFDGETFDCYQVFQNSALTEFMSLKLPYFPELVRVFYNNLKIHDGIIYSEALRANAPLPYPHLVTLFLHHFNIPLDDEPFVMVMQSFSIGTGAVTSFGYRKDVDGQWVRKQDLPLPIPDERTPSPPPQRADSFSLLTDVLTELCCLRAFVGEQFDAMDAHFDGMDTRITHLEDDMNFIRRCFDPRPTLSFYFPSFYNFLSLVAKGGENKGRNHKPLGINSKLKGE

SEQ ID NO: 148520 - protein, 188 aa, Glycine max
  Coding DNA Sequence Number=SeqID_31742
MEKNKANGRVINPKGNTKFSQYCPKNILLFPKACFGLISVIPIQIPHQGDNEDWEDNDQGSLQKSSQKRKTPSSSNTGNKVSKKTTSTKNDDQVKLPPKPPKFQKPSKEEEDAQSHSESSPSKQLAPPEPMVQENTIKVDSNPNIPFHHEASQHTPIKQEKPLFIKPFAVIVTIPIVETNEPLIDQGT

SEQ ID NO: 148521 - protein, 189 aa, Glycine max
  Coding DNA Sequence Number=SeqID_31743
  Gene Ontology: Mol. function=transcription factor activity; Cellular component=transcription factor complex; Biological process =regulation of progression through cell cycle
  Homolog annotation: Hit_ID=Q9LEL4; Match level="QueryCoverage=99%, HitCoverage=53%, E-value=5e-44, Identity=47%"; Hit description =Transcription factor E2F
  Subcellular localization annotation: CTP_CleavageSite=52; ConfidenceScore=5.42e-01
MKRKSGMTDSEGESQAQKWSNSPGYTNVSNVTNNSPFKTPVSAKGGRAQKAKASKEGRSCPPTPMSNAGSPSPLTPASSCRYDSSLVLEQNSYIKPYRGIESSTSGEVDGDISVLKAEVEKLSLEEQGLDDQIREMQERLRNLSENENNQKCLFVTEEDIKGLPCFQNETLIAIKAPHGTTLEVPDPEE

SEQ ID NO: 148522 - protein, 116 aa, Glycine max
  Coding DNA Sequence Number=SeqID_31744
  Homolog annotation: Hit_ID=Q1S1X7; Match level="QueryCoverage=52%, HitCoverage=4%, E-value=2e-07, Identity=43%"; Hit description =Integrase, catalytic region; Zinc finger, CCHC-type; Peptidase aspartic, catalytic
MREGVPLKEHLDELNFILIELRDIDVKMEDKDLTMILLAFLPPSYKNFVSPLSVDKNSFTLSLYSRELQLKAYGNGDEASTSRLLVNDFAKRRKKNKGKGGKKSKVDPKDICNYCK

SEQ ID NO: 148523 - protein, 247 aa, Glycine max
  Coding DNA Sequence Number=SeqID_31745
MTTKDDDKGDEQKAQRSKNNSSESRTSQEFKIQDSRSQESRSRFKTQDSRMKKRLNQDKFNNLRSLSQHIGGYILCGTSRGYIYLGLTENKRGCISCGSVLVEGTSTRFKENKGGYIPCGSLLVKGFLQGSIQIKIHDGVVRTLIEVCHILELMKNLVSIGAMDSKGFSCWVEDRVMKVIGKGKFVVESLQLCKDCIYEKQQWMKFSKVVHITKAILDYVHSNYWGPLRVPSLGGQGISSPSSMVTP

SEQ ID NO: 148524 - protein, 453 aa, Glycine max
  Coding DNA Sequence Number=SeqID_31746
MSVHAPVPRLTWRVDMCLRVPLKGDDFVEPPGMDECLFDVGCGNLDSCSGWTCIWHASTLAYVSLREWARTGVVVHGRCLISGHRYFDLLLRCLLLAILFLRSLSSILKGILFFTMPSFLSDSAIGMGDNDSGGSIEQPMMDWEVISIGSSLSEDARCCASDKESSSSERPVLTIVILPHSTSGGVRRGSGGGDVRDDVLKYKSSLTFAASVVALQCQVKLASLGNSCKIVVQACGSDDFPFLRAASAAGGIVPLNVVAPVFGEEGQPASEVGSIAVVVEITSGAPSSVLAMRKQEDGVGPSGCKKWNAPMSLCALRQTTGLMLDLGHLSSEQVVPPAQSVVEAPASIVATPTPSPPPTVPVQEATPTTVVNMPTTLAGLVMVPSSIVAAPLLSAGVANVSASVVLPPPSSAPPVPPSVVLVMASPSSSSRPHVSLDHLYTFSGADSSWGCKL

SEQ ID NO: 148525 - protein, 155 aa, Glycine max
  Coding DNA Sequence Number=SeqID_31747
  Gene Ontology: Mol. function=transcription factor activity; Cellular component=transcription factor complex; Biological process =regulation of progression through cell cycle
  Homolog annotation: Hit_ID=Q9LEL4; Match level="QueryCoverage=89%, HitCoverage=33%, E-value=6e-17, Identity=41%"; Hit description =Transcription factor E2F
ILSSIFVRLTLMLGMVVSQFEEKFEEVNGAELPMIPLASSSGSNEQLMTEMVPAECSGKELEPQTQLSSHAFSDLNASQEFAGGMMKIVPSDVDIIGFYQMLTTILYSLTPNKTATVDWNGIDMLHPDFGIISRPQSPSSGLAEVPSTGANSIQK

SEQ ID NO: 148526 - protein, 244 aa, Glycine max
  Coding DNA Sequence Number=SeqID_31748
MESEIAKWRATAHTVWRVECPKVANTTIAFVEVVRLNCQLSSKVGGVLAKLLCTRLDCDELFRCYKDLQVEKKELVGKVEGIAEEKDKLAKVVVDLKAQLKESKSRLEESELRVVRERKSSKELKEELLVYKKEAMEQYEKRFHKAVRKVGFFVKDLDLGFFDPFKDVKDGVLLDEEEIAGEKGIVNEEQGLFNKSGGRSLDLLSFFSDGYEDHVVVRVVELGSLMVVAVVSASERTNGMPWVL

SEQ ID NO: 148527 - protein, 332 aa, Glycine max
  Coding DNA Sequence Number=SeqID_31749
MTSQSIMGCSIEPPESLSPMPMAESDKNEGIVKNKIPLRIEESERRKRIASRRQRSKRSKETTVSITGGSGSGALNFHTTTHPTHPCTTTPVRAHSLSDTSRQNVMFVFNAPSNSQKRAKLSNLEASLTWHAKYMSIPNNLTEAAGQHLSKLGGLVGHINLQFSHLSRLPHPTSNKHSSIPGGSTKSSPFTCQDYNPKHHILTFDTRQSLSPASRLRAWGAYVLSRVHKIHVAPYMSPLFCKSPPSCPPNKGISQSRCVKFGSLLWPRPPWRVLAPYFGSGPYGFIGMISSLTKLNHVPRRFLMVQFVSHGYGLLLKWTKLPSPSMSGPGNL

SEQ ID NO: 148528 - protein, 585 aa, Glycine max
  Coding DNA Sequence Number=SeqID_31750
MMKLTTFYFSHFSVELHGGKFVASVLPIKGGQGRLHSKEKELIGNVKLHVNLPRFRRREGMQLSQEQPEGGDKGRGSKGLCRTLVNIKGTGSPLMGTKVGSVRGKEDFHTTDGLELWEGSDMLVETTNEAWLSKSLVRRLHEPEKIFDLQDMFILDALSSIKAQYIGDNRVLLIGHDSDILLLDMSDNRIVEELGDKRDKCCCFHEKENEGDEEEFIVAALGRVVSKRMRSMSSWGVHRDIWGVKRIFLLRMFRNRKSANRCRPDGGALLAKKALSLGRVGALIESSMGKANTGLSNLSPILPTQRKGFVDVSETQYMNPLLDDPTNITGPMADDGDHVLKVIDVAIRPPIAPPKCKENEGGTTEGLWEVEGCSKEPMRELPEPYKIIWTHSKFDSGPRSSSECQGSQWIKDDQQEAKGMARVAYEDSFTQDARVGRKGKRQGIKRLSITVDKHSRRIVVHLGQKGFVGSIRKREPEGGVAWEIQCNSAQEEINGRRWQDVYEWHGVAACSRLDRFLLSIGWLDFDPSCAQFVMNRKLSGHCPIMLTFTRLDWGSKPFWFINGWLTMCTFDEFVKEKYTNLHMQG

SEQ ID NO: 148529 - protein, 163 aa, Glycine max
  Coding DNA Sequence Number=SeqID_31751
  Gene Ontology: Mol. function=nucleic acid binding; Cellular component= nucleus; Biological process=DNA integration
VILSRDVIYDKLTILDSKFGEDLGKAKDFTKKVVDDIDVFRPSTYQEAISCSEAREWTRKSGSPTEEVVHYKACLIAKGYMATLDMELEQLDIEEVSLWAEAITKVEDGSHICLVLYVDDKLIASQNLLAIQKLKSLLDSEFEIKDMGVVENILGMEIKRDQV

SEQ ID NO: 148530 - protein, 362 aa, Glycine max
  Coding DNA Sequence Number=SeqID_31752
MPHFKKGYGWASGAGRTVGNGVGGSHLKQVPSVLCFKYAEARRNKNNLHEKARDIVEEGMEWLYQSLVRSLKDVVIFDKLQDVFFMEKNRELKLRYLGDKLVLIFGMGEKTSQERIEKGDEGFFEELGELGMVVKMDKDTEKYGKLEYVRVLVKSSAHKILDVYKRVQISALVHQERVMEETSSMVLQCKCWLWNKGASSNGDSMSKSNIRVEVMSSNLECSVIDEGDGFIINPMWQPHKGSHQRGEPNVDMVEGPLQAMVMERPLEMMVENQMWSWSTKSTKKCTKGTNEVASLDETHDNNMSRGLVDVSQASSSVLETPRARQNYLSNEITRVVKDRRALQEGGDFKWIENPSVNSVGGL

SEQ ID NO: 148531 - protein, 199 aa, Glycine max
  Coding DNA Sequence Number=SeqID_31753
  Homolog annotation: Hit_ID=Q2HSY3; Match level="QueryCoverage=78%, HitCoverage=87%, E-value=8e-20, Identity=31%"; Hit description =Nucleic acid-binding, OB-fold
MANKHNSVSEINAEKESWRIMVRVVCLWMVSNVSTHKQTYASKIPLSMEMVRVDSKGDRIHGFVKRTLIYKFEKSLQEGKVYSVQFFGVTDIGGVGTERENEKNGRRTRMNVIQIEDDEFSIECTLCGPFVDELNAFLASGEVKDVVTKYIFPSTRVVFNAECEEVKELATRKIGIPDLLTVGSNSNFVRRLLKQLSAF

SEQ ID NO: 148532 - protein, 296 aa, Glycine max
  Coding DNA Sequence Number=SeqID_31754
  Gene Ontology: Mol. function=ATPase activity, coupled to transmembrane movement of substances; Cellular component=integral to membrane; Biological process=transport
  Homolog annotation: Hit_ID=Q3KGD6; Match level="QueryCoverage=99%, HitCoverage=48%, E-value=1e-134, Identity=82%"; Hit description=ABC transporter-like
  Pfam annotation: Domain name=ABC_tran; Domain location=74-263; Score =206.4; E_value=6.5e-59; Accession=PF00005.17; Description=ABC transporter
  Pfam annotation: Domain name=SMC_N; Domain location=63-267; Score= -125.4; E_value=0.02; Accession=PF02463.9; Description=RecFRecNSMC N terminal domain
  Pfam module annotation: Pfam domain module=ABC_tran::SMC_N; Domain location=74-263::63-267
MSGWIMWVVNGIFENIGMVQDGLNTIAQPLSVQDAPQAKKLQVTRGQIRFEDVRFDYGGGRQVINRLNLNIKPGEKIGLIGPSGAGKSTLVNLLLRLYDINGGRILIDDQDIAQVTQASLRSQIGMITQDTSLLHRSIRENLLYGRPDASEAELQAAIVRARADEFIPLLSDPQGRTGLDAHVGERGVKLSGGQRQRIAIARVLLKDAPVLIMDEATSALDSEVEAAIQESLETLMQGKTVIAIAHRLSTIAKMDRLVVLENGGIVEMGNHRELLAHGGLYARLWQHQTGGFVGVD

SEQ ID NO: 148533 - protein, 96 aa, Glycine max
  Coding DNA Sequence Number=SeqID_31755
  Gene Ontology: Mol. function=NADH dehydrogenase (ubiquinone) activity; Cellular component=mitochondrial respiratory chain complex I; Biological process=mitochondrial electron transport, NADH to ubiquinone
  Homolog annotation: Hit_ID=Q1SG50; Match level="QueryCoverage=97%, HitCoverage=91%, E-value=2e-36, Identity=82%"; Hit description =Mitochondrial ribosome
  Pfam annotation: Domain name=L51_S25_CI-B8; Domain location=20-96; Score=46.9; E_value=6.9e-11; Accession=PF05047.6; Description =Mitochondrial ribosomal protein L51  S25  CI-B8 domain
MAWRGNLLKNIKELRFLMCQSSPASSPISYTYMPYAFVERNYKELKTLNPKLPILIRECSGVEPQLWARYDLGVEKGIKLEGLSEAQIFKALEDLR

SEQ ID NO: 148534 - protein, 300 aa, Glycine max
  Coding DNA Sequence Number=SeqID_31756
  Gene Ontology: Mol. function=protein dimerization activity; Cellular component=nucleus; Biological process=regulation of transcription, DNA-dependent
  Homolog annotation: Hit_ID=UPI00003CC80C; Match level="QueryCoverage =94%, HitCoverage=73%, E-value=3e-55, Identity=42%"; Hit description =COG3146: Uncharacterized protein conserved in bacteria
  Pfam annotation: Domain name=DUF482; Domain location=2-300; Score =410.0; E_value=3.4e-120; Accession=PF04339.3; Description=Protein of unknown function, DUF482
HLSSLAEITAAEWDALLPDNQPFLRHAFLLTLEESGSVRAENGWQPDHLLWREDGRLRAALPGYRKRNSWGEYVFDHAWADACQRAGIPYYPKWLGAIPFSPVTGARLLGDETAIIPMLEALPDVLQRHGLSGAHINFTTPHANALLATQPDWLARLGVQYHWHNRGYRDFHDFLDTLMSRKRKQLRKEREQVASSGFAFNWYRGDELREDQWDFVYTCYANTYAVRGQSPYLTRSFFSLLAERMPQAIRVVIATLQQQPAAMAFCLVDDDTLYGRYWGCLAEFDRLHFETWRAQAGARL

SEQ ID NO: 148535 - protein, 145 aa, Glycine max
  Coding DNA Sequence Number=SeqID_31757
MYPLNHIDDLLKRPPKETFSTIDFAYEEELSDVWKLIDNYKNVEEVNVVKTKRETLILENGWRQVKVNNEVMEDKEVYFRYLGDSYFHISFNKIDEEEAAKKVELEPKKPKNLGNSSNVPKTGHHSKGKTPALFVPPKRRSAKSL

SEQ ID NO: 148536 - protein, 137 aa, Glycine max
  Coding DNA Sequence Number=SeqID_31758
RALKSELGKARLAKEKFKLVATDVRKECAGNNELKLLREERDQSRAHSMVLKEELTACSRSKRNLSQRLCETETNMLAIVSKYQEELNLATTHEHKVADEYAQVYSEKEVIGRVIDSLPQEATMWMDRFALTLNGSQ

SEQ ID NO: 148537 - protein, 73 aa, Glycine max
  Coding DNA Sequence Number=SeqID_31759
PPNQSQKNDDLEPVHRWIVVKFEYHVRNTIPRILTVGNFDIMEKKESYEDSTSGGFNLFSVSLAFGNSIGAVG

SEQ ID NO: 148538 - protein, 148 aa, Glycine max
  Coding DNA Sequence Number=SeqID_31760
MGEVEEVQEQMKADMEAMNVRMATMMEAMMSMKKIMEANTVVVVATSTVAKVNPMPPSDLNQMTHPTSGMVGKDLGSTDGPMMCKFKTSTPSRRMACLPTIHHPMWRTLPMRMSITPLPYSLRADKPKLIMHMSLNPWGRHMDCPTTI

SEQ ID NO: 148539 - protein, 129 aa, Glycine max
  Coding DNA Sequence Number=SeqID_31761
MATMLAFPFQNVAKLYGLHNNACLDFQGIVKLHGLRNNACFDFWSVATLYEFRNNACFDFWSVVKLYGLQNNACFDFWRDQTKFPSRSPVYPNEIRRKFLEYLVLHRAFPPLANFCKLGLTHVWGGKTF

SEQ ID NO: 148540 - protein, 113 aa, Glycine max
  Coding DNA Sequence Number=SeqID_31762
  Gene Ontology: Mol. function=transposase activity; Biological process= transposition, DNA-mediated
  Homolog annotation: Hit_ID=Q8GXE9; Match level="QueryCoverage=95%, HitCoverage=40%, E-value=3e-24, Identity=49%"; Hit description=HVA22- like protein j
  Pfam annotation: Domain name=TB2_DP1_HVA22; Domain location=3-52; Score=-25.3; E_value=0.0093; Accession=PF03134.9; Description=TB2DP1, HVA22 family
MAQFTVLEKFTDIFIGWLPMYGLMKLVLFVYLWYPKTKGTGYVYETVLGPYVSRLISHEHDIDMKLLELKATGWDNVIYYWQYCAKFWQSAFVKALQHLASQSSGFSANPNTE

SEQ ID NO: 148541 - protein, 167 aa, Glycine max
  Coding DNA Sequence Number=SeqID_31763
  Homolog annotation: Hit_ID=Q8UWJ5; Match level="QueryCoverage=62%, HitCoverage=31%, E-value=2e-13, Identity=53%"; Hit description=CDH1-D
MGGGAWPFLVGGAICLVNSVNERDLSLLNSYVEVCDALRCSGPHARYTDVFNESIALADRSLQLLVFNEEFLVSAESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 148542 - protein, 85 aa, Glycine max
  Coding DNA Sequence Number=SeqID_31764
MQDEVNGSTGNNKTKWYPTSLKKRGPTGDHMILLGPTDDMKQRQMMHKLFIKEIATRRREGDTFGSDPLGMTLGEIEGYKLFMID

SEQ ID NO: 148543 - protein, 115 aa, Glycine max
  Coding DNA Sequence Number=SeqID_31765
MIRGDTLRLFAPFCHPEAAGPMTSRDQVWSFCTLVSSRGGGPDDTRKYPSETDIVFCTFCSSGDNKSFTCRSFMVARDSRQPRGAKLVSYTDYRGPLLDDMRPFFGPCEMLGIHH

SEQ ID NO: 148544 - protein, 94 aa, Glycine max
  Coding DNA Sequence Number=SeqID_31766
  Gene Ontology: Cellular component=mitochondrion
MDWIETTFLSNPFVSRAWEKDQRYHRERRVLACTRSHPCPRWQSVDLHPPGMPLCRPIAGRLRTANPQSVGPPAFEGAYLRTPLQWRYEDYPEL

SEQ ID NO: 148545 - protein, 48 aa, Glycine max
  Coding DNA Sequence Number=SeqID_31767
MPLLVIMLLLVICLLVLLVLVLLATQYQLLSLLFFSRSKGVSCDSPTL

SEQ ID NO: 148546 - protein, 167 aa, Glycine max
  Coding DNA Sequence Number=SeqID_31768
MGEVEEVQEKMKADMEAMKEQMATMMEAKMIMKKIMEASAVAVVATNTVAKYGRPHDVQIQNEHAFPPHGLPPNYTPPNVAYTPNEDVNKCSLRVDNLIIYMSLNPWGRHMKFPTTIKPTSGLASDMPLKGKQTTSPRLQRTTRSQHQRATCPRLQRTRRPRLQRTA

SEQ ID NO: 148547 - protein, 48 aa, Glycine max
  Coding DNA Sequence Number=SeqID_31769
MASPMTCGEESEPIDPQRLTSSSAPLSSRDDESDDMQGYLMIIYTIVI

SEQ ID NO: 148548 - protein, 91 aa, Glycine max
  Coding DNA Sequence Number=SeqID_31770
  Gene Ontology: Mol. function=metal ion binding; Cellular component =integral to membrane; Biological process=electron transport
  Homolog annotation: Hit_ID=Q9M4A3; Match level="QueryCoverage=76%, HitCoverage=36%, E-value=2e-14, Identity=47%"; Hit description =Putative cytochrome B 561
MAFQTIPSERKVRKFVHMALHLIAIVLGIVGLNAVFKFHGMENIPNVYSLHSWIGIVTFCLFGLQKIVYGKGGCLVTMSWAKLKVMTRSVK

SEQ ID NO: 148549 - protein, 201 aa, Glycine max
  Coding DNA Sequence Number=SeqID_31771
  Homolog annotation: Hit_ID=Q5XM22; Match level="QueryCoverage=49%, HitCoverage=70%, E-value=2e-14, Identity=42%"; Hit description =Resistance-like protein HAAS-2
CTLFANKSATNVHVVYLEALRDLSVTERYAWGVATLVHMYDQLNDASMSHSRQFVGYITLLQWLIYEHFPSVAKSIADQDYDEASPRACRERLDRLRIPDVCWIPYGEHQEVQDFHTIPAPPVDSWVSYDDIHGRWMHYEDHIVPAGEAPQANIPRVLEPGASSTFAEEPRHAVEVCDDIAERLERHLSLGVVMSGSSTHE

SEQ ID NO: 148550 - protein, 105 aa, Glycine max
  Coding DNA Sequence Number=SeqID_31772
MTTLTWIWMTLLFSNILPRDHNANLPLQMYRLGSRPQDAQWARRSPTEPWGFQLWLRASISPTGCPFPPARSCHRDIGIAPTKTPSGPGEVQQGPGVSSSGYGPL

SEQ ID NO: 148551 - protein, 60 aa, Glycine max
  Coding DNA Sequence Number=SeqID_31773
MRMRSPLKARACSPLQARTYSPLKIDCPFEKGDNSCNLILSFANLSGNSLRVYILFDSVT

SEQ ID NO: 148552 - protein, 45 aa, Glycine max
  Coding DNA Sequence Number=SeqID_31774
CFEKSVLEFSPSDVSSGMGAVYGIAKSGIGVASMGHAGAGLILCL

SEQ ID NO: 148553 - protein, 322 aa, Glycine max
  Coding DNA Sequence Number=SeqID_31775
MGEVKEVQEQMKADKEAMKEQMATMMEAMMSIKKIMEANVVTVVVTSTVAKYGWPHDVQIQNEHAFPPYGLPPNYTPPNVAYTPNENVNNSTPILIESRQSQTDHAHVSRAIGETHEMPHHNLADFEPCLGYATKGQAVVKGGRDYALANLEELFLVPNIITPPKFKVLDFDKYKGTTCPQNHLKMYYRKMGAYAKDEELLIHFFQESLTGVVVTWYTNLEPSRVHSWKDLMVAFVRHESFKEYTQRWRDLPAQVVPSMTEKEMITIIVGTLPVFYYEKWIKVGLKRGKFNHPAWTNEKTGANEEGEDERETHAVTAIPIRP

SEQ ID NO: 148554 - protein, 57 aa, Glycine max
  Coding DNA Sequence Number=SeqID_31776
MWAIIDEYKEKLYLAAAHRQKLEDEYAKVSVLQAEREAREKILLYFEWESKASSTAS

SEQ ID NO: 148555 - protein, 237 aa, Glycine max
  Coding DNA Sequence Number=SeqID_31777
MRRHFISPSLRATKREEDEEVQALRTELKQAQIVKERFKSAALKIRKENSELRDINIATTKALEQETKRARREEHGRNKFRGALWGSNNELKLRREERDQSRVDRLILKDELKACSRSKRSLSQWLCETETNMLAIITKYQEELSLATAHKHRVVDEYAQVYAEKEARGRVIDSLHQEATMWMDRFALTLNGSQELSRLLAKAKAVANTYSALDEIHELLNYCQHTIDLMAHMIRNR

SEQ ID NO: 148556 - protein, 257 aa, Glycine max
  Coding DNA Sequence Number=SeqID_31778
  Gene Ontology: Mol. function=sequence-specific DNA binding; Cellular component=intracellular; Biological process=positive regulation of carbohydrate metabolic process
  Homolog annotation: Hit_ID=P06993; Match level="QueryCoverage=95%, HitCoverage=27%, E-value=1e-105, Identity=76%"; Hit description=HTH -type transcriptional regulator malT
  Pfam annotation: Domain name=NACHT; Domain location=33-202; Score= -35.5; E_value=0.034; Accession=PF05729.3; Description=NACHT domain
MLIPSKLSRPVRPESTVTRDRLLQKLSAAANYRLVLIASPAGYGKTTLVSQWAADKSELGWYSLDEGDNQPERFADYLIAALQQATRGACSRSETLAQKRQYVNLNALFAQLFNELAAWQQPLWLIIDDYHHITNPAVHEAMRFFLRHQPDNLTLVVLSRNLPQLGIANLRVREQLLELGSQQLAFTHQEAKQFFDCRLSAPLAPDESNRLCDDVAGWATALQLIALSTRQGAASAQDSARRLSGIMPAIFPISGRG

SEQ ID NO: 148557 - protein, 226 aa, Glycine max; identical to SEQ ID NO: 117043
  Coding DNA Sequence Number=SeqID_31779
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=54%, E-value=1e-121, Identity=95%"; Hit description =Acetyl-coenzyme A carboxylase carboxyl transferase subunit beta

SEQ ID NO: 148558 - protein, 63 aa, Glycine max
  Coding DNA Sequence Number=SeqID_31780
MGTEGGKTSGYAIHDLSSVEEMSGVSMRYLGDDIVLIAGMDEDGAKKMMAREEDNYLSIFHSI

SEQ ID NO: 148559 - protein, 482 aa, Glycine max
  Coding DNA Sequence Number=SeqID_31781
  Gene Ontology: Cellular component=chloroplast inner membrane
  Homolog annotation: Hit_ID=Q9FGP9; Match level="QueryCoverage=64%, HitCoverage=65%, E-value=1e-113, Identity=64%"; Hit description =Arabidopsis thaliana genomic DNA, chromosome 5, TAC clone:K8E10
MAGCSSNFAVARFANVRKEVVLGNEETNLIRLSFRGVLNESAFQVLRGSKCGRSCVPMQEKAMFLIMSMSQPSAENESQSAVTSIGLSEGGGDNVLSNDDGTRDSEPDSKNERNDDNGVVLDGSGGNGNFGSGGAGDGSGGGGGDDDGNDNEEEEFGPILKYDEVMRETEARGATLPLDMIEAAKSVGIRKVLLLRYLDLQGSFWPLGFFMKSCSMLRNRMLADPAFLFKIGSEDIVEPPWFAFPILNARNCGTKIAFLCNKIVIDTCCATFAEIQKRGKDFWAEFELYLADLLVGLVVNVALVGMLAPYARIGKPSISSGFLGRMQKAYAALPSSVFEAERPGCRFSVQQRLGTYFYKGIMYGAVGFGCGIIGQGIANLIMTAKRSIKTSEEDIPVPPLVKSAALWGVFLAISSNTRYQIVNGLERLVEASPLAKQVPPVALAFTVGVRFANNVYGGMQFVDWASILMDEIQIPESVVSKG

SEQ ID NO: 148560 - protein, 239 aa, Glycine max
  Coding DNA Sequence Number=SeqID_31782
  Gene Ontology: Mol. function=hydrolase activity; Biological process =metabolic process
  Homolog annotation: Hit_ID=Q5NUF3; Match level="QueryCoverage=81%, HitCoverage=91%, E-value=8e-27, Identity=30%"; Hit description=2 -hydroxyisoflavanone dehydratase
  Pfam annotation: Domain name=Abhydrolase_3; Domain location=65-195; Score=-41.4; E_value=5.3e-05; Accession=PF07859.3; Description =alphabeta hydrolase fold
MGTLIRIFSDGTIERPLQTPFVPLKLDEPHTGLSSKDVVISHNLPVSALVYLPKLTNEADKVPILVYFHGGGLLQSIFFQHVTMIVGLHSSGSPPIIILQRIIPPIMLSHGDFNRVFIGGDSAGGNIAHNILMRAGTEALPGLTGLGCSRMIACVAGKDSLRERGVSYYESVKKSGWQGKLEFFEEKDEGHVYQLFNVEATRVVVVFVIAVVLPCCTASPRHRKRLKLESPHSSKALIS

SEQ ID NO: 148561 - protein, 158 aa, Glycine max
  Coding DNA Sequence Number=SeqID_31783
  Homolog annotation: Hit_ID=Q9FN45; Match level="QueryCoverage=76%, HitCoverage=54%, E-value=3e-22, Identity=38%"; Hit description =Genomic DNA, chromosome 5, P1 clone:MYJ24
MVRPPSSTPNCKSLAASGTKSGSEKEHTEFLAGALVGVDEMKRFGIGVAHHVFEVGAHVHEFLGGCGGGGGEAGGDDAGADGDALHGAEDVADAVSGAAAGGEAGLLAVTEGGPEGDGAEGAGVGGGGAFEGDADDAVPHFADKVVGGERQLKKKGRL

SEQ ID NO: 148562 - protein, 61 aa, Glycine max
  Coding DNA Sequence Number=SeqID_31784
MAIGTTGVQVGWKAASWCWANIGLQIMRQHTRKPTNFEGRAVIGLLVFAATDTFFVIVCTN

SEQ ID NO: 148563 - protein, 101 aa, Glycine max
  Coding DNA Sequence Number=SeqID_31785
MGCFCFRKHKSDNSKNKSNGGLQGQHKNHKTDTSSHVQQLHASKDSPNRIKGSGGVKDGDMTILTAATTTWVESHAPTGHHRSDRGSGDGGDGGGGGCGGD

SEQ ID NO: 148564 - protein, 54 aa, Glycine max
  Coding DNA Sequence Number=SeqID_31786
MHQKVSSKEDLEVHAEDLTQRARFAKRGDPLSAEKNSPSAKKNPREYKVRELRA

SEQ ID NO: 148565 - protein, 129 aa, Glycine max
  Coding DNA Sequence Number=SeqID_31787
MILDLKRIGQWSEKSLSNTNWLELNSEMLVELPTMHSEAEALEHMKKRDTGHESVSLENKTGDSTMMKIGDSTKVVIKQDMKGRRHKYGFNNNKREKPEKVRVVDDETGDKHQLHEVLRMPSTCVFLKI

SEQ ID NO: 148566 - protein, 106 aa, Glycine max
  Coding DNA Sequence Number=SeqID_31788
MGCFCFRGRKKSDDNKYKNNGGLQGANTRCKVQQSHAYKGSASRVRNGGGDGDMVILTGVAAAATTTSVGTHGYTGHHGSGGGGGCGGGGCGGGGCGGGGCGGGGC

SEQ ID NO: 148567 - protein, 48 aa, Glycine max
  Coding DNA Sequence Number=SeqID_31789
MAHQKPPNLAFCTPGQNEIKNKIQGMKGMGNIKLAYVFLNERQGMKGM

SEQ ID NO: 148568 - protein, 262 aa, Glycine max
  Coding DNA Sequence Number=SeqID_31790
  Gene Ontology: Mol. function=DNA binding
  Homolog annotation: Hit_ID=Q1SDS1; Match level="QueryCoverage=73%, HitCoverage=40%, E-value=2e-21, Identity=30%"; Hit description=IMP dehydrogenase/GMP reductase
MANQEERVPFMDVLALLIFGVVLFPNMDGLVDLATIYAFLAYHHSKESPVVAILADLFDTFDRRCEKSSARIICYLPALCRRVDWDQHLAGIGGKTINWFPRWKEGKEGVLFSCGDNPNIPLIGMKGCINYNPALTIRQLGYPMRGAPTEESLYPFLVRDFGAQSFKIIQRVHTAWESPLRKDKELRGIRNGIIDGYHEWLKVCTQGLDWLSKLNIINEENFEAPEEDEETSGKSVSGYEKKMQLPQEPLNKKPRGLARKSM

SEQ ID NO: 148569 - protein, 237 aa, Glycine max
  Coding DNA Sequence Number=SeqID_31791
  Gene Ontology: Mol. function=signal transducer activity; Cellular component=membrane; Biological process=signal transduction
  Homolog annotation: Hit_ID=O08228; Match level="QueryCoverage=72%, HitCoverage=27%, E-value=1e-37, Identity=51%"; Hit description =Methyl-accepting chemotaxis proteins
  Pfam annotation: Domain name=HAMP; Domain location=39-109; Score =42.4; E_value=1.5e-09; Accession=PF00672.15; Description=HAMP domain
MLIKAVPFTSFAGDKIGVFEIGTDATKLLAEARSSLWTMIAVTLLTSLLALTAFFLFAKSLGNAIGRLTGTMTRLASGDLSTDIDGEDRSDETGAMARAVRVFKDNALKTRELENQADEQRQMTEEQRRQIAEQERVRAEAMAEATNGLAAGLKRLASGDLTVTLEHSFAPDFESLRTDFNAAVEQLQGTLGSVSQAVASIDSGSREISQSADDLSRRTEQQAASLEETAAALDQIT

SEQ ID NO: 148570 - protein, 210 aa, Glycine max
  Coding DNA Sequence Number=SeqID_31792
  Homolog annotation: Hit_ID=Q2K2K0; Match level="QueryCoverage=59%, HitCoverage=100%, E-value=3e-10, Identity=42%"; Hit description =Hypothetical conserved protein
MRIPPLPSIRKRGPFRRPRMQSEASGLNRRSIRRVRPDDRAKAASEGRLDVDDTLLLGHDHRQLGACEFQLDLDFAALVAVHGVSQFGSQFFNVLFQKHRRRLLDVCERRRARSWGRGGVKDRASDRRSRRVGEPNLLERRVPERRQNWGHRSSLRPACRHGILRRTEQTFPLRIAPEPEDGLDARLGVTDTVNNCGDPGLSAAFATVCR

SEQ ID NO: 148571 - protein, 228 aa, Glycine max
  Coding DNA Sequence Number=SeqID_31793
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=1e-23, Identity=30%"; Hit description= UPI00006A17C9 related cluster
  Subcellular localization annotation: CTP_CleavageSite=67; ConfidenceScore=5.58e-01
YPCLQRTTHPRLQRTTRPHLQRASRPRLQRASCPRLHRATCPHLQRTARPHLRRTTRPNLRRTKRPRLEKATRPRHQRAARPNLQRVAHPRLQKVTSPHLQRASRPRLQRASRPRLHRATCPHLQRTACPHLQRTARPHLRRTTRPLLERATRPRHQRAACPNLQRVAHPRLQRVTSPNLRGLHILTFRGLHVLKLQRTTRPHLQSATRPHLQSASRPHLQGTARHRL

SEQ ID NO: 148572 - protein, 97 aa, Glycine max
  Coding DNA Sequence Number=SeqID_31794
  Subcellular localization annotation: CTP_CleavageSite=77; ConfidenceScore=5.70e-01
MTKDVIHGHNSRASWLHFSSSPSSSLASAFFSLLCFYWIKQPRSADKFSQASCSSPRRICCLLLKTSTCQSKLSLAQASYHSPKQAIARPGELLAKG

SEQ ID NO: 148573 - protein, 135 aa, Glycine max
  Coding DNA Sequence Number=SeqID_31795
MESPNIGHEEYSRFGIIFTFEEGISTSHVDKSGALASMYPPSKRKSDLRSSFKRGKSSDSFYLEGDTHVFEPVHGGWPPAGKPNAVNNALRPVTHLDWPAKVVAVRLRTDDWQRPMIRAGNPRALLDFYGSRGCL

SEQ ID NO: 148574 - protein, 56 aa, Glycine max
  Coding DNA Sequence Number=SeqID_31796
MTRRMRVPPKGIARSLHQRSFEEKVGKTGKDAIYELLSERLEISILRAGKIKREMT

SEQ ID NO: 148575 - protein, 135 aa, Glycine max
  Coding DNA Sequence Number=SeqID_31797
LKVSSEAEAETPEESEEVQVLKEELERAQAVKEKFKTTAIKVRKECNKLRDVNTTTAKALEQETKRARKEEWGRNKFRGALWGSNNKLKLRRAERDQSRVKSMILEDELKACQWSKRSLSEHLSKTNENMWAIID

SEQ ID NO: 148576 - protein, 77 aa, Glycine max
  Coding DNA Sequence Number=SeqID_31798
  Subcellular localization annotation: CTP_CleavageSite=41; ConfidenceScore=5.70e-01
GGETSSSTESNGGSQNVRLSIPILPNSSSSLVSMTYSPSFNSSQLVAQRKLFAESQIGRTSFQRLLEPNSGSWNCSL

SEQ ID NO: 148577 - protein, 87 aa, Glycine max
  Coding DNA Sequence Number=SeqID_31799
MVATQRKKTNYIKNLVNSEGVEVKDMEVLCEKVKGYFRELFNGCHANMNLVLELTRSHRKPWQISYNLFLKNVSPRNSPLSWKGGQS

SEQ ID NO: 148578 - protein, 242 aa, Glycine max
  Coding DNA Sequence Number=SeqID_31800
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=1e-23, Identity=31%"; Hit description= UPI00006A17C9 related cluster
CLAIRGLHVLTFVGLHALTFRGLHVLANRGLHALTLRRLHVLALRGLHVLTIRGLHTLTSRGLHVLTNIGLHALPLRGLHVLANRGLHALTLRGLHVLALRGLHVLTIRGLHALTSRGLHVLALRGLPALALGTSYPHLQRTTCPHFQRATRPFHLRTACPHLRLHAVTFRGLRILIFVGLHALTFRGLHALAIRGLHVLTFVGLHALTFRGLHVLAFRGLHVLAIRGLHVPRFQRETCPHL

SEQ ID NO: 148579 - protein, 130 aa, Glycine max
  Coding DNA Sequence Number=SeqID_31801
DMRKNALAIQKQSTAPHVLSHEGYEHLEKKLMDEKTKKKLEEAAKFGSTDMIIDHPSPIRRHASQGSFVAHGRQDVLTIAIGLGVADSTNQGLVGGVDHRKTDLIANVILQPYAIPVSVTDAITGTCTTS

SEQ ID NO: 148580 - protein, 159 aa, Glycine max
  Coding DNA Sequence Number=SeqID_31802
  Gene Ontology: Mol. function=transferase activity, transferring glycosyl groups; Biological process=biosynthetic process
  Homolog annotation: Hit_ID=Q2D7T8; Match level="QueryCoverage=97%, HitCoverage=12%, E-value=6e-44, Identity=57%"; Hit description =Mannosyltransferase A
  Pfam annotation: Domain name=Glycos_transf_1; Domain location=21-159; Score=-15.3; E_value=0.018; Accession=PF00534.10; Description =Glycosyl transferases group 1
MGYSHHGADILSTIPSAGTNSHDLDKVSAIKQNLSFLMVGTVEPRKGHLQAIAAFDRLWASGNESSLVIVGKEGWKGLPDNARRTIPEIVHTIKNHPLLGKKLFWFDNASDELLSELYANADCLLYPSEDEGFGLPLIEASQHNKPLIARDIPVLREVA

SEQ ID NO: 148581 - protein, 96 aa, Glycine max
  Coding DNA Sequence Number=SeqID_31803
KLMAEKTKKRLEETAQSGSTKGDSLEEQASQGSFVPHGRQDLLTAAIGRPEHLGRVRATGAGVTIKQYFGSAPQSSCSSSSMPPEKLKQLTQQIRD

SEQ ID NO: 148582 - protein, 299 aa, Glycine max
  Coding DNA Sequence Number=SeqID_31804
  Gene Ontology: Mol. function=transporter activity; Cellular component= integral to membrane; Biological process=oligopeptide transport
  Homolog annotation: Hit_ID=Q3BVH5; Match level="QueryCoverage=76%, HitCoverage=35%, E-value=4e-98, Identity=78%"; Hit description =Proton-dependent oligopeptide transporter family protein precursor
MRILRRQRHQHVALAAQPEHEGGDEHQDARDTERPLRAPVLQHQRDQQRGEQRAEVDDPVEGVEDDLGQVLVALVELITHERGHQWLDAAGTERDQAQAEEEALAAVLEQRQAQVAGAVDQAEPENGVVLAEEPVGQPASEQREEIHADHEAVHDVLGFTGTAFRSDFLQQQRGDQELHQDVAHPVETEPLAGLIADDVRDLARHLSLAGDGGNCVVAHPVRQSCKAKGARLPEAGLAKHAAGLHDNGANPWQTPHAMPEVTAPARQKRAGAAAGTGHNGQRKRAPPTDRGRAGAAQPR

SEQ ID NO: 148583 - protein, 84 aa, Glycine max
  Coding DNA Sequence Number=SeqID_31805
METWVENLQSKFKGDPMLNKSKIVVLPKQLNCHSLTWNPMILIRRVWMLSYLNFVRGRSFANIWILSCRIEPLNTNCLTFRRVL

SEQ ID NO: 148584 - protein, 452 aa, Glycine max
  Coding DNA Sequence Number=SeqID_31806
  Gene Ontology: Mol. function=DNA binding
  Homolog annotation: Hit_ID=Q1S0F5; Match level="QueryCoverage=55%, HitCoverage=49%, E-value=3e-34, Identity=37%"; Hit description=IMP dehydrogenase/GMP reductase
MVPTIEEFEEILGCPLGGRKPYPFSGFLPSLSKIAAVVGDSAKELDRTKQTRNGVVGLPRKYLEGKARDMVSQEKWGSFTDILALLIFGVVLFPNVDGLVDLAAIDAFLAYHYSKESPVVAILADLFDTFDRRCEKNSARIVCCLPALCVWLISHLFRQDTRHPCPLQSYRSCAEKGRVDWDQHLAGIGGSAINWFPRWKEGKEGVLFSCGDYPNVPLIGTRGCINYNPTLAIRQLGYPMRGAPTEESLSPCLVRDLGAQSLKAIQRVHKAWRSPLRKDKELRGIRNGVIRDWLSKLKVINEEDFKAPEEDEEVRALKLELGKARLAKEKFKSAATHIQKECTELQEENAATAKALEQETKRARKEEYGREKFRGALWGSNNELKLRREERDRSRVHGMILKEELVACARSKRSLAQHLEATEQSMLTIIGQYKEELNQSVAHEQKLVEDFA

SEQ ID NO: 148585 - protein, 239 aa, Glycine max
  Coding DNA Sequence Number=SeqID_31807
MEAMKEQMATMMEAMMSMKKIMEANAIAVAATSTVAKMNPMPPSVLNQMNHPTSSMVGKDLGTNVAYTPNENVNNSTPIFIESRQPQTDHAPIGETHEMPHYNLANFEPCLGYATEGQAVGGIPLQNTWEGPHYHPQSHPSHSIAIINPHAMAEMGKLDHLEERLRAIEGGKDYAFANLEELFLVPNVITPPKFKVLDFDKYKGTTCPKNHPKMYCWKMGSYTKDEELLIHFFQESLTG

SEQ ID NO: 148586 - protein, 86 aa, Glycine max
  Coding DNA Sequence Number=SeqID_31808
  Homolog annotation: Hit_ID=Q1S9T9; Match level="QueryCoverage=81%, HitCoverage=5%, E-value=3e-07, Identity=51%"; Hit description =Peptidase S8 and S53, subtilisin, kexin, sedolisin; Integrase, catalytic region; Zinc finger, CCHC-type
MRQCKELLEHCGSLLKAFDNFKSQKTLVENQIGRKIKRFRTDNGLEFALISMPSAKRMTLQGRGQLLAPVAKMVELKDSPRPFWRE

SEQ ID NO: 148587 - protein, 138 aa, Glycine max
  Coding DNA Sequence Number=SeqID_31809
  Gene Ontology: Mol. function=DNA-directed DNA polymerase activity; Cellular component=intracellular; Biological process=DNA replication
  Homolog annotation: Hit_ID=Q2NQR5; Match level="QueryCoverage=97%, HitCoverage=14%, E-value=4e-64, Identity=88%"; Hit description=DNA polymerase I
  Pfam annotation: Domain name=5_3_exonuc_N; Domain location=7-138; Score=213.8; E_value=3.9e-61; Accession=PF02739.7; Description=5'-3' exonuclease, N-terminal resolvase-like domain
MAQIAENPLILVDGSSYLYRAYHAFPPLTNSAGEPTGAMYGVLNMLKSLLMQYQPNHVAVVFDAKGKTFRDELFENYKSHRPPMPDDLHAQIAPLHEMVKAMGLPLLAVSGVEADDVIGTLALEAENHGRAVLISTRR

SEQ ID NO: 148588 - protein, 364 aa, Glycine max
  Coding DNA Sequence Number=SeqID_31810
  Gene Ontology: Mol. function=transcription regulator activity; Cellular component=nucleus; Biological process=regulation of transcription
  Homolog annotation: Hit_ID=Q9SP39; Match level="QueryCoverage=83%, HitCoverage=72%, E-value=5e-33, Identity=37%"; Hit description=BHLH transcription factor GBOF-1
  Pfam annotation: Domain name=HLH; Domain location=217-264; Score=8.9; E_value=0.016; Accession=PF00010.16; Description=Helix-loop-helix DNA- binding domain
  Subcellular localization annotation: CTP_CleavageSite=40; ConfidenceScore=5.35e-01
MAAFSYQYHPFLVDPAFFPNNLNTPSPPPHQFQQLPHETSSFNVTNQETSCVDQSSKITISDNEPSVTENLSPQSSMVVDKLETGEQVTQKVNTPVEKKRKTRNGSSLTSNPQSKDAATERKNKKQRKGNGGLKEEDKAKEEKKEQRKCPEEPPTGYIHVRARRGQATDSHSLAERVHCNSLINNLKNYHLYGYVGPTSVLAFPRGFIFMFHSSNVARKWIFQVRREKISERMKVLQRLVPGCDKVTGKALMLDEIINYVQSLQNQVEFLSMKLASVNPMFYDLATDLDTLLVRPEKLNSMASPSPPLPSVSHCNSPNNQATTFADTTTMTPTNIFHIASDYLLDNSVSFFLQGQRSNVFSEEV

SEQ ID NO: 148589 - protein, 104 aa, Glycine max
  Coding DNA Sequence Number=SeqID_31811
STLEDPTEPAGLRAAQRGFQLRIGQGLEEIQIAQQGMTKGRRHHGLLAWGDCAFMVAPPPGRGNARAAPGWRRVCATAKNGKGMRHSIGLPTYTAVENPIRSWT

SEQ ID NO: 148590 - protein, 298 aa, Glycine max
  Coding DNA Sequence Number=SeqID_31812
  Homolog annotation: Hit_ID=Q2QQY1; Match level="QueryCoverage=17%, HitCoverage=24%, E-value=3e-15, Identity=69%"; Hit description=SAM domain family protein
  Pfam annotation: Domain name=SAM_1; Domain location=192-252; Score =51.0; E_value=3.9e-12; Accession=PF00536.20; Description=SAM domain (Sterile alpha motif)
  Pfam annotation: Domain name=SAM_2; Domain location=185-254; Score =42.2; E_value=1.7e-09; Accession=PF07647.7; Description=SAM domain (Sterile alpha motif)
  Pfam module annotation: Pfam domain module=SAM_1::SAM_2; Domain location=192-252::185-254
MAEVPAPEAQLNGGAPTTAANSSDPIGSKRQRRPSVRLGDIGDQPYDSHPRRAAAKTWRLAFDHPRNSAAVKPSKTRPLTNLTPAAAEFGETLESDGNVDSVVIGSWKVKDSKKRGGSKRIRSNWISRIDGGEEDDKDVDVGVVDGYHHRDFSAEHSQSPLREEQSPIMENLGVDEEREVLHYHERNGNSGRGDGVRVWLNGLGLGRYAPVFEIHEVDDEVLPLLTLEDLKDMGISAVGSRRKMFCAIQKLGKGCRKTDHEKGENDRKVLVLIRESAVLLCCVSSGASGLLFLDAPEV

SEQ ID NO: 148591 - protein, 69 aa, Glycine max
  Coding DNA Sequence Number=SeqID_31813
MGFRGFRDTPVLSGKNCFREENPSRGASVMLLRCFHERIRVDFSPFFNVLHPFFVRSSFFVLRSSFFNG

SEQ ID NO: 148592 - protein, 47 aa, Glycine max
  Coding DNA Sequence Number=SeqID_31814
MTADSLEDINSESPQASNSNSFSEDENYESNTNEAAIDTEGYSDLGD

SEQ ID NO: 148593 - protein, 58 aa, Glycine max
  Coding DNA Sequence Number=SeqID_31815
MEEELEKKSMQGDMLMVGRLLGSQIQPLDDTQRENIFHTRCIINGLLTERDTTSRDGS

SEQ ID NO: 148594 - protein, 156 aa, Glycine max
  Coding DNA Sequence Number=SeqID_31816
  Gene Ontology: Mol. function=RNA-directed DNA polymerase activity; Cellular component=chromatin; Biological process=RNA-dependent DNA replication
MTKAPILRLPDFALSFILETGASGVGIGAVLSQQGHPIAFFSKVFCPILLKLSTYICELEAIVVTVKKWLQYLLDHHFTIITDYYNLKELMTQVIQTLEQQMYMACLIGYNYDIQYRAGKSSTVQCRIWLPKDTRFIPTLITEFHASPLGGHMGVT

SEQ ID NO: 148595 - protein, 137 aa, Glycine max
  Coding DNA Sequence Number=SeqID_31817
MVKDLTQLSSKAVPFEGTLNDDWKFDFYVHEARRLVCTNQADMTGRLLPDSLAFESHILHYLIVQILLPRSSNLAQRSFLIGATVIASFGYRKEHDGSWVKKGAQPIDEEGHLHGGEDSSLLQKVLDRFDGLQTFRL

SEQ ID NO: 148596 - protein, 113 aa, Glycine max
  Coding DNA Sequence Number=SeqID_31818
MRFMQHRSINQGGWRVSMLMQKPLVIIGKTRDSTVVKISEKNNNADTDDCMILDDHEGEEHCCGIGTNARSVSFLPRSQEKIRDSTKVVIKQDMKGGEHKYGFNNNRREKPEK

SEQ ID NO: 148597 - protein, 644 aa, Glycine max
  Coding DNA Sequence Number=SeqID_31819
  Gene Ontology: Cellular component=exocyst; Biological process =exocytosis
  Homolog annotation: Hit_ID=Q6YZW7; Match level="QueryCoverage=92%, HitCoverage=84%, E-value=2e-91, Identity=36%"; Hit description =Putative leucine zipper-containing protein
  Pfam annotation: Domain name=Exo70; Domain location=140-644; Score= -3.5; E_value=6.2e-11; Accession=PF03081.6; Description=Exo70 exocyst complex subunit
  Subcellular localization annotation: CTP_CleavageSite=48; ConfidenceScore=5.60e-01
MSPSFTSTPTFSTSSSSASDNTFKLFGLTPSLHIILIRPKGNNMQCPKNMALEEDPTTLLKLESACSDLKTLLRASEETEENLGNTDTRLDLLQRSLSTASKRIVPLQSLAMSRKALDSRITRALAPALALLNTFKLTECLQNSLVELSTRLSSEKPLQKRLERLLEYTKYVDQLNEGLSNISDEVEVVIQKLQEVVEFISRTKAADQYREARLREALGTLKGLYEIEVDEMRFQGLLDQALVHVQDEFEGLLLRMKLRNLQGDLVHQHGDDFRELGSELEIEVLRRISTTLAANDCLDICIDIYVKARYRRAAKALMKLNPDYLRTYTPEGIEEMEWETLETATTLWIQHLEVAVKKVLLAEKKLCERVLGDFMEGLIWPECFIKISDKIMAVFFRFGEGVARSSKEPQKLFKLLDMFESLEKLKPEMSQIFEGEPGLDICTRFRELEKLIIDASSKVLWEFGLQIEGSIDGLPPAQDGSVPKLVRYAINYLKYLTTVNYRTSMVKVLRTQQTWEDRSINDMSSDEGLLKHAISNVMEALQRNIEAKRMCCRDKVLVHVFTMNTYWYIYMRTKDTELGEVLGERCMKEDYKAVAEESAYLYQKQAWGGLVRVLDGNDVRGEGKGSVGRVVSEKIEAFFKGLNE

SEQ ID NO: 148598 - protein, 368 aa, Glycine max
  Coding DNA Sequence Number=SeqID_31820
  Subcellular localization annotation: CTP_CleavageSite=33; ConfidenceScore=5.12e-01
MIKTLNPYPNPAKTAEIMSRYRPIAPKPETSPNSSMSEGSCSSLSQKINQSPYLRNLWPQLQARPTRTRKRGRAPLTLPSSSLKRHKTTHILGFCPPCHVVTSSPAKNLSFQGFAPLPNHGLGVLNCTMENNNTLTANPSLVTLPLLPCSPCPAPKLESNSTLTKPCVGEVIDLNTKVSVPEEKDLLQQLQKPVSSNINVITPQPVRPIGSSISVVCISEDLTLPPLSQTPKRPNEVEQEVENEPLPAVISDSNHRIRMANSAYKEMVGQPLCPWLESMVNNNGGGECKRISGEVTLHLSDSTIVPTSSNGFSCWVRIEWQSEHNNKKNCVNAFCDVMKLACESRDYLFTWRFHTRTTREASQSSCNA

SEQ ID NO: 148599 - protein, 55 aa, Glycine max
  Coding DNA Sequence Number=SeqID_31821
MGRVIKDGGLRLMKEDMWGLGSESGSMHGYTYIEILLVILIFNTTIGLDKNVQAS

SEQ ID NO: 148600 - protein, 71 aa, Glycine max
  Coding DNA Sequence Number=SeqID_31822
MACPKGQKVAFGTYALVEEAEYWWENTRQCLDAEDCFTTRDPQSLNPFSDVRRRKEGISLERDRLNNGALK

SEQ ID NO: 148601 - protein, 43 aa, Glycine max
  Coding DNA Sequence Number=SeqID_31823
MVFATGTGDLGAMLSTSLIGELPTAGRRCRGLRRLVEQHAEIF

SEQ ID NO: 148602 - protein, 51 aa, Glycine max
  Coding DNA Sequence Number=SeqID_31824
MPQEIQSSAQCVEYFARFWVDLSPFYDVTFPGVHLDLENFDPDGLFHDVRI

SEQ ID NO: 148603 - protein, 604 aa, Glycine max
  Coding DNA Sequence Number=SeqID_31825
  Gene Ontology: Mol. function=RNA-directed DNA polymerase activity; Cellular component=chromatin; Biological process=chromatin assembly or disassembly
  Pfam annotation: Domain name=rve; Domain location=344-506; Score =42.0; E_value=2.1e-09; Accession=PF00665.16; Description=Integrase core domain
MKFLHSSRVIELKGDTDLELHSITSLQLHRLVCKDGASGFFHIEGYHLSEHKPFFIPVLLVKKQDGTWRFCVDYRALNVITVKDHFLIPTIDDLLDELGAAQLAFENLKIAISIAPVLSLPNFCLPIVLETDASDTGMGAVLSQQGHLIAFFNKSFGLKLLHDSTYVMELAAITTAVKKWRKCLLGHHFTILRDHQSLKELMMQVVQTPEQQLYLARLIGYDYSIQYYSGKTNIVVDALLRIPEVSTSRFLFLFVPNFAFLTVLKSALAQHMDFIQFWQAIDSCPNDHIDCVLAQDSILQQGHIWLPSNFKLILTLLAEFHSMPTSGHMGIMKTLARVALPPASAVPAVEDLSLDFIVGLLVYCRHTTILVIVDCFSKGIHLGMLPSHYTTHTVALHFMEIVGKLHGMPKILVSDCDPLFITKFWQELFQLSGTKLRISSAYYLQSNGQTKVLNRVIEQYLRAFVHNKPSSWGTSTNDVVDNFLSNREAAFAELKKKLLKAQEVIKEYADSKRREINFKSGNWVMVKLRPYWQSSVSGISTLYSKLEKRFYGPFQVLEQIGKFSEATYSPLPLPPETIDNHPVISPLAIISTRWDYESTPHKLK

SEQ ID NO: 148604 - protein, 564 aa, Glycine max
  Coding DNA Sequence Number=SeqID_31826
  Gene Ontology: Mol. function=transporter activity; Cellular component= membrane; Biological process=transport
  Homolog annotation: Hit_ID=UPI000034F4F5; Match level="QueryCoverage =96%, HitCoverage=99%, E-value=1e-159, Identity=51%"; Hit description= permease
  Pfam annotation: Domain name=Xan_ur_permease; Domain location=52-479; Score=1.9; E_value=3.6e-08; Accession=PF00860.11; Description =Permease family
MAQENAACNNASSAPDNNSGGGAKKVEEVKPHAVQEQLPGVQYCIKSPPPWREALLLGFQHYLLTLGITVLIPTILVPQMGGGNAEKARVIQTLMFVSGISTFLQSLFGTRLPIVVVGSYTYIIPIMSIIQASRYNSYTDPYERFTQIMRGIQGALIITSCFQMTLGFFGLWRNAVRFLSPLCVAPYVTFTGLGLYRLGFPMYLNRYIGTKKPIFDRYSVLFTVSSAWLFALFLTSCTLYNHKPESTQNSCRTDRAGLMSAAPWVYFPRFFPWGSPTFNAGEAFAMMAASFVSLFEYTGTCYAVARYGSATPVPPSVISRGAGWMVGFTKLCKSPLTLVYIKDWSKYFAQWHVWFYNWMYGISGCYLTLELSFPCIFLLMLYFYFTGKMQCLGSILVLEILHRVVICPTIVVYEKGKFGAFFASVPMPIIAALYCVLFGYVSSAGLGFLQFCNLNNFRTKFVLGFSFFLGLSIPQYFTEYYHVKQHHGVPRWFNDVVTVIFMSHTTVAALVAFVLDVTLSREDDAARKAIGLQWWERFSLYSSCVKNDEFYSLPCKLDKFFPPI

SEQ ID NO: 148605 - protein, 167 aa, Glycine max
  Coding DNA Sequence Number=SeqID_31827
CMQTRSQKPELLEEPEIERLPHRLRKEQREKIMVEAKDATRTLMEYLTHHLRETNNIQLSALPRGVTLEFKHGLCDMINQPNIIKEDISKYFFVMKTNKLQRDVGNFTQRLSSHNRISLDVSCQGNLTMEPPADAIKIIEDMCFNLYNNSRGRRNMKRVVSHVEDEA

SEQ ID NO: 148606 - protein, 130 aa, Glycine max
  Coding DNA Sequence Number=SeqID_31828
MENVPIIVYCDDEMTSSSKEILFECPSDSKVILISEDMSLDALRKTIIDTIGGDGCVEYECMELKRDDDVGKIFFIFSNFSSKGLIGLNATFSQSPYEVLTLLCKPRKPRSADEIIALIVIHLCSHVCSL

SEQ ID NO: 148607 - protein, 825 aa, Glycine max
  Coding DNA Sequence Number=SeqID_31829
  Gene Ontology: Mol. function=protein binding; Cellular component =nucleus; Biological process=ribosome biogenesis and assembly
  Homolog annotation: Hit_ID=Q969X6; Match level="QueryCoverage=99%, HitCoverage=99%, E-value=9e-45, Identity=22%"; Hit description=Cirhin
  Pfam annotation: Domain name=WD40; Domain location=186-224; Score =27.2; E_value=5.8e-05; Accession=PF00400.22; Description=WD domain, G-beta repeat
  Pfam annotation: Domain name=WD40; Domain location=236-273; Score =6.1; E_value=7; Accession=PF00400.22; Description=WD domain, G-beta repeat
  Pfam annotation: Domain name=WD40; Domain location=277-315; Score =24.0; E_value=0.00053; Accession=PF00400.22; Description=WD domain, G-beta repeat
  Pfam annotation: Domain name=WD40; Domain location=336-423; Score =0.4; E_value=32; Accession=PF00400.22; Description=WD domain, G-beta repeat
  Pfam annotation: Domain name=WD40; Domain location=5-42; Score=4.5; E_ value=11; Accession=PF00400.22; Description=WD domain, G-beta repeat
  Pfam annotation: Domain name=WD40; Domain location=51-92; Score=17.0; E_value=0.067; Accession=PF00400.22; Description=WD domain, G-beta repeat
  Pfam annotation: Domain name=WD40; Domain location=96-179; Score=5.3; E_value=8.7; Accession=PF00400.22; Description=WD domain, G-beta repeat
  Pfam module annotation: Pfam domain module=WD40::WD40::WD40::WD40::WD4 0::WD40::WD40; Domain location=186-224::236-273::277-315::336-423::5 -42::51-92::96-179
MAELYRLSSVEWSPSPVIALATSFDGSRVAAARKDGSLEIWLVSPGSIGWHCQLTIHGNPNGRVTSLIWCPGGPDGSRLFSSNIDGSVTKWDLFHLTQKTVLPSDGVTIWQMAGTFPKGDEIDDKRKGERMGNGFHGFDEHESSESDDDSDSPGSPELSVGEYPRVAIALDNGCVKIYDISDTDEFIHVKSMPRVKGRVLSVTWSTDSNYVYSGSSDGLIRCWNATLGNEIYRITAGLGGLGSGHELCIWSLLSLRSGTLVSADSSGSVQFWDSQHGTLLQAHTLHKGHVHALAASPSHNRVFSAGSDGQVILYKLSSSQSASSDDINSPSTMKRWIYVHYVRAHTHDIRALAVAVPISHEGIWHVPFLSCAFLCSTDIKPEKRIKRARRAENPISFRYHKWAHLGVPMLISAGDDTKLFAYPAKEFTMFSPHDICPAPQRTPIQLVHNSVFNQRKLLLIQSSQKIEVHLLQLKKVCTSGGFTKNDVVAEVKSKGSRKIICSTISNSGALFAYSDHKKPSLFQLKRNEVGKIKWDVRKRELPQILPFGHSMIFTHDSSKLIVAGHDKRIYVVHVGGADEVKSELLHTFTPLRESQDQELPPTEPPITRLFTSSDGQWLAAVNCFGDIYVFNLEILSQHWFISRLDGASVTAGGFPPQNDNVLIVTTSSNQVYAFDIEAKQLGEWSTRHTHALPRRYLEFPGEVIGLSFPPSETSSSPSATSSSVVVYSSRAMCLIDFGLPVEQDESDMLNTKDSRARNLQNFNVKKRIEVMKEHNRRNFEVIPFENPVLFLGHTAKNSIFMVDKPWLQVVKSLEGRPVHRHIYGT

SEQ ID NO: 148608 - protein, 200 aa, Glycine max
  Coding DNA Sequence Number=SeqID_31830
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=96%, HitCoverage=53%, E-value=1e-109, Identity=84%"; Hit description=PSI P700 apoprotein A2
  Pfam annotation: Domain name=PsaA_PsaB; Domain location=1-200; Score=- 209.0; E_value=0.0032; Accession=PF00223.9; Description=Photosystem I psaApsaB protein
PAFNAEQSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFIDKPVALSIVQARLGGTSPLFR

SEQ ID NO: 148609 - protein, 150 aa, Glycine max
  Coding DNA Sequence Number=SeqID_31831
MLQNFTDCATMLSFNFRHVAELHGLPNHGCQVPRNGQMRVSSQQQDGPQTKLGYDKPLKASMQEKTNSIKCFKFKCLGRRHITSQCPTKKTMIMRGQDIYSSQDELTTSPSSSESEEAKGEESSEEIYPQEGGQPLMVKEECKDLSVSSK

SEQ ID NO: 148610 - protein, 52 aa, Glycine max
  Coding DNA Sequence Number=SeqID_31832
MSGEEGVRDVELKLFMKSVQDQMKGYYKNMEIAMIRVNIEEDREATMARFIG

SEQ ID NO: 148611 - protein, 121 aa, Glycine max
  Coding DNA Sequence Number=SeqID_31833
MEACLWSFYGGWIFELQRGPSMVILHHGDAAEDKGEEAKCASTAKHSFSALSVTEESARASILGPRAKRKISALSATVVFIQAQRTIGENHHHTEKSEPTTVPISGNELWRQQEEQLYRDT

SEQ ID NO: 148612 - protein, 236 aa, Glycine max
  Coding DNA Sequence Number=SeqID_31834
MLQRIRKAWNTLERKDKVLRGSSNDIIGGYLKWLKAQTQGITWLPKLKSPSGEEAKVPKESEEVQALKAELERTRVVKEKLKTTVTRVRKECDELRDVNMTTIEANNKLKLQRAKKDESRVESMILEDKLKACQRSKISLTEQLSRTKENMLSIIDQFKEKLNLAASHGQRLEDEHAMVSALQVEREARERVIESLHGEAMKWMDRFTLILNGSQELPRLLVRAKAMADVYSAPEE

SEQ ID NO: 148613 - protein, 282 aa, Glycine max
  Coding DNA Sequence Number=SeqID_31835
  Gene Ontology: Mol. function=DNA binding; Cellular component=nucleus; Biological process=regulation of transcription, DNA-dependent
  Homolog annotation: Hit_ID=Q9LZ21; Match level="QueryCoverage=52%, HitCoverage=77%, E-value=2e-25, Identity=40%"; Hit description=I-box binding factor-like protein
  Pfam annotation: Domain name=Myb_DNA-binding; Domain location=100 -147; Score=36.0; E_value=1.3e-07; Accession=PF00249.21; Description =Myb-like DNA-binding domain
MNRYLQQQNQMWTRLQTQYFSSSEWTRSQNKVFPMFPEEEGEGQWEKVAEEIMKRYHQALFRDTIHTESTRVELPADSDDSPVDDARSPKSIRRRKGKSWKPWTEQEHRLFLLGLKIYGKGDWKNISKHCVKSRTHIQVASHAQKYFLRMKVTKKESKRKSIYDIALKDKHTELQRLQAQNQERGMMQKNSLDDFAIEFEILVEDPSVIDVEIAHIELTKLRGVRKVDLGKIDLVHHGRVECNYHNISIAFQYNPCNNEWVHLGNLKRIITKRHILRGSVGG

SEQ ID NO: 148614 - protein, 53 aa, Glycine max
  Coding DNA Sequence Number=SeqID_31836
MDEKCYQMQGKNQEMNEHAVRFGFRLTLLEAVDEAGDMVMNDLSNAEVDNDLA

SEQ ID NO: 148615 - protein, 97 aa, Glycine max
  Coding DNA Sequence Number=SeqID_31837
MEKSDKMNFKEKKEKKGYITWEDNVLNYSSDSEKKIISLGIMMKDYENGEEQSRYIDSNFSKHMACIKVYSYFSPRKVNMQFMETTNKGHLINNPNK

SEQ ID NO: 148616 - protein, 57 aa, Glycine max
  Coding DNA Sequence Number=SeqID_31838
  Gene Ontology: Mol. function=oxidoreductase activity
  Homolog annotation: Hit_ID=Q2HVL4; Match level="QueryCoverage=89%, HitCoverage=18%, E-value=2e-10, Identity=69%"; Hit description=RNA -binding region RNP-1
MNQKVKFVDQRLQVSDKTMAAIIATERKINDTGSTVKTSRPLARIVTAEAYWGFSHS

SEQ ID NO: 148617 - protein, 96 aa, Glycine max
  Coding DNA Sequence Number=SeqID_31839
MDPWNPISNVIESVDSMKDIVFSVLSSLQQAQQANFATIFWSIWRNRNESLWQEVNTSFCDWAQTTTSVDKRFVLHTPGPNYITEQPPNQLHEMQY

SEQ ID NO: 148618 - protein, 50 aa, Glycine max
  Coding DNA Sequence Number=SeqID_31840
MRDEGGRRVIDRLREENGPMREESDRVRVDKSSASASDRGRHTDGKRSTT

SEQ ID NO: 148619 - protein, 126 aa, Glycine max
  Coding DNA Sequence Number=SeqID_31841
MMKEKKEFPKEEFSGFSGLGHVYSRLARVPEFALSAPIPHLMSVLVFVLNASWIDELPVTGVVTGDMRVACQALLGYIPPNKYIKGKLIYLTWLWQNFQELIVDVDDVVIAQHAIAHIMMLISGCL

SEQ ID NO: 148620 - protein, 732 aa, Glycine max
  Coding DNA Sequence Number=SeqID_31842
  Gene Ontology: Mol. function=RNA-directed DNA polymerase activity; Cellular component=chromatin; Biological process=chromatin assembly or disassembly
  Pfam annotation: Domain name=Chromo; Domain location=649-702; Score =24.1; E_value=0.00051; Accession=PF00385.14; Description='chromo' (CHRromatin Organisation MOdifier
  Pfam annotation: Domain name=rve; Domain location=424-576; Score =80.2; E_value=6.6e-21; Accession=PF00665.16; Description=Integrase core domain
  Pfam module annotation: Pfam domain module=Chromo::RVT_1::rve; Domain location=649-702::105-350::424-576
MGDVSIKVDALLFELKGIDMVLGMAWLASLGGIWEKCKHLNLRKDAVSCRRRNLRLYLNDMSKFFRNLKGPINVRLYRYPHHQKNESEKHVKEMLNIGIIKPSQSAFSSPVILVKKKDVAWRMCVDYHAINKVTIPDKFPIPIIDELLDELHGAYFFSKLDLKSGYHQVRVRLEDIHKNPFRTHEGHFEYLVMPFGLMNAPSTFQSLMNEVHQLVANKKKSFFAQKSVEYLGHIISKNGVAMDPNKVASVLQWPIPKTVKGVCGFLGLAGYYRKFIKDYGKMATTPVLALSDFTKEFVIENDASSLGLGAILMQGGKPITYFSKALSEKNLIKSAYEKELMAVKLLGYYFDLVYKPGLENKGEYALSRMYEEGHFQSLVHCPTWLECDKIINEIGDFEDISLDFDVVARIPCHSSKRPFRQKYMATAPGGLLQPLNVPYQGFKAILVVIDRLSKYAHFILLKHPYTARVVAEIFIKEVERLHGIPASILSNRDPIFVSSFWKELFKLQETQLKISIAYHPQTDGQTKVINRCLETFLRYFILDLPKSWLQWLSWVEFWYNTTFHISIGTTLFEAIYGRHSPKLIYFLLGEVKVEVVRRELQDRDEVLRQLKFHLARAQGQMKVQADKKRIDRSFEVVGAMAYRLQLPKSAHIHPVAKTISKQGETVNKLLVQWKGKSIEEATWEEEFVIRSQFPEFKLEDKFAIQGGGNDEALDKSMGSKNSVFSVRSSALV

SEQ ID NO: 148621 - protein, 421 aa, Glycine max
  Coding DNA Sequence Number=SeqID_31843
  Gene Ontology: Mol. function=ubiquitin-protein ligase activity; Cellular component=ubiquitin ligase complex; Biological process =protein ubiquitination
  Homolog annotation: Hit_ID=Q9AR60; Match level="QueryCoverage=91%, HitCoverage=96%, E-value=1e-30, Identity=26%"; Hit description =Photoperiod responsive protein
  Pfam annotation: Domain name=Arm; Domain location=277-317; Score =16.5; E_value=0.095; Accession=PF00514.13; Description=Armadillobeta- catenin-like repeat
  Pfam annotation: Domain name=U-box; Domain location=35-109; Score =53.9; E_value=5.4e-13; Accession=PF04564.6; Description=U-box domain
  Pfam module annotation: Pfam domain module=Arm::U-box; Domain location=277-317::35-109
MQFFQPSKEREDENAKIEEAGVDLKVMIEEMESIDVPSVFICPISLEPMQDPVTLCTGQTYDRSNILKWFSLGHKTCPTTMQELWDDVVTPNSTLSHLMLTWFSQKYLALKKKLKDVQGRALEILNMLKKVKGQARVRALQDLRQLVASHVNARKALEENGGVALVFNFLGPFTSHAVGSEAIGIIVCLDLSSEVKRSLMHPAKVSLLVDIMNEGTIETKMNCAKLIEMLLVEGNNETVSSLSLLVGLLRLVRDKKHPNGVVSIGLILLKKAIICSHESVRSSLISLGAIPLLIELLPSLNNECLEKALYILEVLSTLPEGRMALKECPNIIPNVVKLLMRVSERCTQFALSILWAIYKLAPEECASKAVEAGLAAKLLLVIQSGCNPVLKQMSSEFLKMCSLNYSTSILVSKCMLTTTIQ

SEQ ID NO: 148622 - protein, 590 aa, Glycine max
  Coding DNA Sequence Number=SeqID_31844
  Gene Ontology: Mol. function=RNA-directed DNA polymerase activity; Cellular component=chromatin; Biological process=chromatin assembly or disassembly
  Pfam annotation: Domain name=zf-H2C2; Domain location=478-519; Score =16.3; E_value=0.0024; Accession=PF09337.1; Description=His(2)-Cys(2) zinc finger
  Pfam module annotation: Pfam domain module=RVT_1::zf-H2C2; Domain location=123-373::478-519
MVGNGHEIECRRLCEQVLVHVQGQAFSMDFYVLPLCGADLVLGVQWLKSLGPILTDYNDLTMKFLRSDRVVKLKGDNNSKLYAMSPPQLHRLMQIDGANEFFHIHLLVAELPSTQTPPSISAIPKIASLITQKKDESWRFYVDYQALNVITMKDRFSIPIIDELLDELRGACWFSKLDLLQGYHQILMDDEDISKTAFQTHHGRFEFRVMSVGLCNTSFSFQEHVLHLEKTFQVLMEGRFFLKLSKCSFGQQQVEYLGHMVSAQGFKPIHAKVQAIQQWPSPNSFKALRSFLGLARFYGRFIHGYASIAAISAALVLLLPDFLILFVLEIHASKIGMGTFNAKLLQASMYVRELAAITAAVKKWRQYLLGHHFTILTDHKCLKELMTQTNMVADALSRIPQVLSGELFLLSMPNFEFINELKRELARHAQFIELRQNIIEQPQHHNYYKLTQDFILKEGHIWLPSGFKLIPLLLTKFHSTPTGGHMGIMRTMAGLSDSFTWSNMKKDVQEFIVACLDCQHTKYETNRFTGLLCPLPVPARPWEDLSLDFIVGLPPYQGYTTILVVMNRFSKGVHLGMLSSQYTVHNVGSP

SEQ ID NO: 148623 - protein, 373 aa, Glycine max
  Coding DNA Sequence Number=SeqID_31845
  Gene Ontology: Mol. function=oxidoreductase activity; Cellular component=proton-transporting two-sector ATPase complex; Biological process=flavonoid biosynthetic process
  Homolog annotation: Hit_ID=Q9ZSA8; Match level="QueryCoverage=94%, HitCoverage=92%, E-value=5e-58, Identity=38%"; Hit description =F3H7.16 protein (Putative Fe(II)/ascorbate oxidase)
  Pfam annotation: Domain name=2OG-FeII_Oxy; Domain location=200-322; Score=112.1; E_value=1.7e-30; Accession=PF03171.10; Description=2OG -Fe(II) oxygenase superfamily
MKTFQLANESSSLLSLSPKFILPEDERPQLSEVTSLDSIPIIDLSDHSYDGNNHSSSLVVQKISQACEEYGFFQIVNHGIPEQVCNKMMTAITDIFNLPPEQTGQLYTTDHTKNTKLYNYYLNVEGGEKVKMWSECFSHYWYPIEDIIHLLPQEIGTQYGEAFSEYAREIGSLVRRLLGLLSIGLGIEEDFLLKIFGDQPRLRAQANFYPPCPDPELTLGLPVHTDFNALTIVLQSQVSGLQVIKDGKWIAVPVIPNAFVINLGDQIQDKLKAFQLEAIVFSMCMHVHRTMVLSNGRFKSVHHRAVTNKLSPRVSMAMFYGPNVDTTIGPIQDLIDEEHPPRYRNYRFSEFLEEFFKQEGTRRMVKEVFELPC

SEQ ID NO: 148624 - protein, 104 aa, Glycine max
  Coding DNA Sequence Number=SeqID_31846
MDCTRVSLEFTSITQSFLLLRSLKPFSMLVDEVLPKKELIVGACRRPNLAVVERNKFGNAFMIVAKQLGKAKLFLHPSWIVLDSFDVMPFMKGLLKNMSSFEIY

SEQ ID NO: 148625 - protein, 171 aa, Glycine max
  Coding DNA Sequence Number=SeqID_31847
MFSGLVVEAEKVGWDERWEGCMVFAKGGGWCIGYGKCDECRKISLHVVWPNQLLASELGMLNTLPTPEGTQTKTPVDCCAPATGTMRASSRPLSGCAEEEEGDGGRDSRLATFCKSSSSLRVMEFWLAINKSWFDVSFAIASSRRSMFDLELVDYAIVLNESTRNDMFSRV

SEQ ID NO: 148626 - protein, 146 aa, Glycine max
  Coding DNA Sequence Number=SeqID_31848
MTLLLNNILPSDRNANLPLQKYQMVCVVPTWGSHPQRHPVDLKKSNRALGFSALGSHLQDTQWTRRSPTGSWSCQALITGLCQFYGVPVTSSKGIRPPTNRAFIKKYCAPRQAQGETPQQHWDGRQRATDAPPSPLEFTSAHPQKG

SEQ ID NO: 148627 - protein, 46 aa, Glycine max
  Coding DNA Sequence Number=SeqID_31849
MATSSVRNLANGEVRKIERISLTTKYKILNCNKINEKSTDSKRVIK

SEQ ID NO: 148628 - protein, 146 aa, Glycine max
  Coding DNA Sequence Number=SeqID_31850
  Gene Ontology: Mol. function=protein dimerization activity; Cellular component=nucleus; Biological process=regulation of transcription, DNA-dependent
  Homolog annotation: Hit_ID=Q9T062; Match level="QueryCoverage=55%, HitCoverage=26%, E-value=2e-11, Identity=45%"; Hit description=BZIP transcription factor-like protein
  Pfam annotation: Domain name=bZIP_1; Domain location=57-121; Score =25.9; E_value=0.00014; Accession=PF00170.11; Description=bZIP transcription factor
  Pfam annotation: Domain name=bZIP_2; Domain location=57-111; Score =21.5; E_value=0.0031; Accession=PF07716.5; Description=Basic region leucine zipper
  Pfam module annotation: Pfam domain module=bZIP_1::bZIP_2; Domain location=57-121::57-111
MFFHEEAEAVQSSYFPVLETMFTPSEIEELFSLVNEPASPGSGSGSGSQGSNRAVRSSHERKLRRMQSNRESARRSRWRKKRHLENLMNQLNRLRMENQKYRNRLFLTMHQNLLLSLENERLRSESMTLMARLSDLYQILGTMISQ

SEQ ID NO: 148629 - protein, 185 aa, Glycine max
  Coding DNA Sequence Number=SeqID_31851
  Homolog annotation: Hit_ID=Q9C9K1; Match level="QueryCoverage=34%, HitCoverage=19%, E-value=2e-16, Identity=69%"; Hit description =Putative chlorophyll A-B binding protein; 65434-67056
  Subcellular localization annotation: CTP_CleavageSite=26; ConfidenceScore=5.79e-01
MVSLHPHTLTLACPLSVSSSSSRFLRCSVNSAPKRRRSSFITASWQELAGVLLFSAIPFTAVKAIANSPLGESLQRKMEERKTFAVENSSTFKALAGKARKESSPTKGVECVRQLRKGRIQRWGRGWGRGRKLGILLFTGIDANDWVNQVEKYFQLKRISDRERIQMVTIAMKGHALSWFHWWDS

SEQ ID NO: 148630 - protein, 73 aa, Glycine max
  Coding DNA Sequence Number=SeqID_31852
MSVNSPRVWKLEEAKSTRPVVGWQGDRCATSLINEGGRQASLCQTIEVDYGTLYPCSKEEVMKARSMYSDWLS

SEQ ID NO: 148631 - protein, 106 aa, Glycine max
  Coding DNA Sequence Number=SeqID_31853
MARLLAEKERREATIATAMTVVNDVGGSNTPITPQLNINVAGNTPNSQKRAQTEIGGLDYIHVDSKELDAHPITLTRSNGQSLIEAMGGNWNPQELGNPQNEGISF

SEQ ID NO: 148632 - protein, 146 aa, Glycine max
  Coding DNA Sequence Number=SeqID_31854
  Homolog annotation: Hit_ID=UPI000034F3B5; Match level="QueryCoverage =65%, HitCoverage=8%, E-value=3e-12, Identity=39%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
MNSSSPIKCDERFREERNRAFISKWLRRPLRVYENFDLSLEGLKSFFENAKEHYGINTVRATQSLGLNGDVVQNKDQNAWFTRKKKQKLNKSGNGDGRETSVIENNISFPTLTSPDLIESQPSAQKNSNTYNCKYLPQCSNQTEPR

SEQ ID NO: 148633 - protein, 133 aa, Glycine max
  Coding DNA Sequence Number=SeqID_31855
  Gene Ontology: Mol. function=oxidoreductase activity; Biological process=electron transport
  Homolog annotation: Hit_ID=Q49HE0; Match level="QueryCoverage=75%, HitCoverage=29%, E-value=3e-17, Identity=48%"; Hit description=12 -oxo-phytodienoic acid reductase
MTTLGLGCLLSLITMIVETLTLKHILGIHIAQSLSQLGILYIHLIEPRMHQLGRPSKTGLLLWLVARIGLRDRNEAISTGAAHLVAYGRLFLANNPDLPTRFHLDAHLNQPDVTTFYTHHPVLSSTQPQVMLL

SEQ ID NO: 148634 - protein, 400 aa, Glycine max
  Coding DNA Sequence Number=SeqID_31856
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=O22813; Match level="QueryCoverage=96%, HitCoverage=79%, E-value=1e-149, Identity=66%"; Hit description =Putative steroid dehydrogenase
  Pfam annotation: Domain name=3Beta_HSD; Domain location=26-309; Score= 420.7; E_value=2e-123; Accession=PF01073.9; Description=3-beta hydroxysteroid dehydrogenaseisomerase family
  Pfam annotation: Domain name=Epimerase; Domain location=25-274; Score= 73.2; E_value=8.1e-19; Accession=PF01370.11; Description=NAD dependent epimerasedehydratase family
  Pfam annotation: Domain name=KR; Domain location=24-153; Score=-95.4; E_value=0.079; Accession=PF08659.1; Description=KR domain
  Pfam annotation: Domain name=NAD_binding_4; Domain location=27-252; Score=17.4; E_value=8.9e-10; Accession=PF07993.2; Description=Male sterility protein
  Pfam annotation: Domain name=Polysacc_synt_2; Domain location=25-281; Score=-171.0; E_value=0.0031; Accession=PF02719.6; Description =Polysaccharide biosynthesis protein
  Pfam annotation: Domain name=RmlD_sub_bind; Domain location=24-324; Score=-166.4; E_value=0.0029; Accession=PF04321.7; Description=RmlD substrate binding domain
  Pfam annotation: Domain name=adh_short; Domain location=23-157; Score= -29.1; E_value=0.00045; Accession=PF00106.15; Description=short chain dehydrogenase
  Pfam module annotation: Pfam domain module=3Beta_HSD::Epimerase::KR::N AD_binding_4::Polysacc_synt_2::RmlD_sub_bind::adh_short; Domain location=26-309::25-274::24-153::27-252::25-281::24-324::23-157
MNQGNLGELIRMHLSENEGIEGKTFVVTGGLGFVGSGLCLELIRRGAVEVRAFDLRLSSPWSRPLKDKGVLCIQGDVARKEDVERALRGADCVFHLAAFGMSGKEMLQFGRVDEVNINGTCHVIDACLYLGIKRLVYCSTCNVVFGGQQIINGNETLPYFPIDHHVDPYGRSKSIAEQLVLKNNARTLKSDSSGNHRLYTCAVRPAAIYGPGEDRHLPRIVTMARLGLLLFRIGDQTVKSDWIFVDNLVLALILASMGLLDDNLSKGKRPVAAGQAYFISDGSPVNSFEFLQPLLRSLGYELPKTSLPVERALVLGRICWAVYTILYPWLNRWWLPQPFILPSEVHKVGVTHYFSYLKAKEEIGYAPMVTSREGMALTISYWQERKRTTLDGPTIYACCF

SEQ ID NO: 148635 - protein, 576 aa, Glycine max
  Coding DNA Sequence Number=SeqID_31857
  Gene Ontology: Mol. function=oxidoreductase activity; Cellular component=glyoxysome; Biological process=hydrogen peroxide catabolic process
  Homolog annotation: Hit_ID=P29756; Match level="QueryCoverage=81%, HitCoverage=96%, E-value=0.0, Identity=100%"; Hit description =Catalase-1/2
  Pfam annotation: Domain name=Catalase; Domain location=18-401; Score =968.2; E_value=3.2e-288; Accession=PF00199.9; Description=Catalase
  Subcellular localization annotation: CTP_CleavageSite=9; ConfidenceScore=5.05e-01
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQDLEKLCGSEVDNPWFEENTVWKIGRGDKCRFWKDVWVNGNSLANLFPRLYLISEQKEELIEVMGCWRGPFEWESGLIQQVKALVETILVNKDESDYWKWSRCG

SEQ ID NO: 148636 - protein, 708 aa, Glycine max
  Coding DNA Sequence Number=SeqID_31858
  Gene Ontology: Mol. function=hydrolase activity, acting on acid anhydrides, catalyzing transmembrane movement of substances; Cellular component=proton-transporting two-sector ATPase complex; Biological process=protein modification process
  Homolog annotation: Hit_ID=Q9FH07; Match level="QueryCoverage=96%, HitCoverage=70%, E-value=1e-114, Identity=40%"; Hit description =Arabidopsis thaliana genomic DNA, chromosome 5, TAC clone:K5J14
  Pfam annotation: Domain name=ubiquitin; Domain location=29-92; Score =56.3; E_value=1e-13; Accession=PF00240.13; Description=Ubiquitin family
MAGQSSNEGSSTGNISAECSDSTVQLNIKTLDSRIYSFQVDKNMPVSLFKEKIANEIGVPVNQQRLIFRGKVLKDEHALSEYCILQIASGTSSGESTGTSGNRGNDVGSGAPRNHVGQISHSVVLGTFNVGEQGEGIVHDLTRVLAIMVIGHVLNSIGNGGQSTLSGPNATQTSSVHPWNETEGMHAGNQNSAGNQAPSGQTFHGPTVQSVSHVVQIPVAAGAIPIPSLNAPIPDSLNTLSEFMNRMEQTLTQNGYQSNLSSANPGDQQAELPSNAQGLPTLEALSTVLHSAERLLGGQAVAALSGAEVWRWTSFVSFSLNILLEGLHFTTHIAGRLEREGTSADLRVRDQIQSESVQIGLAMQHLGALLLELGRTMLTLRMGQSSAESVVNTGPAVYISPSGPNPIMVQPFPLQTSSLFGGPVPPSTPATLGTIGIGNAPRNVNIHIHAGTSLAPIVSAIGSGANNGEGTRSEHRNEPGSGDSGSTRVLPVRNVIAATIPSHPPGVGISSSTQTGFGIPTSQPPSDSASLSSVLAEINSRLRNVVGNMHGDNTVPSGQMESNSRDLPSGSESRPATVNEQRDTMDMNGFGATSASSVGCTSESEVQKLQTKAVQTSSNDERDVLVDKFVSSSSNQDLRSCSSGETIVKPEKEQDVPAVSERQNVTEPAKAAPLGLGVGGLERKHHLCEYCTQLSELECGFDSWQLTD

SEQ ID NO: 148637 - protein, 60 aa, Glycine max
  Coding DNA Sequence Number=SeqID_31859
QKGSTECDYYVMHWMSMIILGNFRNNWEVYFDDVRPLKAKRLKALRIQWAKFYLKVRNES

SEQ ID NO: 148638 - protein, 90 aa, Glycine max
  Coding DNA Sequence Number=SeqID_31860
  Gene Ontology: Mol. function=oxidoreductase activity; Cellular component=cellulose and pectin-containing cell wall; Biological process=lignin catabolic process
  Homolog annotation: Hit_ID=Q655H5; Match level="QueryCoverage=91%, HitCoverage=15%, E-value=2e-26, Identity=65%"; Hit description =Putative PS60
  Pfam annotation: Domain name=Cu-oxidase_3; Domain location=32-90; Score=-24.2; E_value=0.0017; Accession=PF07732.5; Description =Multicopper oxidase
MTLNIAALAVLCISVFGIAVVAEDPYRFFTWNVTYGDIYPLGVRQQGILINGQFPGPDIHSVTNDNLIINVFNSLDQPFLLSWYLLYIFN

SEQ ID NO: 148639 - protein, 114 aa, Glycine max
  Coding DNA Sequence Number=SeqID_31861
MKAQAIQKQNTAPHVLSRGGYDYLEQKLLAEKTKKKLEEAAQSGSVDGVIDPSSPVRRHVKWKMAHMKKTGEGRRRLRLQRKSLRRLIYLRSRPHRDRSSPMDVRMFSPLLFDV

SEQ ID NO: 148640 - protein, 109 aa, Glycine max
  Coding DNA Sequence Number=SeqID_31862
MIKVVLQVIPTYDMSVYLLAKLTMKELQRMRLQVLLLPLLDEFEEDKRIWKFSTDGLYSVKSTYRLVMDRLETREFYNGPNWMAGSKLSTANLICEPANYPFNPLMSYV

SEQ ID NO: 148641 - protein, 210 aa, Glycine max
  Coding DNA Sequence Number=SeqID_31863
  Homolog annotation: Hit_ID=Q47522; Match level="QueryCoverage=21%, HitCoverage=56%, E-value=5e-20, Identity=97%"; Hit description=LacZ protein
  Subcellular localization annotation: CTP_CleavageSite=39; ConfidenceScore=5.00e-01
VPPVQLLTGWCVTAKAPPDISAGKCSGHAARNHHTRRAYCAATGRVPFAIQAAQLLGRAIGAGLFAITPAGERGMCCKAIKLGNARVFPVTTLLDRGGWMNEKLFMGLGIRFEGWRIEEQRLAINSWGSRLNGGGCMNDKHFMGLLIRFEGWSIDEQHMAINSWGSRLDGEGCIKDNQFMGLRIRFKGGGYTNSPRQSILGAPDSMAEDA

SEQ ID NO: 148642 - protein, 199 aa, Glycine max
  Coding DNA Sequence Number=SeqID_31864
  Gene Ontology: Mol. function=molecular_function; Cellular component =cellular_component; Biological process=regulation of progression through cell cycle
  Homolog annotation: Hit_ID=Q9LZL8; Match level="QueryCoverage=92%, HitCoverage=72%, E-value=5e-63, Identity=66%"; Hit description =Thaumatin-like protein
  Pfam annotation: Domain name=Thaumatin; Domain location=14-198; Score= 29.6; E_value=1.8e-10; Accession=PF00314.8; Description=Thaumatin family
MVYLLYDDHSLHNNKWGSTHSSEQLWGKCMARDTWRCGAANTKRWWDASWKWKEVVRAREVVRKNLGQAGGQGGVPPATVVEMTLGSSSSPLHFYDLSLVDGFNLLDSMKPVGGGVGCGVASCEVDLNVCCPSALEVKINGKVVGCKSACLAMQSAKYCCTRSYSDPKTCKPTLFNHLFKAICPKAYSYAYDDSSSLNR

SEQ ID NO: 148643 - protein, 63 aa, Glycine max
  Coding DNA Sequence Number=SeqID_31865
MSLNVDDDELVSEMDEAPSFASSLPVPNVQEMVPVIDLALLSNGNKEELLKLDVACKEWGFFQ

SEQ ID NO: 148644 - protein, 136 aa, Glycine max
  Coding DNA Sequence Number=SeqID_31866
  Gene Ontology: Mol. function=protein serine/threonine kinase activity; Biological process=protein amino acid phosphorylation
  Homolog annotation: Hit_ID=Q2HT01; Match level="QueryCoverage=59%, HitCoverage=16%, E-value=7e-14, Identity=64%"; Hit description =Protein kinase
MAGTMFSVLQSEKGVNEFEICHKKFKVYVLQTKPIVETIQELIDELECEFNPSVTLQTLLARHHGSVKPNKASILKGSECEIGLDKSFGFTNHFHAHFELRPKVGVTPKRGLMNKIKDEVGRGLMVRVEGWGRAFF

SEQ ID NO: 148645 - protein, 46 aa, Glycine max
  Coding DNA Sequence Number=SeqID_31867
  Gene Ontology: Mol. function=nucleotide binding; Cellular component =membrane; Biological process=small GTPase mediated signal transduction
  Homolog annotation: Hit_ID=Q9SBU1; Match level="QueryCoverage=70%, HitCoverage=16%, E-value=1e-10, Identity=93%"; Hit description=GTP binding protein
MATFLDYFSSVPGAKRLPRAQPAQNPAGMVLVDRPAEGTRAASCCS

SEQ ID NO: 148646 - protein, 256 aa, Glycine max
  Coding DNA Sequence Number=SeqID_31868
  Gene Ontology: Mol. function=helicase activity; Cellular component =membrane; Biological process=protein amino acid phosphorylation
  Homolog annotation: Hit_ID=Q9LTU4; Match level="QueryCoverage=86%, HitCoverage=15%, E-value=1e-64, Identity=55%"; Hit description =Helicase-like protein
  Pfam annotation: Domain name=DUF889; Domain location=179-256; Score= -79.0; E_value=3.9e-06; Accession=PF05970.5; Description=Eukaryotic protein of unknown function (DUF889)
MTGLFIVLTCLAYFPPLCLALEFQAVIKTRTIFMPTDQQAKIYNQIIQAVNKNEGEMFFLYGYGGAGKTFIWKTLAASLRADNKIVIMVASSGIASLLLPGGKTTHSKLKIPVPIFEDSTCNIHQETQLAELLNEASLIIWDEAPMAHKFCFEALDQSLRDVIKAKSSSDKIFGGKVMVFGGDFRQILPVIPRGSRSDILNATINSSYLWNHCHVLTLSKNMRLEANIDATDREETSAFAQWILDIGDGIVRQQND

SEQ ID NO: 148647 - protein, 221 aa, Glycine max
  Coding DNA Sequence Number=SeqID_31869
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-32, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVVAFRGLHVLPFRGLHVIAFRGIHVLSFRGRHILAVIGIHVLPFKGLHVLAFRGLHVIAFIGLHALAFIGLHVLAFRGLHVLAFRGLHVLSFRGLHVLAFRWLHAFTFRAQQILTFRGPDVLAFRGLHALARLQRTTRSRIQRTTHPRLQMATRPHHQKATRPRLAFRGQHILAFRGLHVLAFRGLHVPAFRGLHVPAFRGLHVLAFRGLHVLAFRGLH

SEQ ID NO: 148648 - protein, 77 aa, Glycine max
  Coding DNA Sequence Number=SeqID_31870
  Gene Ontology: Mol. function=adenosine kinase activity; Biological process=purine ribonucleoside salvage
  Homolog annotation: Hit_ID=Q1RYR5; Match level="QueryCoverage=58%, HitCoverage=13%, E-value=2e-15, Identity=86%"; Hit description =Adenosine kinase
MWRTLLEWKCIFHNDSFYNFFFVCVLEGATHNSIKVAQWMLQVPGATSYMGGIGKDKFGEEMKKNSKLAGVNVGLIL

SEQ ID NO: 148649 - protein, 868 aa, Glycine max
  Coding DNA Sequence Number=SeqID_31871
  Gene Ontology: Mol. function=microtubule motor activity; Cellular component=microtubule associated complex; Biological process =microtubule-based movement
  Homolog annotation: Hit_ID=Q9S7P3; Match level="QueryCoverage=77%, HitCoverage=78%, E-value=0.0, Identity=58%"; Hit description=Kinesin- like protein
  Pfam annotation: Domain name=Kinesin; Domain location=111-439; Score =525.6; E_value=5.4e-155; Accession=PF00225.13; Description=Kinesin motor domain
MEANRLTWHEDPWSGHEEGCCHCPSLSCNWFSESQEVPHRVRPLREWDRSRVDRSDSEDGPEFKFSGWAAIREGISVNLKNSNEVKEKRVVAEPALSIRKAKMEKICVAVRLRPQVSQDSSSSSVGTFWKVEDNRISLHKIHGTPLSASSYAFDHIFDERSSNGSVYELLAKDIIHAALNGFNGTAFAYGQTSSGKTFTMNGSETDAGVIPRAVRDIFATIEMMSDREFLIRVSYMEIYNEEINDLLVVENQKLQIHESLERGVFVAGLKEEIVNNAEQVLNLIKAGEVNRHFGETNMNVRSSRSHTIFRMVIESKGKDSNSSNDCSINDVVRVSVLNLVDLAGSERIAKTGADGVRLKEGKYINKSLMVLGNVINKLSEGSKQRGHIPYRDSKLTRILQPALGGNAKTSIICTIAPEEIHIEETRGTLQFASRAKRITNCVQVNESIFGQARVLTVGILQILTEAALLKRQQLEIEELRKKLQGSHAEVLEQEILKLRNDLLKYEMERGKLEMELQEERKSRDQWIREQRMKIENSCTTKSFSDCRTNDSQGPGFFRRGFMEEYSDISSSISQGDIFKSPKVDPSAFVARRSKYSTLPDHSPLPDAFGNVADEDMWVKMNNGYVADLDSLQTTPPTNRKVQPFPTSDATAGCTSEIEKYEREVLDLRKQLELAKERINELAQNHSEEVPSSKQLLVETPKHQQETRLTHELPLRLSESVGNFKDSFEEALSVMQRFASDGTLSTAKILSTMSEIGDHLFATLEGHFAVNTGGERSSTGNGTLINEQQKVFCERIDNIITSLELSESSITEGQEWKHKCSCEPKGLCLLSELHCLSTIVTEALTCTCLYKSRLASCLSYSYELSVPPK

SEQ ID NO: 148650 - protein, 166 aa, Glycine max
  Coding DNA Sequence Number=SeqID_31872
  Gene Ontology: Mol. function=nucleic acid binding; Biological process= DNA integration
  Homolog annotation: Hit_ID=Q1S7C5; Match level="QueryCoverage=87%, HitCoverage=16%, E-value=4e-21, Identity=31%"; Hit description =Integrase, catalytic region
MASTPSSSVPQSFPNFVAEKLDDSNYLHWRQHVKPIIKSHRLQRFVVNPIIPPRYLTEDDRVADRINPDYEAWEVQDEMLLLLLNGKTIEEYLRKIKGFVDELAGVGVPVRHEEYVDALLEGQPRIMRQWFLLSKTKSKLCPSQRLKRYSTNMKLDSCATTKKHKC

SEQ ID NO: 148651 - protein, 362 aa, Glycine max
  Coding DNA Sequence Number=SeqID_31873
MASATPKPQKRLAEFLDEEQEPFLLGVYLSESEYSKGWSLDGDSSNTEKSTKSGLNKRKKGQLPFCQVLKAIYNKLGFHNESKNSLTKFHDQRTKHEEGAPEPSQVNDIVQFSSDRFSTMFNSCQDIDEEVPSILSHKDQHLFYSHTLCNMGPQRRKRRRFIEGGHELLRKIPVRRAPNVSEEVRRMQQRIRSGGVILPKKIREDSLLSAAIWSSLLDQSINKGNCCTRELGVLFPGTSDVSQILKSKRVLHRIKKMLFDCVKDIAITLPTQDDRKKGNRKFMGPLQIGKVLPQRTKKWGQQVGYGENLTYLLTLDYLNSIMEWRRFEPHVKGISVEITDAILDSIHNEIVLEMIGTFTRNR

SEQ ID NO: 148652 - protein, 196 aa, Glycine max
  Coding DNA Sequence Number=SeqID_31874
MALDTMLNKLRERRKRKLVEQKGGPVQARLYVGQVVGSCRQAKKEKEREEKRKEKEKKEKDREREKDKSKERNKKDETDSDNQDMADSHGYKEEKKKEKDKERKHRKRHQSSIDDVDSEKEEKEESKKSRRHGSERKKSRKASEICGTIILQHANSPESDNENRHRRHKRDHWDGSRKTGGHEELEDGELGDDAEN

SEQ ID NO: 148653 - protein, 814 aa, Glycine max
  Coding DNA Sequence Number=SeqID_31875
  Gene Ontology: Mol. function=protein binding; Cellular component =nucleus; Biological process=mRNA processing
  Homolog annotation: Hit_ID=UPI00005DC1C7; Match level="QueryCoverage =95%, HitCoverage=83%, E-value=1e-169, Identity=40%"; Hit description= protein binding
  Pfam annotation: Domain name=FF; Domain location=386-435; Score=61.9; E_value=2e-15; Accession=PF01846.10; Description=FF domain
  Pfam annotation: Domain name=FF; Domain location=453-503; Score=48.5; E_value=2.3e-11; Accession=PF01846.10; Description=FF domain
  Pfam annotation: Domain name=FF; Domain location=521-570; Score=23.8; E_value=0.0006; Accession=PF01846.10; Description=FF domain
  Pfam annotation: Domain name=FF; Domain location=595-651; Score=16.5; E_value=0.04; Accession=PF01846.10; Description=FF domain
  Pfam annotation: Domain name=FF; Domain location=728-778; Score=20.6; E_value=0.0058; Accession=PF01846.10; Description=FF domain
  Pfam annotation: Domain name=WW; Domain location=174-203; Score=37.7; E_value=4.1e-08; Accession=PF00397.16; Description=WW domain
  Pfam module annotation: Pfam domain module=FF::FF::FF::FF::FF::WW; Domain location=386-435::453-503::521-570::595-651::728-778::174-203
  Subcellular localization annotation: CTP_CleavageSite=61; ConfidenceScore=5.27e-01
TQAQQGQPFVPMNSQQFGPAGHAIPSSNAGMPVIQGQQLQYSQPMQQLTQRPMQPGHPAPSSQAIPMQYIQTNRPLTSIPPHSQQNVPPLSNHMPGLAVSVAAPHSSYFTLSYGQQQDNANALAQYQHPPQMFAPPSGQPWPSSASQSAVAVTSVQPAGVQSSGATSTDARADASTVWKEFTSSEGRKYYYNKVTQQSTWSIPEELKLAREQAQNAANQGMQSETSDTCNAVVSSTETPTPTAANAASLNTSLTSNGLASSPSSVTPIAATDSQRLVSGLSGTSVSHSMATPSTTGVEPSTVVTTSAAPTIVAGSSGLAENSPQQPKMPPVVENQASQDFASANGSSLQDIEEAKRPLPVVGKNNVTPPEEKTNDDETLVYANKLEAKNAFKALLESVSVQSDWTWEQAMREIINDKRYNALKTLGERKQAFNEYLGQRKKLEAEERRMKQKRAREEFTKMLEECKELTSSMRWSKAISMFENDERFNAVERPRDREDLFESYMVELERKEKENAAEEHRQNIAEYRKFLESCDYVKVNSPWRKIQDRLEDDDRYLRLEKIDRLLVFQDYIRDLEKEEEEQKRIQKDRIRRGERKNRDAFRKLLGEHVSAGILTAKTQWREYCLKVRDLPQYQAVASNTSGSTPKDLFEDVAEDLEKQYHEDKTLIKDTVKSGKITVVTTSVFEEFKVAVLEGAACQTISEINLKLIFEELLERAKEKEEKEAKKRQRLADDFTNLLYTFKDITTSSKWEDCKSLFEETQEYRSIGDESYSREIFEEYITYLKEKAKEKDRKREEEKTIWFPKPLHCVMIWFSH

SEQ ID NO: 148654 - protein, 172 aa, Glycine max
  Coding DNA Sequence Number=SeqID_31876
MPTAILLLHQQYQSGGIGLEEVRVFQEELVDSRKWVVLREGDGERTTDMVELHGQCVVVGDNRSKLFQPLNAESNVGSTDGKDGVVTDSDLKRNGNDGEQTRTGEGLPGSNTGKGVEANEDVGEVRRRWDRWFGTRGFKCTSLIRVCELGDSFLEAVRGFGTGVVFCHDSAG

SEQ ID NO: 148655 - protein, 274 aa, Glycine max
  Coding DNA Sequence Number=SeqID_31877
  Gene Ontology: Mol. function=DNA binding; Biological process=DNA integration
  Homolog annotation: Hit_ID=Q1SS72; Match level="QueryCoverage=85%, HitCoverage=27%, E-value=2e-18, Identity=37%"; Hit description =Integrase, catalytic region
MVEGLYKLKMIPIKYKYKSDFASSSISNFSAFSYKQFVCETCHYSKQKRLSFPISESHSFCAFALIHVDIWGPCNVTSLNGYKYFLTIIDDYSSTLTTNRKKLDPRTATFVFLGFKPNTKGFIMFALKTKAISVSRNVIFYEDCFPSIGQDKPDVVTILPIPSSHAINQPNGVSLELPVDHIMPVPNNADFDPLTLEQSFNTTRISLRQTHKPSTCLYPLNFVLSYRKFSPSYHNIVLSITQSLEPQSYNEASEDLVWVEAMNAKIKALELNDT

SEQ ID NO: 148656 - protein, 305 aa, Glycine max
  Coding DNA Sequence Number=SeqID_31878
MACCLRYATHWWGKAAIYAENACAIEIIATDVERCFHGALVGIIDGHKRESKGSASNDLENTCNARSDSSTSWVEYSNKYRGRSLQAKDMEEGYSTNKTPLFKGEKEWRLQVITLRVAKNLDSMSIEKLVRTLKVHEQELQQDEGIKNGKSLALSAQKTQKSSISKEFSSISTSREAFNADTSFGDGSDEEESNKNDQLAFISKKIRKKPGHFKFECLNLDKTKDKKNYFKEKDKKVLLSTWEDPDDTSSDEETEEEANFCLMPDTTSKESESDSNEEKLEEGFQNLSKDQTKPKMAHQDINLST

SEQ ID NO: 148657 - protein, 405 aa, Glycine max
  Coding DNA Sequence Number=SeqID_31879
  Gene Ontology: Mol. function=RNA-directed DNA polymerase activity; Cellular component=chromatin; Biological process=chromatin assembly or disassembly
MLSVGLIQLSQSPFSSLVLLVKKKDGSWHFCVDYRALNSLIVKYHFPMPTIDEIMDELGNASWFFKLDLRQGFHQILLAEQDTAKTVFRTHFGHYKYKVMPFGLCNAPSTFRATMNELLKPFIHHFVTVLFDDILVYSPSFEDHLHHLTQSDATQIAFDSLKHAMTQAPVLALPDFSVPFTLETRSSGLDMGVVLMQHGHPLAFFSKTLCPRLQRASTYVLELHAITTAIRKWRQYLLGHPFIILTDHKSLCELMNQVIQTPEQQVYLSKLLGYDYSIQYKSDKANVVVDALSWLPQYSTRQCLILSMPHSVFLATIRDYMRSNNLIQNHIHQVTSLPNPQPDFKFHGRLLFFKNKIWLHSDHPFRTSLIEEFHTTPIGGHMGFAKTLHRLQANFHWSNMRRDVR

SEQ ID NO: 148658 - protein, 323 aa, Glycine max
  Coding DNA Sequence Number=SeqID_31880
  Gene Ontology: Mol. function=zinc ion binding; Cellular component =nucleus; Biological process=regulation of transcription
  Homolog annotation: Hit_ID=Q1SDI6; Match level="QueryCoverage=90%, HitCoverage=71%, E-value=8e-50, Identity=45%"; Hit description=FAR1; Zinc finger, SWIM-type
MVLDYGYFDDVLSLDAIDCFNHYRSFVIFGETLLYDETTESFKWLFKTFLEAHSHKKPKTIFTDQDQAMAEALVEVVEFGEAWTKLIANYNVQENNWINSIYVLKEKLASCYMKEAFTLGMRSTQLSESLNSHFKACMKPNVDIKKFFCHFEGVVEEKHYNELVLFEANDIKVVPEKYILKRWTREGRSGIIHDIRGREVEKDPRLSSTRRYRHLASKLIRVASNVSPSKEYCQLLLLQAQSIDKNKHDAPTLVINDYTQPKGFKQRPSIKRHNQKCLNSWPELQLKRNKKSLTRGQSQSQTSKGCVCAPLDDRDVSTLDDKF

SEQ ID NO: 148659 - protein, 77 aa, Glycine max
  Coding DNA Sequence Number=SeqID_31881
  Homolog annotation: Hit_ID=Q9LUI2; Match level="QueryCoverage=42%, HitCoverage=1%, E-value=9e-09, Identity=66%"; Hit description =Centromere protein
QPLSEQLKPQVPKADELELCPIWQIQYEALAKSKPDVLLFFAEVMPTLSHSESQRSYSWWWDSHLPKNSRWLQEDLA

SEQ ID NO: 148660 - protein, 455 aa, Glycine max
  Coding DNA Sequence Number=SeqID_31882
  Homolog annotation: Hit_ID=Q8L8A8; Match level="QueryCoverage=97%, HitCoverage=69%, E-value=3e-67, Identity=39%"; Hit description =Transcription activator
  Pfam annotation: Domain name=QLQ; Domain location=10-45; Score=63.2; E_value=8.7e-16; Accession=PF08880.1; Description=QLQ
  Pfam annotation: Domain name=WRC; Domain location=79-124; Score=99.4; E_value=1.1e-26; Accession=PF08879.1; Description=WRC
  Pfam module annotation: Pfam domain module=QLQ::WRC; Domain location =10-45::79-124
MHGALAGVRGPFTPSQWMELEHQALIYKYITSNVPVPTHLIPIRKALDSLGFCNFSTGLLRPNALGWGGFHLGFSNNTDPEPGRCRRTDGKKWRCSRDAVVDQKYCERHMNRGRHRSRKPVEGQLGHALTTTTTTNTPNASSNSTVVPRNTTTTTTFAHNNVHHPLPPHSSQANTINRMFTSNKENNSTSERLQDPALPMLPPTLELKPKENNPFMIHKHHIPADEYSRNSNEFGLVTSDSLLNPTQKRSFTSSQKDDSESQQQHSLRHFIDDSPKPQSHNHHHHHHSSSIWPELDSMQSDRTQLSISIPISSSDFMSFTTSSPSNEKLTLSPLGHSRELDPIQMELGMGSGASNEANTRQANWIPITWESSMGGPLGEVLNLSNNSNASDQCGKNNNTSALNLMKDGWDNNPPLGSSPTGVLQKSAFGSLSNSSAGSSPRAENNKEGATLCNAL

SEQ ID NO: 148661 - protein, 121 aa, Glycine max
  Coding DNA Sequence Number=SeqID_31883
  Gene Ontology: Mol. function=alpha-amylase activity; Cellular component=extracellular region; Biological process=carbohydrate metabolic process
  Homolog annotation: Hit_ID=Q2VMU3; Match level="QueryCoverage=55%, HitCoverage=15%, E-value=2e-17, Identity=60%"; Hit description=Alpha- amylase 2
MHGEDEGFGSLISGNNRRDPRDPRYSIEESVTSRHSKYITCENSGGQARPLLCSNLREGVHEDWKWFMVPNCEGMDTINFWSQLRCVAQVVFCWHDPSSPLEYSQIREGNYELLICFSIES

SEQ ID NO: 148662 - protein, 89 aa, Glycine max
  Coding DNA Sequence Number=SeqID_31884
MEVIQVPTFLFIRDGNIEGKGELIGEILRSSFQQTSYFTTSREGNFVRKEQHTIYELAYSVSNCWKQSECWGWDEMQGVGGCYELSSDI

SEQ ID NO: 148663 - protein, 150 aa, Glycine max
  Coding DNA Sequence Number=SeqID_31885
  Homolog annotation: Hit_ID=Q1SCJ0; Match level="QueryCoverage=82%, HitCoverage=32%, E-value=6e-21, Identity=49%"; Hit description=TCP -domain protein
MDMEELELRREMFGEVKMAGWCRCRWRRSQQAPPAGGATRWFHCSTYGPARGADIWMHCPRPSTFVCRSLVEEPPPQPPWRAGRIEWNWTCSVPWRLLRKGKGRRWSMRRFLGLLSSQVAGMGSCSDGGGILASLHDRMERKKIKFGGGV

SEQ ID NO: 148664 - protein, 229 aa, Glycine max
  Coding DNA Sequence Number=SeqID_31886
MDIDADLKMYMDMRSSQGKKLHFGSAGIDTRQIGDKLQHVTFCVSVHNPIPENLKYDRTSFLGQLSVLVLVWNNGFHFSDKEYQVQGHANTYPNPPSLLQIGKTQTHLVKTYFSIKIKALDMSGHEAKLHDESRLIQRCFDDNKDDDKGDDKKLKSQSKNEFKMFNIESRTLQDSRGKLKNTSRFKRKVDFKNQGSSFQESRSRFKTQDSRIKRRLNQDKYEKVFSKTE

SEQ ID NO: 148665 - protein, 543 aa, Glycine max
  Coding DNA Sequence Number=SeqID_31887
  Gene Ontology: Mol. function=protein serine/threonine kinase activity; Cellular component=cytoplasm; Biological process=protein amino acid phosphorylation
  Homolog annotation: Hit_ID=Q2PEW3; Match level="QueryCoverage=82%, HitCoverage=81%, E-value=0.0, Identity=68%"; Hit description =Putative calcium dependent protein kinase
  Pfam annotation: Domain name=Pkinase; Domain location=105-361; Score =316.1; E_value=6.5e-92; Accession=PF00069.15; Description=Protein kinase domain
  Pfam annotation: Domain name=Pkinase_Tyr; Domain location=105-359; Score=-61.7; E_value=1.1e-08; Accession=PF07714.7; Description =Protein tyrosine kinase
  Pfam annotation: Domain name=efhand; Domain location=408-436; Score =34.1; E_value=4.7e-07; Accession=PF00036.22; Description=EF hand
  Pfam annotation: Domain name=efhand; Domain location=444-472; Score =19.9; E_value=0.0092; Accession=PF00036.22; Description=EF hand
  Pfam annotation: Domain name=efhand; Domain location=480-508; Score =33.8; E_value=6.2e-07; Accession=PF00036.22; Description=EF hand
  Pfam annotation: Domain name=efhand; Domain location=514-542; Score =36.5; E_value=9.5e-08; Accession=PF00036.22; Description=EF hand
  Pfam module annotation: Pfam domain module=Pkinase::Pkinase _Tyr::efhand::efhand::efhand::efhand; Domain location=105-361::105 -359::408-436::444-472::480-508::514-542
MKKHKVQIPKQKQEANGQCKLSLLNQKSSGMKMGVGFSKVLTKKPEHEIPINASPDYTPQLTYKQPRKNLLIAPPLPLPPPKPTECCSQTEPVLGKPYVKIKQMYEMKEELGRGKFGVTYLCVEKATGRAYACKSIAKKKPPQEMEDVRMEVVILQHLSEQHNIVEFKGAYEDRKNVHLVMELCSGGELFDRIVAKGNYTERQAAKIMRQIVNVVHVCHFMGVMHRDLKPENFLFATKDEDAPLKLTDFGSSVFFHKGKVCTDFVGNAYYVAPEVLKRSHGKEIDVWNAGVILYILLSGVPPFWAETEKGIFDAILGGKLDMDSEPWPSISEAAKDLVRKMLTCDPKERITAADALEHPWLKEGGEASDKLPDSAVLIRMKRFRAMNQMKKLALKVIAENISEKETKGLIQMFNNMDTDGSGTITFEELKSGLFRLGSLVNESEMKQLMDAADIDKSRTIDYFEFIAATMDRHKVEKEESLFKAFQYFDKDNNGYITRDELREAITEHQGDEAAIDEVFNDVDSDKDGKIDYHEFMTMMKNEC

SEQ ID NO: 148666 - protein, 150 aa, Glycine max
  Coding DNA Sequence Number=SeqID_31888
  Pfam annotation: Domain name=Complex1_LYR; Domain location=79-142; Score=47.6; E_value=4.2e-11; Accession=PF05347.5; Description =Complex 1 protein (LYR family)
  Pfam annotation: Domain name=OS-D; Domain location=72-149; Score= -45.3; E_value=0.014; Accession=PF03392.4; Description=Insect pheromone-binding family, A10OS-D
  Pfam module annotation: Pfam domain module=Complex1_LYR::OS-D; Domain location=79-142::72-149
MAQMNRSLVSLFPLQNTTYSPLPCMIVEEHTKCLRKCANDAFPILIDRVLKMKETLFCLYSGRGWIVSLSLSMDLQDFLIRARVLRLYRQALRIAGRAPSSAKAELRQTIRQEMENNRNCNDKQRIRFLISEGLDKLKRLDEMLDMQGYR

SEQ ID NO: 148667 - protein, 82 aa, Glycine max
  Coding DNA Sequence Number=SeqID_31889
  Gene Ontology: Mol. function=protein serine/threonine kinase activity; Cellular component=cytoplasm; Biological process=protein amino acid phosphorylation
  Homolog annotation: Hit_ID=Q2PEW3; Match level="QueryCoverage=92%, HitCoverage=13%, E-value=6e-27, Identity=71%"; Hit description =Putative calcium dependent protein kinase
  Pfam annotation: Domain name=efhand; Domain location=16-44; Score =34.9; E_value=2.9e-07; Accession=PF00036.22; Description=EF hand
  Pfam annotation: Domain name=efhand; Domain location=51-79; Score =34.8; E_value=2.9e-07; Accession=PF00036.22; Description=EF hand
  Pfam module annotation: Pfam domain module=efhand::efhand; Domain location=16-44::51-79
FIAATIDPHKLEKEEHLYKAFQYFDKDNNGYITRDELSQALTKYQMGDEATIYEVINDVDTDNDGRINYQEFVDMMRGDPGY

SEQ ID NO: 148668 - protein, 287 aa, Glycine max
  Coding DNA Sequence Number=SeqID_31890
  Gene Ontology: Mol. function=glutamate-1-semialdehyde 2,1-aminomutase activity; Cellular component=chloroplast; Biological process =tetrapyrrole biosynthetic process
  Homolog annotation: Hit_ID=P45621; Match level="QueryCoverage=73%, HitCoverage=45%, E-value=2e-89, Identity=75%"; Hit description =Glutamate-1-semialdehyde 2,1-aminomutase, chloroplast precursor
  Pfam annotation: Domain name=Aminotran_3; Domain location=1-218; Score=-89.4; E_value=3.8e-07; Accession=PF00202.11; Description =Aminotransferase class-III
MNMQRFDKIRREEIEILTFLDENGESKTSGFDSCIGMVGGQHEILGLEVSMHDGHEMADANNSICVVEDIVVGNSGFIVPKFEFLDAIRKIAKENNALIIFDEAMTGFRLAYGGAPEYFGIVPDLTTLGKIIGGGLPVGAYGGRRDIMEMVAPAGHMYQAGTLSGNPLAMAAGIETLKLIKEPGTYEYLDKVTGELVQGILQVGKSAGHSMCGGHINGMFGFFFTEGPVFNFADAKKSDLAKFARFYRGMLKQGVYFAPSQFEVGFTSLAHTTEDIKMTIAARYDMI

SEQ ID NO: 148669 - protein, 427 aa, Glycine max
  Coding DNA Sequence Number=SeqID_31891
  Gene Ontology: Mol. function=protein serine/threonine kinase activity; Cellular component=flagellin-based flagellum; Biological process=protein amino acid phosphorylation
  Homolog annotation: Hit_ID=Q7XZK5; Match level="QueryCoverage=83%, HitCoverage=64%, E-value=1e-142, Identity=69%"; Hit description =Calcium-dependent calmodulin-independent protein kinase isoform 1
  Pfam annotation: Domain name=Pkinase; Domain location=77-335; Score =306.3; E_value=5.6e-89; Accession=PF00069.15; Description=Protein kinase domain
  Pfam annotation: Domain name=Pkinase_Tyr; Domain location=77-330; Score=-85.7; E_value=3.3e-07; Accession=PF07714.7; Description =Protein tyrosine kinase
  Pfam annotation: Domain name=efhand; Domain location=382-410; Score =35.4; E_value=2e-07; Accession=PF00036.22; Description=EF hand
  Pfam module annotation: Pfam domain module=Pkinase::Pkinase _Tyr::efhand; Domain location=77-335::77-330::382-410
MGICLSKSNTNEIPFNYDHSPPYHHYQPRRTQQPQQPRYPYHNPNSDPSQSIAPSSSFGDQQARILDKPYFDINVLYTLERELGRDEISITRLCTEKTTRRKYACESIPKQKLSKKKHIDDTKRQVLILQHLSGQPNIVEFKVAYEDRQNVHLVMELCLGGTLFDRITAKGSYSESEAASIFRQIVNVVHACHFMGVMHRDLKPENFLLASKDPKAPLKATNFGLSVFIEEGKVYKEIVGSAYYMAPEVLNRNYGKEIDVWSAGIILYILLSGVPPFWGENDRSIFESILGGQLDLESAPWPSISAAAKDLIRKMLNYDPKKRITAVEALEHPWMKEGGEASDKPLDNVILTRMKQFRAMNKMKKLALKVIAENLSEEETKGLKQMFSNMDIDRSGTISYEELKSGLTKLGSKLSEYEIKQLMAAVS

SEQ ID NO: 148670 - protein, 173 aa, Glycine max
  Coding DNA Sequence Number=SeqID_31892
  Gene Ontology: Mol. function=metal ion binding; Cellular component =integral to membrane; Biological process=ubiquitin cycle
  Homolog annotation: Hit_ID=Q8L9W3; Match level="QueryCoverage=73%, HitCoverage=83%, E-value=4e-29, Identity=46%"; Hit description=RING -H2 finger protein ATL5J
  Pfam annotation: Domain name=PHD; Domain location=115-160; Score= -0.4; E_value=0.062; Accession=PF00628.19; Description=PHD-finger
  Pfam annotation: Domain name=zf-C3HC4; Domain location=116-157; Score= 28.0; E_value=3.4e-05; Accession=PF00097.15; Description=Zinc finger, C3HC4 type (RING finger)
  Pfam module annotation: Pfam domain module=PHD::zf-C3HC4; Domain location=115-160::116-157
  Subcellular localization annotation: CTP_CleavageSite=62; ConfidenceScore=5.37e-01
MDGGGAFGELSLSHAKQQNFKREQRSSQSNANNLSFPYSLPTPTNMLGSVLLAVFLPCIGMSAALIVYMCLLYYFTDHFSDPALPAKPASDSGLSPSQLDKLPRITGKELVMGNECAVCLDHIGTEQPARLVPGCNHAFHLECADTWLSEHPLCPLCRAKLDPALFSSSQNPC

SEQ ID NO: 148671 - protein, 87 aa, Glycine max
  Coding DNA Sequence Number=SeqID_31893
  Gene Ontology: Mol. function=nucleic acid binding
  Homolog annotation: Hit_ID=Q2RA28; Match level="QueryCoverage=57%, HitCoverage=18%, E-value=1e-13, Identity=76%"; Hit description =Expressed protein
MDRYQKVEKPRAETPIDENEIRITSQGRMRNYITYAMSLLQPFVFGYDEIVCFGFWSEWEGSVCVVGGVPYPTCLYFYFSLLNKKRR

SEQ ID NO: 148672 - protein, 71 aa, Glycine max
  Coding DNA Sequence Number=SeqID_31894
MAKEDSTLPSLSSGLAYCCSMVVLRVLDWKLRSVDVLLLVLSEEKAMPGRRRIGAGRGRCSASGKCTGSHK

SEQ ID NO: 148673 - protein, 390 aa, Glycine max
  Coding DNA Sequence Number=SeqID_31895
  Gene Ontology: Mol. function=protein binding; Cellular component =protein complex; Biological process=isoprenoid biosynthetic process
  Homolog annotation: Hit_ID=P93768; Match level="QueryCoverage=85%, HitCoverage=65%, E-value=1e-113, Identity=66%"; Hit description =Probable 26S proteasome non-ATPase regulatory subunit 3
MVGLTLFFDKQTHKMSEDVEMKDQATPSHSLSSVPPSALQHLKEIASIIETGSYSKEVRRIARALRLTFALRRKLTAPVLSSFLDYVLPPASEPHTRLSSFLPNPKEGDREMEVDSSTSTIQTPAAKHLLPELEIYCYLLVLLFLIDQKRYDTAKACSSASIVRLKSLNRRTVNVIASRLYFYYSYSYELTGNLAEIRGNLLALHRIATLRHDELGQMGHVLYLPGDVMQETLLNLLLHNYLHYNLYDQAEKLRSKAPRFEAHSNQQFCRYLFYLGKIRTIQLEYTDAKDLLLQAARKAPSAAQGFQIQCNKWAVIVRLLLGEIPERIIFMHRGMEKSLRPYFELTNKMGEKSQFYPQKPLNKDVSGVEMVFESHHGSAAKAHRKPLFCA

SEQ ID NO: 148674 - protein, 369 aa, Glycine max
  Coding DNA Sequence Number=SeqID_31896
  Homolog annotation: Hit_ID=Q10RR9; Match level="QueryCoverage=90%, HitCoverage=88%, E-value=2e-17, Identity=25%"; Hit description =Expressed protein
  Pfam annotation: Domain name=DUF677; Domain location=47-362; Score= -89.2; E_value=3.1e-06; Accession=PF05055.3; Description=Protein of unknown function (DUF677)
MLDFIGRSRKECEEDRLCKKQSVNEEYLEAFRTKSYIEICNKAQGGIGKTSTKMLTSSSSSSIPLCMQLTEYLLEPRQEMIANITQRLKLHHLLVDYFEASLEACRCCDTILEAIHSMRLSYRRITRIVKLSKTVLDDDDTKGVIYRELASFALQNNPLSVAISSVKFRDIHDRYVELLKRLKSTSKEIRRRLTLKRVCKKVAGIALITSHSVVLVALLVFAFHSIVGLVAAPSIVGGLVGLFVKKGRQRFMSISSNNNNNNCEERLCEQLDLAAKGVYVLINDLDTMSRMVKRLNDEVEHRKVVAEVCVRNGKSEILLKQVMRDFHEHESSFLEQLEELEGHIYLCFLTTNRSRRLVVQQITDKKVKH

SEQ ID NO: 148675 - protein, 1071 aa, Glycine max
  Coding DNA Sequence Number=SeqID_31897
  Gene Ontology: Mol. function=DNA binding; Cellular component=nucleus; Biological process=transcription
  Homolog annotation: Hit_ID=Q53J12; Match level="QueryCoverage=98%, HitCoverage=83%, E-value=2e-19, Identity=24%"; Hit description=BAH domain-containing protein, putative
MTLEDFFTLTEMKDGLMAPSRVQELVSVMKKEQDCVAKNAGDTTRQWAAVASTIAATENKDCLDFFIKLDGLGFINKWLKDTLNLGADNTNDGFIEESITAMLRAIEKLYLDSEKSISSGISVTVSNLLGHRSSKVQDRARVLFDRWKGGGDGDAEPTDNSDLGRINNVSDEIVSEKGQPSSVNEAGNEDDHVSQPAGGEKSLLGGSDSQLQEKVSSIQIQSADNALQSSVRLDCEDAKERSNHVDSVLASVQEVANINEGGTTSAGTCNLPVNKQDSFKGQQDDLELNDLSKKEMQDENVNDPPEELRASDISLASAKPEPEPVSIGDSEAKALESVKEEPALEHNAESNENIICPKINVSGSMRTPASDGISVGDDVRAINSSNPQLPKASENDDCCSQALQDLSVTSSHLEKPEMSFLKTQYVGAVKESKGQESDQDDDTSDGSDSSNQGKGPTSPNIIDKNSDMELEYGIVDALEVARLVAQEVERECVSPIKQGHGQVSYKVNSTTNGSDSFKWGNGPKSPNVIDKSSDIELEYGIVDALEVARQVAQEVEREVCSSSSEKISEGGIRQAASPDFVGRKDEVTRVLHEEVSSRQSNSDEVCSEEAGHMSVSDNIEAGQDDLESSQVTEAARDPGGNSEKSLCTFDLNEEVGSDDMDVSVNAMSTMPIPVVSASKPALTSWLPMAPLQFEGTLGWKGSAATSAFRPASPRKNSDNEKNVSVGGNSSEISKQRQDCLDFDLNVAEGEEGLLKQIGESSGLPSGQSSVELSPKRSSRFKLDLNSIGDDGDAQPSDQRMEGPLFPRRNGYWSPSPASSSSSMQPLVRNIDLNDRPFFQTDLVDQGLSKSSSIIEAYKQSKSDAPVISILGAKVEVGTREYIPQTLSFPNGKAIEPAMDLPLSGAGSVLGMGPTLSYNHSTAFGYNGLTSVPALSFSPAMYGSPGGPIPYMVDSRGSPVVPQVGGSSSTALSSYSQPPFIVSITGTQLGLNGVGSSRPNFDLNSGFTIDGGNRDMLTARQFFFPAQGRAMEDHVRTLPQSSSSGVSVKRKEPDGGWDTYPLSYKHQQPPWK

SEQ ID NO: 148676 - protein, 437 aa, Glycine max
  Coding DNA Sequence Number=SeqID_31898
  Gene Ontology: Mol. function=kinase activity; Cellular component =integral to membrane; Biological process=calcium-mediated signaling
  Homolog annotation: Hit_ID=Q1T680; Match level="QueryCoverage=99%, HitCoverage=75%, E-value=0.0, Identity=74%"; Hit description=C2
  Pfam annotation: Domain name=C2; Domain location=136-220; Score =111.9; E_value=1.8e-30; Accession=PF00168.20; Description=C2 domain
  Pfam annotation: Domain name=C2; Domain location=294-402; Score=29.7; E_value=1e-05; Accession=PF00168.20; Description=C2 domain
  Pfam module annotation: Pfam domain module=C2::C2; Domain location =136-220::294-402
MAGMKVYVTDEKELIMEPSVKWAGNPNIIVAIKAFGLRATVQVVDLQVFAAPRITLKPLVPSFPCFANIYMSLMEKPHVDFGLKLLGADAMSIPGLYRIVQEIIKDQVANMYLWPKALEVQIMDPTKAMKVPVGILHVKVVRAEKLKKKDLLGASDPYVKLKLTEEKLPSKKTTVKYKNLNPEWNEEFNVVVKDPESQVLELTVYDWEQIGKHDKMGMNVIPLKEITPDEPKVVTLNLLKTMDPNDPENEKLRGQLTVEVLYKPFKEDELPQSTEDSNAIEKAPEGTPASGGLLVIIVHEAEDVEGKHHTNPYVRLLFKGEERKTKRINLTLDSEVLARAKNKGSRNENVEHVKKNRDPRWGESFQFMLEEPPTNERLYVEVQSASSKLGLLHPKESLGYVDIKLSDVVTNKRINEKYHLIDSRNGRIQIELQWRTP

SEQ ID NO: 148677 - protein, 109 aa, Glycine max
  Coding DNA Sequence Number=SeqID_31899
YGKTENSKQYPPLQRHTFVKWWSQFDTSKAAPEQVKNWFQSNPEFLKPADPETSLFLNQKSQLVAFLASSKSKESLTQNLKEMFEQYFLEVQQSNILVEWYCSSKTRGG

SEQ ID NO: 148678 - protein, 188 aa, Glycine max
  Coding DNA Sequence Number=SeqID_31900
  Gene Ontology: Mol. function=endonuclease activity
  Homolog annotation: Hit_ID=Q1S9P8; Match level="QueryCoverage=50%, HitCoverage=25%, E-value=1e-37, Identity=79%"; Hit description =Endonuclease/exonuclease/phosphatase
MKKDNQVPKKIMITFADADCNCLQGSGYAPQVGLAEHFKVKFWEDLEGVLQDIPQGEKVFLGGDLNGHVGSVARGFEGVHGGFGLGEMNGEGKSILEFSEALDLSIANTWFKKREEHLITYKSGGTCSQIDFFLIRKSDRKYCLNCKVIPGESLTTQHRVLVMDVRIRDRAKRRSPMVAPRIKWWHLK

SEQ ID NO: 148679 - protein, 392 aa, Glycine max
  Coding DNA Sequence Number=SeqID_31901
  Gene Ontology: Mol. function=oxidoreductase activity; Cellular component=cytoplasm; Biological process=lignin biosynthetic process
  Homolog annotation: Hit_ID=Q1S8H7; Match level="QueryCoverage=98%, HitCoverage=98%, E-value=1e-166, Identity=74%"; Hit description =Alcohol dehydrogenase superfamily, zinc-containing
  Pfam annotation: Domain name=2-Hacid_dh_C; Domain location=183-308; Score=-97.6; E_value=0.044; Accession=PF02826.9; Description=D -isomer specific 2-hydroxyacid dehyd
  Pfam annotation: Domain name=ADH_N; Domain location=36-152; Score =112.9; E_value=9.2e-31; Accession=PF08240.2; Description=Alcohol dehydrogenase GroES-like domain
  Pfam annotation: Domain name=ADH_zinc_N; Domain location=213-348; Score=100.9; E_value=3.7e-27; Accession=PF00107.16; Description=Zinc- binding dehydrogenase
  Pfam module annotation: Pfam domain module=2-Hacid_dh_C::ADH_N::ADH _zinc_N; Domain location=183-308::36-152::213-348
MAESRANHTVSVSGWAAHDSSGKITPYSFKRRQNGVNDVTIKILYCGICHTDLHCAKNEWGITMYPVVPGHEIIGEVTKVGTNVKGFMEGDRVGVGCLAASCLECHHCKTDQENYCQDLQFVYNGIFWDGTITYGGYSQIFVADYRRHYLEIHVAFKGMAVVVEGNQYKPHYTAWQYVVHIPASLPMDAAAPLLCAGITVFSPLKEHDLVATAGKRIGVVGLGGLGHIAVKFGKAFGHHVTVISTSPSKEPEAKQRLGADHFILSSNPKQLQAARRSMDFILDTVSAEHSLLPILELLKVNGTLFLVGAPDKPLQLPAFPLIFGKRSVKGGIIGGIKETQEMLEVCAKYNITSDIELITPDKINEAMERLAKNDVRYRFVIDIANAVTSNNN

SEQ ID NO: 148680 - protein, 518 aa, Glycine max
  Coding DNA Sequence Number=SeqID_31902
  Gene Ontology: Mol. function=RNA binding; Cellular component =ribonucleoprotein complex; Biological process=RNA processing
  Homolog annotation: Hit_ID=Q1S8H3; Match level="QueryCoverage=79%, HitCoverage=90%, E-value=1e-91, Identity=44%"; Hit description=RNA -binding protein Lupus La
  Pfam annotation: Domain name=Extensin_2; Domain location=1-396; Score= -141.8; E_value=0.094; Accession=PF04554.4; Description=Extensin-like region
  Pfam annotation: Domain name=La; Domain location=389-446; Score =113.9; E_value=4.7e-31; Accession=PF05383.7; Description=La domain
  Pfam module annotation: Pfam domain module=Extensin_2::La; Domain location=1-396::389-446
  Subcellular localization annotation: CTP_CleavageSite=69; ConfidenceScore=5.72e-01
MVTAAKSSNHHSPPSAPSPAQPSDANSPKFRRKNLPSPWVQLVHGGEPQPGSGIHQSPPSSSSSSSSLVADQAPEVDNSNTVGDVDSSDGAEGNADRSKKLVWNKPSNGVVVETGPVMGAAESWPTLLASTKGSAKLPPESSSNTVIDYGSLSTSPQGPMASQSPQKQATTNAKPNSAPNYNVPGRQRSMKRVGGSSSTVSDPSQGNFSNPPPPPPPPPFPVYQLPPVSYCNMVPGVPDPAPRDHYRNNNWDAGPMVGGFVPAMNGYRGSSRRGYFGPHPRGDGSYHNSYGSRRDHQDRGNYVNTRDAFVPQPRMPPRGLPRHTPPPTTAAAFVGPQPIGPFAKPIGFPEFYYYQPVTVEQFTGMSFFAHSPPPTPFFSAAESPLSNMIVYQIEYYFSDANLVKDAFLRSKMDEQGWVPVTLIADFPRVKSLTTNIQLILDSIRTSAIVEVQGDKLRRLNEWKRWLSSTQRGSTSPIGSRYNNLTTNLQTIKLEETIKDEDPRMSNGGDATGSSSGNN

SEQ ID NO: 148681 - protein, 190 aa, Glycine max
  Coding DNA Sequence Number=SeqID_31903
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLELNDLDRSMKTQQTDKLSQLDEQNPRKHMKKDSGTN

SEQ ID NO: 148682 - protein, 48 aa, Glycine max
  Coding DNA Sequence Number=SeqID_31904
MSLFQGNMQNSCKYKVSMVVKGEEKEGKVAGSIPHANKTNILITNICQ

SEQ ID NO: 148683 - protein, 1250 aa, Glycine max
  Coding DNA Sequence Number=SeqID_31905
  Gene Ontology: Mol. function=DNA binding; Cellular component=beta -galactosidase complex; Biological process=DNA integration
  Homolog annotation: Hit_ID=Q1SNS9; Match level="QueryCoverage=57%, HitCoverage=82%, E-value=0.0, Identity=79%"; Hit description =Integrase, catalytic region
  Pfam module annotation: Pfam domain module=RVT_2::Retrotrans_gag; Domain location=756-1011::95-209
MAEKKDDGNKISDESNKDESGSHLKKQISPYDLYSSDNPGNIITQVQLKGENYDEWARAVRGSLRARRKFRFVDGSIKKPDDAAPEIDDWWTVNSMIVSWIFNTIEPKLRSTITYRENAQELWDDINQRFSISNGPRIQQLKSELANCKQNGDSIVTYFGRLKKLWDELNDFDQIPMCTCNGCKCGISAALNKKREEEKLHQFLMGLDDTQFRTVRSNVLSLDPLPNLNRAYQMVVQEERVGVMTRGKEERGDPIAFAVKSGRTSSWEKKPNTGSEKPCSHCKRDGHDIDSCFQLVGYPDWWGDRPRSVGRALGRGKHVHRPMSGALKGRGNNAKVNMTQVVDDTEVMKYEDDQVLPGLSSKQWNALLNAINTQKGGTSTRLTGENSWIIDTGASHHMTSTLACMNDVRDIEPCPVGMPNGTRTYATKEGMVTVGDKLMLKHVLFVPNLNCNLISISQLLHDADYIVHFTKTMCVIQDRTSRMMIGAGEQSEGLYVLSVVTPVRAYQANGIRFCELWHRRMGHPSSKITTNLPLKFWGERILTAAYLINRTPSALLDGKTPYEVLFDAKPAYTQIRTFGCYPYGKKGWEMYDIETEEYFVSRNVNFVEDIFPFSSNDKVSETHVDEWGWPLDPIDECEERNETRNVVTTNDLGAVVVGNDVQDIENHEEVHVMEQQTETIEDVDQGERLDSQQSIRSDELLGRGHRIKNPSTRLKDHVTHTATVSLSTSSPLHSKSSGYEPNSFAEAVKDEKWRNAMKEEIQALEDNGTWTTEDLPLGKKAIGCKWIYKIKYNSDGSIERHKARLVIHGNRQVEGVDYNETFAPTAKMVTVRTFLAIAAAKNFQLHQMDVRNAFLHGDLEEEVYMKLPPGFEKKSPGKVCRLRKSLYGLKQAPRCWFAKLSDALKTYGFEQSYSDYSLFMLRRRNTELYVLVYVDDIVISGNQSDAIHKFRDYLGHCFHMKDLGKLKYFLGIEVARNATGIFLSQRKYALDLISDCGLLGAKPATIPLEQNHQLALVEGEGIKDPTGYRSLIGRLIYLTITHPELSYCVHILAQFMQAPKIEHWNAALRVVRYLKGNPGQGILLRTDCDLRLYGYCDADWAGCPLTRRSLTAYFVMLGSSPISWKTKKQTTVSRSSAEAEYRSMAAATCELKWLKGLLSSLGVEHTDPMQLYCDSQSALHIANNPVLHERTKHIEVDCHFVRDEIVKGSIQPLYVHTSKQLADILTKALGKRQFDSLLSKLGVLHLHAPT

SEQ ID NO: 148684 - protein, 80 aa, Glycine max
  Coding DNA Sequence Number=SeqID_31906
MAVRIHKRALSILKGHNGDCRNVPFCGRARARLTGALSKGGKVRGVATNVYLWKTSGKPKETGQNENSKFGSYIYALGKY

SEQ ID NO: 148685 - protein, 117 aa, Glycine max
  Coding DNA Sequence Number=SeqID_31907
MNENKETFKFIDIQRITINNTKKEPMDNNTMKEKERECVKSLKAFEVLNKCGTTLNTNKSEARDPRHINPSKAARKTREKIGSKGLPVWGRKRRRRVQQWRRLREQQGEDVEELFFW

SEQ ID NO: 148686 - protein, 98 aa, Glycine max
  Coding DNA Sequence Number=SeqID_31908
MAGTPHVGLDPYPPGLDHVSIFTPSSSMCPVLEARGLSTFLDQIMSRPLCPQPLCALRLRLRGCDVAPYGACRPWIFFINGVLCFLKINGSGMEKEER

SEQ ID NO: 148687 - protein, 33 aa, Glycine max
  Coding DNA Sequence Number=SeqID_31909
RKFSSTVLRKGIDSPIPTEETAIRQGDSELRSL

SEQ ID NO: 148688 - protein, 333 aa, Glycine max
  Coding DNA Sequence Number=SeqID_31910
  Gene Ontology: Mol. function=protein binding; Cellular component =integral to membrane; Biological process=xylan catabolic process
  Homolog annotation: Hit_ID=Q1SWI7; Match level="QueryCoverage=96%, HitCoverage=99%, E-value=4e-84, Identity=36%"; Hit description =Leucine-rich repeat
  Pfam annotation: Domain name=LRR_1; Domain location=152-174; Score =8.1; E_value=8.7; Accession=PF00560.23; Description=Leucine Rich Repeat
  Pfam annotation: Domain name=LRR_1; Domain location=176-198; Score =15.0; E_value=0.28; Accession=PF00560.23; Description=Leucine Rich Repeat
  Pfam annotation: Domain name=LRR_1; Domain location=200-222; Score =16.0; E_value=0.14; Accession=PF00560.23; Description=Leucine Rich Repeat
  Pfam annotation: Domain name=LRR_1; Domain location=224-245; Score =6.8; E_value=15; Accession=PF00560.23; Description=Leucine Rich Repeat
  Pfam annotation: Domain name=LRR_1; Domain location=30-53; Score =11.5; E_value=2; Accession=PF00560.23; Description=Leucine Rich Repeat
  Pfam annotation: Domain name=LRR_1; Domain location=55-77; Score=9.5; E_value=4.7; Accession=PF00560.23; Description=Leucine Rich Repeat
  Pfam annotation: Domain name=LRR_1; Domain location=6-28; Score=10.5; E_value=3.1; Accession=PF00560.23; Description=Leucine Rich Repeat
  Pfam annotation: Domain name=LRR_1; Domain location=79-101; Score =16.3; E_value=0.11; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=152-174::176-198::200- 222::224-245::30-53::55-77::6-28::79-101
MGSLAELQSLQIRNNTLSGIFPTSLKKNNQLISLDLGENNLSGCIPTWVGEKLLKVKILRLRSNSFAGHIPNEICQMSHLQVLDLAENNLSGNIPSCFCNLSAMTLKNQSTDPSIYSEAQYVGSSYSSIYSMVSVLLWLKGRGDEYRNILGLVTSIDLSSNKLLGEIPRKITNLNGLNFLNLSHNQLIGHIPQGIGNMGSLQSIDFSRNQLSGEIPPTISKLSFLSMLDVSYNHLKGKIPTGTQLQTFDASSFIGNNLCGLPLPINCSSNGKTHSYEGSHGHGVNWFFVSATIGFVVGFWIVIAPLLICRSWRYAYFHFLDHVWFKLQSFRSG

SEQ ID NO: 148689 - protein, 56 aa, Glycine max
  Coding DNA Sequence Number=SeqID_31911
MGARDKSIMHKGNKNLVSDPGSVVVVGPDPWPPHSSPVQECLLEMPVWNQCFPSLF

SEQ ID NO: 148690 - protein, 173 aa, Glycine max
  Coding DNA Sequence Number=SeqID_31912
  Subcellular localization annotation: CTP_CleavageSite=36; ConfidenceScore=5.03e-01
GLAVTIRGAKRARTRPAEAPSTSTTLLPARTLTAPSASAPADFQCFEAMLQSIHQGQIILLQSLQMVAPPDTIPSIEQFNEWEAWPVTQSSLHKEDEGPTAQVPQQMEDESSETTIPEPLVRRKKADQTQEVAATFDKSLQATSEPSVPVADTASLQQATYPSTPVLDQVASE

SEQ ID NO: 148691 - protein, 67 aa, Glycine max
  Coding DNA Sequence Number=SeqID_31913
MTRGILKRTQHSDEDTTKGKDHEALEGPMTRGRLKQVDSLWRHRDLSSTFGSGVPLRQQSCIKRSAS

SEQ ID NO: 148692 - protein, 137 aa, Glycine max
  Coding DNA Sequence Number=SeqID_31914
  Gene Ontology: Mol. function=hydrolase activity, acting on ester bonds; Biological process=lipid metabolic process
  Homolog annotation: Hit_ID=Q1S8F9; Match level="QueryCoverage=86%, HitCoverage=36%, E-value=6e-51, Identity=78%"; Hit description =Lipolytic enzyme, G-D-S-L
RTLAGGLTRKCSEKYNYAARLFNSKLSKELDSLGHNLSDTRIVYIDVYSPLLDIIDNYQKYGYKVMDRGCCGTGKLEVAVLCNPLDDTCSNASEYVFWDSYHPTEGVYRKIVNHVLEKFNIHSRHRSISGTFQIFPL

SEQ ID NO: 148693 - protein, 280 aa, Glycine max
  Coding DNA Sequence Number=SeqID_31915
  Gene Ontology: Mol. function=hydrolase activity, acting on ester bonds; Cellular component=nucleus; Biological process=lipid metabolic process
  Homolog annotation: Hit_ID=Q1S8H0; Match level="QueryCoverage=99%, HitCoverage=75%, E-value=3e-80, Identity=54%"; Hit description =Lipolytic enzyme, G-D-S-L
  Pfam annotation: Domain name=Lipase_GDSL; Domain location=34-273; Score=74.5; E_value=3.4e-19; Accession=PF00657.12; Description=GDSL -like LipaseAcylhydrolase
MDKVLWERLVMVVFVFFAIPFPKVLVVNGAIPALFAFGDSILDTGNNNNILAITKCNFPPYGRDFPGGIPTGRCCNGKIPTDLIASALGIKETVPAYLSGNLSPQDLVTGVCFASAGSGIDDATSRLQGVVSLPSQLRLFQEYIGKLTALVGQQRAADIISKSVFLVSAGNNDIAITYSFLLAPTLQPFPLYSTRLVTTTSNFFKSLYELGARRVWVLSTLPLGCLPGGSTVAGGPLRICAPFANQFAQTFNGQLSSAVDSMRVPFPIMTLGSSMSTLLY

SEQ ID NO: 148694 - protein, 131 aa, Glycine max
  Coding DNA Sequence Number=SeqID_31916
GVTQSAHTLPKFTERESHPYADIPLGWKPLNLERYDGTTVPDEQIDAFLTLANLYTNDDAILCHVFPIFLKGAALTCGLSAHPPLSATEESGRAAASRPRAKRKISVLSAADVFSQAQRMTGAKLESTYPR

SEQ ID NO: 148695 - protein, 102 aa, Glycine max
  Coding DNA Sequence Number=SeqID_31917
  Gene Ontology: Mol. function=hydrolase activity, acting on ester bonds; Biological process=lipid metabolic process
  Homolog annotation: Hit_ID=Q1S8F8; Match level="QueryCoverage=79%, HitCoverage=95%, E-value=1e-33, Identity=78%"; Hit description =Lipolytic enzyme, G-D-S-L
MALMQLTSSHVALLLRFIVIFALCYRTMALVKLPPNASSVPAVLAFGDSIVDSGNNNNIKTLIKCNFPPYGKDFQGGNPTGRFCNGKIPSDLIVPCMKTLKV

SEQ ID NO: 148696 - protein, 75 aa, Glycine max
  Coding DNA Sequence Number=SeqID_31918
MQKGVIVDLRNWDREKTENKLERVFRSLAYRVELLEANTEPMTEKKSVSVSEVNEREREREGGDWRGMSERKKKL

SEQ ID NO: 148697 - protein, 273 aa, Glycine max
  Coding DNA Sequence Number=SeqID_31919
  Homolog annotation: Hit_ID=Q2QXS5; Match level="QueryCoverage=28%, HitCoverage=10%, E-value=1e-26, Identity=75%"; Hit description=Heavy metal-associated domain containing protein, expressed
  Pfam annotation: Domain name=HMA; Domain location=13-73; Score=56.9; E_value=6.6e-14; Accession=PF00403.16; Description=Heavy-metal -associated domain
MSKEEFLKIQKCVLKVNIHCDGCRNKVKKILQKIDGVFTTEIDAEQGKVTVSGNVDPNVLIKKLAKSGKHAELWGAPKGNSNNNQNNMANQFKNMQIDNGKSGANNKGQKGGGVNNQPKGNNQQQQNPQQQQNPQQQLQQHLQQLQQMKGFQDLKLPQFKDMKLPNPNPNPNPKAVKFSLPEDDLSDDELDEFDDEFDDEFDDDDMDDPQHPLNKMMMMKPPMGAKPPIGSVPMGNGAQMMSNSMMNAQKGGNGGGNNGKKGGGGSGGPVPVQ

SEQ ID NO: 148698 - protein, 349 aa, Glycine max
  Coding DNA Sequence Number=SeqID_31920
  Gene Ontology: Mol. function=receptor activity; Cellular component =mitochondrion
  Homolog annotation: Hit_ID=Q5Z9P3; Match level="QueryCoverage=73%, HitCoverage=44%, E-value=3e-48, Identity=41%"; Hit description =Receptor-like protein kinase-like
  Pfam annotation: Domain name=DUF668; Domain location=95-180; Score =142.8; E_value=9.5e-40; Accession=PF05003.3; Description=Protein of unknown function (DUF668)
MKHVFCEISTSLNLSLNSKRIIFLIFGDSLTAFQIEIKHQRKLVRSLKKKSLWSRNLVEIVEKLVEIVTHIDQAILEFLGDHGATAVKHCNGSERLGEAGLSLHYANIINQINMIASRPTVLPPNIRDTLYHGLPNNIKSALPSRMQSIDAMKELSITQVKAEMDKTLQWLNPFATNTTKAHQGFGWVGEWANTCNEFGENMARESNLIRLQTLYYAEKQKMDFYIIELLTHLHYLVTFVRYRHNTMRPMPTRTSPRRLDFQSNMLQFISLDSINKPLGSKLSQEDKRLLEEVTMRKRSPGVSKSENLEVTKKRSAKVWHHSNSVGSSPVTREGLEHQRSNVLDIIDGL

SEQ ID NO: 148699 - protein, 266 aa, Glycine max
  Coding DNA Sequence Number=SeqID_31921
  Gene Ontology: Mol. function=metal ion binding; Cellular component =nucleus; Biological process=ubiquitin cycle
  Homolog annotation: Hit_ID=Q8RUJ8; Match level="QueryCoverage=76%, HitCoverage=47%, E-value=5e-58, Identity=53%"; Hit description =Putative hydroxyproline-rich glycoprotein
  Pfam annotation: Domain name=zf-C3HC4; Domain location=211-249; Score= 27.3; E_value=5.6e-05; Accession=PF00097.15; Description=Zinc finger, C3HC4 type (RING finger)
MVFHFVILVAAISLCIRNPEMHLLFDLSLSFFSYFEIGFEELRSTSSPHPSCFICSSCITILYFAKEEEKCRFVPLYPEAFQPVRIPFQKGVGQKFAQPSGTGIDLGFFELDDLSKPSPGEDVFPLVICAETSLKTTSEDETPGDSLLDASPHMQITQGVLEKSNGAGPFLIKVVKQILWIDGVRYELRELYGIGNSSAADFDDNDPGKECVICMTEPKDTAVLPCRHMCMCSECANAHRLQSNKCPICRQSIEELIEIKVNNGDH

SEQ ID NO: 148700 - protein, 170 aa, Glycine max
  Coding DNA Sequence Number=SeqID_31922
MKIGVMVVDLEAQGVFVDIDVVPYLLGGLVVDDEGRATRRAGAGAGGGSNAAGSESEGREWECRRNWGWSCNRKKLSGFVMLASAAWEGEGRKGLLKGESNLAAAVVVQGGILYGSSKKGVEVVVGFGVLLLLRETELSEAESLTIDPIPPSSDLSAATVYRTSLPSLAP

SEQ ID NO: 148701 - protein, 221 aa, Glycine max
  Coding DNA Sequence Number=SeqID_31923
  Gene Ontology: Mol. function=iron-sulfur cluster binding; Cellular component=integral to membrane; Biological process=electron transport
  Homolog annotation: Hit_ID=Q8H3D8; Match level="QueryCoverage=85%, HitCoverage=68%, E-value=1e-61, Identity=64%"; Hit description =Integral membrane protein-like
  Pfam annotation: Domain name=SNARE_assoc; Domain location=11-131; Score=143.1; E_value=7.4e-40; Accession=PF09335.1; Description=SNARE associated Golgi protein
MEAQQLEEDNNIREKGFGLGGGYLFGLPVGFVADSIGATVGAGAAFLLGRTIGRSFVVSRLKDYPQFRSVAIAIRRSGFKIVLLLRLVPLLPFNMLNYLLSVTPVSIGEYMLASWLGMMPITLALVYVGTTLKDLSDVTHGWGEFSKTRWAFIILGLVISVVLMICVTKVAKAALDKALAENEDIDGITSSPDLPIVAEPSADLNQPLIIKIDSSEDSHEK

SEQ ID NO: 148702 - protein, 97 aa, Glycine max
  Coding DNA Sequence Number=SeqID_31924
  Gene Ontology: Mol. function=catalytic activity; Biological process =metabolic process
MNAKRREDMVDVLSKRRILAWHRESQGNRDTTAYTTIPDHSIQSTAQGMTSAVLRVPLRPHPINALRAQTVFLEEEYHRHERRVASSRMEFQELSGG

SEQ ID NO: 148703 - protein, 594 aa, Glycine max
  Coding DNA Sequence Number=SeqID_31925
FVMPEKVESHRALWSSSIHWRFGLLTALVLGGMVVVWTIDGFTVRNVIEAWSWSSPYGPLSLNQNQTNATTLFGPHNLVNITLSEHSETVSAKNYSSSGVSDKLDTKTPLKPEVKGHSTWLSSELEPNLTSSLLARWLAPGGEPCKDSKTVGISIPGLDDGKLIELSAGEVHEFGFQALDDLGKPRCLGGDYFETDLAGESWKSRPLVKDFSNGSYSISLQVHPDFVGVYNLTVILLYRHFEGLKFTPWRFVYDRVVWNVAIRFYKSSAQLPELETCKASDFGKDVWCGRWTRHAKNDGCQIGNDGRYRCLAPDFPCNAPWCDGSLGVIESNGWVYSTHCSFKMFSAESAWKCLKNRWIFFWGDSNHVDTIRNMLNFVLDLPNIHSVPRRFDMNFSNPKDPSQTVRITSIFNGHWNETQNYLGLDSLRDKGFQNLLKKYFSEDTIPDTVIMNSGLHDGVHWRNIRAFSAGADYAASFWGDVMISVKQRGLAWPRVFYRSTVATGGYARSLAFNPYKMEVFNGVLIEKLKKAGIITGVIDDFDMTFSWHFDNRCNDGVHYGRAPAKMKWRDGKIGHQYFVDLMLAHVLLNALCAR

SEQ ID NO: 148704 - protein, 36 aa, Glycine max
  Coding DNA Sequence Number=SeqID_31926
MRTINVSGGGSDDNYDSGYDSGSKDDEDLDSKGGDE

SEQ ID NO: 148705 - protein, 178 aa, Glycine max
  Coding DNA Sequence Number=SeqID_31927
MDDVSLSCDDSLHSESLLHGTTTNMVTNMQRLTWLWGDAIDDEEIPNKGSPINTMNNVTPWHLLGYFKAVMGAHERGVVSYLFPSFALNSTLRQSIFMELYFMPHSPQIINRSHSLAFVMEACLWGFYGGWIFELQWGPLMVIFHHGDAAEDKGKELGEDASMEEKKEGEKEGGGARN

SEQ ID NO: 148706 - protein, 108 aa, Glycine max
  Coding DNA Sequence Number=SeqID_31928
MMKHGCSSKLHTKEEKEVAKMLLEFQHSEPPLLNWGRKRKRSAVQDCFSPSLVFLQNHSRHTRTVMKKVLLKTENASSPDTPLSFHPDENPNLSIKQQSPKKELDSIQ

SEQ ID NO: 148707 - protein, 155 aa, Glycine max
  Coding DNA Sequence Number=SeqID_31929
MVVTNFHFDLQLINGQKSEPTLEFGGSMLQSVHVNGSVNPSGSKAQNEKLLMMPFQNQISGATQSERFLVSGHPTTSLQVPLTSSNGLGHEAHLAHPGLNTNPVEFTQINSSQSQPLDEATANRELNRALAAEARRRRILIFRLKYSQKSRNDYR

SEQ ID NO: 148708 - protein, 130 aa, Glycine max
  Coding DNA Sequence Number=SeqID_31930
  Subcellular localization annotation: CTP_CleavageSite=39; ConfidenceScore=5.05e-01
MKNGGKPSRNRPRKRLGSFTEVPRLGFSSQKQFFSLILSDSQIPGGGKEGGGCRSARPSELGCFHQKAPPSVGTSWKSQVGLIAIYCALMLPFDSRHVAELHGSPNNGCQVPRSGQAKVASHKQMVPRRN

SEQ ID NO: 148709 - protein, 163 aa, Glycine max
  Coding DNA Sequence Number=SeqID_31931
  Gene Ontology: Mol. function=GTP binding; Cellular component =intracellular
  Homolog annotation: Hit_ID=Q10C01; Match level="QueryCoverage=70%, HitCoverage=30%, E-value=1e-33, Identity=64%"; Hit description =GTP1/OBG family protein, expressed
  Pfam annotation: Domain name=MMR_HSR1; Domain location=41-157; Score =64.0; E_value=4.8e-16; Accession=PF01926.13; Description=GTPase of unknown function
MPQHKRKKMMALPTNVMRDDSDKVLIHGQPGEEVNLELILELLLTLGLPNAGKSTLLAAITLAKPDIADYPFTTLMLNLGRLGGDPSFGAGMYSSEATLADLHGLIEGAHLGKGLGRDFFRHLRRTRLLVHVVDAATENPINDYRPVREVIHFNTSNMSSEQG

SEQ ID NO: 148710 - protein, 59 aa, Glycine max
  Coding DNA Sequence Number=SeqID_31932
MYCPVVQIATETGSIAGQIAIYSGETTGIANGSSVFAATCCTSEFLASIVGDLHVSYVK

SEQ ID NO: 148711 - protein, 78 aa, Glycine max
  Coding DNA Sequence Number=SeqID_31933
MAERPGVDGQDNDKIHRRQLERRGIVLGYLTCYNLLESLTQKSNSKAHGIPHPRVLETLSQDFQSCKLLLKRSTTHKP

SEQ ID NO: 148712 - protein, 265 aa, Glycine max
  Coding DNA Sequence Number=SeqID_31934
  Gene Ontology: Mol. function=DNA binding
  Homolog annotation: Hit_ID=Q1SFS3; Match level="QueryCoverage=73%, HitCoverage=36%, E-value=4e-24, Identity=34%"; Hit description =Lambda repressor-like, DNA-binding
MGSSQTPSLKKRFYQVKVKSLGTTSLKELGQLMGQLQRHAFRKAYEAIASLAQYYDQPLRCFTFGDFQLSPMVEEFDEILGCPPGGRKPYLFSGFYPSLARISKIVQISAQELDHKKQVKNGVVGIPRKYLEVEARILAGKGELVLFIDILALLIFEGVLFPNVDGLVDLAAIDAFLAYHNHKESPIVAMLADLYDTFDQRCEKRNTRIVCCTPALYVWLVSHLFRQEVRHACPLESHRSCTEKGGANWDRLLANKEGASANWFP

SEQ ID NO: 148713 - protein, 135 aa, Glycine max
  Coding DNA Sequence Number=SeqID_31935
MAWVIDRCMDSLSLNLYTMQRTDVANVKNISKNGLRNRNDNAHWQMVVLCPKDNVVVWFCSVRRKSDVHIKTAINNAYKKLNTTADGKVPKTAPQWLELKWFGDGSALDSEVITTLRKKWAAYFLKLRTIQCRKL

SEQ ID NO: 148714 - protein, 232 aa, Glycine max
  Coding DNA Sequence Number=SeqID_31936
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=2e-40, Identity=34%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=1-189; Score= -46.6; E_value=0.049; Accession=PF02389.6; Description=Cornifin (SPRR) family
MPWPAEDYTSSPSKDYTSSPSEDYTSSPSEGYMRSLSEDYTSSPSEGYMRSISEDYKSLPSEDCAPSTSEDYTSSPSEGCTSLPSEGYTPSPSEDYTSSPSEGSTPSPSEDYTSSPSEDYTSSPSEDCTSSPSEGYKRSLSEDYKSSPSEDYTSSPSEDYTWATCPCLQRTTHHRLQRSTHPCLQRTTHPRLQRSTHPNFQRAARPHLERATCPRLHWATRPRLQRTKRPYL

SEQ ID NO: 148715 - protein, 104 aa, Glycine max
  Coding DNA Sequence Number=SeqID_31937
  Gene Ontology: Mol. function=metal ion binding; Biological process =metal ion transport
  Homolog annotation: Hit_ID=Q9LF57; Match level="QueryCoverage=74%, HitCoverage=53%, E-value=9e-25, Identity=66%"; Hit description =Farnesylated protein ATFP6-like protein
  Pfam annotation: Domain name=HMA; Domain location=27-92; Score=44.3; E_value=4e-10; Accession=PF00403.16; Description=Heavy-metal -associated domain
MGALDYLSNFCTVTSTRTKQKAMQTTEIKVRMDCDGCERRVRNAVSSIKGVKSVEVNRKESRVVVRGYVDPKKVLKRITESATVQTKIKEIISNAKCKNRFSKV

SEQ ID NO: 148716 - protein, 70 aa, Glycine max
  Coding DNA Sequence Number=SeqID_31938
MSNEELKLQDPRCRIQCPDILPENTGVADPRCRIQCPDMLPENTGIAVQCKIKVKCRSEAAGSTMSDTMS

SEQ ID NO: 148717 - protein, 313 aa, Glycine max
  Coding DNA Sequence Number=SeqID_31939
MAAPARTSSSTRNTVRPHVAAVIRVVQQRHVLARDVGQFNQRDEAAHAGLLHAAFAVDVFQLELHLWLFVEVGAGLTDLQYPGLHADAAILQRITAGIGVQQAAEQAQPQRIATQHQRAYQQRVTERQEGPAQPLVLQPVGQHIGSGNGCDAECCTDATPPQAGDIQFGLRTVQHDVGECPGRQLQFPLREAAHLHAGLFGLFDQCTARFTVGQDRLHPVQCARWPQQQVVQEGEQQRQPQGQRQCEQQQCRPRRAAVDQGHRPRSAEIENAGKRQREEQQERAPEPEIGFHGGRGPRWNRARRLLRFSGTAG

SEQ ID NO: 148718 - protein, 75 aa, Glycine max
  Coding DNA Sequence Number=SeqID_31940
MQDEKSLIERSWKLTLRRAGLIRDSPQISASPHHLDFAPYASGSYNAQWNAPGLLHDKHTLRSSRILRQMEVEET

SEQ ID NO: 148719 - protein, 110 aa, Glycine max
  Coding DNA Sequence Number=SeqID_31941
  Homolog annotation: Hit_ID=Q2HUG7; Match level="QueryCoverage=68%, HitCoverage=24%, E-value=1e-08, Identity=49%"; Hit description=Cupin, RmlC-type
MEHETENRKQIEEQSKQVKQRSEGQSYGIKDPIALVLCDLGNVEPDEVGPDVCVGGVKGHIGVDARCRLSEIHARKRKKARTKGMEWLPLQLPLPGAGRVRFVSGIRVLI

SEQ ID NO: 148720 - protein, 85 aa, Glycine max
  Coding DNA Sequence Number=SeqID_31942
MELTSWRLIDLSQAHYGHLVAKFLHGLVFMLIGRSGSEGRWARGGDAILPRKGPVTRAMSKRLQEDWARANKEGLRVLMNLRVDF

SEQ ID NO: 148721 - protein, 100 aa, Glycine max
  Coding DNA Sequence Number=SeqID_31943
  Gene Ontology: Mol. function=phosphotransferase activity, alcohol group as acceptor; Biological process=protein amino acid phosphorylation
  Homolog annotation: Hit_ID=Q1RT20; Match level="QueryCoverage=58%, HitCoverage=5%, E-value=1e-18, Identity=76%"; Hit description =Phosphatidylinositol 3-and 4-kinase, catalytic
MKDPILLRTNASLNSIKSRYPNISSLCEFFIAKYQENSPSFKLAQRNFVQSMARYCLVKDRHNGNLLTECVSFTLSSFISSIGDTALASPFDKYVKRYES

SEQ ID NO: 148722 - protein, 76 aa, Glycine max
  Coding DNA Sequence Number=SeqID_31944
MSLNVSVIKVEAGKVEVLASDLDDGGVELPVVEEGGEVVEEEEAGDGADAEVEEGKGAGGTLFVLGFILDWDSRSI

SEQ ID NO: 148723 - protein, 82 aa, Glycine max
  Coding DNA Sequence Number=SeqID_31945
MGFTELLYFPVLTCKDSSLKAPSSLLGKPGFVVHLGSFGWVNEVDSTAERAAAKRNIPELSARKNPEEDELYRFDKRTASSL

SEQ ID NO: 148724 - protein, 78 aa, Glycine max
  Coding DNA Sequence Number=SeqID_31946
MEFTTTPLLWKQHLHRSGESYAQAMPFLDPIIESLLVQAWVSDVAKLEQVKIDDPLVIALVERWRLELYMFHLPIVNV

SEQ ID NO: 148725 - protein, 33 aa, Glycine max
  Coding DNA Sequence Number=SeqID_31947
MTSSSVNAIMYYNGAFKTTKHGSMFETFQPHKP

SEQ ID NO: 148726 - protein, 103 aa, Glycine max
  Coding DNA Sequence Number=SeqID_31948
MVISHTFLPFGDNCVRWHTETNYGHSAPHLSSRGGEHAEKNYGHSAHLFAIRRQSCPMACRDKLWSFYALLSSRGGEPDDMRRYLMVIRAFCQLRGTSSAVSG

SEQ ID NO: 148727 - protein, 70 aa, Glycine max
  Coding DNA Sequence Number=SeqID_31949
MVMTMVIVHAEQRRSGCWRVVRKLGEDKDMDKVDVEPNATKMNRSTPTRLKQSIFATSEWICLPPLILKI

SEQ ID NO: 148728 - protein, 85 aa, Glycine max
  Coding DNA Sequence Number=SeqID_31950
  Gene Ontology: Mol. function=DNA binding; Cellular component=nucleus; Biological process=regulation of transcription, DNA-dependent
  Homolog annotation: Hit_ID=Q6K1S6; Match level="QueryCoverage=91%, HitCoverage=30%, E-value=7e-36, Identity=83%"; Hit description =Putative myb protein
  Pfam annotation: Domain name=Myb_DNA-binding; Domain location=14-61; Score=49.9; E_value=8.4e-12; Accession=PF00249.21; Description=Myb -like DNA-binding domain
MGRAPCCEKMGLKKGLWTQEEDLILIHHINTHGHKNWRALPKQAGLLRCGKSCRLRWINYLKPDIKRGNFTREEEDMIVAVASIA

SEQ ID NO: 148729 - protein, 309 aa, Glycine max
  Coding DNA Sequence Number=SeqID_31951
  Homolog annotation: Hit_ID=Q2HRX8; Match level="QueryCoverage=56%, HitCoverage=24%, E-value=2e-22, Identity=38%"; Hit description=IMP dehydrogenase/GMP reductase
MYTSADVRRNTRQLPLVLIFYIFWVALFLLIRVQPMFMSHTYRPYVTSLLLGGMHEELLASSICTISLMMPVSAPADSLLCWIYEHFSSVVKCNADLDYDEVSPRACRWIATKKTVKKVSTATYRQCLDRLRIPDVCWMPYAEHRPVQNFHLILCFSGQLRWGPIVVRYRPERVIRQFGYVQCIPAHPVHSWVSYDDVDDTWTHYSDHLATAGDLCVVPGQCAPDYIDWFFVISHPFMTMPQTDPPRDAYATQPSHIPPEATSASTHADPDADEPRHAVEACHAIMEVLEQDLNAPGLLGVSHKTAMCM

SEQ ID NO: 148730 - protein, 78 aa, Glycine max
  Coding DNA Sequence Number=SeqID_31952
MEKGTSLPMEKGFKILLFPIIDSLGNPLRIFMEKGTSLPMEKGFKILLFPIIDSLGNPLRIFTCGIRACVMKFMILQE

SEQ ID NO: 148731 - protein, 87 aa, Glycine max
  Coding DNA Sequence Number=SeqID_31953
MLKSLVTIIVFFLIVRVQDDLGDDSLFMKSLTLFRKDSTLEMLYDNCENAGSLKARVSQAVKHESQREKSHIAKKPTCAKIYPLHNC

SEQ ID NO: 148732 - protein, 98 aa, Glycine max
  Coding DNA Sequence Number=SeqID_31954
  Gene Ontology: Mol. function=zinc ion binding; Cellular component =integral to membrane
  Homolog annotation: Hit_ID=Q1SJ34; Match level="QueryCoverage=95%, HitCoverage=28%, E-value=1e-19, Identity=42%"; Hit description=Zinc finger, RING-type
MCKDHISLLEAVTSRARQRQRWPPVHSPIQIRNSAGETVVVANAQGREMKGVAKASEEVEAKVRGYGNMFDCNICLKMARNLVVTCCGHLFCWPCYYH

SEQ ID NO: 148733 - protein, 254 aa, Glycine max
  Coding DNA Sequence Number=SeqID_31955
MKNLCSGKKFSGTKSLDANGKLLAVLIQGISMVVFLLERNSQSNHFEERSQMRRFIESMEDWGLGSFKATGRDGLQVCKTFIPLVIATFLIKLLPYYWQKGEGDGQSSQPMPISNLALYPTMRMLWNGEALSAFFSLQGPRPSYFMIVDDLILFVEDSLEQRLSQGRVCLLAITIECKVSTVSGLIVVTLSTRRVEIGSGHFNILHHPMLRERLLTLSLVQKNGIFICCNISQGAFVIGSGHFNILHHSMLMIK

SEQ ID NO: 148734 - protein, 76 aa, Glycine max
  Coding DNA Sequence Number=SeqID_31956
  Subcellular localization annotation: CTP_CleavageSite=18; ConfidenceScore=5.44e-01
KKNSASGPAQHLAQRKARAKRKGSSRTKRATRAKHANQNNGAKREQLAKREMQHALSERSALSKLTMAQVHFSSYK

SEQ ID NO: 148735 - protein, 86 aa, Glycine max
  Coding DNA Sequence Number=SeqID_31957
MELKYLVKVQWVKDFTIRFATSRGSTGTTEKGAAEKPGPTCEGSVTLKLVGSMHSTSSHDSAGILTLKKSRDEKSTCRGVSLHLLE

SEQ ID NO: 148736 - protein, 168 aa, Glycine max
  Coding DNA Sequence Number=SeqID_31958
  Gene Ontology: Mol. function=DNA binding; Cellular component=nucleus; Biological process=regulation of transcription
  Homolog annotation: Hit_ID=Q0PJI9; Match level="QueryCoverage=57%, HitCoverage=52%, E-value=3e-25, Identity=53%"; Hit description=MYB transcription factor MYB124
MDEDQKNLNDMAKVMMMVNRKSTDMFNTIHIKDQACVIAANYAVEPTTTAQPATTANELGFVTAAIEQSGYSGPPVIVLGIGYDDGVVFLGREGAMLHGGAKLIAPSEQAQLVGPTLNDLNLFGAPWAFDSAGLVGVGLGRAAIKGRESEGRAFVRYFHSIEKNLKLS

SEQ ID NO: 148737 - protein, 239 aa, Glycine max
  Coding DNA Sequence Number=SeqID_31959
MPKRGRTKKTAKATESVTEPQSQTQAPQFIDLEIQAMQRQIDAIRAVRDVEIEHLLTELRFLRSRFDGEELRKPVLHVFEETLPNLAVVVNGECNKNLEVKWRETEGCNDGVNLHASLLQRLSIASIPRFPGFEYSTNEGRMSFIGADDLHFKDIALEEPSDTQTLAVQEGLQTPDCVNVQNSQLHHISSVTSQRLSVGMTPKTLRLPKPGEMLLSVHGSPLGVYKDNNMEAIHGMKNG

SEQ ID NO: 148738 - protein, 89 aa, Glycine max
  Coding DNA Sequence Number=SeqID_31960
MATLFVIRPSPLHDCCSVTVVTIVIVVVVVVVVAATIVEVVAAMTMTTVMVVVDDNSDGGDDNFGGGYNGGDGGDNDNNEDHGSRDGDN

SEQ ID NO: 148739 - protein, 39 aa, Glycine max
  Coding DNA Sequence Number=SeqID_31961
MEMQRKVHVSNNDGDFVAALTHCLIGNLPSMKLKLLPYS

SEQ ID NO: 148740 - protein, 326 aa, Glycine max
  Coding DNA Sequence Number=SeqID_31962
  Homolog annotation: Hit_ID=Q8RZK0; Match level="QueryCoverage=26%, HitCoverage=30%, E-value=1e-35, Identity=75%"; Hit description=Beta 1,3-glucanase-like
  Pfam annotation: Domain name=Extensin_2; Domain location=39-325; Score=-137.1; E_value=0.06; Accession=PF04554.4; Description =Extensin-like region
  Pfam annotation: Domain name=X8; Domain location=140-223; Score =164.4; E_value=3e-46; Accession=PF07983.3; Description=X8 domain
  Pfam module annotation: Pfam domain module=Extensin_2::X8; Domain location=39-325::140-223
MGVRSWPLVLFSLCLFCNSGLSIATTFREEEHQEISYEFGTKLDAVPVVNPTTPGTANSFPTLNPTTTPQAPGSTGQTTPTTPYMTPINPYTNPTTPKTSPTNPYSNPTTPTMAPPSPTTTTTTPTTPTTPTTTASSGGQWCIASQSAAENTLKVALDYACGYGADCSAIQPGASCYNPNTLKDHASYAFNDYYQKNPAPTSCAFGGTATLTNKDPSNGNCRYTSSKTPSMSPPTPTYVSPPNPPSTMTPTTPTTMTPSAPSTMTPTTPGIMTPTAPGMTTIPGGASVYGTGPAGSPNTATSASHSEVLLLTLFGLWASIRVEIYI

SEQ ID NO: 148741 - protein, 89 aa, Glycine max
  Coding DNA Sequence Number=SeqID_31963
VVVLDKGIGDKYVTLPWYKFIQEGDFSHGDKLSFNYRRAEKIWEVVDMNGNGMEKEEREETPLQGKDESRRSSPPWKAMDKSLEEEEDE

SEQ ID NO: 148742 - protein, 106 aa, Glycine max
  Coding DNA Sequence Number=SeqID_31964
MLFEEMEEYQELLRQLEPHIALRIAPHEQGGCYDVVAIQGTLKWIQDQILSQWSESYREEWTMLGSVGVTNTSAESHFFHQSRFEQQSAPFDEDQHFQILDFIYSL

SEQ ID NO: 148743 - protein, 101 aa, Glycine max
  Coding DNA Sequence Number=SeqID_31965
  Gene Ontology: Mol. function=protein binding; Cellular component =nucleus; Biological process=regulation of transcription, DNA -dependent
  Homolog annotation: Hit_ID=Q9ZSM8; Match level="QueryCoverage=88%, HitCoverage=10%, E-value=3e-27, Identity=65%"; Hit description =Probable Polycomb group protein EZA1
  Pfam annotation: Domain name=SET; Domain location=2-71; Score=-8.9; E_ value=0.006; Accession=PF00856.18; Description=SET domain
MKKCEFKQVMWVIDSCRLGDKLKFANHSSKPNCYAKVMLVGGEHRVGIFSKENIEAGEEIFYDYWYDLDCAPQWALPPDEVSKKDESIVSQGRAKKNQSHC

SEQ ID NO: 148744 - protein, 49 aa, Glycine max
  Coding DNA Sequence Number=SeqID_31966
MTISDSFTGEKGIAEDSTSGGFNLFSVSLTFGNSIGAVGGITEGISGNR

SEQ ID NO: 148745 - protein, 368 aa, Glycine max
  Coding DNA Sequence Number=SeqID_31967
  Gene Ontology: Mol. function=protein binding; Cellular component =nucleus; Biological process=regulation of transcription, DNA -dependent
  Homolog annotation: Hit_ID=Q9ZSM8; Match level="QueryCoverage=67%, HitCoverage=27%, E-value=8e-81, Identity=66%"; Hit description =Probable Polycomb group protein EZA1
MEEDPTLPHDEPQDSSKRLRTPNDIITEIDLRYMELNLDANDEENHTTYGASLKSLNEHSSGKSTVFYNYSHDEQGKGVMDGEKDLTNEIEFNQLSISREVQAYEMTNESNWRPLERDLYLKGVEMFGKNSCLIAFNLLHGLKTCIEVTKYMSACDETITHGSIPSSTVDKKEKINAEFTKASNYVDFESETIFCYRTKKWLQDHGRNEKRANQESLIILENLLAFHLDGEKLLMGKINIISNILLVGVRECVERNVLVFFMELAVKNIVGVQSFATTDLEDVVVLRVNAEADNAHVLQPTANVTQMFVEIVGCGDGSLGEPPRCGDGKCGNMNLLLGLKERILLAKSDVIGWGTFAKVDMLVTIYFR

SEQ ID NO: 148746 - protein, 60 aa, Glycine max
  Coding DNA Sequence Number=SeqID_31968
MGSSQMPWLKKRFYQVKIKSLGVTSLKELGQLMEAIASLAQYYDQPLRCFTFGDFQLTPT

SEQ ID NO: 148747 - protein, 100 aa, Glycine max
  Coding DNA Sequence Number=SeqID_31969
  Gene Ontology: Mol. function=selenium binding; Biological process =cell redox homeostasis
  Homolog annotation: Hit_ID=Q1SPM5; Match level="QueryCoverage=83%, HitCoverage=39%, E-value=4e-17, Identity=57%"; Hit description =SelT/selW/selH selenoprotein
MDRTQILLVGLPIFLFFSDILNLFSPQPSPKPTHHHLPPIHPKPHPQPHLQQPLEFPTQKQSGIGLIGIGNTVSIDFCTSCSYKFVQFLAFFQFRSNCLI

SEQ ID NO: 148748 - protein, 556 aa, Glycine max
  Coding DNA Sequence Number=SeqID_31970
  Subcellular localization annotation: CTP_CleavageSite=47; ConfidenceScore=5.25e-01
MAWACAASRRTSGGISRPRRRTRPFTAFREPILVIVIFPYFASGGVRRGSGGGDVRASPRTGLSSSTPVVASYEWVKLASPEDTCKLVVQACGSDDFPFWKAASGSPPSSFMYMCLFEVLGLILPLIAFPYALLEHLNVASSQLHPNIWDMPDPTRFKLFDEDLLTLIERVKKASFSASDPLTTEDGIIGDFAWRPLVKQVTSSAPSSILEKRKQNYGVGSSSRNKSKVFMSLRAIRQAVGLAHSAGHPSIMEDVSLAPSTIEAPTTVVSAVLVQKATPATGVNVPATSAGSVVVPSSTITASLFSSCSVGVATASAHIVSPPPSSAPPFVVLGMASPSSSSCPHVSLDHLYTSSDTNSLWGCKLRQKFDSVSRGAECYKFCQCLSPEKFGDSRGEQTTSLKGFAPGGVLRGGGCQMKEIKDLAGKVEGIVAKRDKLTKVVADLEAQLKELESSLEGSELQVAKEREAKKELMEELLIYKKETMEFFTKDLDLGLFDAFKDVKDGFLLDEEEITANEEVVDEEQGSEEQGDDATVRLPFVYLLFFCMVGFLAIQAL

SEQ ID NO: 148749 - protein, 147 aa, Glycine max
  Coding DNA Sequence Number=SeqID_31971
  Homolog annotation: Hit_ID=Q47336; Match level="QueryCoverage=17%, HitCoverage=28%, E-value=2e-07, Identity=96%"; Hit description=LacZ -alpha peptide
MQSQMQSKELVLSPKVEVGPSTACVSTKESCVDSLGVYGGSTTVHNVPLGNDQVKVGVEEVRDVDARVPDKHRVEGPAKLVDRPDPNVDPLYLMTLTIPQLFHKSFTWWSMSQHLYYTIVDSHIPLSPAGVIAKRPAPIALPNSCAA

SEQ ID NO: 148750 - protein, 130 aa, Glycine max
  Coding DNA Sequence Number=SeqID_31972
  Gene Ontology: Mol. function=actin binding; Biological process =cytoskeleton organization and biogenesis
  Pfam annotation: Domain name=Transposase_21; Domain location=22-130; Score=39.2; E_value=5.9e-18; Accession=PF02992.5; Description =Transposase family tnp2
MTSVIVMKPQRKAPQRRSYSIFQDGRNCNGMLHHPADSSQWKKIDRLYPNFSKEARNLRLGLATDGMNPYGNLSTQHISWPILQVIYNLPPWLCKKQKYMMLSMKISGLRQLGNDIDVYLSPLIEDLTKL

SEQ ID NO: 148751 - protein, 142 aa, Glycine max
  Coding DNA Sequence Number=SeqID_31973
MDEDSDRPIRIMNFVSEDQLVEAKKTRGERVEDGTAQRDRPLYEILKENKDKKDAEFNERFKHIIECDSVWQWQLPRQLVRFNLLILSCLLGVCPFEIGIVCASCLTDVQTAIFLTLFYMVVFCCYSALNFDPSNYHIHRTT

SEQ ID NO: 148752 - protein, 92 aa, Glycine max
  Coding DNA Sequence Number=SeqID_31974
MKYESNIKEQKSAGKKNPASRPLGLIIKVKPQAKKTKVNQGNAEEISKAGNTPVNDRSKSLEPVQALNGEADKSQVALTGLVSYSDESDDDL

SEQ ID NO: 148753 - protein, 70 aa, Glycine max
  Coding DNA Sequence Number=SeqID_31975
MWKSVCPLLGVACAAHAQYSFIHVTCRVGMHWSCGVWVNWGVSWCKNLEHHFCSRQLPKSPSDRGRTRIK

SEQ ID NO: 148754 - protein, 175 aa, Glycine max
  Coding DNA Sequence Number=SeqID_31976
MFQLAVDKPIMIPKENFYKGKKKLVQDDEDAPSTHYVKTKLVRLFKHKVALHQKREVTSRNCQALQSYYSLGAHCSNLEPEEKPPLKGVHHKTRCDYQITNHNPFVVNSKDELHVAVVEDMIMEVYDGPPPSWKYVCFHEQTLLKTREALAKALHDRAHAERRALASMSLVLRNA

SEQ ID NO: 148755 - protein, 557 aa, Glycine max
  Coding DNA Sequence Number=SeqID_31977
  Homolog annotation: Hit_ID=Q1SKG1; Match level="QueryCoverage=23%, HitCoverage=9%, E-value=4e-38, Identity=58%"; Hit description =Integrase, catalytic region; Zinc finger, CCHC-type
EVYVRQPLHFEDHTLPDHVFKLQKDFVWFETGTLCLVDKLNSFLLENGFMSVKVDTILFRREVGKDFIIVQIYVDDIIFGATNESLCKEFSDVIKSEFEMSMMGELKFFLGLQIKQDSKGIYIHQQNYTRDHVNGINYIYIYKMMVGGKTFKDMFNPKVKKNHIPYGMLFTQILRLVGMEVSLMEPSSRATQPKEDTFVKIWIAENFPEYIQRHIKKKVKKEVIETPLSNVEILETPTLLPSPSLAFPSQQTPKSTSPSPSKAKATAIAKAKKHCFANTKRKAKAENAIKKKTLTKEEELRNAAASDQVPEEVGHRAPTNYGSREKVEEERQALDIAMLQSVIKVSLQDEVVVDALLAPPMSEVDILRLESIYGATKSVSFDAMKFRLEMRKRVDTTTAPQLLPQPQTQPEPMPTLDDNKCKKVELQKLNLVKLWKGVPRIDPFSYSSFETFPEEEFKIKFNFKLHEMKSRRFKNQEKFDFKGTYFVVQVEGTSTWVVVTENKKRYISCGSVQVEGTSIWLFKENKGGYIPCGSLLVKVFTRLKRNLKDRRSLGDWM

SEQ ID NO: 148756 - protein, 110 aa, Glycine max
  Coding DNA Sequence Number=SeqID_31978
MAAIFECSDNLKELEYVPEWHENESVLVRTPLLGQRLEMAPKKLSTKRSRRDAAAEGPSATPEFDSHHFRSAEHQQHFEAIKGWSFHREKCIQLREDEYTDFQEEIARRH

SEQ ID NO: 148757 - protein, 275 aa, Glycine max
  Coding DNA Sequence Number=SeqID_31979
  Gene Ontology: Mol. function=translation initiation factor activity; Cellular component=nucleus; Biological process=regulation of translational initiation
  Homolog annotation: Hit_ID=O80846; Match level="QueryCoverage=93%, HitCoverage=56%, E-value=1e-83, Identity=60%"; Hit description =Expressed protein
  Pfam annotation: Domain name=Gcd10p; Domain location=3-169; Score= -125.9; E_value=0.05; Accession=PF04189.4; Description=Gcd10p family
MGLRSSQSSEFIIGVRIFLRVDTLSLLLSMGNVSSNSDILVVDMVGGLLTGAVAERLGGTGFVCNSYIGQAPYSMDIVRIFNLSDEICKRIVRSPISDLLSQKESPEQTLQPDDACNVESQSNDQISASTSMEDISHSSENGISDLGAENTEPAKEVWKAPKAGERAQKEIIDLWKENGFSSLIIAAPELDTWTLVRDILPLLADSAPFAIYHQYLQPLATCMHNLQLEKMAIGLQITEPWLREYQVLPSRTHPCMQMSSFGGYILSGTKICSTE

SEQ ID NO: 148758 - protein, 54 aa, Glycine max
  Coding DNA Sequence Number=SeqID_31980
  Pfam annotation: Domain name=PPR; Domain location=19-53; Score=29.7; E_value=1e-05; Accession=PF01535.11; Description=PPR repeat
MAKSAHKVFDKRCYESNMVTFNTLIHEFCKRGDMEGARRVFDRLVESQSCKPDV

SEQ ID NO: 148759 - protein, 170 aa, Glycine max
  Coding DNA Sequence Number=SeqID_31981
  Gene Ontology: Mol. function=translation initiation factor activity; Biological process=regulation of translational initiation
  Homolog annotation: Hit_ID=O80846; Match level="QueryCoverage=97%, HitCoverage=36%, E-value=2e-47, Identity=63%"; Hit description =Expressed protein
  Pfam annotation: Domain name=Gcd10p; Domain location=7-170; Score= -35.5; E_value=3e-07; Accession=PF04189.4; Description=Gcd10p family
MCESSSSRVTWEGCSVLLDINDGDRLVFARLSPAAKLKIGNKNCSLQPLIGCPFVNGNNAEEVRDGQVSVESRDKVNNDNNPEEVRDGRANVDSRDNRALVDNNTAQSLTGEDIEAMRRQGAGGNEIIEALIANSATFEKKTSFSQEKYRLKKQKKYAPKVLMRRPVARR

SEQ ID NO: 148760 - protein, 59 aa, Glycine max
  Coding DNA Sequence Number=SeqID_31982
MKKKGEDEILCERKRDIAEVWKRIEELKCRIAHQDHSVQEAYLTQEANLEVNCSAHLMA

SEQ ID NO: 148761 - protein, 367 aa, Glycine max
  Coding DNA Sequence Number=SeqID_31983
  Homolog annotation: Hit_ID=Q8LE10; Match level="QueryCoverage=85%, HitCoverage=100%, E-value=4e-84, Identity=53%"; Hit description =HVA22-like protein i
  Pfam annotation: Domain name=TB2_DP1_HVA22; Domain location=55-150; Score=55.2; E_value=2.1e-13; Accession=PF03134.9; Description=TB2DP1, HVA22 family
MRHRKSRQRNGSRYPLLPPPIFLSLHRQIYLFSFRIRISLSPPQHTHLQGYKMIGSFLTWALVMVFGYAYPAYECYKVVEKNKPEIEQLRFWCQYWILVAVLTVCERVGDTFISWVPMYSEAKLAFFIFLWYPKTKGTTYVYDSFFRPYVAKHETEIDRNLLELRTRAGDIAVLYWQRAFSYGQTRIYDILQFVAAQSTPAPRPAQPRPGVRGVRQQAPAKPAAAAEPQVEEPPSPTSSTSSSQLQREVEEELGSSPQVPKAPTSVTGLSNQKTPVAGVSTQKSAGASLSTQKSTGASLSTQKSNVAPETTNQSAPAEAEPKQIEAAPSSAKENGNSPPTSTKETLMEESIRVTRGRLRKTRSAGTR

SEQ ID NO: 148762 - protein, 125 aa, Glycine max
  Coding DNA Sequence Number=SeqID_31984
THLLLEVASPLSLPFSIPLPFIFQEAKESIDEEDPRPTSSNGAYITGLNSLTVPSGVSNCRNLPSSGGTMRDSMDASSEEGKREESPPMVDKGVALAPTYAQGHFRAFATRLGELKLSAEAMSSP

SEQ ID NO: 148763 - protein, 337 aa, Glycine max
  Coding DNA Sequence Number=SeqID_31985
  Gene Ontology: Mol. function=DNA binding
MNEKVKRQWASLRQIGLSQNRTIHVRDVIQAIHMELEASNQPKQERSRTRWTASLDKIFADLVVKQIQLGNRPNNVFDKKTWNHIRDEFNRQTDLNFNNNQLRKHLDVLRTRFYNLKSAYDQNNDFVMDDSCCIGFEQWEDIGVQPRNETVKVKDCPIYEQLCTIFIDSAADGKYAQSSHYEELDKSIGADATGFTPCPEAKVSHYVNPSTSKFIPGNISTAEKLTKNSIDRKRKRSCETQTTSLDQDTCNAMAEALLGMVAVSRLRAVVSSVSDDKFSITNCIKALDEIEGIDQQLYFSALDLFENPSLRETFISLKSVKIRLTWLQGKCSKTPFH

SEQ ID NO: 148764 - protein, 130 aa, Glycine max
  Coding DNA Sequence Number=SeqID_31986
MDQSLSLQLHDEGKGTPHTFWIHPVQCFVQFFRHGVNEKPTRSTFCQDRTIKVYEDVGDFSDDDNLTPSEIAYYMDVIGEEILEGEMLSTDDGRQRRRGEGRHHTLGNKPRKKEFHHQELPWIRSLKRML

SEQ ID NO: 148765 - protein, 108 aa, Glycine max
  Coding DNA Sequence Number=SeqID_31987
  Subcellular localization annotation: CTP_CleavageSite=40; ConfidenceScore=5.06e-01
MKSPIQLNFRGGGEHLLTTSHVLVFPTFSSNKRWWRLCAPSSLGRCTREPHVALLPKGFDGCLLDPETKLKGRAKWLFFQDFRHPFAQASNQLAWANQVSLGINNQLT

SEQ ID NO: 148766 - protein, 116 aa, Glycine max
  Coding DNA Sequence Number=SeqID_31988
  Pfam annotation: Domain name=zf-CCHC; Domain location=1-18; Score =13.7; E_value=0.0055; Accession=PF00098.13; Description=Zinc knuckle
MTYSNCRQKGHIQKGCPHPKKKQNGGSMNDQTGCPKDTRGVFTLHGVEALKKPWFLWVTFPLSEFREVFLKDISNLPPERKIKFYVDMVPGACPISIAPYSISPIELAVLDQVSSE

SEQ ID NO: 148767 - protein, 288 aa, Glycine max
  Coding DNA Sequence Number=SeqID_31989
  Gene Ontology: Mol. function=transition metal ion binding; Biological process=cytoskeleton organization and biogenesis
TKPVGLPESRHEEKEGGKGSRGLHVITLGLEELKQVRLYILNSKIEFMPYIVHHEALVKESNLKMTKNRVLKEHNKTFLNWFKDTTVGDDNAYETLRKLADGPQKKFRSWQGYNISKYLFYTKSQDDKSTMQNSGVSLRDESQHFATVNDDNLRVASMPYFGVIEEIWELNYPAYQNEPFIMAKQAKQVFYVQDPCDERHMDTPLSSPPPKLAPSPSTSKRTRKATQLISLAARLVGVDRLVVHVDPTTRKADGLRREKLKTYLGVITQDNVNVTYVNWKQVPVAQKI

SEQ ID NO: 148768 - protein, 101 aa, Glycine max
  Coding DNA Sequence Number=SeqID_31990
MACTKISSQITSEATRQIANRNGIVPPVEPQVTPSATRVSTKRSCVDSSGQDPDMVASDKHGLYVDDNPPCRLPSEEFMKAINTFLAWATHLVQPFSKKDK

SEQ ID NO: 148769 - protein, 128 aa, Glycine max
  Coding DNA Sequence Number=SeqID_31991
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O22960; Match level="QueryCoverage=96%, HitCoverage=34%, E-value=1e-25, Identity=44%"; Hit description =Expressed protein
  Pfam annotation: Domain name=DUF231; Domain location=1-125; Score =133.9; E_value=4.4e-37; Accession=PF03005.6; Description=Arabidopsis proteins of unknown function
MNPMEAYKIGLTTWSQWIDANIDPSNTTVLFQGIAASHSGGKGCLKQPQPGQGPQPPYPGVEIVKGILSSMSCPVYLLDITLMTQLRIDGHPSIYTGKGTSYVDCSHWCLAGAPDTWNEMLYAALLGL

SEQ ID NO: 148770 - protein, 204 aa, Glycine max
  Coding DNA Sequence Number=SeqID_31992
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q9SIN2; Match level="QueryCoverage=82%, HitCoverage=45%, E-value=7e-49, Identity=55%"; Hit description =Expressed protein
MAFYFRLCALAFAVLWLVASPLYHVQGNGCDFSLGNWVVDDSYYPLYDASRDCPFIGQGFNCLRNGRTDQEYLKYRWKPSGCDLPRFDGVNFLERYRGKKIMFVGDSISNNMWQSLTCLLHIAVPESSYALSTPTKYLYVFSFPEYDASIMWLKNGFLVDVVHDKENGRIVKLDSIRSGRMWNGVDVLIFNTYHWWTHSGESKT

SEQ ID NO: 148771 - protein, 181 aa, Glycine max
  Coding DNA Sequence Number=SeqID_31993
  Pfam annotation: Domain name=zf-CCHC; Domain location=88-105; Score =33.3; E_value=8.5e-07; Accession=PF00098.13; Description=Zinc knuckle
MSMGQIHQFTQEVVDKLCRQHQYFSDIMNRKAKYIRTCKMPYLEIKCSEKTFHCSPKKKKVLQTDTNGKRRPLKFFRKSGRKGKSRGQRCFICNQTGHFAKNCPKKSQKAIRLISHLQIDEYDDIESMYSEKSELDKETEFALNQTDSSDEESPASPILIFSIQEEQSIKPAIPQPCVEIQ

SEQ ID NO: 148772 - protein, 348 aa, Glycine max
  Coding DNA Sequence Number=SeqID_31994
  Gene Ontology: Mol. function=RNA-directed DNA polymerase activity; Cellular component=chromatin; Biological process=chromatin assembly or disassembly
  Pfam annotation: Domain name=RVP_2; Domain location=224-348; Score= -62.3; E_value=0.071; Accession=PF08284.2; Description=Retroviral aspartyl protease
MVTLETGQSSSPVSTANQHSMSFFPITHHMNLEVSCFNGSKLMDWIFKITQFFDYHATSEHERLTIALFYMEGPDPTDTLFKLNQKGSVNDYLSKFEALANSIIDLPMPFLLSCFISGLASDIRQEVQALQPITLIQETALALPSESSSMPIKHLSPEQMAIHPEKGICFNCDKKFSKGRKCSSKIFLLIAEEDDTTVGGADLGQLHLGPSEDVDQSPTQISFHELSGHLALETLHLVGQIANHKVVILIDGGSTHNFVQECLLKTLDLVTQPIPSLRVMVGNDNEIDCHQLCADVAIYVLGLDFTMDLHVLPLCGANLVLGVQWLKSLKPVPTDYNDLPTKFMHSGK

SEQ ID NO: 148773 - protein, 80 aa, Glycine max
  Coding DNA Sequence Number=SeqID_31995
MCHNAVELKAELERLRSPPSLKEALEKEKAVLEDGVKKLHKMIKDEDLSLQIEQEERVLAEKEKQEKVKEEKWKQIYELK

SEQ ID NO: 148774 - protein, 73 aa, Glycine max
  Coding DNA Sequence Number=SeqID_31996
MKLPKVSSSNRGVIFFSYQQEDFGRALATFAELLVAVKAYSLFRKTKRWSSKWIADQRRLKSVVEDGKNDETH

SEQ ID NO: 148775 - protein, 251 aa, Glycine max
  Coding DNA Sequence Number=SeqID_31997
VTCLFGSSTAKGQGKGQCAEVQVNLDLAASVTMFQCQVKLTNAEVSYKLGIHACGSDDFQFLKAAPALECGPFLASPKQLGNVSKKLFKFDSNVFHHLKDHFFKVLDIDVVADGMPLMFNRDGEVDKAILEQLSASLDARAILSLPLTSDTLIALDNKCLTFSSFVVSVGRQPMSNTPLVKQVRLAGGIMPLSVAALSTGKGSQLAGEVGPSAEVAPNVPSSVLAKRKWDDAVGPSGHKKLKATMSLCALR

SEQ ID NO: 148776 - protein, 245 aa, Glycine max
  Coding DNA Sequence Number=SeqID_31998
  Gene Ontology: Mol. function=potassium channel activity; Cellular component=membrane of vacuole with cell cycle-independent morphology; Biological process=potassium ion transport
  Homolog annotation: Hit_ID=Q9S6Z8; Match level="QueryCoverage=99%, HitCoverage=60%, E-value=1e-84, Identity=66%"; Hit description =Probable calcium-activated outward-rectifying potassium channel 5, chloroplast precursor
  Pfam annotation: Domain name=Ion_trans_2; Domain location=90-165; Score=50.1; E_value=7.4e-12; Accession=PF07885.6; Description=Ion channel
MCTIGYGDIAPLTPFTKIFACAFVLVGFGFIDILLSGLVNFVLDLQENMILTGLQMGASDQREGFSARNYIVDVAKGRMRIRLKVGLALGVVVLCIGIGGLVLYFVEGLDWVDSIYLSVMSVTTVGYGDRAFKTLPGRLFAAIWLLFSTLMVARAFLYLAEARIDRRHRRMAKKVLHREITVEDLLAADINNTGFISKSEYVIFKLKEMGKIQEKDVLQICDQFRKLDPSNCGKITLPNLLGGSL

SEQ ID NO: 148777 - protein, 118 aa, Glycine max
  Coding DNA Sequence Number=SeqID_31999
  Gene Ontology: Mol. function=catalytic activity; Biological process =metabolic process
MTQGMVQVLRADKHFHRVIESDGCSPRVQFYVSPYIHIRSTLHKLRRYFLKKRIIGIREELRVNEIFGTFQVKKRMQEETGQRLGTGRARMELSTENGKDTDFATLQYAVQKPSDNGV

SEQ ID NO: 148778 - protein, 431 aa, Glycine max
  Coding DNA Sequence Number=SeqID_32000
  Gene Ontology: Mol. function=binding; Cellular component=nucleus; Biological process=regulation of transcription
  Homolog annotation: Hit_ID=Q1SUU4; Match level="QueryCoverage=96%, HitCoverage=86%, E-value=1e-164, Identity=68%"; Hit description =Tetratricopeptide-like helical
  Pfam annotation: Domain name=PPR; Domain location=151-185; Score =22.4; E_value=0.0016; Accession=PF01535.11; Description=PPR repeat
  Pfam annotation: Domain name=PPR; Domain location=213-247; Score =42.4; E_value=1.6e-09; Accession=PF01535.11; Description=PPR repeat
  Pfam annotation: Domain name=PPR; Domain location=248-282; Score=6.2; E_value=1.4; Accession=PF01535.11; Description=PPR repeat
  Pfam annotation: Domain name=PPR; Domain location=314-348; Score =34.0; E_value=5.4e-07; Accession=PF01535.11; Description=PPR repeat
  Pfam annotation: Domain name=PPR; Domain location=349-383; Score =10.3; E_value=0.45; Accession=PF01535.11; Description=PPR repeat
  Pfam annotation: Domain name=PPR; Domain location=385-419; Score =10.6; E_value=0.42; Accession=PF01535.11; Description=PPR repeat
  Pfam annotation: Domain name=PPR; Domain location=57-91; Score=19.8; E_value=0.0099; Accession=PF01535.11; Description=PPR repeat
  Pfam module annotation: Pfam domain module=PPR::PPR::PPR::PPR::PPR::PP R::PPR; Domain location=151-185::213-247::248-282::314-348::349 -383::385-419::57-91
MRCVNRLLLRTPCSRPRNMCTVTSAKLNFMINACIQDNNINNARKLFDENPSSRNLVSWNMMMTGYVKHHQIEYAQHLFDQMSFKDTVSWNIMLSGFHRITNSDGLYHCFLQMEELVWPPMTIPSPRAYASLRDEEAFKRAFDDILAKDVTSWNALVSGYMEVGSMDDAQTTFDMMPERNIISWTTLVNGYIRNKRINKARSVFNKMSERNVVSWTAMISGYVQNKRFTDALKLFLLMFNSGTRPNHFTFSSVLDACAGYSSLLMGMQVHLYFIKSGIPEDVISLTSLVDMYAKCGDMDAAFCVFESIPNKNLVSWNSIFGGCARHGLATRVLEEFDRMKKAGVIPDEVTFVNVLSACVHAGLVEEGEKHFTSMLTKYGIQAEMEHYTCMVDLYGRAGRFDEALKSIRNMPFEPAWCCGVRCLQLVTCIQI

SEQ ID NO: 148779 - protein, 179 aa, Glycine max
  Coding DNA Sequence Number=SeqID_32001
  Gene Ontology: Mol. function=DNA binding; Cellular component=nucleus
  Homolog annotation: Hit_ID=Q1SEP7; Match level="QueryCoverage=51%, HitCoverage=98%, E-value=1e-32, Identity=72%"; Hit description =Homeodomain-related
MKSPNVNELPGNPQFPQSTLKGSMEDFAKSLSGWSWEENKLFELALAVVDEQHPERWEVVAAMVGGEKSAGDVQEHYVILLEDLLVIESGKLDHTLGEVVPFVLVECKDSICLSDNDTSIMEARDIYYELAWSHVSVNQAVCCIMFIPAWSFNWSNLAHGIQTTRIRQSLEGVTRPALN

SEQ ID NO: 148780 - protein, 178 aa, Glycine max
  Coding DNA Sequence Number=SeqID_32002
  Gene Ontology: Mol. function=transferase activity; Biological process= paclitaxel biosynthetic process
  Homolog annotation: Hit_ID=Q5JNT2; Match level="QueryCoverage=90%, HitCoverage=42%, E-value=3e-29, Identity=42%"; Hit description=3'-N -debenzoyltaxol N-benzoyltransferase-like
MAMSVIRTKRGLVKPAEEIPLTTVLDLSAIDRLPVLRCNARTLHVFKHGPEATRVIREALSKALVPYYPLAGRLKESKPVEASSDCTLRSVNFFDDVHSIPYDHLLPDAIPESQCIHPLVQIQVTEFGCGGSVIGLIFCHCICDGLGAAEFLNPMGEQSRGLRVLGNQHSLKQNYLYP

SEQ ID NO: 148781 - protein, 101 aa, Glycine max
  Coding DNA Sequence Number=SeqID_32003
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=94%, HitCoverage=13%, E-value=8e-37, Identity=80%"; Hit description =Methionine synthase
MDVDVITIENSRSDENLLLVICEGVKYRAGIYDIHSPRIPPTEEIVDRINKMLVVLESNILWVNPDCGLMTRKYTKVKPALTNMVVVIKLICNQLASTKFD

SEQ ID NO: 148782 - protein, 568 aa, Glycine max
  Coding DNA Sequence Number=SeqID_32004
  Gene Ontology: Mol. function=enzyme inhibitor activity; Cellular component=cell wall; Biological process=cell wall modification
  Homolog annotation: Hit_ID=Q1SEQ0; Match level="QueryCoverage=95%, HitCoverage=95%, E-value=0.0, Identity=62%"; Hit description =Pectinesterase; Pectinesterase inhibitor
  Pfam annotation: Domain name=PMEI; Domain location=36-196; Score =90.0; E_value=7.4e-24; Accession=PF04043.6; Description=Plant invertasepectin methylesterase inhibitor
  Pfam annotation: Domain name=Pectinesterase; Domain location=249-547; Score=620.7; E_value=1.3e-183; Accession=PF01095.10; Description =Pectinesterase
  Pfam module annotation: Pfam domain module=PMEI::Pectinesterase; Domain location=36-196::249-547
MSGKIIISAVSLILVVGVAIGVVVAVNKKGEDPAVESHQKYVGVICQNTDEKKLCHDTLSSVKGMDSADPKAYIATAVKATMDSVTRAFNMSDRLTTEYGGSDNGTKMALDDCKDLLQSAIESLQLSTDMVHNNNVQAVHNQQADFKNWLSAVISYQQACTEGFDDAKDGEKKIKEQLQTQTLDNVQKLTGITLDIVSSLSHILEQFGLKFNLKPASRRLLSEDGFPTWFSAGDRKLLARGWRARIKPNVVVAKDGSGQFNTVAQAIASYPKNNQGRYIIYVKAGVYDEYITVPKTAVNILMYGDGPAKTIITGRKNYVEGVKTMQTATFANTAEGFIAKAMTFQNTAGAEGHQAVAFRNQGDRSALVGCHILGYQDTLYVQTNRQFYRNCVISGTVDFIFGTSPTVIQHSVIIVRKPLDNQFNTITADGTSMKNMDTGIVIQGCNIIPEAELFPTRFQVKSYLGRPWKQFSRTIVMESTVGDFLHPEGWCPWAGEHFEDTLYYAEYNNDGPGANVNGRIKWKGYRGLISQQEAAQFTPAQFLQAGSNGGTDWLKALHVPHALNFMKA

SEQ ID NO: 148783 - protein, 154 aa, Glycine max
  Coding DNA Sequence Number=SeqID_32005
  Gene Ontology: Mol. function=heat shock protein binding; Cellular component=integral to membrane; Biological process=protein folding
  Pfam annotation: Domain name=DnaJ; Domain location=51-100; Score= -1.1; E_value=0.0056; Accession=PF00226.21; Description=DnaJ domain
MDADEAKILLGFPPNSRPTPSQEEDALPCKLAIGVVVILEVVAVGVVVILEVKSAYKKKVWESHPDLFPSHEKPLAESKFKLISEAYTCLESGGRGGASSSGYVLSDEIGVVDFGNTTVVNVPPHRNLGRRVSCGCMTTHHLTIAFIFLENHAN

SEQ ID NO: 148784 - protein, 43 aa, Glycine max
  Coding DNA Sequence Number=SeqID_32006
MAEPSNKRKGSSSRSQRHSEAQDTPIPSSISSSSLFSSKEQRT

SEQ ID NO: 148785 - protein, 462 aa, Glycine max
  Coding DNA Sequence Number=SeqID_32007
  Homolog annotation: Hit_ID=UPI000019713A; Match level="QueryCoverage =35%, HitCoverage=16%, E-value=1e-58, Identity=66%"; Hit description =nucleic acid binding / zinc ion binding
  Pfam annotation: Domain name=DUF537; Domain location=12-157; Score =245.0; E_value=1.6e-70; Accession=PF04396.4; Description=Protein of unknown function, DUF537
MGGHAATTYSAAKISVWWDIDNCRVPKGHNANSIAQNITSALVGINYAGPLSISAYGDTNRIPPPVQHALSSTGVSLNHIPTGANDASDMKILVDMLLWAVDNPAPANYLLISGDTNFSNALHQLSLRKYNILLAHPPHVSPSLAAAAKVVWLWTTLSAGGPPLSDSTSNSCKPPTPAPLLQPFQFKPKPKYIRKITTITPIETKNNDAEPLPPPPQPLRKFFIGAPHEFFTSKCNEPVNLIPTPTSSKEINQILIPRRDSHQKKLNEIPRVMNATTHQDNSEYNVENLIDVIMRTLNLLKVEMILPSEANITDCIRYGDPKYQTIDVRMVLDAAIQQGRLAKRVCGPMHLYLARNDTLWNCVNHMGGHPCDFPQETWDRVKQFLTSSSGRSLMLTSRCRFEASVTLKKSCLREVVLGDVLKILEMMITVKKWIIHHHSGWQPITIRLKESIFSSSVDIAKS

SEQ ID NO: 148786 - protein, 368 aa, Glycine max
  Coding DNA Sequence Number=SeqID_32008
  Gene Ontology: Mol. function=sugar porter activity; Cellular component=membrane; Biological process=transport
  Homolog annotation: Hit_ID=Q75I89; Match level="QueryCoverage=95%, HitCoverage=96%, E-value=1e-143, Identity=71%"; Hit description =Expressed protein
  Pfam annotation: Domain name=TPT; Domain location=158-298; Score =182.5; E_value=1e-51; Accession=PF03151.7; Description=Triose -phosphate Transporter family
  Pfam annotation: Domain name=UAA; Domain location=14-304; Score= -172.5; E_value=0.086; Accession=PF08449.2; Description=UAA transporter family
  Pfam module annotation: Pfam domain module=TPT::UAA; Domain location =158-298::14-304
MAVTMALMTRQHLLTYIYLLVYISLSSGWVLSTLYFNFPFPITLTMIHMAFSGGVAFFLIRVLKVVSPIKMTLHIYATCVVPISAFFAASLWFGNTAYLYISVAFIQMLKALMPVATFLVAVTCGTEKLRCDVFWNMVLVSVGVVISSYGEIHFNVLGTVYQVTGIVAEALRLVLTQVLLQKKGLTLNPITSLYYIAPCSFAFLFIPWYILEKPEMEDPHMQFNFWVFFSNALCAFALNLSTFLVIGRTGAVTIRVAGVLKDWLLITLSTIIFPESKITGLNIIGYAIALGGVVIYNYLKVRDVCTSQLQSIRDESAKELQTEKKADDAMDNKEETSWNDSVSETHLDEEAPLISSRISHFGVGRKPA

SEQ ID NO: 148787 - protein, 91 aa, Glycine max
  Coding DNA Sequence Number=SeqID_32009
  Gene Ontology: Biological process=protein transport
MDSATNVNGATRIRDFIANEVSDWDDEVIAFARFKAFSGQRCDWEPTFLFWKHLIIKIATHFRLLLIRPSQVKNDWFNRRGLTPLCLDNVL

SEQ ID NO: 148788 - protein, 164 aa, Glycine max
  Coding DNA Sequence Number=SeqID_32010
MGHLRFVILFGRSNQQENIGKGVEGRSPEFQEPLDLRFIGDPTNQGHPGLQVKSTLVGRGELSYWRDVTLASQGSFSRKLFSFMYFGMGDFSEAQRSSIHRRFSSKLPSACPRTGCQHILDQGKSSTQGKQYLSRPTLQAIQHQEGRAPQDRHLGDTPKSHHRC

SEQ ID NO: 148789 - protein, 309 aa, Glycine max
  Coding DNA Sequence Number=SeqID_32011
  Gene Ontology: Biological process=regulation of GTPase activity
  Homolog annotation: Hit_ID=Q8L7A4; Match level="QueryCoverage=98%, HitCoverage=76%, E-value=1e-105, Identity=64%"; Hit description =Putative GTPase-activating protein
  Pfam annotation: Domain name=ArfGap; Domain location=1-81; Score= -19.6; E_value=0.0012; Accession=PF01412.9; Description=Putative GTPase activating protein for Arf
  Pfam annotation: Domain name=C2; Domain location=154-233; Score =105.4; E_value=1.7e-28; Accession=PF00168.20; Description=C2 domain
  Pfam module annotation: Pfam domain module=ArfGap::C2; Domain location=1-81::154-233
MVRLGDCLGRVLSLKLDEWTDEQVDALVKFGGNTVINMKYEACLPSNIKKPKPNSSIEERSDFIRRKYEFLQFLDIEENLSCPFVPSHARCSSYSERSSSSNNFPQDKKHYDKQETKSLIGSTFRNSWGRKDSEHKSSKKSNSLAGMIEFIGLIKVNVVKGTNLVIRDVMTSDPYVIISLGHQSVKTRVIKSSLNPVWNESLMLSIPDNIPLLKVLVYDKDIFSTDDFMGKAEIDIQPLVSAAKAYEKSSINDSLQLGKWVANGDNNTLVKDGTISLEDGKVKHDISVRLQHVERGVLEIELECVLLTQ

SEQ ID NO: 148790 - protein, 296 aa, Glycine max
  Coding DNA Sequence Number=SeqID_32012
  Homolog annotation: Hit_ID=Q1SBD1; Match level="QueryCoverage=44%, HitCoverage=52%, E-value=4e-16, Identity=51%"; Hit description =Epoxide hydrolase
MMSFMKLLFPLFCNFSMHHRYHRTTTHTQNIPSSPIANTNLEHLTSSKLHLDFLKKSIEKGIENCRKNRGTYKVLDLSESATPTLLEQHNPNTLAKTKETPNPTSLTTGTSRTQMKKTPLVDDVVSINFDGVVGEAVSGEVDEGDVEALGDEGFGEVLIGVRAKDLGGEGLGGGGFVGVCLDLDGAVIGVVVAKGGGEGEEPVFGVLGAKGGGGEDEEESEKGDKEGEVELEGEGIVVGFAMLTALCSELPCGYKTKGCECWLRGQHHCMSNGAVVLVSNSKVHRTMNICVRLSFS

SEQ ID NO: 148791 - protein, 115 aa, Glycine max
  Coding DNA Sequence Number=SeqID_32013
  Gene Ontology: Mol. function=RNA-directed DNA polymerase activity; Cellular component=membrane; Biological process=RNA-dependent DNA replication
MHSPTNVQKVQKLNGRLTSLFKFLPKLAEKTKPFYKLLKKTEPFSWDETFEHAFLAFKKIIATPPVLSRPRMRAPLLLYLSVVDKVVSSTLVQEEKKHQERCSTSFLRKLLKEAT

SEQ ID NO: 148792 - protein, 213 aa, Glycine max
  Coding DNA Sequence Number=SeqID_32014
MGGFIWGSRMGTSRLNASSRIMLVPLVQLVQVGLEVFFALVTLLSDLADFIPESRHFFHLDVALSSFMQLVHATRIEIFDLDNHAPKSVHELSEELVVCLSQIGQGGQGHAVRPAIGLLHTESFDEGVEGVYGPRWEFIVPGIQVLIWICCPIIPLEEGLRLFALLLMRRGCDSPWVRSGKIVWVCHNYRMRRGVCEGSLMPEAKLSANHGRM

SEQ ID NO: 148793 - protein, 85 aa, Glycine max
  Coding DNA Sequence Number=SeqID_32015
  Gene Ontology: Mol. function=RNA-directed DNA polymerase activity; Biological process=RNA-dependent DNA replication
MVRVLGTCLVQISVVGAHSPFYVGLFYHDDVGKPGEKPDLFDEVGMEDLHVGDALVLITSEVPTKPSALPRSRSELQLYKLFDGF

SEQ ID NO: 148794 - protein, 798 aa, Glycine max
  Coding DNA Sequence Number=SeqID_32016
  Gene Ontology: Mol. function=nucleic acid binding; Cellular component= intracellular; Biological process=regulation of transcription, DNA -dependent
  Homolog annotation: Hit_ID=Q75IH8; Match level="QueryCoverage=89%, HitCoverage=98%, E-value=1e-118, Identity=37%"; Hit description =Putative zinc-finger protein
MDDCCAVCAEPLEWVAYGPCLHREVCSTCVARLRFICDDRRCCICKTECNLVFVTKALGDYTRMINDFSTLPLEAREGKVGSYWYHEDTNAFFDDVDHYRMIKAMCRLSCNVCDKIEDQPQDAASRRRAKFRNIGQLKGHLFHRHKLHMCNLCLEGRKIHFRQEHFLCEDEACLAKKFVVFQSEAEMKRHNAIEHGGRMSRSKRNAALQAITAFIPPLQIPTSFRYRHGNEHEQRRGRGRTFRRDTENQLSMAIEASLETANAEQTFLDQSTSSSGQVAVDDGNDDIDALIQPFESLAAGSEASARYLQALGHSSRNGPLEDSSFPPLPIISSNGQQRSKHELEGSSSNTMAARLRRHGNRTVSVINSGNAWPAAGRGLVQSSSNPSQSKLSTNNVLGLSRNTGQMKTVINSGPSSSTYAGSIQATQRTAHGQFPAGSSRNTRDNVRIVHSASAPNLMENNSVEVSISDFPPVSAAQVSKLPASSQSSLNVENVQSANKSLVEKIRGALDFDEERYSIFKDISAQYRQGTIDTGTYLDYVQQFGLSHLVLELARLCPDTHKQKELVEAYNASLQRDAFPEINLVRGSTSTHSKDSNVNKKGKEEKAEVLSRGDYRSEGGKLKIEQRIDMNSGSQPTMKLGGKTETSNDSLSNQSKDDGGGGNKQRKKTSKFLRVRLGDGSVSALLDQSDPGTTDGSEGNKDDSGGGPPVRGVWRKGGAVVELQYEHELNGIGERNNDGGGPTVSRMAHAPWPLPRRHLSSLFSSLSQSLSSFSARSRIGHYIATFLAELRGLGSAKGS

SEQ ID NO: 148795 - protein, 325 aa, Glycine max
  Coding DNA Sequence Number=SeqID_32017
MSGLVIVAWLEALKDEGTLLKGLKKAFMVVQEYRRRVRTPTWVNVLSSEHVLDLSFDFLLLKGGRVAGVWKSGEYARRRRCTGGGMEVLAAIGPGVPLNHNGDVATNLIAGDLGAIAHHNHQQRYRLGNPVEEMGQKIMDKVVGWPDKVCRLSWAKCGVEGWSVGLGKGEGDVGNRGGRVEEGGKDEGGRWARGDDEGGLKGQDFAADIWCEVGNEAVEEERGRETHNPVGQGFELSKVGVDGRGKIEALVPEERRTRKVAGRFGASTETSSVQRRQGSYGVQVNEVRVMGKLFRGREGKKRVMASSMRDRVWERVLLAMERRDQ

SEQ ID NO: 148796 - protein, 109 aa, Glycine max
  Coding DNA Sequence Number=SeqID_32018
MKSVYEVHGALQNQNFDLFKRISKWKGLEKVKGFLWKLGHECLLTNSKRMQFGMIHLNLYPTCKVLEEHLFHLFRDCPNTIIFQGEKWTVEVVIKKACNMTHSYKDNLM

SEQ ID NO: 148797 - protein, 54 aa, Glycine max
  Coding DNA Sequence Number=SeqID_32019
MISSVAPNSKSLLCCDVGISKGRCLAIYSHQSPHDRTPEPEVSPLDFKGVEKRW

SEQ ID NO: 148798 - protein, 145 aa, Glycine max
  Coding DNA Sequence Number=SeqID_32020
  Gene Ontology: Mol. function=endopeptidase inhibitor activity
  Homolog annotation: Hit_ID=Q1SMD8; Match level="QueryCoverage=53%, HitCoverage=38%, E-value=2e-15, Identity=56%"; Hit description =Kunitz inhibitor ST1-like
  Pfam annotation: Domain name=Kunitz_legume; Domain location=31-144; Score=-39.8; E_value=0.026; Accession=PF00197.9; Description=Trypsin and protease inhibitor
MKKVSALAFSILFLAFTIEPFIGIAEAAPEVVLDTSSHKLRIGVKYYILSVFKGKGGGLTISSSDNNTCSFFVVQEKLEVSKAPKPLSPSGHKSNPRCSTVAPPPNCLRPTNPTWHLEKHVHPPHQPCYKSVDAWPLAAELPNKQ

SEQ ID NO: 148799 - protein, 84 aa, Glycine max
  Coding DNA Sequence Number=SeqID_32021
MASTSGDATAPFPKTTRLMVEMIKLGDQIRIMNYENEERMERMRKENEESLGIIHRSRETLSMRGMKRIREEGGMRGIRREEII

SEQ ID NO: 148800 - protein, 73 aa, Glycine max
  Coding DNA Sequence Number=SeqID_32022
MLSQGVGVKGGRCHCWGWPPKEMLSQEVAVKGDAITGGVKIDGRDKGGVRVGRWEMCNRKYIITHHFSCSTHQ

SEQ ID NO: 148801 - protein, 313 aa, Glycine max
  Coding DNA Sequence Number=SeqID_32023
  Gene Ontology: Mol. function=exonuclease activity; Cellular component= intracellular
  Homolog annotation: Hit_ID=Q1S1E2; Match level="QueryCoverage=71%, HitCoverage=27%, E-value=4e-61, Identity=55%"; Hit description=Zinc finger, CCHC-type; Putative 5-3 exonuclease
DTCSGGMNGYISLCGGEPCPPIFRSPVASMEDIMDNHVICAIYRLPDAHTHITRPPQGVKFPKKIQAGDTMLKMGAAGHLVGLKLTGSPFFCIRKNPPGSISGRELGDAAHRLIVNSLQAKVDTNGYRHPHNGPPISYPAPMGHHRQPLPSHGYESCPGYVAMPPPISAPSLQGRPQFAPYNAVPTAPQYGYNQPYPAPPVGYNHPRQQSNPVERNDYQHPRSHNYERNHHQGSGGSSRHGYQSSGNNHNARFNNSHGSHHSQSFQPRAHQNWTPRNNPSGHRDHGQYSSNQYSLLDRRGNRNQMPPPGYSRK

SEQ ID NO: 148802 - protein, 184 aa, Glycine max
  Coding DNA Sequence Number=SeqID_32024
  Gene Ontology: Mol. function=exonuclease activity; Cellular component= intracellular; Biological process=regulation of transcription, DNA -dependent
  Homolog annotation: Hit_ID=Q1S1E2; Match level="QueryCoverage=87%, HitCoverage=20%, E-value=3e-79, Identity=87%"; Hit description=Zinc finger, CCHC-type; Putative 5-3 exonuclease
MNKVRICESTLKFYPYHYAPFASDLKGLGELDISFKLGTPFKPYDQLLGVFPAASSHALPEPYRRLMTDPSSPIIDFYPVDFEVDMNGKRFAWQGIAKLPFIDEVRLLAEVQKIENLLTPEEKRRNAIMFDLLFVNSCHPLSACISTLDNKCKNMPNSERAVVKEKINPKESCGFVLMEHYLCL

SEQ ID NO: 148803 - protein, 1140 aa, Glycine max
  Coding DNA Sequence Number=SeqID_32025
  Gene Ontology: Mol. function=protein transporter activity; Cellular component=soluble fraction; Biological process=ER to Golgi vesicle -mediated transport
  Homolog annotation: Hit_ID=Q9C698; Match level="QueryCoverage=93%, HitCoverage=99%, E-value=0.0, Identity=45%"; Hit description=Mysoin -like protein; 11013-7318
  Pfam annotation: Domain name=DUF593; Domain location=236-314; Score= -24.5; E_value=0.017; Accession=PF04576.6; Description=Protein of unknown function, DUF593
  Pfam annotation: Domain name=DUF869; Domain location=157-1037; Score =1212.1; E_value=0; Accession=PF05911.2; Description=Plant protein of unknown function (DUF869)
  Pfam annotation: Domain name=Strep_SA_rep; Domain location=127-151; Score=4.2; E_value=21; Accession=PF06696.2; Description =Streptococcal surface antigen repeat
  Pfam annotation: Domain name=Strep_SA_rep; Domain location=244-268; Score=12.5; E_value=0.95; Accession=PF06696.2; Description =Streptococcal surface antigen repeat
  Pfam annotation: Domain name=Strep_SA_rep; Domain location=901-925; Score=0.4; E_value=87; Accession=PF06696.2; Description =Streptococcal surface antigen repeat
  Pfam annotation: Domain name=Strep_SA_rep; Domain location=936-960; Score=1.7; E_value=54; Accession=PF06696.2; Description =Streptococcal surface antigen repeat
  Pfam annotation: Domain name=Strep_SA_rep; Domain location=992-1015; Score=0.3; E_value=91; Accession=PF06696.2; Description =Streptococcal surface antigen repeat
  Pfam module annotation: Pfam domain module=DUF593::DUF869::Strep_SA _rep::Strep_SA_rep::Strep_SA_rep::Strep_SA_rep::Strep_SA_rep; Domain location=236-314::157-1037::127-151::244-268::901-925::936-960::992 -1015
MRVNQGPKNGCQNYEQSTIWPYPVALFAFGVVSCVLFLSPPTLPTSAWSHLLLSSVENGSHLCGGCPYFSMDRRWPWKKKSSDKAVLEKAAAELDSAAGAAATQKPSYIQISVESYSHLTGLEDQVKTYEEKVQTLEDEIKELNEKLSAANSEINTKESLVKQHAKVAEEAVSGWEKAEAEALALKNHLETVTLAKLTAEDQASQLDGALKECMRQIRNLKEEHEQKIQEVTLTKTKQLDKIKGEFEAKIANFEQELLRSAADNAALSRSLQERSNMIINLSEEKAHAEAEIELLKGNIESCEREINSLKYELHVISKELEIRNEEKNMSMRSAEAANKQHMEGVKKIAKLEAECQRLRGLVRKKLPGPAALAQMKLEVESLGREYGETRLRKSPVKPASSHMSTLAGFSLDNAQKFHKDNEFLTERLLAMEEETKMLKEALAKRNSELQASRSSFAKTLSKLQILEAQVQTNNQQKGSPQSIIHINHESIYSQNASNAPSFVSLSEDGNDDVGSCAESWSTAFLSELSQFPKEKNTEELSKSDATKKLELMDDFLEVEKLAWLSNESSGVSVTSNNITNEIVVNDLSEVSAGKDVPSNTQENSEPNPLPSEVSSAEELSAPDPQSDVPAGLSLAELQSRISSVFESLAKDADMEKILKDIKHALEEACGTSIQDSVSAIPHDVKPSDTTCDELGNAEDAGSNAEKEISSQKPTEFVQMTSDLEAATSQIHDFVLFLAKEAMTAHDISSDGDGISQKMKEFSVTFNKVTCNEASLLQFVLDLSNVLAKASEFRFNILGYKGREAETNSPDCIDKIALPENKLVQDNSSGERFQNGRSHILNPCSDPEIPDDGNLAPGYESNATSQKFSMENFEELKLEKEKAVVDLSKCVENLEMTKSRLLETEQHLAEVKSQLTSAQRSNSLAETQLKCMTESYRSIEARAKEFETELNHLQMKTETLENELEDEKRAHEEALAKYKELEEQLQRNESSAADNDIKTKQERDLEAAAEKLAECQETIFLLGKQLKSMHPQTEPTGPPYSKAEGFAEREPNSPNFQDQAEMDSASSAFVQRLGGESPLHFSNSLYSPSDNESNFPAISSVQNPNHRPTKSTSSSASSTPTPEKHNRGFSRFFSSKGKNGH

SEQ ID NO: 148804 - protein, 74 aa, Glycine max
  Coding DNA Sequence Number=SeqID_32026
MASYGEAKDSIDEEDPRPTSSTWSYIKVEVETSHILKNSSKRLGSEKLGLSQSSCFPDANKKTGNPLHLIISKM

SEQ ID NO: 148805 - protein, 578 aa, Glycine max
  Coding DNA Sequence Number=SeqID_32027
  Gene Ontology: Mol. function=exonuclease activity; Cellular component= intracellular; Biological process=regulation of transcription, DNA -dependent
  Homolog annotation: Hit_ID=Q5N739; Match level="QueryCoverage=99%, HitCoverage=53%, E-value=0.0, Identity=73%"; Hit description =Putative 5'-3' exoribonuclease
  Pfam annotation: Domain name=XRN_N; Domain location=1-255; Score =607.7; E_value=1.1e-179; Accession=PF03159.8; Description=XRN 5'-3' exonuclease N-terminus
  Pfam annotation: Domain name=zf-CCHC; Domain location=261-278; Score =25.6; E_value=6e-05; Accession=PF00098.13; Description=Zinc knuckle
  Pfam module annotation: Pfam domain module=XRN_N::zf-CCHC; Domain location=1-255::261-278
MGVPAFYRWLAEKYPMVIVDAIEEEAVVIDGVQIPVDTSNKNPNNIEYDNLYLDMNGIIHPCFHPEDRPSPTSFDEVFECMFDYIDRLFVMVRPRKLLYMAIDGVAPRAKMNQQRSRRFRAAKDAADAAAEETRLREEFEKEGRKLPPKGESQTFDSNVITPGTEFMAVLSIALQYYVHLRLNNDPGWQNIKVILSDANVPGEGEHKIMSYIRLQRNLKGYDPNTRHCLYGLDADLIMLALATHEIHFSILREVVFTPGQDKCFLCGQMGHMAANCEGKAKRKAGEFDEKGEAIVAKKPFQFLNIWTLREYLEYEMRIPNPPFEIDFECIVDDFIFMCFFVGNDFLPHMPTLEIREGAINLLIAVYKKEFREFGGYLTNGSTINLSKVEHFIQAVGSYEDKIFQKRARLHQRQTERIKREKAQARRGDDAEPQFKPESLVAVSRFHGSRLASAPNPSPFQPSGHYNSQVSASVRKDNKEAFERPYKVARVSSGATVAAAIVEAENNLEIDAQDNKDELKTKLKEILREKSDVFNSKNAEEDKIKLGEPGWKERYYDEKFSAKTPEELEAIRKDVVLST

SEQ ID NO: 148806 - protein, 186 aa, Glycine max
  Coding DNA Sequence Number=SeqID_32028
MGGGCSELVVQNHLRQLPLHVTPLLSIKRSRREGRGREEQGGEEGERGGRKKGEGEWQEGGEGGHTMAVAASLVSTCCLRKQIYATLLNWGHNDERWLWTIGTIGSSKKLRDRLECASAATLVASKSGQDIVAFIYHDLTQQGTLFTGHCLRKAPSNKDVSRFHRIGPPKKAQNPKKLDLDHSKYA

SEQ ID NO: 148807 - protein, 88 aa, Glycine max
  Coding DNA Sequence Number=SeqID_32029
MFFRMKDFYVTEQSSSVRPYGTTFFRMNIRNKVVPYELTEEGEIQSTNLEQTQQMHQKASPTSDNGGRKKMLGAQEKKRELEREEEKK

SEQ ID NO: 148808 - protein, 35 aa, Glycine max
  Coding DNA Sequence Number=SeqID_32030
MSYLELSYMTSWKIVCGSLRERPMLEVLGRDVDCA

SEQ ID NO: 148809 - protein, 187 aa, Glycine max
  Coding DNA Sequence Number=SeqID_32031
  Subcellular localization annotation: CTP_CleavageSite=39; ConfidenceScore=5.15e-01
MASRKRARADDIPSPSTPAPPSATIGPDVQSSQTLVLMLQSLFQGQVIIMHSLRELAHQRTILTMEQFLKQVTWPGALPSMVRPNEATPHEPTLAQVEPVPANPQSLVANPPSPKLEAVPPSPPIIIISDSPSGKTAAPPDSPTGEAADLSDSLSGEVVALFDSHVFHLIDEEDAQTHDTQDLSQGF

SEQ ID NO: 148810 - protein, 52 aa, Glycine max
  Coding DNA Sequence Number=SeqID_32032
MEKSDREGVFNASHALSARLPSYSLSVAITLSAKDLDIEKCLYSKKWKMISK

SEQ ID NO: 148811 - protein, 131 aa, Glycine max
  Coding DNA Sequence Number=SeqID_32033
  Gene Ontology: Mol. function=transferase activity; Biological process= DNA integration
  Homolog annotation: Hit_ID=Q1RVS1; Match level="QueryCoverage=62%, HitCoverage=71%, E-value=4e-17, Identity=53%"; Hit description =Polynucleotidyl transferase, Ribonuclease H fold
MYQKKYEINILKRFNMTNCNPTTTPAETAYQVAWLEILLEELNLIEDKPMRLLVDNKSTIDLAKRSIAHGRSKHIETRLHFSCDQVTKEKLELEYCKSKEQVADILTKPLKLVKFHKLRDKLGILSLADLN

SEQ ID NO: 148812 - protein, 49 aa, Glycine max
  Coding DNA Sequence Number=SeqID_32034
MYKKEKVTRGLILTLVSWSSTGFLVNFDSLPWNVSVKMLLLEFTRVFGI

SEQ ID NO: 148813 - protein, 109 aa, Glycine max
  Coding DNA Sequence Number=SeqID_32035
MYKNEIGLIKKLMPLCEVQHTLHEGNQCVDVLAKLGANSLSPLDALHDPPVAGRRTEGCLPKAVQNLDSEYFDASLKATETCDQRRNHGRHSSVTKSSRKSCLVFPSNL

SEQ ID NO: 148814 - protein, 46 aa, Glycine max
  Coding DNA Sequence Number=SeqID_32036
MDLLDGSMMGSPPRAGFGGLCRVHHGSFLVGLYGHVGGQEILYAEI

SEQ ID NO: 148815 - protein, 125 aa, Glycine max
  Coding DNA Sequence Number=SeqID_32037
MGGAITLSDIPCEGNRVIKESKHLRKGMVRSFNLSMVFALDDAMFHTLDVVYVRGGGGCIDLVGCPLCGKIEWLKSLNIFEGMFRIFNSSMGVRHLVGNSLVAQADHRGGGGVTMHDWVALTITA

SEQ ID NO: 148816 - protein, 65 aa, Glycine max
  Coding DNA Sequence Number=SeqID_32038
MAARATAAQRQKQTKNEEEEASFLLVPKAIVIKEMPTHYMSQKEMNTPMTQGNCFVHLAFLLHRQ

SEQ ID NO: 148817 - protein, 289 aa, Glycine max
  Coding DNA Sequence Number=SeqID_32039
  Homolog annotation: Hit_ID=Q1T1F7; Match level="QueryCoverage=83%, HitCoverage=51%, E-value=3e-15, Identity=27%"; Hit description=IMP dehydrogenase/GMP reductase
  Pfam annotation: Domain name=DUF1723; Domain location=163-212; Score =42.4; E_value=1.6e-09; Accession=PF08330.1; Description=Protein of unknown function (DUF1723)
MSLIVNQPFNVKIMIRARGLGRALGRVIGRALSREVSHDADEGPQRRRPTTSARRQWEVTPIAEDVKHVDHATKEVHEQPQEAPAADVVSDVEGFPDRPHNTSVLMDYVHHVTVIVWNEEERFELKLFSHGRKVEKFGRSAPKIESLVVVTGLSPLIACSLDNGDRGLVSTFAERWHKETSSFHLLVGGVSITLDDMASLLHLTITGTFNSFEVLHVNDVVFLLVELLEVSSEEARAETIQCHGAYVRLSWLRDIYRSKCDVAKWTMAAPTYLLHLLGCTLFANKSATH

SEQ ID NO: 148818 - protein, 81 aa, Glycine max
  Coding DNA Sequence Number=SeqID_32040
MDNRHHHREFTFLSSAHFLDHIDPPSIKEMDFFSTSSPRDHKNNTSSRDTNDNHYQNRDDQHDTHDRHGSPTRVIDHRVNV

SEQ ID NO: 148819 - protein, 69 aa, Glycine max
  Coding DNA Sequence Number=SeqID_32041
MTPTHDTLLYYNRRWNMPHQDDFMGYSFTGKNPKRFDIPSGCSIDGIKDVIMQVAPQGIPLMPGHSEYS

SEQ ID NO: 148820 - protein, 163 aa, Glycine max
  Coding DNA Sequence Number=SeqID_32042
  Gene Ontology: Mol. function=DNA-directed RNA polymerase activity; Cellular component=nucleus; Biological process=transcription
  Homolog annotation: Hit_ID=Q2HW77; Match level="QueryCoverage=89%, HitCoverage=65%, E-value=7e-46, Identity=64%"; Hit description=RNA polymerase subunit, RPB5; RNA polymerase Rpb5, N-terminal
  Pfam annotation: Domain name=RNA_pol_Rpb5_C; Domain location=90-163; Score=57.5; E_value=4.4e-14; Accession=PF01191.9; Description=RNA polymerase Rpb5, C-terminal domain
MDKSLKVREDEWRERRSMKFCASNEVQVVFVGPKEIRKGTVNEICSQIADKGSLKWLILVVKSKMTSFAKKDLENFPFKVETIKIDDLLVNITKHVLQPKYEILTDDEKQALLTKHNLDEKQLPHMLKTDTIARYYGLEKGQVVKITHSGPVVNFDVSYRCVV

SEQ ID NO: 148821 - protein, 173 aa, Glycine max
  Coding DNA Sequence Number=SeqID_32043
  Gene Ontology: Mol. function=DNA binding; Biological process=DNA integration
  Homolog annotation: Hit_ID=Q2HT49; Match level="QueryCoverage=59%, HitCoverage=14%, E-value=4e-12, Identity=30%"; Hit description =Integrase, catalytic region
MNAEIKALELNNTWVLTDLPQHKNLDLNNAFLHGDLNEEVYMTLPQGMQVAKPGKFANFKDDIVLSGNDIAKVQSITQLLDNAFKIKHPGDLRSRTGFRLSNRKSPGEERLGPPTVVEELNEEQQQPPVEEGVTDVEGFPGESHDTSVLRDFENRIALRVWDGEEYAELKLSS

SEQ ID NO: 148822 - protein, 673 aa, Glycine max
  Coding DNA Sequence Number=SeqID_32044
  Gene Ontology: Mol. function=structural constituent of ribosome; Cellular component=intracellular; Biological process=translation
  Homolog annotation: Hit_ID=Q6YS36; Match level="QueryCoverage=99%, HitCoverage=85%, E-value=2e-79, Identity=27%"; Hit description =Putative fertility restorer homologue
  Pfam annotation: Domain name=PPR; Domain location=11-45; Score=30.9; E_value=4.4e-06; Accession=PF01535.11; Description=PPR repeat
  Pfam annotation: Domain name=PPR; Domain location=116-150; Score =39.1; E_value=1.5e-08; Accession=PF01535.11; Description=PPR repeat
  Pfam annotation: Domain name=PPR; Domain location=152-186; Score =37.5; E_value=4.6e-08; Accession=PF01535.11; Description=PPR repeat
  Pfam annotation: Domain name=PPR; Domain location=187-221; Score =43.6; E_value=6.9e-10; Accession=PF01535.11; Description=PPR repeat
  Pfam annotation: Domain name=PPR; Domain location=222-256; Score =48.1; E_value=3e-11; Accession=PF01535.11; Description=PPR repeat
  Pfam annotation: Domain name=PPR; Domain location=257-291; Score =38.0; E_value=3.2e-08; Accession=PF01535.11; Description=PPR repeat
  Pfam annotation: Domain name=PPR; Domain location=292-326; Score =31.4; E_value=3.1e-06; Accession=PF01535.11; Description=PPR repeat
  Pfam annotation: Domain name=PPR; Domain location=327-361; Score =53.1; E_value=9.4e-13; Accession=PF01535.11; Description=PPR repeat
  Pfam annotation: Domain name=PPR; Domain location=362-396; Score =29.1; E_value=1.6e-05; Accession=PF01535.11; Description=PPR repeat
  Pfam annotation: Domain name=PPR; Domain location=397-431; Score =30.9; E_value=4.5e-06; Accession=PF01535.11; Description=PPR repeat
  Pfam annotation: Domain name=PPR; Domain location=432-466; Score =46.0; E_value=1.3e-10; Accession=PF01535.11; Description=PPR repeat
  Pfam annotation: Domain name=PPR; Domain location=46-80; Score=26.9; E_value=7e-05; Accession=PF01535.11; Description=PPR repeat
  Pfam annotation: Domain name=PPR; Domain location=467-500; Score=1.0; E_value=5.6; Accession=PF01535.11; Description=PPR repeat
  Pfam annotation: Domain name=PPR; Domain location=537-571; Score =36.9; E_value=6.8e-08; Accession=PF01535.11; Description=PPR repeat
  Pfam annotation: Domain name=PPR; Domain location=572-606; Score =39.6; E_value=1.1e-08; Accession=PF01535.11; Description=PPR repeat
  Pfam annotation: Domain name=PPR; Domain location=607-641; Score =49.2; E_value=1.4e-11; Accession=PF01535.11; Description=PPR repeat
  Pfam annotation: Domain name=PPR; Domain location=81-115; Score=31.7; E_value=2.6e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=11-45::116-150::152-186::187-221::222-256::257-291::292 -326::327-361::...
  Pfam module annotation: Domain location=362-396::397-431::432-466::46- 80::467-500::537-571::572-606::607-641::81-115
MSKLARTPSLRSCNSLLAKLVRSGEGDAALMVFEQVLKMGIVPDVYMISIVVNAHCREGSVECAERFVEKMEGMGFEVNVVVYNALVGGYVCKGGVDGAERVLSLMSGRGVERNVVTWTLLMKCYCRQGRVDEAERLLRRMKEDEGVVVDDRVYGVLVNGYCQVGRMDDAVRIRDEMARVGLRVNVFVCNALVNGYCKQGWVGKAEEVLREMVDWNVRPDCYSYNTLLDGYCREGRMAESFMLCEEMIREGIDPSVVTYNMVLKGLVDVGSYGDALSLWHLMVQRGVVPNEVSYCTLLDCLFKMGDSDRAMKLWKEILGRGFSKSNVAFNTMIGGLCKMGKVVEAQTVFDRMKELGCSPDEITYRTLSDGYCKIGCVVEAFRIKDMMERQTISPSIEMYNSLINGLFKSRKSSDVANLLVEMKRRALSPNAVTFGTLISGWCNEEKLDKALTLYFEMIERGFSPNSVICSKIVISLYKNDRINEATVILDKMVDFDLLTVHKCSDKSVKNDFISLEAQRIADSLDKSDICNSLPNNIVYNIAIYGLCKSGKIDEARSVLSILLSRGFLPDNFTYGALIHACSAAGDVGGAFNLRDEMVERGLIPNITTYNALINGLCKVGNMDRAQRLFHKLPQKGLVPNVVTYNILITGYCRIGDLNEASKLREKMIEGGIS

SEQ ID NO: 148823 - protein, 69 aa, Glycine max
  Coding DNA Sequence Number=SeqID_32045
MARNVFGYKNVYGKTGSSGSNVRTKLAISASIYNGITKYLPMGISGFNPNSIQLSRSEHKVNQVTPSPL

SEQ ID NO: 148824 - protein, 54 aa, Glycine max
  Coding DNA Sequence Number=SeqID_32046
MPRSENALRSMSKAVGEKPNSRERSWWSMERVSGKSLARARMWRRRQKEVAWGR

SEQ ID NO: 148825 - protein, 200 aa, Glycine max
  Coding DNA Sequence Number=SeqID_32047
  Subcellular localization annotation: CTP_CleavageSite=58; ConfidenceScore=5.18e-01
MSSGGDDLPQPPSHDSIRPPDVAATPFPPPTEARPFSSHVDARGPSTIPAFTPSPSCLASHLKEVSLAIREEASQGGELSYERASSPSFLSKAHLGGEAPSSMAYSLMDGASSHLFSFVFRCISMGTSFVVQVEGTSTWIIVTENKRGYISCGSVQVEGTSTWLFKENKGWYIPCGSLLVKAFKRLKRNLKDRRSLEDWM

SEQ ID NO: 148826 - protein, 277 aa, Glycine max
  Coding DNA Sequence Number=SeqID_32048
  Gene Ontology: Mol. function=aminoacyl-tRNA ligase activity; Cellular component=cytoplasm; Biological process=tRNA aminoacylation for protein translation
  Homolog annotation: Hit_ID=Q22620; Match level="QueryCoverage=75%, HitCoverage=24%, E-value=2e-41, Identity=44%"; Hit description =Prolyl trna synthetase protein 1, isoform a
  Subcellular localization annotation: CTP_CleavageSite=49; ConfidenceScore=5.21e-01
MAGTEAKKTESKKPAAKQSGNSHYSFSCMFVCVSCLCMFVLLTATERSLAGGKKKEVKKETGLGLTHRKAENFGEWYSEVVVNAEMIEYYDISGCYILRPWSMAIWEIMQEFFDPEIKKMKIKNCYFPLFVSPGVLQKEKDHVEGFAPEEYSPGISCIDWYGCKDLEIIACSNQLFIQWSRAFLIRDMLCWIVIFFPEGYFNISTCLIVLLFHQVAWVTKSGESELEIPIAIRPTSETVMYPYYSKWIRGHRDLPLKLNQWCNVVRWEFSNPTPFIR

SEQ ID NO: 148827 - protein, 336 aa, Glycine max
  Coding DNA Sequence Number=SeqID_32049
MACNQLQGVLVYKYLDFRRTLIPHSRVTAPLAPKSSYLTHFLRKSLQTKPNLHHFQFSFKPTNQNPLQHLQMLESSKKRKRSSSTTTAAGHRRQGTSGNPPTPVPPSLSSPRPSTLFSSDDQCQRYYSQFYNRVILDPKYLDLEFFDGETFDCYQVFQNSGLIDFMSLKLPYFPELVKIDWAHLVRYRMHKALRANAPLLYPHLVTLFFHHLNVPLDDEPFVKVIRSFSIGAGAVTSFGYQKDVDGEWVHKHDLPSPIPDERTPSPPPQLGDSTTLLTEVLTELHDLRAFVGERFNAMDTRLDVMDTCFDGMDMRITRLEDDMSFIRHCFDPSADF

SEQ ID NO: 148828 - protein, 66 aa, Glycine max
  Coding DNA Sequence Number=SeqID_32050
MRVGREVFCEREKRRWDEFIDPNSAIEWNEFDDSDAHKSDDVLDPSSWRLIFDYTPSALARIQRLI

SEQ ID NO: 148829 - protein, 96 aa, Glycine max
  Coding DNA Sequence Number=SeqID_32051
  Homolog annotation: Hit_ID=Q1RV39; Match level="QueryCoverage=61%, HitCoverage=5%, E-value=2e-11, Identity=60%"; Hit description =Calponin-like actin-binding; Kinesin, motor region
MGYEVFLPKSDFDIVQALTSIVQQTKLGMQFMQNEHQKEIINLSKHLHCLASAASGYPQVLDENCKLYNIVQDLTALLDDEEFAKAAQSITWPFGE

SEQ ID NO: 148830 - protein, 74 aa, Glycine max
  Coding DNA Sequence Number=SeqID_32052
MIFVGWEPNIVNYNKIMGSLCKGRVNEALNIFKKLVRCGVLGTNLEHWGWFCVGVANQKENLMPPDEDHLPLIV

SEQ ID NO: 148831 - protein, 75 aa, Glycine max
  Coding DNA Sequence Number=SeqID_32053
  Subcellular localization annotation: CTP_CleavageSite=24; ConfidenceScore=5.15e-01
MDEYALVGTSSKSISKSMSFDGARRMALKHIKAFVLMFSNPQAFEAPATSVICSCNIMTAYIFSMGHMVDRPITF

SEQ ID NO: 148832 - protein, 157 aa, Glycine max
  Coding DNA Sequence Number=SeqID_32054
  Gene Ontology: Mol. function=zinc ion binding; Cellular component =COPII vesicle coat; Biological process=ER to Golgi vesicle-mediated transport
MFCPLFFLIFLSSFLLFCLVCLQPFLLPGQWLLPVLKAAVAGGQMASQGGAELAADEGRSAAALAACRTLAEELTEYRFPAPRILAFKEGSSQARYFVSRLIPAHKDPPYEQEARFPQLRSLTSEQRTKLKASFVHFDDPSFCEWMRSLKVVPPQPS

SEQ ID NO: 148833 - protein, 60 aa, Glycine max
  Coding DNA Sequence Number=SeqID_32055
VPSLLCKSPLRLAISIAGQIAIYSGETTGIANGSSVFAATCCTSEFLASIIGDLHVSYVK

SEQ ID NO: 148834 - protein, 50 aa, Glycine max
  Coding DNA Sequence Number=SeqID_32056
MSSLLNPHAVRLLLQPPRPPCCPHPQPISGPLSSTLHQNLVRPTLSTRAA

SEQ ID NO: 148835 - protein, 83 aa, Glycine max
  Coding DNA Sequence Number=SeqID_32057
MTSGAHRGFNRWSFKVEIFKVSFGEGEGTGVHCCGGWFVGGGNRGTHFCWVCVSGVVRKSYGSTSSVKADTDQLDPYKPYGSS

SEQ ID NO: 148836 - protein, 72 aa, Glycine max
  Coding DNA Sequence Number=SeqID_32058
CSSQVLASFGEFISTTYCYVIVLACFPPSDWYQSRWFDLVSGSNGRHVPWVEQQCKYRKYLEHVGSNGYTRG

SEQ ID NO: 148837 - protein, 122 aa, Glycine max
  Coding DNA Sequence Number=SeqID_32059
MAISWMPNLGIVQAMYDIASMLHRSLFPNEGVKSTYHHLMENKLPRNELKVQDVDPQTSFNISLQWYNEWYQVRHHKEPRTLSTPEAHAQLPFSMELQILEKLKLRHSYTHYNGPLLWASIM

SEQ ID NO: 148838 - protein, 74 aa, Glycine max
  Coding DNA Sequence Number=SeqID_32060
MKKGFWAILEAFACLEIFRERKVQVPESFESFCCVKTGKELSMKRKKLPRYGELNPLLVLPYSTSFQCDFALIT

SEQ ID NO: 148839 - protein, 139 aa, Glycine max
  Coding DNA Sequence Number=SeqID_32061
  Gene Ontology: Mol. function=protein disulfide isomerase activity; Cellular component=endoplasmic reticulum; Biological process=cell redox homeostasis
  Homolog annotation: Hit_ID=Q43116; Match level="QueryCoverage=99%, HitCoverage=94%, E-value=6e-59, Identity=58%"; Hit description =Protein disulfide-isomerase precursor
  Pfam annotation: Domain name=Thioredoxin; Domain location=20-125; Score=144.3; E_value=3.2e-40; Accession=PF00085.10; Description =Thioredoxin
DGSVEPFKKSEPIPEVNNESVKVVVADNLQDIVFNSGKNVLLEIYAPWCSHCKKLAPILEEVAVSYQSNPDVIIAKLDATANDIPRDTFDVQGYPTVYFRSASGQISQYDGSRKKEDIIDFIEKNRDKVDQQESVKDEL

SEQ ID NO: 148840 - protein, 82 aa, Glycine max
  Coding DNA Sequence Number=SeqID_32062
HIYACKADLPGQKEEEARAQSADGRVFKIVPWHHLEHSTSNSLSIQALSHDLTGSDRGGFDQIDKDDSNLPLDTAPIKHVTQ

SEQ ID NO: 148841 - protein, 125 aa, Glycine max
  Coding DNA Sequence Number=SeqID_32063
MSLPSAVHVSSTFDFGAMLHDCPSVDPQVQSSILPLFSEPHECHCLALFMCPPLSSMKPLKKKEGVETRVVITERAGRTKSVSYLCFPLISDERYLAPFGAQYVKSRDVPKIKRKQAYAIRENSV

SEQ ID NO: 148842 - protein, 66 aa, Glycine max
  Coding DNA Sequence Number=SeqID_32064
MELLQRLRTGPFDPRSSWGGSGSIYLIRVPWMIKTKNIKVSSLHIYANVPCAVSYAAMNYPIPPNL

SEQ ID NO: 148843 - protein, 85 aa, Glycine max
  Coding DNA Sequence Number=SeqID_32065
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=100%, HitCoverage=16%, E-value=1e-31, Identity=72%"; Hit description =Protein disulfide-isomerase precursor
MEALSKFVEESSVPIVTVFNNDPSNHPFVVKFFDNPNVKAMMFFNFTVDNADSLKSKFRESAEQYRQQGISFLVGDLEASQGAFQ

SEQ ID NO: 148844 - protein, 310 aa, Glycine max
  Coding DNA Sequence Number=SeqID_32066
MELLHLLKLRINCRHLYEDLAEDLFHLFPSQSQVFRQKNLLKTWKKSLVKQEENTLQDFYDNWSPSAAPAKQFQNQLAPSGIQSSPSSILGQPKQIQGAETLYQNIINPFAASSVYGNLTNTYPAMPMLSQTQPALSGYEVSPGIVNPVNNLVDSVKPQIMTPQEKIEKLRRRQQMQAMIAIQKQQQQLGHQVPSTSKSSTQKCPPEIQSHLSDGTDDDLRTLPALDPPIEQDDSNTMSVAVGNDFVEDTVLYRLQDIISKLDIKIRLCIRDSLFRLAQRHYTSDTSSTNKSSREELEVAAREESISQNR

SEQ ID NO: 148845 - protein, 183 aa, Glycine max
  Coding DNA Sequence Number=SeqID_32067
  Gene Ontology: Mol. function=nucleic acid binding; Cellular component= oxygen evolving complex; Biological process=DNA integration
MSFHCLSPLHYACLSSLSFVSIPKHVGDALSHPGWRQAMLEEMCALQSSGTRDFTPLPLGKTVVGCHWIFAVKVGLDGQVDRLKARLVAKGYIHRSMVLTNHSVFYCHLNKWNIYLITKDLDFLHYFLGIEVAQSNNGIVTSQRKYVMDILEDSDLMNAKLIDTPMDPNTKLMQKTGGSLFRP

SEQ ID NO: 148846 - protein, 230 aa, Glycine max
  Coding DNA Sequence Number=SeqID_32068
  Subcellular localization annotation: CTP_CleavageSite=44; ConfidenceScore=5.08e-01
MSLSKSNNLNPYADKLNPYKLHYTGKNGSINAKDTTKGRRGLPRRSTVEQRNARPTTREKLPKHLEHAVNNVEKERKKKINRARAEEEEGTQEEGALAVAKEGALTVTEEEEARCTKVFKKRTRVDELLFNVTKHGKQQKYEVLTDDEKRALLTELKREEKQINIRKHVLQQPETEVLIDDEEAPLTKFNLVEKQACVLISHPCHQATEKAASFHQLPPKSETRVKDMIS

SEQ ID NO: 148847 - protein, 131 aa, Glycine max
  Coding DNA Sequence Number=SeqID_32069
MVSDNAKYLKHQQDQERSTAHKALGTQAFDLVEYPSTLVLNIKEVHVSSGTQVFSLVEYPNVSITVVTGNSSFKSIRVLGLIEYLNTALADVLKEVLLEGTHIFDLAMNLKYPLYYYTTVSLPWCSSIRLG

SEQ ID NO: 148848 - protein, 208 aa, Glycine max
  Coding DNA Sequence Number=SeqID_32070
  Gene Ontology: Mol. function=protein disulfide isomerase activity; Cellular component=endoplasmic reticulum; Biological process=cell redox homeostasis
  Homolog annotation: Hit_ID=Q9XF61; Match level="QueryCoverage=87%, HitCoverage=89%, E-value=5e-62, Identity=63%"; Hit description =Protein disulfide-isomerase precursor
  Pfam annotation: Domain name=AhpC-TSA; Domain location=28-167; Score=- 21.4; E_value=0.051; Accession=PF00578.11; Description=AhpCTSA family
  Pfam annotation: Domain name=ERp29_N; Domain location=34-143; Score= -46.4; E_value=0.092; Accession=PF07912.3; Description=ERp29, N -terminal domain
  Pfam annotation: Domain name=Redoxin; Domain location=27-158; Score= -18.3; E_value=0.095; Accession=PF08534.1; Description=Redoxin
  Pfam annotation: Domain name=Thioredoxin; Domain location=32-140; Score=171.2; E_value=2.5e-48; Accession=PF00085.10; Description =Thioredoxin
  Pfam module annotation: Pfam domain module=AhpC-TSA::ERp29 _N::Redoxin::Thioredoxin; Domain location=28-167::34-143::27-158::32 -140
  Subcellular localization annotation: CTP_CleavageSite=27; ConfidenceScore=5.01e-01
MAHHNNIRVSICFLFASSLLSLFAQISSGKEFVLTLNRSNFSDIVTKHNFVVVEFYAPWCGHCMKLAPEYEKAASILSSNDPPVILAKVDANEEKNRELASQFQVQGFPTIKILRNGGKVVQDYKGPREADGIVDYLKKQSGPATTEIKSADDASALIDKNKVVIETPHHLPQFSECNLYISIVQLHLVPIGFKLRCWGLSKIFWGGV

SEQ ID NO: 148849 - protein, 109 aa, Glycine max
  Coding DNA Sequence Number=SeqID_32071
MACPMCVQTYPTRTETDKTAKKSVIWVGLIRLTGYKIGLVQVALVSSTVACSSDGGLYISLMVLAIVMVACGSMAMATLRNGCNYVNRWVAAVGLFRPESDQTRPVEHP

SEQ ID NO: 148850 - protein, 258 aa, Glycine max
  Coding DNA Sequence Number=SeqID_32072
MASRKRKSIGTRPTSQYDTRRFSSLDAWTRYTDNVLGRNILPERKVELYQTELDDFEAELERHNFHKHLTNLADGSIDLALVKDLNTFLETPVVLAEGETLPAYSRYCRLPTNFREIKAALCIPSRGFILNSKGQPGKILRKDLTTLAQPNTSRLGFPALITALCRARGVVSDSLTFECLSPVINLAYIRKNFWNPEDLTVSIRGARRARARPTELPSTSAAPTPASTSAAPSVPAQTNSQRFEAMLQSIHQGHIILL

SEQ ID NO: 148851 - protein, 460 aa, Glycine max
  Coding DNA Sequence Number=SeqID_32073
  Gene Ontology: Mol. function=heat shock protein binding; Cellular component=integral to membrane; Biological process=protein folding
  Homolog annotation: Hit_ID=Q10QF7; Match level="QueryCoverage=24%, HitCoverage=18%, E-value=1e-24, Identity=52%"; Hit description =Expressed protein
MDESWRMRMGQTPGLPRRRSMEDRSSARTRLSIFAGAGAGEQETLDPDDFADVFGGPPRSLLAHKFSRSNSFYEEIFRPPVFASPAPAKGGRSLPVFRIPAKNEAFYNDIFGSDDDRRSRERSGPQSKAKSKSNSSSALSSEELSPLRPSAGDDAALSAFASKLRPINVPCRWNSTTMMPGEHPIKQGGPFYPCNSQSFENQFQDNEYKESFKSSHLGFSRRVSSPETISLESNSYQSMKISADDWELSSPFSAVSGLCQEPEAKSSVHDHLFPELVIEQDDDDDDEVMSSYVIEVNSNLREESCGTADIDEAIAWAKEKFQSRNSDEESSSRNEGNEQTTTRVEGRSDADECHGDGIEVKSSKVQTETEKLDRDIRLWSSGKETDIRLLLSTLHHILWSESGWYAVPLPNLIESSQVKKAYQKARLCLHPDKLQQRGATLLQKYIAEKAFSILQALFWK

SEQ ID NO: 148852 - protein, 189 aa, Glycine max
  Coding DNA Sequence Number=SeqID_32074
IEEDRYLFIYGGTDAMWIQEFTTAVEKLKRVVDSISLQIDITIESYQLGREDPKVVPRFWIAIDSLLANRKQQMMKGGDQGVQDFATREIKRLLFLKQDPKGWVILSKGYNVKLLGQGEAMCRSVRDFGIWHGKLHEEVSFDVAFKEYYESIKVKDCPKKCEHSEISNYPTDILAHIPCPNMDCGRSME

SEQ ID NO: 148853 - protein, 266 aa, Glycine max
  Coding DNA Sequence Number=SeqID_32075
  Gene Ontology: Cellular component=plastid chromosome
  Homolog annotation: Hit_ID=Q2L8W8; Match level="QueryCoverage=89%, HitCoverage=77%, E-value=6e-87, Identity=65%"; Hit description=MTERF- like protein
  Pfam annotation: Domain name=mTERF; Domain location=1-228; Score =145.2; E_value=1.7e-40; Accession=PF02536.5; Description=mTERF
MGVDAGKALSQNPDLRTATMESIHSIISFLLSKGLQEKDLPRIFGMCPKILTSDIKTDLNPVFDFILSELKVPENSFRRVVNKCPRLLTSSVKDQLRPCLVYLRRLGFKDLGALAYQDSVLLVSNVENTLIPKLKFLETLGLSKDEVRSMVLRCPALLTFSIENNFQPKYEFFAGEMGRKLEELKEFPQYFAFSLENRIKPRHMEVVQSGIALALPVMLKSTDEEFRELSVAIDLQETKNFIDKEDSRPTSSTWSYIIRDFILSYE

SEQ ID NO: 148854 - protein, 62 aa, Glycine max
  Coding DNA Sequence Number=SeqID_32076
MNFWWEVWASVIWETWKHRNDIRFNNIARDSNAVSDACRKLVTYKFEKRVQCMLAKHMFCGV

SEQ ID NO: 148855 - protein, 322 aa, Glycine max
  Coding DNA Sequence Number=SeqID_32077
MLILEQLKAYSWDAKALIVQAAFALEYGKFLYLPLTTQYQMSEKSLADLNGLLMIQHNTQHLTFFNSVVKKVMQVIECITEWKRLTSAGYDIKDVPTLAETLHEIPVVVYWAIFTFVTCTGQIDDFTTDHKIHKHELSKNFENKLDLILRNFKEHLEMCGREIGRIEDYTRRKNIVIHTGKDIVKVLKALIISGENRESRQSVFNVLTGEQIKIEEFKKKHVLLFISGLDSIEEETLLLKSIYEKLKEKPREVEGYRKEDFKILWIPIVDEWNEERRKTLETKLQRTKFGCKLYLCGASMGFLSEPLITPGLLSNGTGSGLK

SEQ ID NO: 148856 - protein, 108 aa, Glycine max
  Coding DNA Sequence Number=SeqID_32078
MSKSLSSTNVQQGKTLLQNPFEFSDEQILDNVYRTHFHCVEKCDVASLHTVASCVISHSIEITDTVITKGSQLSDRFREDTTITSQQLTAKLKRIACQVVANFLLGVN

SEQ ID NO: 148857 - protein, 254 aa, Glycine max
  Coding DNA Sequence Number=SeqID_32079
  Gene Ontology: Mol. function=RNA-directed DNA polymerase activity; Biological process=DNA integration
MSMMGELKLFLRLQTKQDNKGIYIHQQKYTKELLKKFKMEDAKPMKNPMYASNPLSKDELAMPSKIILMMPKNQESSKFQKIKSQASFKNQDQDSTIIKIKIQDSSKESRLEIQESREDSIKIKQERVHLLWISSSGAYIYLGGYTENKRGYISCGSVQVERISTWLFKENKGGYIPCGSLLVKDFTSVINLTKNPIQNSKAKHIEICGSNVFQGYFDDAKESRVKKIPKIQESSFKNQNSRFKNQVSRIKIQE

SEQ ID NO: 148858 - protein, 167 aa, Glycine max
  Coding DNA Sequence Number=SeqID_32080
  Gene Ontology: Mol. function=nucleic acid binding; Biological process= DNA integration
  Homolog annotation: Hit_ID=Q1SVD1; Match level="QueryCoverage=75%, HitCoverage=14%, E-value=3e-10, Identity=31%"; Hit description=Zinc finger, CCHC-type
MLIRIKKGVLLLQTCYDERSDLSAEVQDTLFHQHGLCMKKGHALNASIKRSNELKTLDKEYSKESNHCTKDVIPRKATTLTTHHESFTTKDGEFVDDMFGRLQVLLNNLEALGQTYSKAQINLKVLDNFPKVWELKTITIQEAKDLKNLAWDELLGILRVHEVHLQT

SEQ ID NO: 148859 - protein, 119 aa, Glycine max
  Coding DNA Sequence Number=SeqID_32081
  Homolog annotation: Hit_ID=Q1S6A6; Match level="QueryCoverage=74%, HitCoverage=15%, E-value=3e-09, Identity=34%"; Hit description=FAR1
MDNSNGSDIGLDADVDNEEKAKDVDCIGFKYKNLKDFTIDDITSMEFSCVRACQIMGYMMDQYRVHVGLGFNKKDSFNYIEQQKHVKIKDGYVRALLIYLQGKADNDAMFFAKYMLIED

SEQ ID NO: 148860 - protein, 248 aa, Glycine max
  Coding DNA Sequence Number=SeqID_32082
MKVRLEIKKRVDTVSTPQLLTNIFNKMHQHLSRQDGDSIDWLLPSRPQPQNQPECALDNNTDFIMASRDTYYLKVHKTIIFPKEDYYKGKEKLIEDAPLTLCDKARPDRLFKHEVAALHKKRELTRVHCSSLELEEKPPSDGVHHKTRCCYQTINYNPIMVDSPSNRVCQRKIDIVVVFGRNFSFTIEIPNFIYGHGIYDGPPSSEECVNFIEKTLLRTRETLAEALHDRAHAEREAKRWKIFGEFLF

SEQ ID NO: 148861 - protein, 114 aa, Glycine max
  Coding DNA Sequence Number=SeqID_32083
MPIVGSRDCVSDKYRLCVYKIMVVEKVLYPDFEASWMKVSLMVPSSGATQLKRAAFASEEIPKEVIIVSWKILTRDKELRNEIASDHVPDKVVLEAIKAALEEELQKVELDAKI

SEQ ID NO: 148862 - protein, 148 aa, Glycine max
  Coding DNA Sequence Number=SeqID_32084
MHKALRANAPLPYPHLVTLFLHHFKIPLEDEPFVQVKRSFAIGVGAIILFGYRKDDDGQWVRKQDLPQPIPDERTLSPPPQRVDSSSLLNDVLSELHSLRAFVGDRFDAMDTPLDAMDAHFDGMDTRITRLEDDMSFIRCCFDPPANP

SEQ ID NO: 148863 - protein, 104 aa, Glycine max
  Coding DNA Sequence Number=SeqID_32085
  Homolog annotation: Hit_ID=Q5W7C9; Match level="QueryCoverage=52%, HitCoverage=20%, E-value=3e-20, Identity=83%"; Hit description =Unknow protein
SVLFLDGGKGYNSAVECHLDVVEVISSSLIIPKPNRTPVEYEAPGYKLCLGMEENSESALSTNKEAISNATRNLMESSILAQDERWRHALHMQVGREVVFPVAD

SEQ ID NO: 148864 - protein, 114 aa, Glycine max
  Coding DNA Sequence Number=SeqID_32086
  Subcellular localization annotation: CTP_CleavageSite=72; ConfidenceScore=5.60e-01
MNCFFVHVSSTFKFGAMRSDCLMQFSILNLFRSPMNCVFVHVSPTFQFGAMRTDCLMQFSILNLFRSPMNCVFVHVSSTFQFGAMRSDCLKQFSILNLFRNPKNCVFVHVSPTF

SEQ ID NO: 148865 - protein, 167 aa, Glycine max
  Coding DNA Sequence Number=SeqID_32087
GRRCSSAGSCGRKVKRFFCGFQRKKILPLDPAEEASAGSSAGASERTLSSVDPAEEASAGSSAGASGRTLSSADPVEEPAEPSSAGYIICSRKNLRNLLSQGTCPSRGRTCGTFFRRLPILLAEEPGKLLLRTIMLPYSKSLLKVILARSKVGGPMKSSPSSQASSQ

SEQ ID NO: 148866 - protein, 110 aa, Glycine max
  Coding DNA Sequence Number=SeqID_32088
MEWFFQISHPFVTPTEDIVEPRPAPPPPPHDDDFVEPPVPEVPIALDLPTHSMVDCTGCVRIAEHLERVINLRMVNEGTDLYDIMDLCLRIARGDDPDDSLRPRQRRRIN

SEQ ID NO: 148867 - protein, 94 aa, Glycine max
  Coding DNA Sequence Number=SeqID_32089
  Subcellular localization annotation: CTP_CleavageSite=45; ConfidenceScore=5.74e-01
MGQDGGRVGQGRGPAYLTPSPNLTFSIRKTPNPTQSTQFFPVKVRASPGRSPLGQRGAKFGKCWWRHGTKPYERTSLSLGTMKKKKSLRKIEQN

SEQ ID NO: 148868 - protein, 357 aa, Glycine max
  Coding DNA Sequence Number=SeqID_32090
  Gene Ontology: Mol. function=adenyl-nucleotide exchange factor activity; Cellular component=mitochondrion; Biological process =protein folding
  Homolog annotation: Hit_ID=Q8LB47; Match level="QueryCoverage=81%, HitCoverage=70%, E-value=4e-57, Identity=46%"; Hit description=GrpE like protein
  Pfam annotation: Domain name=GrpE; Domain location=124-335; Score =89.7; E_value=8.8e-24; Accession=PF01025.9; Description=GrpE
MPTSDVVYDTLKIDYMVIPVQLNLLLPPINSLSAPRFGFSSSASTENNDKKNRNNVHNGDSTNADPAKANEEAKNNDQARQDKPADKTEESGSISDSQSQTVKRRRRGFKRTAFSDSDSESECDLSRDDLIKLVAEKEELVMLKHKEIEKMQDKVLRTYAEMENVMERTRREADNSKKFALQNFAKSLLDVADNLGRASSVATENFSKIDTSSDSAEVVKLLKTLLQGVEMTEKQLVEPLCICKGKAAYNIPPPYLRIAKSLWAMGKVLRASAYCKTNYFSLQVLKKFGVEKFDPTNEPFDPHRHNAIFQIPDGSKPPGTVAAVLKIQIQVMLSTSHLPAKHFSLLQSYHPQNHHKE

SEQ ID NO: 148869 - protein, 164 aa, Glycine max
  Coding DNA Sequence Number=SeqID_32091
  Gene Ontology: Mol. function=pyruvate dehydrogenase (acetyl -transferring) activity; Cellular component=mitochondrion; Biological process=glycolysis
  Homolog annotation: Hit_ID=P52904; Match level="QueryCoverage=67%, HitCoverage=30%, E-value=3e-47, Identity=84%"; Hit description =Pyruvate dehydrogenase E1 component subunit beta, mitochondrial precursor
  Pfam annotation: Domain name=Transket_pyr; Domain location=48-164; Score=24.9; E_value=2.5e-08; Accession=PF02779.14; Description =Transketolase, pyrimidine binding dom
MKDYRGLEGNAEEPNASRKEGRKMLGVIRHKSIRPAFSAIRHLSSAAKEITVREALNSALDEEMSADPKVFLMGEEVGEYQGAYKISKGLLDKYGPERVLDTPITEAGFAGIGVGAAYYGLRPVVEFMTFNFSMQLSIKDRDVHGQHQKCYSVIATILKIMYAR

SEQ ID NO: 148870 - protein, 89 aa, Glycine max
  Coding DNA Sequence Number=SeqID_32092
  Gene Ontology: Mol. function=pyruvate dehydrogenase (acetyl -transferring) activity; Cellular component=mitochondrion; Biological process=glycolysis
  Homolog annotation: Hit_ID=Q38799; Match level="QueryCoverage=87%, HitCoverage=21%, E-value=5e-36, Identity=92%"; Hit description =Pyruvate dehydrogenase E1 component subunit beta, mitochondrial precursor
  Pfam annotation: Domain name=Transket_pyr; Domain location=2-89; Score=-47.7; E_value=0.0047; Accession=PF02779.14; Description =Transketolase, pyrimidine binding dom
MMKLKLEGEGMAIDHIINSAAKSNYMSAGQISVPIVFRGPNGAAAGVGAQHSQCYASWYGSCPGLKVLSPYSSEDARGLLKAAIRDPDP

SEQ ID NO: 148871 - protein, 495 aa, Glycine max
  Coding DNA Sequence Number=SeqID_32093
  Gene Ontology: Mol. function=hydrolase activity; Cellular component =intracellular; Biological process=metabolic process
  Homolog annotation: Hit_ID=Q9LIE7; Match level="QueryCoverage=95%, HitCoverage=71%, E-value=1e-145, Identity=34%"; Hit description =Selenium-binding protein-like
  Pfam annotation: Domain name=PPR; Domain location=162-196; Score=9.9; E_value=0.5; Accession=PF01535.11; Description=PPR repeat
  Pfam annotation: Domain name=PPR; Domain location=262-296; Score =13.0; E_value=0.22; Accession=PF01535.11; Description=PPR repeat
  Pfam annotation: Domain name=PPR; Domain location=364-398; Score =37.6; E_value=4.4e-08; Accession=PF01535.11; Description=PPR repeat
  Pfam annotation: Domain name=PPR; Domain location=54-88; Score=19.0; E_value=0.017; Accession=PF01535.11; Description=PPR repeat
  Pfam module annotation: Pfam domain module=PPR::PPR::PPR::PPR; Domain location=162-196::262-296::364-398::54-88
MASSTVVPVPPVPVEGGKPSRGVSIRSRLSKLCQQGQPHLARHLLDTLPRASSAVWNTVIIGFICNHMPLEALHLYAEMKSSPDTPSDCYTFSSTLKACSLTQNLLAGKAIHSHFLRSQSNSRIVYNSLLNMYSVCLPPSTVQSQLDYVLKVFAFMRKRNVVAWNTLISWYVKTHRQLHALRAFATLIKTSITPTPVTFVNVFPAVPDPKTALMFYALLLKFGADYANDVFAVSSAIVMFADLGCLDYARMVFDRCSNKNTEVWNTMIGGYVQNNCPLQGIDVFLRALESEEAVCDEVTFLSVICAVSLLQQIKLAQQLHAFVLKSLAVTPVIVVNAIMVMYSRCNFVDTSLKVFDNMPQRDAVSWNTIISSFVQNGLDEEALMLVCEMEKQKFPIDSVTATALLSAASNIRSSYIGRQTHAYLIRHGIQFEGMESYLIDMYAKSRLVRTSELLFEQNCPSDRDLATWNAMIAGYTQNGLSDKAILILREALVHK

SEQ ID NO: 148872 - protein, 581 aa, Glycine max
  Coding DNA Sequence Number=SeqID_32094
  Gene Ontology: Mol. function=calcium ion binding; Cellular component =endocytic vesicle; Biological process=endosome transport
  Homolog annotation: Hit_ID=Q653F5; Match level="QueryCoverage=99%, HitCoverage=100%, E-value=0.0, Identity=71%"; Hit description =Putative receptor-mediated endocytosis 1 isoform I
  Pfam annotation: Domain name=Dynamin_N; Domain location=251-396; Score=67.8; E_value=3.5e-17; Accession=PF00350.13; Description =Dynamin family
  Pfam annotation: Domain name=MMR_HSR1; Domain location=249-397; Score= -13.4; E_value=0.017; Accession=PF01926.13; Description=GTPase of unknown function
  Pfam annotation: Domain name=efhand; Domain location=18-46; Score =13.5; E_value=0.43; Accession=PF00036.22; Description=EF hand
  Pfam annotation: Domain name=efhand; Domain location=52-80; Score =18.1; E_value=0.031; Accession=PF00036.22; Description=EF hand
  Pfam module annotation: Pfam domain module=Dynamin_N::MMR _HSR1::efhand::efhand; Domain location=251-396::249-397::18-46::52-80
MEFDPIPIGSCSKEHQMIYKEWFNYADSDSDGRITGSDATKFFAMSNLPREDLKQVWAIADSKRQGYLGFTEFIIAMQLVSLAQSGHSITPDLLTSDVDFTNGKPPSMEGLDVLLVKKKHKQKEVDANGGIKAYPRSIQRVTQYIIHTPSSKVLGVRGCIGKNPSPTSARDKAKIEYISERQSSPFELAFGVKLSLDPHSKIVPLSSVTSIIDGLKRLYIQKLKPLEVTYRFNDFVSPLLTNSDFDAKPMVMLLGQYSTGAHIGPEPTTDRFVVVMSGSDERSVPGNTVAVQADMPFSGLTTFGTAFLSKFVCSQMPHPLLEHITFVDTPGVLSGEKQRTQRAYDFTGVTSWFAAKCDLILLLFDPHKLDISDEFNRVISSLRGHDDKIRVVLNKADQVDTQQLMRVYGALMWSLGKVLKTPEVMRVYIGSFNDKPVNDAATGPLGKELFEKEQDDLLSDLKDVPKAACDRRINEFVKRARAAKIHAYIISHLKKEMPAMIGKAKAQQKLIDNLAAEFGKVQREFHLPPGDFPNVEFFRERLSGYNIDKFEKLKPKMTQAVDDMLAYDIPNLLKNFRNPYD

SEQ ID NO: 148873 - protein, 47 aa, Glycine max
  Coding DNA Sequence Number=SeqID_32095
MTSKKLCLHPLGANDSEICSPVQKLCSGGCDNTVKVWKLRWVRDVAY

SEQ ID NO: 148874 - protein, 553 aa, Glycine max
  Coding DNA Sequence Number=SeqID_32096
  Gene Ontology: Mol. function=hydrolase activity, hydrolyzing O -glycosyl compounds; Cellular component=membrane; Biological process =carbohydrate metabolic process
  Homolog annotation: Hit_ID=Q45X99; Match level="QueryCoverage=80%, HitCoverage=96%, E-value=0.0, Identity=73%"; Hit description=Beta-1 ,3-glucanase 2
  Pfam annotation: Domain name=Glyco_hydro_17; Domain location=112-431; Score=411.7; E_value=1e-120; Accession=PF00332.9; Description =Glycosyl hydrolases family 17
  Pfam annotation: Domain name=X8; Domain location=464-549; Score =187.0; E_value=4.6e-53; Accession=PF07983.3; Description=X8 domain
  Pfam module annotation: Pfam domain module=Glyco_hydro_17::X8; Domain location=112-431::464-549
MKPIIILDIVGYRTKHVPPVPLDIRDNIAHYRIQRTVQLTFSFCCLPQVVIVTFSNLTLAVLRVVHWWVGLQHGSRVPHVCMLCKLSMAPLAFSFFFILITFFSSSSEAGSVGINYGRVANDLPTPAKVVELLKAQGLNRVKLYDTDATVLTAFANSGIKVVVAMPNELLANAAADQSFTDAWVQANISTYYPATQIEAIAVGNEVFVDPNNTTKFLVPAMKNVHASLTKYNLDKNIKISSPIALSALQNSFPASSGSFKTELVEPVIKPMLDLLRQTGSYLMVNAYPFFAYAANSDKISLDYALFKENPGVVDSGNGLKYTNLFDAQIDAVFAAMSALKYEDVKIAVSETGWPSAGDSNEIGASPDNAASYNGNLVKRVMSGSGTPLKQNESLDVFLFALFNENQKTGPTSERNYGLFYPTEKKVYDIPLTAEEIKEAPPSGVGKSQVPVSGEVSTTTSKGQTWCVASGGSSEKKLQNALNYACGEGGADCTPIQPGATCYNPNTLEAHASYAFNSYYQKKARASGTCDFGGTAYVVTQPPKYGNCEFPTGY

SEQ ID NO: 148875 - protein, 747 aa, Glycine max
  Coding DNA Sequence Number=SeqID_32097
  Gene Ontology: Mol. function=sequence-specific DNA binding; Cellular component=nucleus; Biological process=regulation of transcription, DNA-dependent
  Homolog annotation: Hit_ID=Q43086; Match level="QueryCoverage=43%, HitCoverage=83%, E-value=1e-158, Identity=88%"; Hit description =Aspartate carbamoyltransferase 1, chloroplast precursor
  Pfam annotation: Domain name=OTCace; Domain location=589-743; Score =171.3; E_value=2.4e-48; Accession=PF00185.14; Description =Aspartateornithine carbamoyltransferase, AspOrn binding domain
  Pfam annotation: Domain name=OTCace_N; Domain location=441-585; Score= 155.6; E_value=1.3e-43; Accession=PF02729.11; Description =Aspartateornithine carbamoyltransferase, carbamoyl-P binding domain
  Pfam annotation: Domain name=WRKY; Domain location=235-295; Score =140.7; E_value=4e-39; Accession=PF03106.6; Description=WRKY DNA -binding domain
  Pfam module annotation: Pfam domain module=OTCace::OTCace_N::WRKY; Domain location=589-743::441-585::235-295
MSFRGTPLVMDELDFFAHKRKVSANDDDHQRVEDLHVDTSLDLLTKNDTDVNNRSTEEDAALETMDDKSNEFIALLTELDQMNAENQRLRELVDQVNNNCNTLRMQLVKLTQKHHSHGNNGVIGEKEDMVPRSFLDIGVAEKDEPNSQQSSEGKLRESKSMVELGHGKDIAVLEAYKLDSTAGRESTKARMEGRQISTEQEFSNKVPRLDPASETMSMIKKARVSVRAKSYSSMIADGCQWRKYGQKMAKGNPWPRAYYRCTMSTGCPVRKQVQRCAEDRSVLITTYEGQHNHPLPPTTSVAASMPSILESASLPCSRNMATLSASAPFPTITLDLTQNATNSSQLQRELPLGQLGLLSPLLAHKFMSVPKIFGQGMDTNSSFANILNAATADPNFTAALVAAITSVMGTSHSNTNATNSTRALQVESAPSFSMGQKFHLHDVIEAQQFDRETLNAIFEVARSMESIESKSSRSQMLKGYLMATLFYEPSTRTRLSFESAMKRLGGDVLTTENAREFSSAAKGETLEDTIRTVEGYSDIIVMRHFESGAAKRAATTASIPVINAGDGPGQHPSQALLDVYTIEREIGKLDGIRVGLVGDLANGRTVRSLAYLLAKYQDVKIYFVSPNVVKMKDDIKDYLTSKGVEWEESADLMEVASKCNVVYQTRIQKERFGEKIELYEEARGKYIVNQDVLNVMQKHAVVMHPLPRLDEQITVDVDSDPRAAYFRQAKNGLYIRMALLKVLLLGW

SEQ ID NO: 148876 - protein, 661 aa, Glycine max
  Coding DNA Sequence Number=SeqID_32098
  Gene Ontology: Mol. function=transmembrane receptor activity; Cellular component=integral to membrane; Biological process=defense response to bacterium
  Homolog annotation: Hit_ID=Q9XGQ5; Match level="QueryCoverage=97%, HitCoverage=97%, E-value=0.0, Identity=80%"; Hit description =Putative transmembrane 9 superfamily protein member 2
  Pfam annotation: Domain name=EMP70; Domain location=60-619; Score =853.4; E_value=1.1e-253; Accession=PF02990.7; Description =Endomembrane protein 70
MEVPTRRKPVIYWICLFVIVNAFVQISNAFYLPGSYMHTYSNGDNIYAKVNSLTSIETELPYSYYSLPYCKPLGDIKKSAENLGELLRGDQIDSSPYLFRMNVNQSIYLCTTTALKENEVKLLKQRTRDLYQVNMILDNLPVMRFANQNGIKIQWTGFPVGYTPPDGSADYIINHLKFKVLVHEYEGNGVEIIGTGEEGMGVISEAEKKKVSGYEIVGFQVIPCSVKRDPEVMTKLHMYDNISSTNCPSELDKYQPIKEQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDGSRLLCVMVGDGVQILGMAAVTIVFAALGFMSPASRGMLLTGMIILYLFLGIAAGYVSVRLWRTIKGTSEGWRSISWLSACFFPGIAFIILTGLNFLLWGSKSTGAIPISLYFELLFLWFCISVPLTLIGGFMGTKAQQIEYPVRTNQIPREIPARKYPSWLLVLGAGTLPFGTLFIELFFILSSIWLGRFYYVFGFLLVVLLLLVIVCAEVSVVLTYMHLCVEDWQWWWKSFFASGSVALYVFLYSINYLVFDLQSLSGPVSAILYLGYSLLMAIAIMLSTGTIGFLMSFYFVHYLFSSVKID

SEQ ID NO: 148877 - protein, 943 aa, Glycine max
  Coding DNA Sequence Number=SeqID_32099
  Gene Ontology: Mol. function=RNA binding; Biological process=RNA processing
  Homolog annotation: Hit_ID=Q9FLQ1; Match level="QueryCoverage=74%, HitCoverage=71%, E-value=1e-104, Identity=37%"; Hit description =Arabidopsis thaliana genomic DNA, chromosome 5, P1 clone:MCO15
  Pfam annotation: Domain name=Surp; Domain location=144-188; Score =48.0; E_value=3.2e-11; Accession=PF01805.10; Description=Surp module
  Pfam annotation: Domain name=Surp; Domain location=352-396; Score =45.8; E_value=1.5e-10; Accession=PF01805.10; Description=Surp module
  Pfam module annotation: Pfam domain module=Surp::Surp; Domain location=144-188::352-396
MDLEVVGRHAMLFDDDGMAAFVNSAEALVEWNSLSIDRYDVRHLLSAPLPPRLKRRPPPPEPDLDQQRYLDLPSSSPDDEQPQDDGSNPLSSTGFHAVAFSYGNSSVSTETKDNDTEPSFHPNFPVPESLLSNLPPNERVHQIISRTATFVSKHGSQSEIILRVKQGDNPTFGFLMPDHHLHAYFRFLVDHQELLKVDKDDGSSTEDMNRTLGLDQTGGALSLLGSVYGSGEDEDATTENTCDVEKKECEGAVDAVSTYTSPGIDQAESYSDVAKKDGSISKNLIPSLKEKVPVIKRNHSISTVKTATTAGAKGDGLDSVSNAQNKLQTSVRSTAKIELPVVEPPSDLKRTIEKIVEFILKNGKQFEAVLAEQDRPHGRFPFLLPSNQYHTYYLKVLQTAEEGFCAPCVFHGLFGTDEGIVNFDFEMLLTDLPNCLQFKLLGKGHQKHNPAGHTGDNNTAVNDDSDNLSHGSMASDLPHDMDQKEKFKMIIGKSKKFGQDPIPKDQAQNTISMDAAATAAILQAATRGIKNPNLEVITKASSGSGQGLGSDGGYLSSSGTGSLYSFRPQGFVGNQNLNVKASASAPVAKAIAEKVAIAAAGEADSSEAHMTKEQKLKAERLKRAKMFAAMLKSGVGASELPRALSVEPPGSGVSGSDAETGNLVGKEREGSSVPYDVDNSAKSQKSEEKLSTDINSDKSRKSEEKLIVDDNERRSKRKYRSRSGRHEEDEEMEEEEENKEDRRDHKRSRKKHRSSHQSQDRHKHKRKHSSSKDKYSSRGTKHDCSSSDDEHHRSRHHRHKYDGSSDDEQHHRSRHRRHKYDGSSDEKHHPSKRRHRDDSLSDHEHRHSHHSNKDYSSSDDEHRHRSRNVRLKSRSRAERETELEEGEIILKSEKSVVSGEVGRASREASEGLSNARVPSQSPEITDVSDELRAKIRILKSCRS

SEQ ID NO: 148878 - protein, 362 aa, Glycine max
  Coding DNA Sequence Number=SeqID_32100
  Gene Ontology: Mol. function=nucleic acid binding; Cellular component= intracellular; Biological process=chromatin modification
  Homolog annotation: Hit_ID=Q1T145; Match level="QueryCoverage=87%, HitCoverage=95%, E-value=1e-132, Identity=62%"; Hit description=Zinc finger, C2H2-type
  Pfam annotation: Domain name=zf-C2H2; Domain location=120-145; Score =22.6; E_value=0.0014; Accession=PF00096.16; Description=Zinc finger, C2H2 type
  Pfam annotation: Domain name=zf-C2H2; Domain location=161-185; Score =29.9; E_value=9e-06; Accession=PF00096.16; Description=Zinc finger, C2H2 type
  Pfam annotation: Domain name=zf-C2H2; Domain location=19-41; Score =17.4; E_value=0.05; Accession=PF00096.16; Description=Zinc finger, C2H2 type
  Pfam annotation: Domain name=zf-C2H2; Domain location=193-218; Score =14.9; E_value=0.25; Accession=PF00096.16; Description=Zinc finger, C2H2 type
  Pfam annotation: Domain name=zf-C2H2; Domain location=221-242; Score =9.6; E_value=0.95; Accession=PF00096.16; Description=Zinc finger, C2H2 type
  Pfam annotation: Domain name=zf-C2H2; Domain location=252-277; Score =28.5; E_value=2.3e-05; Accession=PF00096.16; Description=Zinc finger, C2H2 type
  Pfam annotation: Domain name=zf-C2H2; Domain location=283-309; Score =15.9; E_value=0.15; Accession=PF00096.16; Description=Zinc finger, C2H2 type
  Pfam annotation: Domain name=zf-C2H2; Domain location=63-85; Score =22.8; E_value=0.0012; Accession=PF00096.16; Description=Zinc finger, C2H2 type
  Pfam annotation: Domain name=zf-C2H2; Domain location=91-115; Score =28.4; E_value=2.5e-05; Accession=PF00096.16; Description=Zinc finger, C2H2 type
  Pfam module annotation: Pfam domain module=zf-C2H2::zf-C2H2::zf -C2H2::zf-C2H2::zf-C2H2::zf-C2H2::zf-C2H2::zf-C2H2::zf-C2H2; Domain location=120-145::161-185::19-41::193-218::221-242::252-277::283 -309::63-85::91-115
MCEAVEIEERPKYKDIRRYYCEYCGICRSKKTLITSHINLHHKEEYEKARAERDPEAEASKSNSCEECGATFKKHAYLLQHMQSHSLERPFVCAVDDCQASYRRKDHLTRHLLQHEGKIFKCPVENCNSEFSLQSNMKRHTEEIHDDSSTTTSSDKSHKQHMCPEIGCGKVFRYASQLQKHEDSHVNLESVDMVCLEPGCLKHFTNVQCLQAHVKSSHQYMTCDICGTKQLKKNIKRHLRSHEAEGSSSETFQCEFKGCSCTFSRKSNLDKHKKAVHFNVKPFACGFTDCGMRFAYKHVRDNHEKTAKHVFTLGDFEEADEEFRSRPRGGRKRTCPTVEMLIRKRVTPPSQLEHWLFMQDSE

SEQ ID NO: 148879 - protein, 57 aa, Glycine max
  Coding DNA Sequence Number=SeqID_32101
MGVMRRVVFDEEVGGGANFEQVIGMRVLGKHVQREVRELKLEMEVWRCRRRGTLEPL

SEQ ID NO: 148880 - protein, 239 aa, Glycine max
  Coding DNA Sequence Number=SeqID_32102
  Gene Ontology: Mol. function=RNA binding; Cellular component =cytoplasm; Biological process=sex differentiation
  Homolog annotation: Hit_ID=Q9LT41; Match level="QueryCoverage=65%, HitCoverage=48%, E-value=2e-56, Identity=73%"; Hit description=RCD1
  Pfam annotation: Domain name=Rcd1; Domain location=37-238; Score =155.5; E_value=1.4e-43; Accession=PF04078.4; Description=Cell differentiation family, Rcd1-like
  Subcellular localization annotation: CTP_CleavageSite=30; ConfidenceScore=5.51e-01
MANLPQSFSLSGASFGAPSSSSSATTKDPRTMASVENLVLQLSNPDLRENALHELSKKRELFQDLAPLLWNSLGTMAALLQEIVSIYPAISPPNLTPAQSNRVCNALALLQCVASHLDTRMPFLNGNDFFLIHLKDAHIPLYLYPFLNTTSKSRPFEYLRLTTLGVIGALVKIFNYLLSFKYNPVTTFYDVTVLHRRCIPFIWLMGLPLRRVVLAQDKWTVETLLDIFGCRGVLATLSF

SEQ ID NO: 148881 - protein, 343 aa, Glycine max
  Coding DNA Sequence Number=SeqID_32103
  Gene Ontology: Mol. function=nucleic acid binding; Cellular component= intracellular; Biological process=chromatin modification
  Homolog annotation: Hit_ID=Q1T145; Match level="QueryCoverage=97%, HitCoverage=99%, E-value=1e-134, Identity=61%"; Hit description=Zinc finger, C2H2-type
  Pfam annotation: Domain name=zf-C2H2; Domain location=101-126; Score =22.6; E_value=0.0014; Accession=PF00096.16; Description=Zinc finger, C2H2 type
  Pfam annotation: Domain name=zf-C2H2; Domain location=142-166; Score =29.9; E_value=9e-06; Accession=PF00096.16; Description=Zinc finger, C2H2 type
  Pfam annotation: Domain name=zf-C2H2; Domain location=174-199; Score =13.6; E_value=0.35; Accession=PF00096.16; Description=Zinc finger, C2H2 type
  Pfam annotation: Domain name=zf-C2H2; Domain location=202-223; Score =9.6; E_value=0.95; Accession=PF00096.16; Description=Zinc finger, C2H2 type
  Pfam annotation: Domain name=zf-C2H2; Domain location=233-258; Score =28.5; E_value=2.3e-05; Accession=PF00096.16; Description=Zinc finger, C2H2 type
  Pfam annotation: Domain name=zf-C2H2; Domain location=264-290; Score =16.6; E_value=0.088; Accession=PF00096.16; Description=Zinc finger, C2H2 type
  Pfam annotation: Domain name=zf-C2H2; Domain location=44-66; Score =23.1; E_value=0.001; Accession=PF00096.16; Description=Zinc finger, C2H2 type
  Pfam annotation: Domain name=zf-C2H2; Domain location=72-96; Score =26.8; E_value=7.6e-05; Accession=PF00096.16; Description=Zinc finger, C2H2 type
  Pfam module annotation: Pfam domain module=zf-C2H2::zf-C2H2::zf -C2H2::zf-C2H2::zf-C2H2::zf-C2H2::zf-C2H2::zf-C2H2; Domain location =101-126::142-166::174-199::202-223::233-258::264-290::44-66::72-96
MCEAVELKKGPNTKISDAITASTAEEYEKARAKRDPEAEASKSNTCEECGATFKKHAYLLQHMQSHSLERPFVCAVDDCQASYRRKDHLTQHLLQHEGKIFKCPVENCNSEFSLQSNMKRHTEEIHDDSSTTTSSDKSHKQHMCPEIGCGKVFRYASQLQKHEDSHVNLESVDMVCLEPGCLKHFPNVQCLQAHVKSSHQYMTCDICGTKQLKKNIKRHLRSHEAEGSSSETFQCEFKGCSCTFSRKSNLDKHKKAVHLNVKPFACGFPDCGMRFAYKHVRDNHEKTAKHVFTLGDFEEADEEFRSRPRGGRKRTCPTVEVLIRKRVTPPSQLEHWLFMQDSE

SEQ ID NO: 148882 - protein, 143 aa, Glycine max
  Coding DNA Sequence Number=SeqID_32104
MNRFNKSELLVLFVLPLSGLPTFTSSLTFSSLHLEPKLLFSQILLSLSVTQKPLIPPELYEPEERVEVEASEHDEKKPKVVAKSASDENIVGHTEVKKCPSIPNLLLIGCGESEGDVIEAEDEARGVNGQELFAKAEAFIGNF

SEQ ID NO: 148883 - protein, 61 aa, Glycine max
  Coding DNA Sequence Number=SeqID_32105
MAHSIEKESGLSHEKKFVCAVQIPTADGILQMSGDEKSRVGFDQGGFNGCRLRRFFDWSTE

SEQ ID NO: 148884 - protein, 240 aa, Glycine max
  Coding DNA Sequence Number=SeqID_32106
  Gene Ontology: Cellular component=endoplasmic reticulum; Biological process=intracellular protein transport
  Homolog annotation: Hit_ID=Q9FH68; Match level="QueryCoverage=47%, HitCoverage=45%, E-value=1e-21, Identity=42%"; Hit description =Arabidopsis thaliana genomic DNA, chromosome 5, TAC clone:K16E1
MIQLLFILLMIQIAFILILSFANPIRKLVVIGLDLLKQGRGPLVTKTVAATMCVVLSSTVYTITKIQKRSKDASIVNPTDEVLMAHRLLEAAFLGFSLFLGLVIDRQHYYIREINLLRKNLETWKKRNHNHDSLKRRVETEKPNPKGRAQVSGNGCGDFAGGTGGNTGGNNGDGDTDTGGRSDGDTGRDGDTGDTGGGDGTACSKAHDPNTHNLPKGHTLPHLPQLKRFKFVFKHKRLQH

SEQ ID NO: 148885 - protein, 111 aa, Glycine max
  Coding DNA Sequence Number=SeqID_32107
  Subcellular localization annotation: CTP_CleavageSite=54; ConfidenceScore=5.08e-01
MKCLQLQSSLLPLHAKLKPQPNHTSHTSQIIRAQHFPLASDPLTTKALPHSMVVAPAQSGDLSTFLPISAVLLSAYFIANFVVPGFLTNSFGYDKSNEEQKVDDSNEIEDE

SEQ ID NO: 148886 - protein, 193 aa, Glycine max
  Coding DNA Sequence Number=SeqID_32108
  Gene Ontology: Cellular component=mitochondrial matrix
  Homolog annotation: Hit_ID=Q94ED9; Match level="QueryCoverage=65%, HitCoverage=55%, E-value=9e-25, Identity=53%"; Hit description =Mitochondrial glycoprotein family protein-like
MFLSRVVCHNTQSHTAQEYKQSKRNVEERLGRRRGWSPAAIFVRRWRHLLLRELNAPPLPKGSLSRSRQNEHAPWFRHRMNESRALQKVSAPSPFTIVKGALDSHGPVLKRSYGNEEVSIYVMRLLTPEDEDSAIDQLFIHVDVSKPQQNESLIFLCGLYEDALGIHSVSMRPKVQDSGYLLIPSQYTGPVFA

SEQ ID NO: 148887 - protein, 214 aa, Glycine max
  Coding DNA Sequence Number=SeqID_32109
  Gene Ontology: Mol. function=mismatched DNA binding; Cellular component=synaptonemal complex; Biological process=mismatch repair
  Homolog annotation: Hit_ID=Q56XI7; Match level="QueryCoverage=99%, HitCoverage=36%, E-value=1e-82, Identity=73%"; Hit description=DNA mismatch repair protein
  Pfam annotation: Domain name=MutS_V; Domain location=45-210; Score= -6.7; E_value=1.8e-14; Accession=PF00488.12; Description=MutS domain V
MERAIARDLFSRILLFRTHLIKVATFAAELDCFLSMALVARQHNYVRPSLTEENLLDIKNGRHVLQEMTVDTFIPNDTRILHDGRINIITGPNFSGKSIYIKQDFDHTVLNSNYVEKVAIIVFLSHIGSFVPADSATVGLTDRIFCATGSRLMTAEQSTFMIDLHQIGMMLRHATSRSLCLVDEFGKGTLTEDGIGLLAGTINHFVTTDEPPKV

SEQ ID NO: 148888 - protein, 236 aa, Glycine max
  Coding DNA Sequence Number=SeqID_32110
  Homolog annotation: Hit_ID=Q9FLQ5; Match level="QueryCoverage=68%, HitCoverage=24%, E-value=1e-44, Identity=57%"; Hit description =Arabidopsis thaliana genomic DNA, chromosome 5, P1 clone:MCO15
MEEQTFVSKARTAFHSAAAKAERVLLDFKSDRALTQFVDRREEDHDKQSSPNTFTGQQPEAESPHTNENDSKLRSELKHIKWRPPHLGIKQDWQDRIKNIRRGRKEVEDTDKVGDASMAVPFYDDNLYLLNMKNDLEAKASEAIPSVESLTAATKDPIPPSSVLKQLAIAVEAGSKAKSMKDLIASSGVSSPARERAGLSFSAVKALVLREKEDKLTSEFTSNEKVVQLINSLFDP

SEQ ID NO: 148889 - protein, 63 aa, Glycine max
  Coding DNA Sequence Number=SeqID_32111
  Gene Ontology: Cellular component=mitochondrial matrix
  Homolog annotation: Hit_ID=Q94ED9; Match level="QueryCoverage=85%, HitCoverage=22%, E-value=2e-16, Identity=67%"; Hit description =Mitochondrial glycoprotein family protein-like
MELKELDEKMRDAFHSYIEERGVNESLFKFLQAWLYVKEHRNLMRWFKTMGLFVDGKKPVTGA

SEQ ID NO: 148890 - protein, 104 aa, Glycine max
  Coding DNA Sequence Number=SeqID_32112
MTTDKSRGPSLSSGRTVYFKIMYSEPISHAYAWPLPVKPAPLRMPTPHPNWASLQADIEAHLKQTIPINEALEVFELAHAPPPLGTCGGIATRAVHEKNVVVGE

SEQ ID NO: 148891 - protein, 244 aa, Glycine max
  Coding DNA Sequence Number=SeqID_32113
  Gene Ontology: Mol. function=DNA binding; Biological process =regulation of transcription, DNA-dependent
  Homolog annotation: Hit_ID=Q9FLV7; Match level="QueryCoverage=49%, HitCoverage=36%, E-value=6e-17, Identity=39%"; Hit description =Arabidopsis thaliana genomic DNA, chromosome 5, P1 clone:MZF18
  Pfam annotation: Domain name=B3; Domain location=132-236; Score=3.7; E_value=0.029; Accession=PF02362.12; Description=B3 DNA binding domain
  Pfam annotation: Domain name=DUF313; Domain location=113-216; Score =46.4; E_value=9.7e-11; Accession=PF03754.4; Description=Domain of unknown function (DUF313)
  Pfam module annotation: Pfam domain module=B3::DUF313; Domain location=132-236::113-216
GMGSGGGKREFTVVRNFLAAKEKHLQRPECFSFLSTDEGLSIKTGEKISLKRKAENNYNPSKRVKSKEGASSWQDGKSKFEYLLDAVAFFTAYEEDYLQKRIDELDGLPREFQEKIQELNGCEVKFVTQKKLFKTDLNPQHARLSIPPAKIANRFLTPTEESSLNERRGKHKRLSGMPVMVLDPSLREYNMCFKKWEMTKSYVYNLTMGWNQIVGDNHLKLGDTLHLWSFRLSSQLCFALVKGS

SEQ ID NO: 148892 - protein, 580 aa, Glycine max
  Coding DNA Sequence Number=SeqID_32114
  Gene Ontology: Mol. function=zinc ion binding; Cellular component =nucleus; Biological process=protein modification process
  Homolog annotation: Hit_ID=Q9C8E1; Match level="QueryCoverage=97%, HitCoverage=90%, E-value=0.0, Identity=56%"; Hit description=RING zinc finger protein, putative
  Pfam annotation: Domain name=PHD; Domain location=11-59; Score=12.4; E_value=0.0033; Accession=PF00628.19; Description=PHD-finger
  Pfam annotation: Domain name=YDG_SRA; Domain location=244-396; Score =233.7; E_value=3.9e-67; Accession=PF02182.8; Description=YDGSRA domain
  Pfam annotation: Domain name=zf-C3HC4; Domain location=120-158; Score= 35.5; E_value=1.8e-07; Accession=PF00097.15; Description=Zinc finger, C3HC4 type (RING finger)
  Pfam annotation: Domain name=zf-C3HC4; Domain location=498-555; Score= 29.4; E_value=1.3e-05; Accession=PF00097.15; Description=Zinc finger, C3HC4 type (RING finger)
  Pfam annotation: Domain name=zf-P11; Domain location=116-167; Score =0.8; E_value=0.096; Accession=PF03854.4; Description=P-11 zinc finger
  Pfam module annotation: Pfam domain module=PHD::YDG_SRA::zf-C3HC4::zf- C3HC4::zf-P11; Domain location=11-59::244-396::120-158::498-555::116 -167
MAQLPCDSDGVCMLCKQKPSPSQTLSCRTCATPWHLSCLPSAPLSLSDSHWDCPDCSDTSNHYPVAPTADLVSAVHAIQADTSLTDQEKAKKRQELLAGSSDSSKDKAKTKDIFDGSLNCSICMQLPERPVTTPCGHNLCLRCFEKWVGQGKRTCANCRAQIPAKMASQPRINSQLAMAIRLAKAAKSGEGSSGPPKVYHFVRNQDRPDTAFTTERAKKTGKANACSGKIFVTVPPDHFGPIPSENDPIRNRGVLVGDTWEDRMECRQWGAHLPHVAGIAGQSGYGSQSVALSGGYEDDEDHGEWFLYTGSGGRDLSGNKRTNKLQSFDQKFENMNEALRVSCRKGYPVRVVRSHKEKRSSYAPESGVRYDGVYRIEKCWRKNGTQACKWIFAPNSLVHGEALYCDRVASSFGVCAYVLLTCSDEIGDRPRPLPKIDELKGAVDITERKGDPSWDFDKPPPESKKSVDIKAEDGTTIRVKRKAKNVSVKERLLKEFGCQICRKAMASPLTTPCAHNFCKACLEGAFSGQSFIRNRACGGGRTLRAQKNFMKCPSCSTDIADFLQNPQVLRNAVIGFYSCT

SEQ ID NO: 148893 - protein, 528 aa, Glycine max
  Coding DNA Sequence Number=SeqID_32115
  Gene Ontology: Mol. function=protein serine/threonine kinase activity; Cellular component=cytoplasm; Biological process=protein amino acid phosphorylation
  Homolog annotation: Hit_ID=O24431; Match level="QueryCoverage=94%, HitCoverage=98%, E-value=0.0, Identity=76%"; Hit description =Calmodulin-like domain protein kinase isoenzyme gamma
  Pfam annotation: Domain name=Pkinase; Domain location=80-338; Score =350.1; E_value=3.6e-102; Accession=PF00069.15; Description=Protein kinase domain
  Pfam annotation: Domain name=Pkinase_Tyr; Domain location=80-336; Score=12.8; E_value=2.9e-13; Accession=PF07714.7; Description =Protein tyrosine kinase
  Pfam annotation: Domain name=efhand; Domain location=385-413; Score =35.4; E_value=2e-07; Accession=PF00036.22; Description=EF hand
  Pfam annotation: Domain name=efhand; Domain location=421-449; Score =26.0; E_value=0.00014; Accession=PF00036.22; Description=EF hand
  Pfam annotation: Domain name=efhand; Domain location=457-485; Score =38.3; E_value=2.7e-08; Accession=PF00036.22; Description=EF hand
  Pfam annotation: Domain name=efhand; Domain location=492-520; Score =42.0; E_value=2.1e-09; Accession=PF00036.22; Description=EF hand
  Pfam module annotation: Pfam domain module=Pkinase::Pkinase _Tyr::efhand::efhand::efhand::efhand; Domain location=80-338::80 -336::385-413::421-449::457-485::492-520
MGCCMSKKGSEPEEHIVYRHVAGAGGAGVYNNHKSHEPPSHQPYPLPEKHAPWRPPPSPKHVHKHDTITGKPFEDVKQHYTLGKELGRGQFGVTYLCTENSTGFQYACKSISKRKLVSRDDKEDMKREIQIMQHLSGQSNIVEFKGAFEDKQSVHVVMELCAGGELFDRIIAKGHYSERAAASICRQVVKVVNTCHFMGVIHRDLKPENFLLSSKDDKGLLKATDFGLSVFIEEGKVYRDIVGSAYYVAPEVLRRSYGKEADIWSAGVILYILLSGVPPFWAETEKGIFDVILQGHIDFESSPWPSISNSAKDLVRKMLIKDPKKRITAAQVLEHPWLKEGGNASDKPIDSAVLSRMKQFRAMNKLKKLALKVIAENLSEEEIQGLKAMFTNIDTDNSGTITYEELRAGLQRLGSKLTEAEVQQLMDAADVDGNGTIDYIEFITATMHRHRLERDEHLHKAFQYFDKDGSGYITRDELETAMKEYGMGNEATIREIISEVDTDNDGRINYDEFCTMMRSGTQQQGKLF

SEQ ID NO: 148894 - protein, 65 aa, Glycine max
  Coding DNA Sequence Number=SeqID_32116
MCRGALCLLDNDRHWWRRIFNAASSSSLSVKDYFTLNCDDALYIKIFVWNSAEKGECEEGGFPFM

SEQ ID NO: 148895 - protein, 116 aa, Glycine max
  Coding DNA Sequence Number=SeqID_32117
MEEYWETNDCKNRRCLATTQVAAQCPTTMRKIPHKAHKIPLFAHPQSSDGIIDPIGDVDLDLTSRLQHFIKQISVEHCFFYVDLMLAITQNEILVVGSGLCPDGSMDLDMSLPHTL

SEQ ID NO: 148896 - protein, 166 aa, Glycine max
  Coding DNA Sequence Number=SeqID_32118
  Gene Ontology: Mol. function=endonuclease activity; Cellular component=cytoplasm; Biological process=regulation of translational termination
  Homolog annotation: Hit_ID=Q84UT6; Match level="QueryCoverage=90%, HitCoverage=79%, E-value=7e-46, Identity=65%"; Hit description =Perchloric acid soluble translation inhibitor protein homolog
  Pfam annotation: Domain name=Ribonuc_L-PSP; Domain location=70-166; Score=90.6; E_value=4.7e-24; Accession=PF01042.11; Description =Endoribonuclease L-PSP
  Subcellular localization annotation: CTP_CleavageSite=74; ConfidenceScore=5.46e-01
MASWCGARSFQIPAMEDSALRNRASLAAGVGCLSVAGTSFWRSSSSPKRSLPFTCLSISSDTRIKESVQTEGAPAALGPYSQAIKSNNLIFVSGVLGLVPETGKFVSDDVEDQTEQLLKNMGEILKAGGASYSSVVKTTIMLADLKDFKKVNEIYAKCEACNNLFR

SEQ ID NO: 148897 - protein, 244 aa, Glycine max
  Coding DNA Sequence Number=SeqID_32119
  Gene Ontology: Mol. function=ATPase activity; Cellular component =chromosome; Biological process=chromosome organization and biogenesis
  Homolog annotation: Hit_ID=Q011Q9; Match level="QueryCoverage=95%, HitCoverage=12%, E-value=2e-40, Identity=40%"; Hit description=[Z] KOG0161 Myosin class II heavy chain
  Pfam annotation: Domain name=OTU; Domain location=11-166; Score=50.9; E_value=4.2e-12; Accession=PF02338.9; Description=OTU-like cysteine protease
MEGVILRRVIPSDNSCLFNAVGYVMDHDKKKAAELRQGKMMPCKHSIVAYGAVIGGGHINKLPTVVIAATVASDPQKYCEAFLGKPNAEYCNWILDSEKWGVDEFDLGFKGYFKVQTPSAIELSILADYYGREIAAYDIQTTRCDLYGQESNYSERVMLIYDGLHYDALVEFDQTIFAVQKNRSIGPVEGLALTFVKDQQRKRSYTDTSNFTLRCGVCQIGVIGEKEAVEHAQATGHVNFQEYR

SEQ ID NO: 148898 - protein, 159 aa, Glycine max
  Coding DNA Sequence Number=SeqID_32120
  Subcellular localization annotation: CTP_CleavageSite=54; ConfidenceScore=5.34e-01
MAKAKASRGASGSGSVGSNVIPQRDPHLPPMKSYVALLRFFIFLFISVISYLPPSFHLFSLRFIAIHKMGNCLRRQSRIGYSTDDDEDWEDFRAAAAASGGVKKSTREVKIKITKKQLVELVGKVEVKELRMEQVLAHLMNHSLQRPWRPALQSIPEDH

SEQ ID NO: 148899 - protein, 489 aa, Glycine max
  Coding DNA Sequence Number=SeqID_32121
  Homolog annotation: Hit_ID=Q9LJU8; Match level="QueryCoverage=99%, HitCoverage=91%, E-value=6e-36, Identity=28%"; Hit description =Arabidopsis thaliana genomic DNA, chromosome 3, TAC clone: K10D20
MENFEVPSFSLGLDETPPHSPIHPSPSPADLHVSDSDPESRPYPPRPLLKRFRRDLPPPCLDADDDIEEFSSQEDPDQGHAFPSAWNRNHSVCSSSKVSLNGSGVLTPHSCSNSSSRDRKRKELSNDVPASSRLETRKSGLMFPKLNTSPLRRFQLIDSDSDDADVDVGADKVNPNSHLEQDKKTLVDLNGNEDLWKDFSPVKNVYVNRFQLLSDSDDLDVDVGAANKANLDSNLEKNKKTLLDEDLWKDFSPVKNVSVPTPAFNEMCEEYFRSAYCKEVGGGDVSKSFNERNPGVSSSCQRDQQQQESTDPVHPAHSYFFHEDPRIRRLVCSRLQNFNPLGTINTVNQQPNVSHIDYMRQFGNGGASNMQGVQNGRVSNSTRGKNKSSNLNVEGYFDASGGWMDPKFVSPFSHGKSSRKKATKRNSTKNSVSKSNNKTNKSNPSNQSSEGWVEPRSCTSLPKDAGKRRVQASGQSAGHWFTSPEGRKA

SEQ ID NO: 148900 - protein, 691 aa, Glycine max
  Coding DNA Sequence Number=SeqID_32122
  Homolog annotation: Hit_ID=P35749; Match level="QueryCoverage=36%, HitCoverage=12%, E-value=1e-09, Identity=24%"; Hit description =Myosin-11
  Subcellular localization annotation: CTP_CleavageSite=45; ConfidenceScore=5.15e-01
MKYSGKGSLPAGIASRSVNNNPSPDSDLEPAKPFQRWKPRTPGTRLRRHGGKRSRPETPLLKWKIHDDPLEDDRKSSVAGSRRRTCRSAKKQAEVAVSARRLAAGLWRLHLPETAANDDRKGLEHKHGIGHAGLQFLGHPNGMTHGSDMKKNPSQSPRSIFGTKNGHFCEPECFQFSNNEMEGATKWDPLCSKTADEAQHIYSHMKHVDQKASAVSVISALGAELEQARTRIQELETEHHSSKKKLEHFLKKVSEERAQWKSKEHEKIRAYIDDIKAELNQERKNRQRIEIVNSRLVNELADVKLSAKRYMLDYEKERKARELIEEVCDELAKEIGEDKAEVEALKRESMKFREEVEEERKMLQMAEVWREERVQMKLIDAKVALEEKYSQMNKLVAELESFIRSKSAEPNTMEMKEAQSLQQAAAAMNIQDIKGFSYEPPNSDDIFAIFEDANFGEANEREIEPCVSHSPASLASNIHMVSPEANAISKGGIQRHSDVFLDDNGDIEGDESGWETVSHVEDQGSSYSPEGSTRSLNRNHRESNVSGRSVLEWEETAGEETPITEISEVCSIPTKQAKKVSSITRLWRSTYPNNGDNYKIISVEGMNGRLSNGMLSNGGIMSPDHGSGKGGLSPQDLLYQLSPESGSPHAHRGMKGCIPRTVQKNSLKARLMEARMESQKVQLRHVLKQKI

SEQ ID NO: 148901 - protein, 1063 aa, Glycine max
  Coding DNA Sequence Number=SeqID_32123
  Gene Ontology: Cellular component=nucleus
  Homolog annotation: Hit_ID=Q013W3; Match level="QueryCoverage=41%, HitCoverage=20%, E-value=2e-33, Identity=25%"; Hit description=[S] KOG1837 Uncharacterized conserved protein
  Pfam annotation: Domain name=BP28CT; Domain location=775-947; Score =118.0; E_value=2.6e-32; Accession=PF08146.2; Description=BP28CT (NUC211) domain
  Pfam annotation: Domain name=HEAT; Domain location=1019-1055; Score =6.1; E_value=7.7; Accession=PF02985.12; Description=HEAT repeat
  Pfam annotation: Domain name=HEAT; Domain location=557-594; Score =10.6; E_value=2.2; Accession=PF02985.12; Description=HEAT repeat
  Pfam module annotation: Pfam domain module=BP28CT::HEAT::HEAT; Domain location=775-947::1019-1055::557-594
VEIEIQIKLMILSLFKGIGNALMHIPEVGPLLSSFLEQYYDELNKSCPKLSNTETQIVCLLLESCVMSSPSGGNDLQNLLLKALRLGAMTSDDPACVKPCITVLNKLNSQFYMELKNEVKEGLFCELVFLWHNDNGDVQRATKEALMRIDISFSTVGHMLDLILAQKSCISSSAEEKMVKKQKFIGHQEAGYPPNDISRRDNPVYILSSLLDVLLLKKDITNRHLLLGPLFKLLSKVFSGEWVNGAYSPCARKSPVAVTRNHVFSVLSAVTRVFPGEVLEHMLDILEVIGQAAVTQDVLFIVVKMKSNTVSKPTAISVVSKFPLCITWSAGIRGVGGGVESPTSPIEIDSHSKHVFEDLISAIVPCWLAKTDDVEKLLMIFMDILPEIVEHRRLSFVLYLLRTLGEGKSLASLLILLLRSLISRKAACFLNVKTRDDLTFYTGEWEYKFAVQICEQYTSMIWLPSLVMLLEQRGNSDVDQALFLELFIVMQFSLQKLQDPEFVFKLESGEDTAVIQALGLLCEVARNHKNVSLKLKGNKGSRSTPSFLLLHMNETSQESLNKLCLEIIRVLDDSSNTSLKVAAVSALEVLAERFPSNNSIFSLCLGSVTRHIVSHNLAVTSSCLRTTAALINVLGPKSLAELPKIMDNVMKSSRRVLASLDKKPETTDVLSASNESHFYVLITLEAVVDKLGGFLNPYLTNIMELLVLYPEYVSGVDAKVESRAHGVRKLLAEKIPVRLALPPLLKLYPAAIEAGDKSLTIVFDMLGTIIGTMDRSSIVAFHGKVFDLCLVALDLRRQSPPSVQNIDVVEKAVLNTMTVLTLKLTESMFKPLLIKSIEWAESEVDETASSGSIDRVISFYGMVNKLTESHRSLFVPYFKHLLGSCVHHLSEGGDVKVSRVNQKKKARILDDGNIKEIGSVSINAWHLRALMLLRPIVSQLVVDPPALLDDSINIPSVKEVDDLLVVCIGQMAVTAGSDLLWKPLNHEVLMQTRSEKLRAKILGLRIVKYFVENLKEEYLVFIAETIPFLGELLEDVELSVKSLAQEILQEMESLSGESLRQYL

SEQ ID NO: 148902 - protein, 707 aa, Glycine max
  Coding DNA Sequence Number=SeqID_32124
  Gene Ontology: Mol. function=ATP-dependent helicase activity; Cellular component=nucleus; Biological process=rRNA processing
  Homolog annotation: Hit_ID=Q9FFT9; Match level="QueryCoverage=95%, HitCoverage=92%, E-value=0.0, Identity=61%"; Hit description =Probable DEAD-box ATP-dependent RNA helicase 32
  Pfam annotation: Domain name=DEAD; Domain location=52-223; Score =214.1; E_value=3.2e-61; Accession=PF00270.19; Description=DEADDEAH box helicase
  Pfam annotation: Domain name=Helicase_C; Domain location=294-370; Score=85.1; E_value=2.1e-22; Accession=PF00271.21; Description =Helicase conserved C-terminal domain
  Pfam annotation: Domain name=ResIII; Domain location=48-218; Score= -30.3; E_value=0.016; Accession=PF04851.6; Description=Type III restriction enzyme, res subunit
  Pfam module annotation: Pfam domain module=DEAD::Helicase_C::ResIII; Domain location=52-223::294-370::48-218
MSLPPLPKNSPVGRLDDDDTYSRYAGASRFEQFPLSKKTKDALRESKFVVMTDIQRASLPHALCGRDILGAAKTGSGKTLAFIIPVLEKLHRERWGPEDGVGSIIISPTRELAAQLFDVLKVVGKHHNFSAGLLIGGRKDVDMEKERVNELNILICTPGRLLQHMDETPNFDCSQMQVLVLDEADRILDSGFKKELNAIISQLPKRRQTLLFSATQTKSIQDLARLSLKDPEYLSVHEESVTSTPTLLKQIVMIVPLEQKLDMLWSFIKTHLQSKTLVFLSSCKQVKFVFEAFKKLHPGIPLKCLHGRMKQERRMAIYSEFCEKRSVLFSTDVAARGLDFNKAVDWVVQVDCPENVASYIHRVGRTARYKSDGKSVLFLLPSEIQMLEKLKAAKVPVHFNKPRKELLQPVSSLLASLLVKYPDMQHRAQRAFITYLRSIHIQKDKDIFDVMKLPIDEYSASLGLPMTPKIRFLNQKIKSKDVSTKSILVEPEDSDKETIFEVSRKKLDTVAFKDEETENDLLQLADTANEGEVKSSEIEEIIPATRVLKKKKLKINVHRPLGTRVVFDDEGHTLPPLARIADTQSGKEMLLDPEQKAEYYRRMRDDLKKADKEDKLIERQRLREKRIKQKMKWKAGNAEEDDQDDISGSEGDETVDRLHKKSKVYFDSDSDEGERNEVTGNARTSTGGVTLEEQEALALKLLNSMHS

SEQ ID NO: 148903 - protein, 214 aa, Glycine max
  Coding DNA Sequence Number=SeqID_32125
  Gene Ontology: Cellular component=nucleus
ILFVVNTKYPSELRGAAHHFLQDNKARSKKDDSLYKVLCKMLDGNSDSSLDISDSNADVRRATLLDLNNSVILKAKAVGLELEDKDLTVVQAALRVDGLPNVIDSSKLLDALQKVLRRCTDKLLSADNYSLNGEVAVTCLKNAISYFSDHTDYLKNVAAMIFPLLLVLPQAEWETSVTAGDASLDEFKPEVLDWDCSAFFNELLYVKLRHLNVK

SEQ ID NO: 148904 - protein, 215 aa, Glycine max
  Coding DNA Sequence Number=SeqID_32126
  Gene Ontology: Cellular component=nucleus
  Homolog annotation: Hit_ID=Q7SY48; Match level="QueryCoverage=66%, HitCoverage=6%, E-value=4e-22, Identity=35%"; Hit description=HEAT repeat containing 1
MDERFRNYKDDLFSHRSIELDRELMGIEQDNQLNVSIASYLRLLSGYFLHTSALQTLEYLIRRHKIHVYNNEDLILCTLPYHDEPEFVRIVQILDTRNTKWGFLDGVKASGARLPRMVIVQQCIRDKGILDALCNYASPSKKSRPSMPAIRFCTAVFVEVLGTVVTVDDDLVKRILPFVSLQPGIKGVSDHKNMLGLAHVIMYVLFKQLIALFCI

SEQ ID NO: 148905 - protein, 76 aa, Glycine max
  Coding DNA Sequence Number=SeqID_32127
MTVSITVIIIVVVTIIITIITCLAMMVVTINDCGDGSGCNDGHGDDIDSDEGRGNKGGDGGGYKMIMVMTTTIWVN

SEQ ID NO: 148906 - protein, 200 aa, Glycine max
  Coding DNA Sequence Number=SeqID_32128
  Gene Ontology: Mol. function=nucleic acid binding
  Homolog annotation: Hit_ID=Q9FFU3; Match level="QueryCoverage=82%, HitCoverage=31%, E-value=1e-80, Identity=79%"; Hit description =Genomic DNA, chromosome 5, P1 clone:MBG8
MEEKLGVSNAHSWTCMDLYIFATPYRVTWDYYFLAREHTLEIKEWEGKAEYEYVKNHGLSIFLLQAGMLGTLQALWEVFPLFTNTGWGENSNIKFLEKHMGASFEVRPQPWVTNVSADDIHSGDFLAVSKIRGRWGAFETLEKWVSGAYAGHTAVCLRDSSGKLWVGESGHENEKDRYQYHTIHDTKTYNSIRAVGDSNP

SEQ ID NO: 148907 - protein, 209 aa, Glycine max
  Coding DNA Sequence Number=SeqID_32129
  Gene Ontology: Mol. function=transporter activity; Biological process= transport
  Homolog annotation: Hit_ID=Q38JB2; Match level="QueryCoverage=89%, HitCoverage=57%, E-value=8e-98, Identity=92%"; Hit description =Chloroplast lipocalin
MQLMRPQLQSRFSRSDSKNLDVVAEIMVTSHFLKPFLMTIAADLSRAPNNICQLASASENAVTSPFENEKGSNLMMMRGMTAKDFDPVRYSGRWFEVASLKRGFAGQGQEDCHCTQGVYTFDREAPSIQVDTFCVHGGPNGFITGIRGRVQCLSEEDLGKTETQLEKQEMIKEKCYLRFPTLPFIPKEPYDVIATDYDNFSLVSGAKDQ

SEQ ID NO: 148908 - protein, 282 aa, Glycine max
  Coding DNA Sequence Number=SeqID_32130
  Gene Ontology: Mol. function=nucleotide binding; Cellular component =intracellular; Biological process=small GTPase mediated signal transduction
  Homolog annotation: Hit_ID=Q9SUJ6; Match level="QueryCoverage=99%, HitCoverage=99%, E-value=2e-94, Identity=61%"; Hit description=SGP1 monomeric G-protein
  Pfam annotation: Domain name=Miro; Domain location=99-212; Score =120.1; E_value=6.1e-33; Accession=PF08477.3; Description=Miro-like protein
  Pfam annotation: Domain name=Ras; Domain location=99-264; Score=4.5; E_value=1.3e-09; Accession=PF00071.12; Description=Ras family
  Pfam module annotation: Pfam domain module=Miro::Ras; Domain location= 99-212::99-264
MAKKIIHDTTRKMSQLCQKIVKVDVRWGVLKRVSFVGHFFRFIWNRLLVCSVAGRPSQYRKLPVRDPSSSPPSYADDVFFSATTTTGGYDSDSDLVNLKISLLGDCHIGKTTFVIKYVGNEQEKRSLQMEGLNLMDKTLSVQGARISFRIWDVAGDKRSLDQIPMACKDSVAILIMFDLTSRCTLNSVVGWYSEARKWNQTAIPILIGTKFDDFVRLPPDVQWTIVTQARAYARAMKATLFFSSATHNINVNKIFKFIMAKLFNLPWTVERNLRVGEPIIDF

SEQ ID NO: 148909 - protein, 243 aa, Glycine max
  Coding DNA Sequence Number=SeqID_32131
  Homolog annotation: Hit_ID=Q9FFU7; Match level="QueryCoverage=79%, HitCoverage=42%, E-value=1e-16, Identity=29%"; Hit description =Similarity to heat shock transcription factor HSF30
  Pfam annotation: Domain name=FBD; Domain location=158-208; Score =47.3; E_value=5.2e-11; Accession=PF08387.1; Description=FBD
MGLTKLFLDKCNFDFDYFRVKAPNLKIFKYCGWINFAVVEIDSLAMEEVDLDFSLESSFEEFGHPIYNLVKDVCTARVLTVCSFVLQVIPTGPEQLRMEVDMDARHLIMKTALDDDEFIGISFFLNSCPLLERLTIEIGPKSELSDYEPAFEFTSLLFWIEYLNVCECLISSLEVVEINGFRGTLNEYRFLEYLIFSGYVLKKIIINMLKDDSGRTVEYYCRHMAELLLTCPCTSRNLEISIF

SEQ ID NO: 148910 - protein, 151 aa, Glycine max
  Coding DNA Sequence Number=SeqID_32132
  Homolog annotation: Hit_ID=Q9FFU7; Match level="QueryCoverage=89%, HitCoverage=29%, E-value=8e-13, Identity=31%"; Hit description =Similarity to heat shock transcription factor HSF30
  Pfam annotation: Domain name=F-box; Domain location=6-53; Score=32.2; E_value=1.9e-06; Accession=PF00646.23; Description=F-box domain
MAVSSDCFCLLPIEVVLTILSLLPFKEVVRTCVLSKDWLDICKSTPNIEFNELFFVKPDQSNETREAQRRAFLEFIKSWIENHKGATIDKFSLSLSMPANVGEIINESVAFATQRGVKELDLDFVDRSKNENGDCSYDSDEALFELPSQGL

SEQ ID NO: 148911 - protein, 248 aa, Glycine max
  Coding DNA Sequence Number=SeqID_32133
  Gene Ontology: Mol. function=transporter activity; Cellular component= integral to membrane; Biological process=transport
  Homolog annotation: Hit_ID=Q58J24; Match level="QueryCoverage=99%, HitCoverage=61%, E-value=1e-90, Identity=71%"; Hit description =Putative plastid glucose 6 phosphate/phosphate translocator
  Pfam annotation: Domain name=DUF6; Domain location=114-238; Score =30.4; E_value=6.1e-06; Accession=PF00892.11; Description=Integral membrane protein DUF6
  Subcellular localization annotation: CTP_CleavageSite=81; ConfidenceScore=5.52e-01
MICTVKQPAISIRVSDIFLRKKGLPSTPVQSCSIVSPSSLPREKNSLRSLVSVQKPLHLSRVGFGDFVGSLVRRERGDFVTCDAYEADRSEVGGAPSKAAKKVKIGIYFATWWVLNVVFNIYNKKVLNAFPYPWLTSTLSLACGSLIMLFCWATKIVEPPKTDLQFWKDLFPVAVLHTIGHVAATVSMSKVAVSFTHIIKSAEPAFSVMVSRLLGEEFPAPVYLSLIPIIGGCGLAAVTELNFNMIGI

SEQ ID NO: 148912 - protein, 57 aa, Glycine max
  Coding DNA Sequence Number=SeqID_32134
MESRGCICWGWPTVTTGQKMLRNTGYVPRKGWVFGSAKATMAGLLPPVIGNNICSTL

SEQ ID NO: 148913 - protein, 929 aa, Glycine max
  Coding DNA Sequence Number=SeqID_32135
  Gene Ontology: Mol. function=protein serine/threonine kinase activity; Cellular component=integral to membrane; Biological process=protein amino acid phosphorylation
  Homolog annotation: Hit_ID=Q49N12; Match level="QueryCoverage=92%, HitCoverage=84%, E-value=0.0, Identity=56%"; Hit description =Putative receptor-like protein kinase 2
  Pfam annotation: Domain name=LRR_1; Domain location=118-139; Score =9.2; E_value=5.4; Accession=PF00560.23; Description=Leucine Rich Repeat
  Pfam annotation: Domain name=LRR_1; Domain location=142-164; Score =8.5; E_value=7.2; Accession=PF00560.23; Description=Leucine Rich Repeat
  Pfam annotation: Domain name=LRR_1; Domain location=191-213; Score =4.5; E_value=42; Accession=PF00560.23; Description=Leucine Rich Repeat
  Pfam annotation: Domain name=LRR_1; Domain location=215-237; Score =19.8; E_value=0.0098; Accession=PF00560.23; Description=Leucine Rich Repeat
  Pfam annotation: Domain name=LRR_1; Domain location=23-45; Score =16.9; E_value=0.076; Accession=PF00560.23; Description=Leucine Rich Repeat
  Pfam annotation: Domain name=LRR_1; Domain location=239-262; Score =8.0; E_value=9.2; Accession=PF00560.23; Description=Leucine Rich Repeat
  Pfam annotation: Domain name=LRR_1; Domain location=46-68; Score=8.0; E_value=9; Accession=PF00560.23; Description=Leucine Rich Repeat
  Pfam annotation: Domain name=LRR_1; Domain location=70-92; Score =14.5; E_value=0.39; Accession=PF00560.23; Description=Leucine Rich Repeat
  Pfam annotation: Domain name=LRR_1; Domain location=94-116; Score =16.7; E_value=0.082; Accession=PF00560.23; Description=Leucine Rich Repeat
  Pfam annotation: Domain name=Pkinase; Domain location=585-856; Score =161.2; E_value=2.7e-45; Accession=PF00069.15; Description=Protein kinase domain
  Pfam annotation: Domain name=Pkinase_Tyr; Domain location=585-856; Score=150.9; E_value=3.3e-42; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=118-139::142-164::191-213::215-237::23-45::239-262::46 -68::70-92::94-116::585-856::585-856
MNRSLKAQNLSGSLSPDFSKLHHLQELDLSRNIITGAIPPQWGTMRLVELSFMGNKLSGPFPKVLTNITTLRNLSIEGNQFSGHIPTEIGKLTNLEKLILSSNGFTGALPPTLSKLTKLIDLRISDNNFFGKIPDFISNWTLIEKLHMHGCSLEGPIPSSISALTRLSDLRIADLKGSKSSAFPPLNNLKSMKTLVLRKCMIKGEIPAYIGRMEKLKILDLSYNGLSGEIPESFAQLDKVDFMYLTGNKLSGIIPGWVLANNKNIDISDNNFSWDSSSPTECPRGSINLVESYSSSVNTQNKIHSCLKRNFPCTSSVNKYHYSMNINCGGNEANISGQIYEADREQKGAAMLYYTGQDWALSSTGNFMDNDIDSDPYVVANTSRLNVSALNSQLYTTARVSPLALTYYGLCLINGNYTVKLHFAEIIFINDRSLYSLGRRVFDVYIQGNLVLKDFDIQREAGGTGKPIVKTLNASVTQHTLEIHFYWAGKGTTGIPTRGVYGPLISAISVNPNFKPPSGDGKRTYFMLAIGIVAGVLVVVLLVLVLMRRMGWLGGKDPVYKELRGIDLQTGLFTLRQIKAATKNFDAENKIGEGGFGCVFKGLLSDGTIIAVKQLSSKSKQGNREFVNEMGLISGLQHPNLVKLYGCCVEGNQLILIYEYMENNCLSRILFGRDPNKTKLDWPTRKKICLGIAKALAYLHEESRIKIIHRDIKASNVLLDKDFNAKVSDFGLAKLIEDDKTHISTRVAGTIGYMAPEYAMRGYLTDKADVYSFGVVALETVSGKSNTNFRPNEDFFYLLDWAYVLQERGSLLELVDPNLGSEYSTEEAMVVLNVALLCTNASPTLRPTMSQVVSMLEGWTDIQDLLSDPGYSAISSSSKHKSIRSHFWQNPSGTHSMSIPSIDTDFSGSHVETDKSYLPVTVNSDGSDK

SEQ ID NO: 148914 - protein, 433 aa, Glycine max
  Coding DNA Sequence Number=SeqID_32136
  Gene Ontology: Mol. function=transferase activity, transferring acyl groups, acyl groups converted into alkyl on transfer; Cellular component=glyoxysome; Biological process=tricarboxylic acid cycle
  Homolog annotation: Hit_ID=P49299; Match level="QueryCoverage=91%, HitCoverage=77%, E-value=1e-167, Identity=74%"; Hit description =Citrate synthase, glyoxysomal precursor
  Pfam annotation: Domain name=Citrate_synt; Domain location=99-424; Score=295.5; E_value=9.9e-86; Accession=PF00285.11; Description =Citrate synthase
MSSNSDAAAATVHAHGRLAMLAAHLLPSQLTHHGALHPLHLSSQLPPPPNLAGTLTVVDERTGKKYQLHVSKEGTVKASEFKKILTGKNDKGLKLYDPGYLNTAPVRSTISYIDGDEGILRYRGYPIEELADKSTFTEVSYLIMYGSLPSESQLAEWEFAISQHSAVPQGVLDMIQSMPHDAHPMGVLVNAMSALSVFHPDANPALRGLDIYDSKQIRDKQITRITTIAAAVYLRMAGRPPVLPSNLLSYTENFLYMLDSLYVCGNRSYKPNPQLTRALDIIFILHAEHEMNCSTSAVRHLASSGVDVYTAIAGAVGALYGPLHGGANEAVLKMLSEIGTVQNIPEFIEGVKARKRKLSGFGHRVYKNYDPRAKVLRKLAEEVFSIVGRDPLIEVFIHFVFPVSLVCYMFLNFGMLVMRPMIRGVNTEKNYYI

SEQ ID NO: 148915 - protein, 123 aa, Glycine max
  Coding DNA Sequence Number=SeqID_32137
MVRIISLDRDLGRIIGRVLGREPTTSIHRQQQVALVAEDVQHVDHTADEVHQQPEEAAADDVVPDAEGFSGESHNTSVLIGYVHHVAVTVWNGEERPELSFHGRKVEKFGRPALKIEGLVTAT

SEQ ID NO: 148916 - protein, 223 aa, Glycine max
  Coding DNA Sequence Number=SeqID_32138
  Gene Ontology: Mol. function=nucleotide binding; Cellular component =nucleus; Biological process=fatty acid biosynthetic process
  Homolog annotation: Hit_ID=Q7XYX5; Match level="QueryCoverage=97%, HitCoverage=80%, E-value=2e-75, Identity=65%"; Hit description=AKIN beta4
  Pfam annotation: Domain name=AMPKBI; Domain location=131-219; Score =40.1; E_value=7.6e-09; Accession=PF04739.5; Description=5'-AMP -activated protein kinase, beta subunit, complex-interacting region
MAIFKVPVAAMQRPAAIAQPLPQNGYVESVIHERLKNVRITWNHAATNVAIAGSWDNWETTEPLLRVDQNFVIVKTLPIGIYHYRFIVDGYLTHAPEFPSASDDSGYGYNILDLQDYIPEIVASLSDFEDPPSPPSSYDNTNLNEEEFSKPPPELPQQLPVAIRNEASSASGSHHVPRPTHLELNHLYIHKTDRDQFVALRSTYKFQHKYITAELYKTLRRER

SEQ ID NO: 148917 - protein, 170 aa, Glycine max
  Coding DNA Sequence Number=SeqID_32139
  Gene Ontology: Mol. function=protein kinase activity; Cellular component=cytoplasm; Biological process=protein amino acid phosphorylation
  Homolog annotation: Hit_ID=Q1ENV7; Match level="QueryCoverage=91%, HitCoverage=33%, E-value=9e-71, Identity=83%"; Hit description =Protein kinase family protein
  Pfam annotation: Domain name=Pkinase; Domain location=2-170; Score =4.6; E_value=7.8e-09; Accession=PF00069.15; Description=Protein kinase domain
  Pfam annotation: Domain name=Pkinase_Tyr; Domain location=1-170; Score=-67.6; E_value=2.5e-08; Accession=PF07714.7; Description =Protein tyrosine kinase
  Pfam module annotation: Pfam domain module=Pkinase::Pkinase_Tyr; Domain location=2-170::1-170
MEVHIIRKISPLLGDLRAYLKRKGALKPVTAVKFALDIARGMNYLHEHKPEAIIHRDLEPSNILRDDSGHLKVADFGVSKLLKVAKTVKEDKPVTSLDTSWRYVAPEVYKNEEYDTKVDVFSFALILQEMIEGCPPFYEKPENEVPKAYVENERPPFRASPKLYAYGLKQ

SEQ ID NO: 148918 - protein, 169 aa, Glycine max
  Coding DNA Sequence Number=SeqID_32140
MGQSMRQDAQNIAKADPGLKVFPDYFALVRGSIALSVEHTKKNLYAKDFLQTRQMKGHYYSTKSNRQGRTCPWQLVSIYIVQHSDSQGCLLSESFPAAPLLRKKLGSKILPLSYIAKTVFVVLILQQKSSYSQFLISMDESKQDEICIGVKSNSVHRSKQVLNSIEAHT

SEQ ID NO: 148919 - protein, 47 aa, Glycine max
  Coding DNA Sequence Number=SeqID_32141
MMQEVTENIIDACGQRKRQIEDQIQGHHIVEIISCLLILGDEEVGVD

SEQ ID NO: 148920 - protein, 516 aa, Glycine max
  Coding DNA Sequence Number=SeqID_32142
MAATFDGFSIRDYTSKMRSIDVFKCWPFASTSSRDTSREEVQSWLPPMNPCPRSDDFNDSHAQNLENPPSAAEVSRTDGDGDCSEEESAESMDFEKSAPPSDSNNNEDEKLEMVCPVCREFNAVTLTAVNAHIDGCLAQTMREERRHMRIMNLKSSSSKSKPLKKRSIAEIFKVEEQQQPPRPQLQPPPLPQIESVLKFWPFRKGEANDVSITSITVTKFEWLSRRLEALRSRPTPRGGEVKSDQGESSEEKMEMVCPVCRDFNAATVTAVNAHIDGCLAQAVREERRQMRRTTVNCKPIPKAPPKPKVPKKRSIAEILTVAPPFEASKRKAIQVEEEDEEKSDYGYSGGDSTSSATPAPYATVASPVASVIKNNKSTMKNRNKKKLKKKSKVEKHGDSGVWFVNHEKKTVVSKKKRKKKKNAFNNVPTGNKRNTRQVKVGKGECYEKGKLRQVPSCAEGIQNTSTLARRGHSWVTSFSDVEVYTQLTAGCILASGRSASGGPEFDRSFVGSVRSV

SEQ ID NO: 148921 - protein, 103 aa, Glycine max
  Coding DNA Sequence Number=SeqID_32143
  Gene Ontology: Cellular component=integral to membrane
  Homolog annotation: Hit_ID=Q682H0; Match level="QueryCoverage=98%, HitCoverage=66%, E-value=6e-31, Identity=55%"; Hit description=HVA22- like protein f
  Pfam annotation: Domain name=TB2_DP1_HVA22; Domain location=1-49; Score=-15.2; E_value=0.001; Accession=PF03134.9; Description=TB2DP1, HVA22 family
MTLFELSTHEILAWFPIWGYLKLMFCIWLVMPMFNGAAYINENYVRQYIKNIGRSSNYSEEYKKVLHMMTFDARKAVERYIGRYGPDAFERVVRAAEKESKKS

SEQ ID NO: 148922 - protein, 919 aa, Glycine max
  Coding DNA Sequence Number=SeqID_32144
MLPLHEVDPSIDRKKQVKNCDSVGKQPKAVSPVHGILKNHFKHVSEKTSSGSSIGDGTEESHDNDQEPTSNRHVKFSGKDDILGPKKTNSFDETMFKLSSDALASSIVKEKSSGSDEETASLEPNRNYDHIAVNIDRDKREEVCPIVESKQFSNTLEQDTVQSFLKPCINQEKSKQLEEKSELLTKVAVCDNIDSQFFYGGNRTTLHCSPYADISRPLSAVQEEQMSGINTQVCESGSFSYSGKLDHLDDPQVDAVNSNENTETFLEPSSSYSASYNANEKPESPLQTYGDKDNSGEALGDRQFSRMLSADMIDNSFPITGWEKGSDKNSCLDPNFFGLPLNSHGELINFSSSGDLRINQSDTSSTLRGSFSGLPINNILHQNNQENLSINENHVVQKTFPKDCLNPFPHHPTRLPVTELQSREREDIHRPNSSDMCSGHYVPPLNSELNRKKNSFIEQNPYNRVRNHNGNGVVSLKEDSDHISPSSNQPTMRLMGKDVPIGRSSQEMQQFAGDVWPDEESRRRNYSEYAALDHSLLGRSSKQNWASGSPLQISADNVLQSAKIQSNQAAQSTILMSSTYSGFSQQFIDRLGNHVSQNGSLGVNRNASSYFNPITQKSSSYSVFNGASNDFSEQFIPGAKPLGLISQSVVLPTPGNFSHSPHVTNGELNDKNTNPHVTKSAFGFPFLQPTVNEQAKTSWFHSPYRSSPSWLSSSTDEMLPGTFSRQFSASISQNFPQNLWGNNFTTPFVNHSAEVRFPSNHLTSLGPMQTTPLSPSSIVHPLHFPVTPSTINSGNRNINKVADRLKFDEHHLCANTRKNPAAAANLDDSRLPNIQVQENLSRMTRLPEEKSSVELQRNTRALELDPHMGSARSRCCQHEAQNQNPGSYPAVNSFKLDSMVTSGPVRLGPKRAKHILNSS

SEQ ID NO: 148923 - protein, 100 aa, Glycine max
  Coding DNA Sequence Number=SeqID_32145
  Gene Ontology: Mol. function=sequence-specific DNA binding; Cellular component=nucleus; Biological process=regulation of transcription, DNA-dependent
  Homolog annotation: Hit_ID=Q9XHM3; Match level="QueryCoverage=77%, HitCoverage=31%, E-value=9e-33, Identity=89%"; Hit description =AGAMOUS homolog
  Pfam annotation: Domain name=SRF-TF; Domain location=27-77; Score =118.8; E_value=1.6e-32; Accession=PF00319.9; Description=SRF-type transcription factor (DNA-binding and dimerisation domain)
MEFPNEAIISEGSNSQKKTGRGKIEIKRIENTTNRQVTFCKRRNGLLKKAYELSVLCDAEVALVVFSSRGRLYEYANNSDTTQAPHPIGVRVSDFSLFSI

SEQ ID NO: 148924 - protein, 420 aa, Glycine max
  Coding DNA Sequence Number=SeqID_32146
  Gene Ontology: Mol. function=transferase activity, transferring hexosyl groups; Cellular component=integral to membrane; Biological process=carbohydrate biosynthetic process
  Homolog annotation: Hit_ID=Q2QN55; Match level="QueryCoverage=86%, HitCoverage=65%, E-value=3e-82, Identity=40%"; Hit description =Glycosyl transferase family 8 protein, expressed
  Pfam annotation: Domain name=Glyco_transf_8; Domain location=29-364; Score=246.4; E_value=6e-71; Accession=PF01501.10; Description =Glycosyl transferase family 8
MEREVQSARKQESLYWHIASHGVPQSLHCLCLKLAEEYAVNAIARSRLPLPEHVSRLVDPTFHHIVLLTDNVLAASVVVTSTVENSANPERLVFHVVTDKKTFTPMHTWFAINSINSAVVEVRGLHHYDWSKEVNAGVKDMQETNNLIWKHYYSNYKQKELDHSEDHNRYLEALRPSSLSLLNHLRIYIPELFPDLNKVVLLDDDVVVQHDLSSLWELDLNGKVSGSVFKSWCENSCCPGNKYVNFLNFSHPIISSNFDGDKCAWLFGVDIFDLEAWRKSDITKTYHQWLKLNVQSGLTLWNPGMLPAALIAFEGQVHPIDTSWLVTDLGYRHRSEEIGNSIERVETAAVVHFNGPAKPWLEIGLPEEAEEPSQLIGRISLGQQAGHQGTDPGNKCCRVLSLWQETEDFLEAKLLKDLGP

SEQ ID NO: 148925 - protein, 63 aa, Glycine max
  Coding DNA Sequence Number=SeqID_32147
MSAKRDKLVCDSIRRIADTQITESNIADSNIADSNIADSNIADSSNDRPRRVIRKPTYLQDYV

SEQ ID NO: 148926 - protein, 338 aa, Glycine max
  Coding DNA Sequence Number=SeqID_32148
  Homolog annotation: Hit_ID=Q019U2; Match level="QueryCoverage=85%, HitCoverage=87%, E-value=4e-19, Identity=25%"; Hit description =Homology to unknown gene
MAEIQFNTSEVVSILEFLRVISLFHYDSDGANPSLAYDYELPKQKWNSSDSLVSLHPKKEFRNGTDLIWQVPESPKGVLFLAHGCNGRAINFWDKSPECPDCIGLPEERLLVLHGLAQGFAVITISSAQRCWTLGKEVMVVKDIIEWWIGRRKLEKLPLVALGASSGGYFVSVLAAAMKFSSTVLMIAEGMFEQIDVKGDYPPTLFVHMPKDLYRQQKIDEYVKVLKDKGIDVGVVECMEFPLLPNTLADRIPGLDQALSRKLFEFFQEKGFIDKNGYMKKDGRQIKWKKALEEKKALLLDKNLVPHIQEELNLAFAYHEMTSVHSDQIFKWFESHMS

SEQ ID NO: 148927 - protein, 436 aa, Glycine max
  Coding DNA Sequence Number=SeqID_32149
  Gene Ontology: Mol. function=oxidoreductase activity; Cellular component=membrane; Biological process=electron transport
  Homolog annotation: Hit_ID=Q9SJH2; Match level="QueryCoverage=99%, HitCoverage=89%, E-value=1e-175, Identity=66%"; Hit description =Putative cytochrome P450
  Pfam annotation: Domain name=p450; Domain location=1-433; Score =146.3; E_value=8.2e-41; Accession=PF00067.12; Description=Cytochrome P450
MGFPLIGETMEFFNAQRRNQLFEEFVHPRILKHGRIFRTRIMGSPTVVVNGAEANKFLLSNEFKLVKSSWPSSSVELMGRDSIMEKDGGRHRFLRGVIGTSLGYAGLELLVPKLCNSVQFHLATNWKGQEKISLYRSTKVLSFSIVFECLLGIKVEPGMLDTFERVLEGVFSPAVMFPGSKFWRAKKARVEIEKMLVKVVREKRREMEGSLGREQDGMLLSKLVSGMIQGEISEKEVIDNVVLLVFAAHDTTSFAVAMTFKMLAQHPDCFGKLLQEHVAIMSNKSRGENLTLEDIKKMKYTWQVARESMRLFPPIFGSFRKAITDIEYEGFIIPRGWKVLWTTYGTHYNEEYFKDPMSFNPSRFEEGVPQYAFVPFGGGPRVCAGYQLARLNILIFVHYVVTQYEWFLLHPDEPVAMDPLPFPSLGMPIRISPKYT

SEQ ID NO: 148928 - protein, 360 aa, Glycine max
  Coding DNA Sequence Number=SeqID_32150
  Gene Ontology: Mol. function=structural constituent of ribosome; Cellular component=intracellular; Biological process=translation
  Homolog annotation: Hit_ID=A0BBG4; Match level="QueryCoverage=73%, HitCoverage=51%, E-value=7e-11, Identity=28%"; Hit description =Chromosome undetermined scaffold_1, whole genome shotgun sequence
MERKRNNPTSFTMFTLLLGVLSQNLVIPVISTTTTIEDHNSPDPHAGTDLSNSLCSYCSPDHGSGSSGHGSSPHHSHHGSPSHHGSPSHHGSPSHGGGGSYNPTPSTPPGGGSYDPTPSPPSGGGGSYNPTPSTPPSGGSYDPTPSPPSDGGENCNPTPSTPPGGGSYDPTPSPPSSGGGGSYNPTPLTPPGGGSYDTTPSPPSGGGGSYNPTPSTPPGGGSYDPTPSPPSGDGVVEVTIQLHQLPQVVEAMIQPHHHPQMVEVTIQPHQLLLVVEAMIQLHHHPRVVEVTIQLHQLPQVVEAMIQPHHHPQMVEVIIQLHHHPQVATVDTTTRPLYSNTLSPNNTINPIKPSLGRRWVL

SEQ ID NO: 148929 - protein, 283 aa, Glycine max
  Coding DNA Sequence Number=SeqID_32151
  Gene Ontology: Mol. function=hydrolase activity, hydrolyzing O -glycosyl compounds; Cellular component=cell wall; Biological process= carbohydrate metabolic process
  Homolog annotation: Hit_ID=Q06BI6; Match level="QueryCoverage=95%, HitCoverage=95%, E-value=3e-93, Identity=58%"; Hit description =Xyloglucan endotransglucosylase/hydrolase 1
  Pfam annotation: Domain name=Glyco_hydro_16; Domain location=26-207; Score=337.1; E_value=3e-98; Accession=PF00722.11; Description =Glycosyl hydrolases family 16
  Pfam annotation: Domain name=XET_C; Domain location=222-277; Score =39.5; E_value=1.1e-08; Accession=PF06955.3; Description=Xyloglucan endo-transglycosylase (XET)
  Pfam module annotation: Pfam domain module=Glyco_hydro_16::XET_C; Domain location=26-207::222-277
MASSYVLFMLSLCLASTTKFALGGNFYTDFNILFGDNRANIQDGGSNMSLAMDKSSGSGIATKNEYLFGRFDMQMKLIPDNSAGTVTTFYLSSQGPNHDEIDLEFLGNLSGDPHILSTNYYANGTGGREIQFYLWFDPTQDFHTYSIDWNPQRIIILVDNIPIRVMHNRENIGVPFPTSQPMKVYATLWDGDFWATRGGKVKIDWSKAPFIAGFRNFNANACIAGPEGSSCMGFNGGRNKGLDAQIRKHLKEIHSRWVVYDYCRDFIRFAHGFPSECRKNKHT

SEQ ID NO: 148930 - protein, 45 aa, Glycine max
  Coding DNA Sequence Number=SeqID_32152
MSYVQEVGNWRMHKSFRKSMLEFDCQSVVFCWISKTVTVVGVPVL

SEQ ID NO: 148931 - protein, 893 aa, Glycine max
  Coding DNA Sequence Number=SeqID_32153
  Gene Ontology: Mol. function=molecular_function; Cellular component =Golgi transport complex; Biological process=intra-Golgi vesicle -mediated transport
  Homolog annotation: Hit_ID=Q9C9V9; Match level="QueryCoverage=90%, HitCoverage=89%, E-value=0.0, Identity=55%"; Hit description =Putative golgi transport complex protein; 67058-70172
  Subcellular localization annotation: CTP_CleavageSite=65; ConfidenceScore=5.93e-01
MASPAAARTPVSTGASPMQRLSTFKNPSSTTATATTTTSSALDSLASDPIFSAFLSPSFSSTSFSSAALSSGSPASTAEKLHHAIRLLENQLRSEVLSRHHDLLSQLSSLHHADHALSTLRSALSSLQSSVRRLRSELSDPHRSVAAKTAQLSNLHRTTELLQHSIRALRLSKKLRDLMAAPDPEKLDLAKAAQLHFEILSLCDEYDLSGIDAVDEELNWVRETGDLLRSVAMKVLERGMDGLNQAEVGTGLQVFYNLGELKVTVEQVVNKYKGLGAKSVTVALDMKTISGGSGYGPGGIRGSGTPHIGGGAKAREALWHRLGNCMDQLHSIAVAVWHLQRVLSKKRDPFTHVLLLDEAIQASSFMQHYTVTAFLSSKELYRMQSREIVKNHACPFSSDALNTTRWILDEMRSICNLLKIYSSEGDPMLTDRVWEAITKAFASQMKSAFTASSFVKEIFTMGYPKLYSMIENLLERISHDTDVKGVLPAINSSGKEQIISAVEIFQNAFLAHCLSRLSDLVNSVFPMSSRGSVPSKEQISRIISRIQEEIEAVQVDARLTLLVLREIGKVLILLAERAEYQISTGPESRQVGGPATPAQLKNFTLCQHLQDVHTRISSILKGMPSIAADVLSASLGALYGVACDSVTALFQAMLDRLESCILQIHDHNFGVLGMDAAMDNNASPYMEELQKCILHFRSEFLSRLLPSRNSTAPGTENICTRLVQSMASRVLVFFIRHASLVRPLSESGKLRMARDMAELELAVGQNLFPVEQLGAPYRALRAFRPLIFLETSQLASSPLLQDLPPNVILHHLYTRAPEELQSPLQRNKLTPLQYSLWLDSQWEDQIWKGIKATLDDYAANVRSRGDKEFSPVYPLMLQLGSSLIEKDQTSSKS

SEQ ID NO: 148932 - protein, 539 aa, Glycine max
  Coding DNA Sequence Number=SeqID_32154
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=98%, HitCoverage=100%, E-value=1e-166, Identity=55%"; Hit description =Glycerol-3-phosphate acyltransferase 1
  Pfam annotation: Domain name=Acyltransferase; Domain location=328 -442; Score=40.9; E_value=4.3e-09; Accession=PF01553.11; Description =Acyltransferase
MVFPMELLRLADWILYQLLANSCYRAARKMKSYGFHLGYLSSKPSLQPSSFPSVTECDWEGRGSQTLVACGIHRVLLRSHSFFPYFMLVAFEGGSILRALLLLLSCPVLWILDSELSLRVMTFITFFGLRTSVMENMSRAVLPKFYLENLNLHAYEVLASAGSKVVFTSVPRVMVEGFLREYLSVGAVVGTELHTVGCYFSGLVSGSGLLVKHRALKDYFGDTKPDIGVGSSSFHDHLFLSLCKEAYVVNNEEGKGNPSSVLPRDKYPKPLIFHDGRLAFLPTPSATLYMFMWFPFGILLAIYRILLGILLPYGWAQALGVWSGINMQVKGNVPEKLEQNKGVLFVCSHRTLLDPVFLSTCLAKPLTAVTYSLSKVSELIAPIRTVRLTRDRKKDGETMQRLLKEGDLVVCPEGTTCREPYLLRFSSLFAELADEIVPVAINSHVSMFYGTTASGLKCLDPIFFLMNPRPSYYIEVLGKVPKELTCAGGKSSCEVANYIQQQLACALGFECTTLTRKDKYMMLAGNEGIVKQDKWSKCY

SEQ ID NO: 148933 - protein, 525 aa, Glycine max
  Coding DNA Sequence Number=SeqID_32155
  Gene Ontology: Mol. function=protein serine/threonine kinase activity; Cellular component=nucleus; Biological process=protein amino acid phosphorylation
  Homolog annotation: Hit_ID=Q9SJG9; Match level="QueryCoverage=95%, HitCoverage=97%, E-value=1e-124, Identity=61%"; Hit description =Mitogen-activated protein kinase 20
  Pfam annotation: Domain name=Pkinase; Domain location=15-214; Score =54.5; E_value=3.4e-13; Accession=PF00069.15; Description=Protein kinase domain
  Pfam annotation: Domain name=Pkinase_Tyr; Domain location=15-212; Score=-102.7; E_value=3.6e-06; Accession=PF07714.7; Description =Protein tyrosine kinase
  Pfam module annotation: Pfam domain module=Pkinase::Pkinase_Tyr; Domain location=15-214::15-212
MEMEFFSDYGDVSRYKIQEVIGKGSYGVVCSAIDSHTGEKVAIKKIHDIFEHVSDAARILREIKLLRLLRHPDIVEIKHVMLPPSRRDFKDIYVVFELMESDLHQYTPAIDIWSIGCIFAEVLIGKPLFPGKNVVHQLDLMTDLLGTPSLDAISKVRNDKARRYLTSMRKKQPIPFAQKFPNADPLALQLLERLLAFDPKDRPTAEEALADPYFKGLSKIEREPSCQPITKMEFEFERRRVTKEEIGELIFREILEYHPQLLKDYINGTERTNFLYPSAVDQFKQQFAHLEEDSGKCCPIMPLERKHVSLPRSTIVHSNMVPLKEQSNIASCINRQTAEEYNKNSRDTENPAPSYIQGLQKFPQAKPGKVVGPVIPYEYASVVKGTYDPRTFMRGSVLPSQPIPPTNHYQRSTSGKQERSATEADKGVSLQSKLAKQCGVNVKIAPEIAINIDTNPFFMTRAGINKIEQDDRIAIETKLLQSKAHQYGGISTTAHRKVGPVQYGGAFLVENKKKVLHSGEVVVSG

SEQ ID NO: 148934 - protein, 401 aa, Glycine max
  Coding DNA Sequence Number=SeqID_32156
  Gene Ontology: Mol. function=molecular_function; Cellular component =Golgi transport complex; Biological process=intra-Golgi vesicle -mediated transport
  Homolog annotation: Hit_ID=Q9C9V9; Match level="QueryCoverage=55%, HitCoverage=26%, E-value=2e-80, Identity=67%"; Hit description =Putative golgi transport complex protein; 67058-70172
MDADEHIGIQGKQQHNFLLITTKTITNEPHLNGLIKQQNMGKGITFLGEHPLQMPHSNSNGMQLIHAIPQPMPESLSSLSPSSNVGRSRAPNPTGTVPASTRNGLHIQRHSNTLSTQALILIHHLLHSDLQFPEIVENLQPGPNLCLVQPIHSAFQNLHRHAAKQISGLPDPIELFVDGVDAGEVVLVAEAEDLEVELGGLGEIEFFGVRGGHEVAELLREAEGADGVLEELRGAVEVGELGGFGGDGAVRVGELGAEAADGGLERGERGSEGGEGVVRVVEGRELREEIVMPREDFGTELAGEPEERAAEEKEVEEKEGERKAEKMGSEARESRADEVVVVAVAVVEEGFLKVERRCIGDAPVETGVLAAAGDAIVIFVFASERRRSFSLVLVQTLGLDS

SEQ ID NO: 148935 - protein, 706 aa, Glycine max
  Coding DNA Sequence Number=SeqID_32157
  Homolog annotation: Hit_ID=Q943F9; Match level="QueryCoverage=72%, HitCoverage=88%, E-value=4e-96, Identity=44%"; Hit description =Lipase (Class 3)-like protein
MAVSSETQLDGKPSGPPNLRSLTWRDLINSSWKDTNYKRVAMASLVRAVYMLELDRQENRTQENALAPSWWIPFKYKLTQILIDERDESIFGAIFEWDRSAALADFLPIRPKGAPKAVLALRGTLLRSATRQRDIEDDIRFAAWESLKGSFRFKVTLEALQSVSGAYGSRNVCIAGHSLGAGFGLQVGKELAKEGINVEAHLFNPPSVSLAMNIEYIEEKAGYVWNGLKSMITSGSEAQVSNDGDKTHGIRLKQVIQGILDAGFGVGNRVPHLYINSSDYISCFYFYADGTREITEEENMGPAYGKNSAKLFVVSKENQEFLEAHSLKQWWSSDAELDQDTHNSKLISKQLRSLNIATPSLVFFLLYPHIVSFAMSHSNIRETTGFVWNILKSMPLSIGKAQVSNDGDNTSSVGLKGWIPQLSGLKDAGFWVRKCVSYLYDYKNDGMGKRMVDKENKVPINEQNLFVVSKEKQKFFAARGLEQWWPSEAELVQVIHNRKHISWQLRYLYTSTHWEATHLLSPPFVSLAMSLSNIGEREEFVWKWNSLKSMLPSSSETQGTVSNDRHKTSDAGLKSWIPQLSGLKDASFVLRKWVPHMYSNNTDYISSQLQSLYSSTPSQVSRLFSNLPSVLPDMSLRNTREKAEFVCESQVSNDKTSGTGLKSWIPQLSSLKDAGFGASKWISQVYAHESNGTTENIGPSLEKNEA

SEQ ID NO: 148936 - protein, 443 aa, Glycine max
  Coding DNA Sequence Number=SeqID_32158
  Gene Ontology: Mol. function=DNA primase activity; Cellular component= alpha DNA polymerase:primase complex; Biological process=DNA replication, synthesis of RNA primer
  Homolog annotation: Hit_ID=Q9FJ26; Match level="QueryCoverage=90%, HitCoverage=92%, E-value=1e-150, Identity=64%"; Hit description=DNA polymerase alpha subunit IV (Primase)-like protein
  Pfam annotation: Domain name=DNA_primase_S; Domain location=119-364; Score=296.9; E_value=3.7e-86; Accession=PF01896.9; Description=DNA primase small subunit
MIPQQEPDFNLNHLKLYYGKLFPFADLVRWVSYGNDGKHPGCDQSYIGRREFSFTLENDIYLRFQSFHNALELENSIKEKTPVKIDIGPVYTVDPAKRNAYAQSGDNNVFAPVERELIFDIDMSDYDDVRYCCSGADVCLVCWPLMTIAIKVIDTALRDDFGFKHILWVYSGRRGVHCWVCDGKARRLTNEQRGAIADYFRVYKGNENSHKKVSLMGAALHPFLATSYTNVLKNYFEKNLLTGQNLLATEERYEKILDMIPDESIASELRGRWQDSRRSSSAKEDINVVRWEQCKQLLQSGKHKGMMQDLLKQAQGLRRCIEEIVFCFTYPRLDMEVSKHMNHLLKAPFCVHPKTGRVCVPIDPKRCEEFDPTTVPTLSQLIEELNYEGSRADADGESNRTSLGNAITLFRSSFLQPLLKACKEEIENSYNLKLQQSKNSLGW

SEQ ID NO: 148937 - protein, 93 aa, Glycine max
  Coding DNA Sequence Number=SeqID_32159
KPKGGGGDSEVAATTKVEEAEGGDKNYSLSRVEYLENDGVHDGRLKIQSFPPKRPRHLLQPQLAPLLLLLLVLVLHHLSLFLYYVIWTQRIRV

SEQ ID NO: 148938 - protein, 1124 aa, Glycine max
  Coding DNA Sequence Number=SeqID_32160
  Gene Ontology: Mol. function=cellulose synthase (UDP-forming) activity; Cellular component=membrane; Biological process=cellulose biosynthetic process
  Homolog annotation: Hit_ID=Q93XQ0; Match level="QueryCoverage=97%, HitCoverage=96%, E-value=0.0, Identity=79%"; Hit description =Cellulose synthase D-like protein
  Pfam annotation: Domain name=Cellulose_synt; Domain location=265 -1117; Score=2018.0; E_value=0; Accession=PF03552.5; Description =Cellulose synthase
  Subcellular localization annotation: CTP_CleavageSite=54; ConfidenceScore=5.73e-01
MSSINRQSSKKSGRNSGGSTSQGSQSSGGPSVKFARRTSSGRYVSLSRDEIDVSSDLSGDYMNYTVHIPPTPDNQPMDSSVAMKAEEQYVSNSLFTGGFNSVTRAHLMDKVIDSEVTHPQMAGSKGSLCSICDGRVMRDERGRDVTPCECRYKICRDCFIDAQKESGMCPGCKEPYKVGEYEEDLTDQYSNNGALPLPAPNGSKRNPNNMSVMKRNQNGEFDHNKWLFETQGTYGVGNAYWPQDDMYGDDALKAGMLDPEKPWKPLSRVTPIPSGIISPYRLLILVRFVVLIFFLHWRVVNPNKDAVWLWIMSITCEIWFGFSWILDQVPKLCPVNRSTDLAVLHEKFDSPSPSNPTGRSDLPGMDLFVSTADPEKEPPLTTANTILSILAVDYPVEKLACYISDDGGALLTFEAMAEAASFADLWVPFCRKHNIEPRNPESYFSLKVDPTKNKSRTDFVKDRRRVKREYDEFKVRINGLPDSIRRRSDAFNAREEMKMMKHMKESGADPSEPVKVLKSTWMADGTHWPGTWATPSSEHAKGDHAGILQVMLKPPSPDPLFGSADDDKILDFTEVDTRLPMFVYVSREKRPGYDHNKKAGAMNALVRASAILSNGPFILNLDCDHYIYNCKAVREGMCFMMDRGGEDICYIQFPQRFEGIDPSDRYANHNTVFFDGNMRALDGLQGPMYVGTGCMFRRFALYGFDPPFADKDSDNKDGKKIEGSETPAMNASEFDPNLDVNLLPKRFGNSTMLAESIPVAEFQGRPLADHPAIKFGRPLGVLRAPREPLDATTVAEAVSVISCWYEDKTEWGDRVGWIYGSVTEDVVTGYRMHNRGWRSVYCITKRDAFRGSAPINLTDRLHQVLRWATGSVEIFFSKNNAFLASKRLKILQRLSYLNVGIYPFTSLFLVVYCFLPALSLFSGSFIVETLSIAFLIYLLIITVCLVMLAILEVKWSGVELEQWWRNEQFWLISGTSAHLAAVVQGLLKVMAGIEISFTLTSKSAGEDEDDMFADLYIVKWSSLMVPPIVIAMTNIIAIAVAFSRTIYSANPQWSKFIGGAFFSFWVLAHLYPFAKGLMGRRGKTPTIVFVWSGLIAITLSLLWVSISPPQGADGQGVGGDFQFP

SEQ ID NO: 148939 - protein, 399 aa, Glycine max
  Coding DNA Sequence Number=SeqID_32161
  Gene Ontology: Mol. function=protein serine/threonine kinase activity; Cellular component=membrane; Biological process=protein amino acid phosphorylation
  Homolog annotation: Hit_ID=Q0WPA7; Match level="QueryCoverage=93%, HitCoverage=76%, E-value=1e-149, Identity=68%"; Hit description =Receptor-like protein kinase
  Pfam annotation: Domain name=Pkinase; Domain location=180-396; Score =64.7; E_value=3.1e-16; Accession=PF00069.15; Description=Protein kinase domain
  Pfam annotation: Domain name=Pkinase_Tyr; Domain location=180-396; Score=28.9; E_value=3e-14; Accession=PF07714.7; Description=Protein tyrosine kinase
  Pfam module annotation: Pfam domain module=Pkinase::Pkinase_Tyr; Domain location=180-396::180-396
MELSKKTSFLGLKRWVLIGIGVGAFIVLILCILSIWAMFRRKCRRSLDKYSVSQIPNVSKDIDVDKVGVQSSHVQPENVVIPVHDKASDKNSDNVSVHLGKSKSGDPDNISQCSSIYHHERGFSSMSAEEGSSGNVKKQSTLSHGGLATASPLVGLPEFSHLGWGHWFTLRDLEMATNRFSSENIIGEGGYGIVYRGRLINGTEVAVKKLLNNLGQAEKEFRVEVEAIGHVRHKHLVRLLGYCVEGVHRLLVYEYVNNGNLEQWLHGNMHQYGTLTWEARMKVILGTAKALAYLHEAIEPKVIHRDIKSSNILIDDEFNAKELTSVVDFSYVAPEYANSGLLNEKSDIYSFGVLLLEAVTGRDPVDYARPANEVPNSYELCQLASSNHTFHWKSSLCFK

SEQ ID NO: 148940 - protein, 337 aa, Glycine max
  Coding DNA Sequence Number=SeqID_32162
  Homolog annotation: Hit_ID=Q93WV4; Match level="QueryCoverage=47%, HitCoverage=55%, E-value=8e-38, Identity=52%"; Hit description =Probable WRKY transcription factor 71
  Pfam annotation: Domain name=FLYWCH; Domain location=177-245; Score= -1.3; E_value=0.098; Accession=PF04500.7; Description=FLYWCH zinc finger domain
  Pfam annotation: Domain name=WRKY; Domain location=188-247; Score =149.1; E_value=1.2e-41; Accession=PF03106.6; Description=WRKY DNA -binding domain
  Pfam module annotation: Pfam domain module=FLYWCH::WRKY; Domain location=177-245::188-247
MANEKDRFYDPFHYNNHHDQQLNHSSSSFPLFFRDNNNNSAPISSQNFQGFDDHNNNSSSDHHHTTFTDCLHGSMDYNTLSRVFDMSCSSSEVISSIDENPKKPSAGGDSVGVRGNQSTPNSSVSSPSNEAEAIIEEDSTKSQKDKQPKACEADGDEKPKKENKPKKKEKKPREPRFAFLTKSEIDHLEDGYRWRKYGQKAVKNSPYPRSYYRCTSQKCGVKKRVERSFQDPTIVITTYEGQHNHHCPATLRGSAASMLSSPSFFGSSYMASSLPQDFLAQLVPSYSQINDHQSPMFHQNLSHNLHPQPQQQHQFQLSHDHGLLQDLLPSFPGKHEP

SEQ ID NO: 148941 - protein, 176 aa, Glycine max
  Coding DNA Sequence Number=SeqID_32163
  Subcellular localization annotation: CTP_CleavageSite=25; ConfidenceScore=5.11e-01
MILNCVRVTAMPMMAVPRWRSTCCCASSSSSVSTINTDQLRSQLDQLHAEADATRTKATNARLRLLRLSEAAEKLKKQAAISIQKGQENYAREMLFQRKKVLQALDKSKRRIELLDELSTKLSERHAHLQKELCIPLKLLLSSLCIYQFVLYAHLRRIPDSHLKDLLSKNCNQHLL

SEQ ID NO: 148942 - protein, 159 aa, Glycine max
  Coding DNA Sequence Number=SeqID_32164
  Gene Ontology: Mol. function=catalytic activity; Cellular component =cellulose and pectin-containing cell wall; Biological process =carbohydrate metabolic process
  Homolog annotation: Hit_ID=Q8RZK0; Match level="QueryCoverage=80%, HitCoverage=46%, E-value=3e-32, Identity=51%"; Hit description=Beta 1,3-glucanase-like
  Pfam annotation: Domain name=X8; Domain location=82-159; Score=135.5; E_value=1.4e-37; Accession=PF07983.3; Description=X8 domain
MVRHGWSEMNFDTEGDDDDDRSNLRDITTPITTIPNLVPTTPTISTSPFLNPNSNPDTVSPASTIPFSTPTTVNSPMFSGASWCIASPTASQTTLQVALDYACGFGGADCSAIQPGGSCYNPNSIRNHASYAFNKYYQKNPVPNSCNFGGTAVIISTNP

SEQ ID NO: 148943 - protein, 51 aa, Glycine max
  Coding DNA Sequence Number=SeqID_32165
MSGMPTKDSADTEQDLEQQGEFQDLSSNRGQEELDCLGRHSSRSPFLFVPS

SEQ ID NO: 148944 - protein, 522 aa, Glycine max
  Coding DNA Sequence Number=SeqID_32166
  Gene Ontology: Mol. function=metal ion transporter activity; Cellular component=membrane; Biological process=metal ion transport
  Homolog annotation: Hit_ID=Q1SW35; Match level="QueryCoverage=91%, HitCoverage=95%, E-value=1e-154, Identity=57%"; Hit description=IMP dehydrogenase/GMP reductase
MVVEALVPLLESNMQAMNEDYSASFTSKMKKEGNHKTYSSTRDSNNNMQQGGELWTNGLICAFEFMRGNGPTKKKDYCLGRIGNSLNESDSHGDDFHLYCKEDLPRRYWRPIGWDRISELVQAVHSGDAQPFDFTDDESDVPVADVATPYWERPVGPTWWCHLDAADPFVTAWFGSSRWLHPAISIALQEESRLISDRMKHLLYEVPVRVAGGLLFELLGQSAGDPFAEEDDIPVVLRAWQAQNFLVTALHVKGSASNINVLGILEVQELLAAGGAKNPCSIHEVVAHLASRLARWDDRRSHEDLHLFTIILNQEIRRLSTQVIRVKWSLHAREEIVFELLKQLRGNAARALLEGVMKSTRQMIGEQEAVRGRLFIIQDVTQSTVRAWLQDRSLTVTHNLGIFGGCGLVLSIITGLFGINVDGIPGSSGTPYAFLLFTMILFVLGVVLIGIGLLYLGLKKPIIEENVALRKQELQELVRMFQHEAETHAQVRKTVPHKAQTAAVRPPNGANHRFIMSKLCSH

SEQ ID NO: 148945 - protein, 248 aa, Glycine max
  Coding DNA Sequence Number=SeqID_32167
  Gene Ontology: Mol. function=DNA binding; Cellular component =chromatin; Biological process=chromosome organization and biogenesis (sensu Eukaryota)
  Homolog annotation: Hit_ID=Q9SJG4; Match level="QueryCoverage=98%, HitCoverage=91%, E-value=8e-62, Identity=52%"; Hit description =Putative DNA binding protein
  Pfam annotation: Domain name=DUF296; Domain location=70-187; Score =180.8; E_value=3.4e-51; Accession=PF03479.5; Description=Domain of unknown function (DUF296)
MDRKQEQDKGNSNMSGTDVALISPKVPKAVSPVSSAAEGDTLRRPRGRPAGSKNKPKPPIIVTRDSANALKAHAMEVSSGCDVNESLSNFARRKQRGLYIFNGTGCVTNVTLCQPGSSGAIVTLHGRFEILSLLGSILPPPAPPGITGLTIYLAGAQGQVVGGAVVGALIASGPLVIMAASFMHATFDRLPLEDDELAAAMQNQHYQNGRTHHLDISDLYAMPQNLLMNGTMPPEIYSWAPGQNLSKT

SEQ ID NO: 148946 - protein, 150 aa, Glycine max
  Coding DNA Sequence Number=SeqID_32168
  Gene Ontology: Mol. function=structural constituent of ribosome; Cellular component=intracellular; Biological process=translation
  Homolog annotation: Hit_ID=Q1SCP5; Match level="QueryCoverage=96%, HitCoverage=97%, E-value=1e-71, Identity=76%"; Hit description =Ribosomal L18ae protein
  Pfam annotation: Domain name=Ribosomal_L18ae; Domain location=6-150; Score=307.0; E_value=3.5e-89; Accession=PF01775.7; Description =Ribosomal L18ae protein family
MVAMRQFHQYQVVGRALPTESDEHPKIYRMKLWATNEIFERNPTKIKNYGIWLRYQSRTGYHNMYKEYRDTTLNGAVEHMYTEMASRHRVRHPCIQIIKTATIPAKLCKRESTKQFHNSKIKFPLVFKKVRPPTRKLKTTYKASRPNLFM

SEQ ID NO: 148947 - protein, 44 aa, Glycine max
  Coding DNA Sequence Number=SeqID_32169
MRLPRRSLLVGSVLRCSGVMALSAHVEKGDTVAVEKLGADGGLL

SEQ ID NO: 148948 - protein, 432 aa, Glycine max
  Coding DNA Sequence Number=SeqID_32170
  Gene Ontology: Mol. function=transferase activity; Cellular component= intracellular; Biological process=protein kinase C activation
  Homolog annotation: Hit_ID=Q1RZ85; Match level="QueryCoverage=99%, HitCoverage=72%, E-value=1e-179, Identity=50%"; Hit description =Asp/Glu racemase; Polynucleotidyl transferase, Ribonuclease H fold
  Pfam annotation: Domain name=PPR; Domain location=119-153; Score =23.0; E_value=0.0011; Accession=PF01535.11; Description=PPR repeat
  Pfam annotation: Domain name=PPR; Domain location=165-199; Score=2.0; E_value=4.3; Accession=PF01535.11; Description=PPR repeat
  Pfam annotation: Domain name=PPR; Domain location=253-287; Score=5.8; E_value=1.5; Accession=PF01535.11; Description=PPR repeat
  Pfam annotation: Domain name=PPR; Domain location=289-323; Score=8.0; E_value=0.85; Accession=PF01535.11; Description=PPR repeat
  Pfam annotation: Domain name=PPR; Domain location=57-91; Score=25.0; E_value=0.00027; Accession=PF01535.11; Description=PPR repeat
  Pfam module annotation: Pfam domain module=PPR::PPR::PPR::PPR::PPR; Domain location=119-153::165-199::253-287::289-323::57-91
MYSLRGGVFVADAYKVFAEMRDKNVFAWTAVVAAHVACHDMVSARRLFDLAPQCDVVLWNVIVSGYIELGDMVAARELFDRMPDCDVMSWNTVLSGYANNGEVELFVKVFEEMPARNVYSWNGLIGGYVRNGLFKEALECFKRMLVLVEGEGKEGSDGVVVPNDYTVVAVLSACSRLGDLEIGKWVHVYADSIGYKGNLFVGNALIDMYAKCGVIEKALDVFDGLDPCHAWHAADALSLFEGMKRAGERPDGVTFVGILSACTHMGLVRNGFLHFQSMVDDYLIVPQIEHYGCMVDLLGRAGLINQAVDIVRKMPMEPDVMYKNVEMAELALQRLIELEPNNPGNFVMLSNIYKDLGRSQDVARLKVAMRDTGFRKVPGCSVIGCNDSVVEFYSLDERHPETDSIYRALQGLTILLRSHGYVPNLVDVAHAN

SEQ ID NO: 148949 - protein, 606 aa, Glycine max
  Coding DNA Sequence Number=SeqID_32171
  Gene Ontology: Mol. function=pepsin A activity; Cellular component =cellulose and pectin-containing cell wall; Biological process =proteolysis
  Homolog annotation: Hit_ID=Q9SJG1; Match level="QueryCoverage=80%, HitCoverage=90%, E-value=1e-164, Identity=59%"; Hit description =Putative chloroplast nucleoid DNA binding protein
  Pfam annotation: Domain name=Asp; Domain location=241-601; Score= -86.6; E_value=1.7e-08; Accession=PF00026.14; Description=Eukaryotic aspartyl protease
MHIRYLLGQIKYTVCSPNSEGANSLKLCYSATRIFIGSKKEDIIAMILKVSLIVVLLVICSCVVEAISRNHNQNPNHNNINKNGSSLAAIKFPDYPSFNDVSSSGDDCSFSNSEQLGHSGPTMTSGEETDEESEAFPAQKPHQNLVKFHLKHRSGSKDAEPKQSVVDFTLSDLTRIQNLHRRVIEKKNQNTISRLQKSQKEQPKQSYKPVVAAPAASRTTSPVSGQLVATLESGVSLGSGEYFMDVFVGTPPKHFSLILDTGSDLNWIQCVPCIACFEQSGPYYDPKDSSSFRNISCHDPRCQLVSAPDPPKPCKAENQSCPYFYWYGDGSNTTGDFALETFTVNLTTPNGTSELKHVENVMFGCGHWNRGLFHGAAGLLGLGKGPLSFASQMQSLYGQSFSYCLVDRNSNASVSSKLIFGEDKELLSHPNLNFTSFGGGKDGSVDTFYYVQIKSVMVDDEVLKIPEETWHLSSEGAGGTIIDSGTTLTYFAEPAYEIIKEAFVRKIKGYQLVEGLPPLKPCYNVSGIEKMELPDFGILFADEAVWNFPVENYFIWIDPEVVCLAILGNPRSALSIIGNYQQQNFHILYDMKKSRLGYAPMKCADV

SEQ ID NO: 148950 - protein, 267 aa, Glycine max
  Coding DNA Sequence Number=SeqID_32172
  Gene Ontology: Mol. function=calpain activity; Cellular component =intracellular; Biological process=proteolysis
  Homolog annotation: Hit_ID=Q1S671; Match level="QueryCoverage=96%, HitCoverage=69%, E-value=3e-20, Identity=29%"; Hit description =Cyclin-like F-box; F-box protein interaction domain
MPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLKGFPVLGTLPKVGGVYLSGTLNWVVIKGKEIIHSEIVIISVHLEKETCISLFLPDDFCFVDTNIGVFRDSLCVWQDSNTHLGLWQMRKFGDDNKSMILPLCMSDNGDFFMLKFTRNADDEYQTILYNQGDGKSQVSVVPSGSFITLLWRNLNDFHQEVWSYLIEILQM

SEQ ID NO: 148951 - protein, 388 aa, Glycine max
  Coding DNA Sequence Number=SeqID_32173
  Gene Ontology: Mol. function=oxidoreductase activity, acting on single donors with incorporation of molecular oxygen, incorporation of two atoms of oxygen; Cellular component=membrane; Biological process=aromatic amino ...
  Gene Ontology: Biological process=acid family metabolic process
  Homolog annotation: Hit_ID=Q56H33; Match level="QueryCoverage=91%, HitCoverage=91%, E-value=1e-126, Identity=63%"; Hit description=4 -hydroxyphenylpyruvate dioxygenase
MHPSGTPSLPHPPPCTQSSEAECPDHLCGQHITGTLVKVGVIGGSRRRRELKSTKETSLPHLSQSGENVVSNKRKMLHTSTFVVFQISLNLALPFRSVNRLVQRQQHRLRVVRQKHRVQPALARSHVLRGELRELVESAEAFQVPDRRRQFGHVPDGVVQPPNPVVQLRKRPRRGLESRQEPPRRIRPRRGVLVAYVAEHDVAVEAYLREAGAAVEESRWRRRLGAVGDAGVEGGFRVGYLQSDGTDAEAVLGGEGEAGGGVEGWKGGGGGASGGSGEEEGEVTGAEEVGGVDLVSGGEIGFCHNRHSKSPRESAGRVGSIGAPEADVVEAVNLKAVRFRVGSDEVCETNELKPGLDIAGLSSLTLLFLHYLFPKLLPRINKFIFIIL

SEQ ID NO: 148952 - protein, 132 aa, Glycine max
  Coding DNA Sequence Number=SeqID_32174
  Subcellular localization annotation: CTP_CleavageSite=27; ConfidenceScore=5.29e-01
TFKGPRKARGKRSEAPSIAPLEAPTPSSSTLPSSSSTDIPMIPPTPTQIPLPAPLSTGDQPSSSGGGGASTSQEPVTKEATAPAPSPAAVEEETTPAQTPQPSPPSAPAPEETQLSSALDLNEDQPQEEQDV

SEQ ID NO: 148953 - protein, 521 aa, Glycine max
  Coding DNA Sequence Number=SeqID_32175
  Gene Ontology: Mol. function=peptide deformylase activity; Biological process=translation
  Homolog annotation: Hit_ID=Q10FJ2; Match level="QueryCoverage=68%, HitCoverage=88%, E-value=1e-116, Identity=61%"; Hit description =Pleckstriny domain-containing protein, putative, expressed
  Pfam annotation: Domain name=PH; Domain location=27-140; Score=26.4; E_value=0.0001; Accession=PF00169.19; Description=PH domain
MTQRAAENTENSLEKIKRQLASASGRNLLQGPLLKRSETLRKWNERWVILDPTTGRMEYKIRRNEPSVKGTIIFDANSTITISPVNFHGLPKYDGCCFCILFVIFITFNIGTPQKKDYFLCAETPGAARAWVSTLHATQLVLKAHKEAVNSLSGNGSTKLGTVATVVAAANSTALECSKEIEAAMQISLRNALGMMNNRTTDGPMDDLTIMKETLRVKDEELQNLSRDLRARDSTIKDIADKLSETAEAAEAAASAAYTMDEHRRIACAEIERLNKDSEKQQELFTQKLKESEEKIGGLSKEREQLIRQRDAAIQEANMWRSELAKAREHDVILEAAVVRAEEKVRVAEANAETRIREAVQRESAALKEKEELLAYVNFIEFEYVYQLRNVELHKTKVDIADIFLFNRQHIDTTQVFEKTESCSDTKHVDPTEENVDKACLSVSRAIPVPAENVVHMATDQVNIQPVGDNEWSDIQATEARIADVREVAPETDGSSLDIPVVNQPGTNHHHEQGANSFHQP

SEQ ID NO: 148954 - protein, 416 aa, Glycine max
  Coding DNA Sequence Number=SeqID_32176
  Homolog annotation: Hit_ID=Q67YV2; Match level="QueryCoverage=97%, HitCoverage=99%, E-value=1e-105, Identity=61%"; Hit description=MRNA, complete cds, clone: RAFL24-07-B09
  Subcellular localization annotation: CTP_CleavageSite=59; ConfidenceScore=5.08e-01
MGGILKQPGAFAITPHKVSLCILLKIYAPPAQISVPFPFSSVAQHNRLGLFLLALTKLPALSVVSYWVLSKYLLEKKLRNSPLSRINALVHATCFADASSSSDAALAYVKLIQHLAVFKGYKEAFFALKIAEEKFLSVSKSQILLLKLLLLHEHALHRGQLKLAQKLCDELGVLASRVTRVDMELKTEASLRHARTLLAANQFREAAAVAHSLFCMCYKYNLQVENASVLLLLAEIHKKSGNAHLGLPYALASLSFCLSFNLDLLKASATLTLAELWLSLGSSHATRALNLIHGVFPMILGHGGLELRSRAYIVEAKCYLCDSNFNVFENYEIVVDSLSQASEELQLLENYKLPSGFIGPFSFFHELASEAFYLMAMVYDKLGQLEEREEAAASFQKHILALRNPQDEDDPLVSVF

SEQ ID NO: 148955 - protein, 742 aa, Glycine max
  Coding DNA Sequence Number=SeqID_32177
  Gene Ontology: Mol. function=RNA-directed DNA polymerase activity; Biological process=RNA-dependent DNA replication
  Homolog annotation: Hit_ID=UPI000034F451; Match level="QueryCoverage =22%, HitCoverage=12%, E-value=1e-63, Identity=69%"; Hit description =hedgehog receptor
MAVVADGRSFWAVGTMKISRASLVPTSSYIAKPAASWLDDFLVWISPEAFSCCRKFTNDSYCPPDDQPPCCLPDEGPCGLGGVCKDCTTCFRHSDLVNDRPSTAQFREKLPWFLDALPSADCAKGGHGAYTNSVDLNGYEGGVIQASEFRTYHTPLNRQGDYVNAIRAARDFSAIISSSLKGSMMSGNSRDNLILGGLKLHANLPKHGKEWKATERVNKDDQHKKESVKEKPIEKDEDKGKVARYGEKMDIEEELWVAALSNQSIMRQKAITKWIEEGDCNSRYFHLIVNWKCQYNMLRGVFAGKCWLEEPSRVKDETRQFFKRRFKEVERERPRLNRVRFKTICQQDNDLLVARFEKKEVRATMWDRGNAKSPGPDGLNFKFIKEFWDILKTDLLRFLDEFYANGVFLKRSNAFFLALIPKVLPTIIDERQTVFMEGRHTLHNVVIANEIMEEARSKWVRWIEGCLKLTSISILVNGSPTDESTPQRENSSFLVGRNNVDISLLQYVDDTIFFGKTSMANVKTIKGDFVKVNPELNSYLFSAATHHIFHLLLEAFVKKVVDRLEKGGLGVRDLVKFNYVLLGKWHWNLFHHHGELWVQVLDSKFGRGASLKVGQMENWMWIKGEVFGKWGFIVGEVPKNVPHFSTATTIYPVARSGNKRRLGMAVPVEEIIFGGASPGAAVKLCLGDLLVMGSNPETASLHMQGGSNSTSSATRHLDLGGGPKWELHSGECLHVAQSIYDR

SEQ ID NO: 148956 - protein, 71 aa, Glycine max
  Coding DNA Sequence Number=SeqID_32178
MSEEKQLLYSLLAPKIYQCVKEGSYHLHEQNYLQNTARKQSKTLAIWVRRSHMQKTGILDCKPFDTHMTKI

SEQ ID NO: 148957 - protein, 710 aa, Glycine max
  Coding DNA Sequence Number=SeqID_32179
  Gene Ontology: Mol. function=DNA binding; Biological process =regulation of transcription
  Homolog annotation: Hit_ID=Q9S7B1; Match level="QueryCoverage=96%, HitCoverage=94%, E-value=1e-160, Identity=57%"; Hit description =Nodule inception protein
  Pfam annotation: Domain name=PB1; Domain location=602-688; Score =86.9; E_value=6.1e-23; Accession=PF00564.15; Description=PB1 domain
  Pfam annotation: Domain name=RWP-RK; Domain location=496-547; Score =100.2; E_value=6.3e-27; Accession=PF02042.6; Description=RWP-RK domain
  Pfam module annotation: Pfam domain module=PB1::RWP-RK; Domain location=602-688::496-547
MEYGAFGSLSECEEDLIEELLEKGCWVETNGSSEAQYDIEQELAMPMGKTTWWIGPKGPVSGSSSSVKERLVVAVGYLREYTKNNNAANVLIQIWVPIRRMTGLLAIGLGPDESVSVAFPFPTNMNMNMKSNVNIRFFRSHEYPRIPYEYGSLALPVFERGSGTCLGVLQIVMPAARWDTINYLPQLDNNNNNNAFQGMIPGGVVKVFDEDEVYEASVNEMMEVVRCVCKTQNVPLALTWAPCVQQLCVDCGHSRDENNYVSIVDRACFVGDGQPQLLGFQEACSQHHLFRGQGIVGTAFTTAKPCFAMDITAFTKAEYPLSHHANIFDLHSAVAIPLRTSSYPHFDFVLEFFLPKHCPDHNLFLNSLSILLQQACPTFHLSAPIHDDVFTSLPSESQSQQASWIAHMIDAQSQHKDNGKGVCLSLDFLEEEPKEEFKVTTTHCNWDTTATSTYHSHDHVVFSDFGEESQSQSQSQTHTFGVKRGRKPGEKRRTKAEKTISLPVLRQYFAGSLKDAAKSIGVCPTTLKRICRQHGITRWPSRKIKKVGHSLKKLQLVIDSVQGAEGAIQIGSFYNSFPELSSRASQSSSPAAQSPPHVPQQPLRVKATFADEKIRFSLQPLWGFTELQLEISRRFNLSDVSNANNVVLKYLDDDGEWVVLACDGDLEECKDLHTTSQSRTIRLALFQASPLNNQPNSYTFANTTSTPSSS

SEQ ID NO: 148958 - protein, 681 aa, Glycine max
  Coding DNA Sequence Number=SeqID_32180
  Gene Ontology: Mol. function=protein kinase activity; Cellular component=integral to membrane; Biological process=protein amino acid phosphorylation
  Homolog annotation: Hit_ID=Q6K2A4; Match level="QueryCoverage=88%, HitCoverage=85%, E-value=0.0, Identity=74%"; Hit description=ABC1 family protein-like
  Pfam annotation: Domain name=ABC1; Domain location=231-351; Score =193.4; E_value=5.4e-55; Accession=PF03109.7; Description=ABC1 family
  Subcellular localization annotation: CTP_CleavageSite=61; ConfidenceScore=5.11e-01
MAMQGCYCHVYTKLATQRRTLDNLSFSGSISVKKLSKNERTTGNNQFHRLLVKMRQTEMPAASEYGTNELVKRKTMLEKTVNNGSATSKVVRKNGIPALSKTMKSRSSLEELKVLATDEGFSWANENYSSWQRSIDVWSFVASLRIRILLDNAKWAYLRGFTEAKQKSRRRKTASWLRERVLQLGPTFIKLGQLSSTRSDLFPREFVDELAKLQDMVPAFSPKKARKFIESELGAPINILFEEFEDRPIAAASLGQVHRAILHNGEKVVIKVQRPGLKKLFDIDLKNLKLIAEYFQRSETFGGPLRDWIGIYEECKTILYQEIDYINEGKNADRFRRDFRNIKWVRIPLVYWDYTALKVLTMEYVPGIKIDYVDTLTSRGYDRLRISSRATEAYLIQILKTGFFHADPHPGNLAIDVDEAIIYYDFGMMGEIKSFTRERLLELFYAMYEKDAKKVMQRLIELGALQPTGDLSSVRRSVQFFLDHLLSQAPDQEQTLSAIGEDLFAIAQDQPFRFPSTFAFVLRAFSTLEGIGYTLNPNFSFAKIATPYAQELLEIRQKQRTAPQLVEEIRKQADDATTYTMSMPYRVQRIEEFTKQLEAGDLKLRVRVLESERAARKATALQMATMYTVLGATLLNLGITLSSQGNITIANGSFIGAGIFMTLFVRSMQRVKMLDKFEKMI

SEQ ID NO: 148959 - protein, 624 aa, Glycine max
  Coding DNA Sequence Number=SeqID_32181
  Homolog annotation: Hit_ID=Q1T2T9; Match level="QueryCoverage=39%, HitCoverage=20%, E-value=1e-30, Identity=33%"; Hit description =Disease resistance protein; AAA ATPase; Tumor Necrosis Factor
MPQTEIPEWFDLVDNINGGNPRFWARGKFPIIALALAFQDVSERARQSRRQLVELHLLINGRCVPRKGYYNFKIAADHVLICDLRLLFSDKEWLGLDAFLEHEWNLVRVSYEAPSTLTLSGWGVFVYEEGANMEDVQFMCPDPKYSDMSPTKLVPTTKDPRQERKKMIDNLCLDEMFDGMLMETMDYEERDDFADKDFAIEQMHILMGGLKDLSTQAKDELESNGSALQDNNKNSTLTWLLDTIKKIDNGEAEPQSFYHKDLALIELKDKVKPPMDAAEEASTSGHQLQEMMREIFYDGITDGLLEAQNIFPSLDIVKIRSAAMNKGNRVAWSAEGNVILPTVEMRTYTSGVLGGLVEAKEVCFPDLDIWATLNTVVSRRGIQASFAAPPTVPQLDWTTIVPPSSRSQDPLLEAFLMMKPESSESEAKSKLFWKFNEEHQALRNKYVQLENENAAPDKDISDTASSPWKNQYEELIQKFNTQSDDEFIAKKHDIIACKCDTEYEKVCAVLKGRAEELGKLYNAGIEGFQNSQEFQDLISAIYLSGLRDGLLEAQAVLLALNMDRKTPVFKEKEEEHVIDHDVAVNESAIVADIPIPIGPDVDNPIRDTDNPSSSKDFFNWQEFI

SEQ ID NO: 148960 - protein, 304 aa, Glycine max
  Coding DNA Sequence Number=SeqID_32182
  Gene Ontology: Mol. function=DNA binding; Cellular component=nucleus; Biological process=regulation of transcription, DNA-dependent
  Homolog annotation: Hit_ID=Q9SK55; Match level="QueryCoverage=50%, HitCoverage=59%, E-value=3e-58, Identity=67%"; Hit description =Putative NAC domain-containing protein 42
  Pfam annotation: Domain name=NAM; Domain location=21-134; Score =202.8; E_value=7.8e-58; Accession=PF02365.6; Description=No apical meristem (NAM) protein
MDVAKLHNSDDDDDKKEDEDVLPGFRFHPTDEELVGFYLRRKVENKPLRIELIKQIDIYKYDPWDLPRRKYRNSIRPNRVTGSGFWKATGIDKPIYCVKEPHECIGLKKSLVYYRGSAGKGTKTDWMMHEFRLPPNGKTSNNPQANDAQEAEVWTLCRILKRFPSYKKYTPNLKDSAAAPIMTKPNYPTNSSSTSKTCSLESDNGKPYLTFTNSLSPLLIQQNERKPAINGHVDVERNHLFLGQLGINVAQAPTSLSYSSFWNRHHQNNVEFANENWDDLTSVVQFANIDPSRVSDHCKEFNRF

SEQ ID NO: 148961 - protein, 1511 aa, Glycine max
  Coding DNA Sequence Number=SeqID_32183
  Gene Ontology: Mol. function=RNA-directed DNA polymerase activity; Cellular component=chromatin; Biological process=chromatin assembly or disassembly
  Pfam annotation: Domain name=Chromo; Domain location=1403-1451; Score= 20.6; E_value=0.0037; Accession=PF00385.14; Description='chromo' (CHRromatin Organisation MOdifier
  Pfam annotation: Domain name=RVP; Domain location=342-446; Score= -1.2; E_value=0.0052; Accession=PF00077.10; Description=Retroviral aspartyl protease
  Pfam annotation: Domain name=RVP_2; Domain location=329-460; Score= -33.5; E_value=0.00041; Accession=PF08284.2; Description=Retroviral aspartyl protease
  Pfam annotation: Domain name=RnaseH; Domain location=843-962; Score= -33.1; E_value=0.07; Accession=PF00075.14; Description=RNase H
  Pfam annotation: Domain name=rve; Domain location=1097-1253; Score =95.4; E_value=1.7e-25; Accession=PF00665.16; Description=Integrase core domain
  Pfam annotation: Domain name=zf-H2C2; Domain location=1038-1079; Score=21.6; E_value=0.00049; Accession=PF09337.1; Description=His(2)- Cys(2) zinc finger
  Pfam module annotation: Pfam domain module=Chromo::RVP::RVP_2::RVT _1::Retrotrans_gag::RnaseH::rve::zf-H2C2; Domain location=1403 -1451::342-446::329-460::583-752::83-173::843-962::1097-1253::1038 -1079
MADSGTDRVEAALDRLTSRIEDLLQHVTPSASPPFPPRSLIPAHTHRMKLDVPRFDGTDPMGWIFKITQFFEYHGTPDSDRITIAAFYMEGRALAWFQWMSSNDQFTSWPVFLQALQTRFAPSNYEDPSGSLFKLIQKTTVAEYLSEFEELANRVVGLPAPFLLSCFVSGLAPEIRREVMINQPLTVAQAAGLARLHEEKLRDLRFDFRQPNRPRPLQLPPVTPPPTSPLPTYTPPRASTLPPLLPLPSRPNPPPPPMFRRLTSEELASRRERGLCFSCDEKFHKGHRCAPRVHLLIADDEDPLDPAGSNLNPPDPPDPLPGPLDRPDSPAHLSINSLAGHLAPETLRLLGTISGVPVLVLIDGGSTHNFIQEPLVHQLGLPCQSTSPLKVMVGNGQHLQCHTICSSTTLVLQHHSFTMDLYVLPIAGANIILGVQWLQSLGPVLTDYTKLTMQFFHDDRFVELRGDPDAHRELLSSPQFRRVCRHQPQSLYFHITVLPEDSAQTLTKPVDPQVQHLLHQFAILFQDPTTLPPARDTDHQIHLLPHATPVNVRPYKYPYYQKREIEAQVETMLQRGLIQPSKSPFSSPVLLVKKSDNTWRFCVDYRALNALTVKDRFPIPTIDELLDELGGASCFSKLDLLQGYHQIRMQPEDILKTAFRTHHGHFEFKVMPFGLCNAPSSFQATMNTLFRPYLRRFIIVFFDDILIYSGSLSDHLRHLQATFQILYENHFVLKLSKCLFAQSEVEYLGHLVSHRGVQPVTSKLDAIAQWPIPRLVRALRSFLGLAGFYRRFIRGYATLVAPLVKATTVEPLQWNSSTQAAFDTLKQALTSAPVLSLPDFQLPFTIETDASAIGMGAVLSQRGHPIAYFSKPFSPKLLRASTYVRELFAITAAVKKWRQYLLGHSFIILTDHRSLKELMSQVVQTPEQHTYLARLMGYDYQIQCRSGSHNQAADALSRLPENPSQALLILSVPCLTFLEELHTQLAANSSFQHLFQEVRDTPDKHPDFSIANKLLLYKGRIWLPSDIPIIKTLLTEYHATPTGGHAGVAKTVARLTTNFYWTGLRDDVMSFIATCVDCQVTKYETKKTAGLLCPLPVPTQPWSDLSLDFICGLPPYRGNTTILVVVDRFSKGIHLGMLPQSHTALAVARLFLDLVVKIHGFPRSLVSDRDPLFISQLWQELFKSSGTQLRMSSAYHPQSDGQTEVLNRVVEQYLRAFVHRKPSSWGKLLPWVEWSHNTSWMASTGTTPYEITFGRRPFNFPDYLAGSSKIEAVEDILTDRDNTFQLVRKKLLKAQSKMKLYADQHRRDVQFAVGDWVLVRLRPYRQFSAKDTHHTNEKLARRYYGPFQVVAKLGPVAYRLALPEGVRLHPVFHCSKLKPFRGDPDSSSPLPLPATFHENQPLVSPLSILDFRRETSDPQSPWQVLVQWQGLPPEETSWEDWHQLCQDYHLEDKVILQGPRDDTSTEDTELGKEDTEEEDDLSKRVEEDRGVQREGKPKRKVTKPNYLKDYV

SEQ ID NO: 148962 - protein, 1724 aa, Glycine max
  Coding DNA Sequence Number=SeqID_32184
  Gene Ontology: Mol. function=transmembrane receptor activity; Cellular component=membrane; Biological process=defense response
  Homolog annotation: Hit_ID=Q1T2S2; Match level="QueryCoverage=77%, HitCoverage=92%, E-value=0.0, Identity=40%"; Hit description=TIR; Disease resistance protein; AAA ATPase; Tumor Necrosis Factor
  Pfam annotation: Domain name=LRR_1; Domain location=564-589; Score =9.1; E_value=5.7; Accession=PF00560.23; Description=Leucine Rich Repeat
  Pfam annotation: Domain name=LRR_1; Domain location=629-650; Score =3.6; E_value=62; Accession=PF00560.23; Description=Leucine Rich Repeat
  Pfam annotation: Domain name=LRR_1; Domain location=652-674; Score =10.6; E_value=2.9; Accession=PF00560.23; Description=Leucine Rich Repeat
  Pfam annotation: Domain name=LRR_1; Domain location=676-695; Score =0.8; E_value=2e+02; Accession=PF00560.23; Description=Leucine Rich Repeat
  Pfam annotation: Domain name=LRR_1; Domain location=699-721; Score =6.9; E_value=14; Accession=PF00560.23; Description=Leucine Rich Repeat
  Pfam annotation: Domain name=LRR_1; Domain location=746-768; Score =3.0; E_value=77; Accession=PF00560.23; Description=Leucine Rich Repeat
  Pfam annotation: Domain name=LRR_1; Domain location=825-846; Score =6.6; E_value=17; Accession=PF00560.23; Description=Leucine Rich Repeat
  Pfam annotation: Domain name=LRR_1; Domain location=848-867; Score =4.6; E_value=39; Accession=PF00560.23; Description=Leucine Rich Repeat
  Pfam annotation: Domain name=LRR_1; Domain location=868-889; Score =9.1; E_value=5.7; Accession=PF00560.23; Description=Leucine Rich Repeat
  Pfam annotation: Domain name=NACHT; Domain location=217-370; Score= -37.0; E_value=0.044; Accession=PF05729.3; Description=NACHT domain
  Pfam annotation: Domain name=NB-ARC; Domain location=178-474; Score =125.0; E_value=2.1e-34; Accession=PF00931.13; Description=NB-ARC domain
  Pfam annotation: Domain name=TIR; Domain location=16-151; Score =179.3; E_value=9.8e-51; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=564-589::629-650::652-674::676-695::699-721::746-768::825 -846::848-867::...
  Pfam module annotation: Domain location=868-889::217-370::178-474::16- 151
MAKQHEEETFGFTYDVFISFRGEDTRNNFIGHLRKELSRKGMKIFFDDRDLPVGNVISPSLSKAIEESKILIIVFSKNYASSTWCLDELVKILEQSKISEMKQLVFPVFYHVDPSDVRKQTESYGEHMTKHEENFGKASQKLQAWRTALFEASNFPGHHITTRSGYEIDFIEKIVEKVQKNIAPKPLYTGQNPVGLGPRVEEVMSLLDMKPYDETVRMLGVWGLGGVGKTELAKALYDNIVQSFDAASFLADVREKLNKINGLEDLQKTLLSEMREELDTELGSAIKGMFEIKRKLKGKKVLLVLDDVDDKDKLEKLAGGRDWFGSGSRIIITTRDKDVLIAHQVDNIYQMEELDKHHSLELFCWNAFKQSHPKTGFEDVSLRAIYVAKGLPLALKVIGSDLATLDEESLEDWKCALEEYERTPPERILDVLKKSYDRLGSKPKQVFLDIACFFKGEKKEYVENILDDIGAITYNINVLVKKSLLTIEDGCLKMHDLIQDMGRVIVRQEEPDNPGERSRLWYYEDVIEILTDDLGSNKIQGIMLDPPQREEVDWSGTAFEKMKRLRILIVRNTSFSSEPEHLPNHLRVLDWIEYPSKSFPSKFYPKKIVVFNFPRSHLTLEEPFKKFPCLTNMDFSYNQSITEVPDVSGVENLRQLRLDQCKNLTTVHESVGFLKKLAHLSASGCTNLRNFLLKMFLPSLKVLDLNLCIMLEHFPDIMKEMKEPLKIYMINTAIKEMPESIGNLTGLVCLDISNSKELKYLPSSVFMLPNVVAFKIGGCSQLKKSFKSLQSPSTANVRPTLRTLHIENGGLLDEDLLAILNCFPKLEVLIASKNNFVSLPACIKECVHLTSLDVSACWKLQKIPECTNLRILNVNGCKGLEQISELPSAIQKVDARYCFSLTRETSDMLCFQAKKGICGLEVVMPMPKKQVVIPEWFDLVGHGGNPHFWARGKFPILSLALLFQDVRTGPIKRYDDLIELQLVINCQCVPRKGYYNFRVPPDHILICDLRLLFSDKEWIGLDAFLDRDWNEVQVAYVAASTMTLSCWGVYVYEGGANKKDVQFECPDAKYSDMSRAVVPTKDTKLERRKMIERYGAGQAFDAISTTLLEVYENVKDLPEYSHLPLKEKLSTILGFYKEVSRQAEAELESGRSDLQDKHSFLTAYLEYEMNVKALEEEEASTSVHQGSKEELLHSMQHEFYDGVTDGLVEARKRFPSLDIIKIRGATLKKRPEGTCVEWLFEVLFHERKAYTEGIVNGLLEAKLSFPELDMWATIHIVLCARGIEGFREGIRPSIQVIDEVEAAPVDVGEASTSGHQGSQKEQGYDPQQQKKIWEIFYYGIVDGLFQAQNSFPYLDVFKTANAAFDKRFAWSPEGNLQVHTLEMRTYTNGIINGLHEAKLSFPDLDIWATLNVVLNRIGIYETPALEFASRILDAINIMEVGEAPTSGLQESDQEEKQEIMRKIECDGMKDGLVEAKKMFPSLDVIKTRAAAFNNGTRVAWLFVLPQVEMKLHIEGIMNGLLEAKLRFPDLDIWTTLNIVLCRRGMEGLHERIRPLIRVMDVGEASTSGHQGSEDEEQGYNAKLQKLMETILYQGMMDALYAAHNNCPSLNIFTTKSAALRASKNLKYLIGVITDDNPALPMVMEIMYINGIMNGLREAKLSFPDLDMWATLTTVLSKIGVCETSILQYASCFLDTNNTKEVGEASTSSHQGSEEEQCCDYSIKE

SEQ ID NO: 148963 - protein, 102 aa, Glycine max
  Coding DNA Sequence Number=SeqID_32185
  Gene Ontology: Mol. function=transmembrane receptor activity; Cellular component=membrane; Biological process=apoptosis
  Homolog annotation: Hit_ID=Q1SY09; Match level="QueryCoverage=79%, HitCoverage=7%, E-value=2e-23, Identity=64%"; Hit description=TIR; Disease resistance protein; AAA ATPase
  Pfam annotation: Domain name=TIR; Domain location=15-102; Score=42.9; E_value=1.1e-09; Accession=PF01582.10; Description=TIR domain
MAKHEEESLGFTYDVFLCFRGEDVRYLFIGHLRKELCSKNINTFCDDEDLRMGEGIAPSLSKAIEESKILIIVFSENYASPPWCLDELVKILESAGLEVSFV

SEQ ID NO: 148964 - protein, 69 aa, Glycine max
  Coding DNA Sequence Number=SeqID_32186
  Subcellular localization annotation: CTP_CleavageSite=56; ConfidenceScore=5.12e-01
MVKVATAGGKVIGCKQNNQQRSKQSIQGCRSRKSPIGESQDQLTFETMLEGSSGISSSAYAAPPISYIA

SEQ ID NO: 148965 - protein, 940 aa, Glycine max
  Coding DNA Sequence Number=SeqID_32187
  Gene Ontology: Mol. function=transmembrane receptor activity; Cellular component=membrane; Biological process=defense response
  Homolog annotation: Hit_ID=Q1T2S2; Match level="QueryCoverage=96%, HitCoverage=63%, E-value=0.0, Identity=45%"; Hit description=TIR; Disease resistance protein; AAA ATPase; Tumor Necrosis Factor
  Pfam annotation: Domain name=LRR_1; Domain location=565-590; Score =5.6; E_value=25; Accession=PF00560.23; Description=Leucine Rich Repeat
  Pfam annotation: Domain name=LRR_1; Domain location=630-649; Score =1.6; E_value=1.4e+02; Accession=PF00560.23; Description=Leucine Rich Repeat
  Pfam annotation: Domain name=LRR_1; Domain location=653-675; Score =11.8; E_value=1.8; Accession=PF00560.23; Description=Leucine Rich Repeat
  Pfam annotation: Domain name=LRR_1; Domain location=700-722; Score =7.5; E_value=11; Accession=PF00560.23; Description=Leucine Rich Repeat
  Pfam annotation: Domain name=LRR_1; Domain location=802-825; Score =1.3; E_value=1.6e+02; Accession=PF00560.23; Description=Leucine Rich Repeat
  Pfam annotation: Domain name=LRR_1; Domain location=827-848; Score =7.5; E_value=11; Accession=PF00560.23; Description=Leucine Rich Repeat
  Pfam annotation: Domain name=LRR_1; Domain location=850-869; Score =4.7; E_value=37; Accession=PF00560.23; Description=Leucine Rich Repeat
  Pfam annotation: Domain name=LRR_1; Domain location=870-891; Score =7.4; E_value=12; Accession=PF00560.23; Description=Leucine Rich Repeat
  Pfam annotation: Domain name=NB-ARC; Domain location=178-478; Score =119.9; E_value=7.2e-33; Accession=PF00931.13; Description=NB-ARC domain
  Pfam annotation: Domain name=TIR; Domain location=17-154; Score =167.4; E_value=3.7e-47; Accession=PF01582.10; Description=TIR domain
  Pfam module annotation: Pfam domain module=LRR_1::LRR_1::LRR_1::LRR _1::LRR_1::LRR_1::LRR_1::LRR_1::NB-ARC::TIR; Domain location=565 -590::630-649::653-675::700-722::802-825::827-848::850-869::870 -891::178-478::17-154
MANHKDESLGFTFTYDVFLSFRGEDTRHKFIGHLRKELCQKGIKVFSDDKDLRIGEGISPALSSAIEKSKILIVVFSENYAESTWCLDELVKILECTKIIIRDKKQLVFPIFYHVDPSDIRHQKKSYGEHMLEHQKRFGKDSQRVQAWRSALSEASNFPGHHISTGYETEFIEKIADKVYKHIAPNPLHTGQNPIGLWPRMEEVMSLLDMKPYDETVRMLGVWGLPGVGKTELATALYNNIVNHFDAASFLSNVREKSNKNQWPGRSTERHFYQRCERSLDTDLGCANKGMSEIKRKLEGKKVLLVLDDVDDKDKLEKLAGGRDWFGSGSRIIITTRDKDVLIAHQVDNIYQMEELDKHHSLELFCWNAFKQSHPKTGFEDVSLRAIDVAKGLPLALKVIGSDLATLDEESLEDWKCALEEYERTPPERILEVLKKSYDRLGSKPKQVFLDIACFFKGEKKEYVENVLDEDFGAKSNIKVLVNKSLLTIEDGCLKMHDLIQDMGRDIVRQEAPNPGECSRVWYHEDVIDILTDDLGSDKIQGIMLDPPQREEVDWNGTAFDKMKRLRILIVRNTSFLSEPQHLPNHLRVLDWEEYPSKSFPSKFHPKKIIVINLRRSHLTLEEPFKKFACLTNMDFSYNQSITEMPDASEVQNLRELRLDHCRNLIAIHQTVGFLKRLAHLSASNCTKLRNFLQTMFLPSLEVLDLNLCVRLEHFPEIMKEMNKPLKIYMINTAIKELPESIGNLTGLVCIEIPSSRKLKYLPSSLFMLPNVVAFKIGGCSQLRESFRGFVQSPSAANVRPTLRTLYFGNGGLSDEDLLAILYCFPKLEELIASENNFVSLPECIKECDHLTSLDVSLCGELQKIPKCTKLRILNVHHCVKLEQISDLPSTVQKVDARYCFSLTRETSDMLWLQLVADPKSWVSGDKEADLQLVLFESEK

SEQ ID NO: 148966 - protein, 333 aa, Glycine max
  Coding DNA Sequence Number=SeqID_32188
  Gene Ontology: Mol. function=oxidoreductase activity; Cellular component=integral to membrane; Biological process=fatty acid biosynthetic process
  Homolog annotation: Hit_ID=UPI00005F7051; Match level="QueryCoverage =99%, HitCoverage=100%, E-value=1e-145, Identity=75%"; Hit description=COG0604: NADPH:quinone reductase and related Zn -dependent oxidoreductases
  Pfam annotation: Domain name=ADH_N; Domain location=28-112; Score =39.5; E_value=1.2e-08; Accession=PF08240.2; Description=Alcohol dehydrogenase GroES-like domain
  Pfam annotation: Domain name=ADH_zinc_N; Domain location=146-294; Score=31.9; E_value=2.2e-06; Accession=PF00107.16; Description=Zinc -binding dehydrogenase
  Pfam module annotation: Pfam domain module=ADH_N::ADH_zinc_N; Domain location=28-112::146-294
MSIKAIAVDPQNPAGFIEISPEMPVPGQYDLLVAVKAASVNPVDTKVHAGLQKSGLQQPRILGWDASGVVVDVGSGVSGFKPGDEVWYAGDITRPGSNSSHQLIDSRIAAHKPRSLNWAESAALPLTALTAWEALFEHLNIQDAPEHKTLLIIGGAGGVGSLAIPLAALRSKVKVIATASRPESAAWCRERGADLVVDYRDLKGELAQHGIEQVDYILCLNDTDGHWPAMAELVAPLGHICTIVENAQPLDQNALKLKSAALHWEFMFTRSMFTTPDIAQQGRILQQVAQLLDEGKLSTTLSETLHGLSVETLTAVHQRLLGGHMQGKLVIAY

SEQ ID NO: 148967 - protein, 418 aa, Glycine max
  Coding DNA Sequence Number=SeqID_32189
  Gene Ontology: Mol. function=transcription factor activity; Cellular component=membrane; Biological process=regulation of transcription, DNA-dependent
  Homolog annotation: Hit_ID=P0A9W3; Match level="QueryCoverage=47%, HitCoverage=72%, E-value=1e-104, Identity=76%"; Hit description=ABC transporter ATP-binding protein yjjK
  Pfam annotation: Domain name=LysR_substrate; Domain location=15-218; Score=164.9; E_value=2e-46; Accession=PF03466.10; Description=LysR substrate binding domain
MSAAERADLALQRLRDNPSGRLRISTPAGLGATLVARLAADFQRQYPDVSLEVSVSDAMVDLVQEGFDAALRTGKPQDSSLIGRRLGYAPRYLLAAPSYLAQHPPIEHPQQLQQHRCIAHRAWTAWNLRCGDDYYRWQLPLAHTTDNLLYARECAIAGAGITLLPAFLSREVVAQKLLVEVLPAWRAEGNELYLVYPSRKLNSPALACFIDVAPHAAPWVLLGDLLVLDAVRLERIGAQRTLLVLFVLGEVAFEEFHFAFILVVQDVGGDTVEEPTVVRDHHGAAREFQQGVFQRAQGFDIQVVGRFIEQQHVAANLQQLGQVQTATLTAGQLAHAFALIDALEVEAADIGAARHLGVADAHDVLPAGDFFPHGFRTVHAVAELIDGRQLDGVAQHDAAGIRLFLAGHHAEQRGFTRA

SEQ ID NO: 148968 - protein, 317 aa, Glycine max
  Coding DNA Sequence Number=SeqID_32190
  Gene Ontology: Cellular component=integral to membrane
  Homolog annotation: Hit_ID=Q7MBA5; Match level="QueryCoverage=99%, HitCoverage=65%, E-value=2e-77, Identity=45%"; Hit description =Similar to unknown protein. Putative transmembrane protein
MAKYSTFAFVYFAALSTLFVPQIRRCYRQPQFYLAVAIWLALVLPNLFWLWNHDFAAFKWVDSQIKMQLNLDMLQSLLLVFYPSLALWVILRRSGAVLAWPAALPMRVLLWVYLLPLGIITFWFSFNVGGRLTEWLQPFFMLAPALLVGCVRQPPVRSLRAATIGLMCAALAVYLGYAAVMLGNVRNAGQKMVGIKAFSVGVERLWQERYGVSLRYVGGEYLSQWMTVYAGSRPQTITRWSNHTRPNIYNVNISYPQIAQHGVALFGRLGEDCAHSDFGGELAHWPKMRLDWQQTLTFRADPHADEQALCVGFVRPQ

SEQ ID NO: 148969 - protein, 471 aa, Glycine max
  Coding DNA Sequence Number=SeqID_32191
  Gene Ontology: Mol. function=transferase activity; Cellular component= nucleus; Biological process=flavonoid biosynthetic process
  Homolog annotation: Hit_ID=Q9MAP9; Match level="QueryCoverage=93%, HitCoverage=92%, E-value=1e-132, Identity=53%"; Hit description =Highly similar to YUP8H12R.39
  Pfam annotation: Domain name=Transferase; Domain location=10-458; Score=359.4; E_value=5.8e-105; Accession=PF02458.6; Description =Transferase family
MSFKVGEGEFIVSVSKEEVVVPEIPMHEHWLPLSNLDLLIPPMDVSVFFCYKKPLPEKYYCFGTMVGSLKNALAQALVYYYPFAGEMVANTMGEPELFCSNRGADFVEAVAEVELQCLNLYNPDDTVQGKFVPRKKHGLLAVQATELKCGSLVVACTFDHRIADAYSANMFLVSWAEIAQSNKPIISIQPSFARSLFIPRNPPSFHSSLHDLYVSISALPRPSDPKPGFQSEPLINRIYYVTGENLNLMQELASSNGVKRTKLESFSAFLWKMVAEAAAAKVKGKKNLVAKMGVVVDGRKRLSNGDKNKEAIMGSYFGNVVSIPYGGKPVEELMEKPLSWVAEKVHEFLEIGLTEEHFLGLVDWVEVHRPAPGLSRIYCGHGKEEGPSFVVSSGQRFPESKVDFGWGKPVFASYHFPWGGDSGYVMPMPSSTGNGDWLVYMHLLEAHLNFMEVRAPQIFWPFSRDYHFNRH

SEQ ID NO: 148970 - protein, 648 aa, Glycine max
  Coding DNA Sequence Number=SeqID_32192
  Homolog annotation: Hit_ID=Q9SSU8; Match level="QueryCoverage=44%, HitCoverage=86%, E-value=1e-119, Identity=66%"; Hit description =Phytoene synthase, chloroplast precursor
  Pfam annotation: Domain name=SQS_PSY; Domain location=408-637; Score =291.1; E_value=2.2e-84; Accession=PF00494.10; Description =Squalenephytoene synthase
  Pfam module annotation: Pfam domain module=RVT_2::SQS_PSY; Domain location=7-178::408-637
MGLQAQKLKYKLDGTMDIYNTQLVAKGYTQQVGIDFSDIFSLVAKLTSVRVLLAIVVVARNWCLQQLDVNNAFLNGDLFEEVYMDLPQGYKTTTSVLLVDVDDIILVCPSSSCIVEIQIKLQSMFKLKILGSLKYFLGIEIAKSSKGISDSQRKYTLSLLDDIRYLGSKPTQLPMDPNLKSTLTDGDLIPDPSLCRRFIVHKLSQYMKTPLTTHLAVVYHLLQYLKYALGQGLFFPAQNSIHLLAYADADYGSCLNTRKSTTRFYVFLGDALISWKSVKQASCTNSSGNCLVLEMSGVLLWVSSGPKENINSLVSFSCRSGGGGERTQKRFSGISFASGASAFSSAVAAETLRSSEERVYEVVLKQAALVKENKRGTKIALDLDKDVEGDFTNVDLLNAAYDRCGEVCAEYAKTFYLVWCRRTDELVDGPNASHITPGALDRWEQRLSDVFEGRPYDMYDAALSHTVSKYPVDIQPFKDMIEGMRMDLRKSRYDNFDELYLYCYYVAGTVGLMSVPVMGIAPEANASTESIYNAALALGIANQLTNILRDVGEDARRGRVYLPQDELALAGLSDEDIFSGRVTDKWRKFMKGQIKRARMFFDEAERGVADLNSASRAYVGKVKKLLSLPTAYGFSLLGPQKFAKMVRR

SEQ ID NO: 148971 - protein, 88 aa, Glycine max
  Coding DNA Sequence Number=SeqID_32193
MEKEGLGGGRRKRNYGEEGDEGLGKKKKKREMKWEPGANWERANSISLKLMCVVSLRGHPFFGGLSTTYFCLDMAMGRNEDGYCLPNP

SEQ ID NO: 148972 - protein, 520 aa, Glycine max
  Coding DNA Sequence Number=SeqID_32194
  Homolog annotation: Hit_ID=Q9FQD4; Match level="QueryCoverage=21%, HitCoverage=90%, E-value=3e-22, Identity=79%"; Hit description =Glutathione S-transferase GST 24
  Pfam annotation: Domain name=GST_C; Domain location=435-520; Score =26.0; E_value=0.00014; Accession=PF00043.15; Description=Glutathione S-transferase, C-terminal domain
  Subcellular localization annotation: CTP_CleavageSite=23; ConfidenceScore=5.01e-01
MGCFFACFRIRENRRTNTSHLITSSTRSTGVVVSRNRLSSLLSEEERDDSARIDGVGFQGDFQGLKDEAKFLKACGTLTGTPVEIRKASEKLKASPAPDKDSEHSRFHCWLPNTSVEKLQLDVQPFDPPTPINLCQKLGNSMDSFEHTPISFISKAQDTEEDSVDYMEKSWSGNLHTADRSERNAALVSALLATNTQRKNKSVRFESETDLATYGSSSDNRHMKENKSPNNQSAYKPSPYPTPLKLFDEMQTPGTVYPASLEELHTGRAQVRSQFVYPTNKPGDNVLRCKILKERDFNPEEDSSELSDLVEKAQNGTPTPEKGSKRFSNENDEIKSNLSSRISPVSTIEEHSPMSFKWWYDNGIPNSTTKYKEDQKVKWHATPFEERLDKALSEENFISQRIFQEKQTMVVKVYGPSCASTKRVLVCLVEKEIEFEDIPVDIFKVEQKNPEFLKLQVIEESEAKLVRVLNIYEERLSKTKYLAGDFFSLADMSHLPFLEYNVNKLEKAYLIKERKHVTAW

SEQ ID NO: 148973 - protein, 151 aa, Glycine max
  Coding DNA Sequence Number=SeqID_32195
MSCSCASSSRWTNVNEELEHLVVNMPKLTIEEHGEWKELAKMMQDVMAPPEALFHTANARDQVYLTEQKVSYSSLDVSSIMYYFLKDKGCTHLYLEDVAECRLVFNHWRKTLKIEVRWKHLCETLSLTRDMEMVFEFINPDVNRVLYWPCL

SEQ ID NO: 148974 - protein, 53 aa, Glycine max
  Coding DNA Sequence Number=SeqID_32196
MAIHFFFYSIEWMGDCAVYGRYLRPGRAPGFILSRCAVARRSPGSWAAPAVQP

SEQ ID NO: 148975 - protein, 377 aa, Glycine max
  Coding DNA Sequence Number=SeqID_32197
  Gene Ontology: Mol. function=signal transducer activity; Cellular component=membrane; Biological process=signal transduction
  Homolog annotation: Hit_ID=UPI00005F7056; Match level="QueryCoverage =54%, HitCoverage=47%, E-value=3e-71, Identity=65%"; Hit description =COG2199: FOG: GGDEF domain
MQLGDRRRRHPQAEDAIAAHRVRHVGDVVQRTDDADQHTARQHQSAQGVEHHAGDHADQAAQQETHQAAAVAAQPDLADLFAPVRNRQDDRFGQRPVRNHLLQTVQRAVGGMAPAGQHLAFIIQNARLQDLFVGGDQHQRLTRGGAVFKHHGGLDGIADGARDQVQVVVGIGAQRKQRHQRQKDAGGADGDQRQPKMHPLQHSAQRRARIAGAVSVQQPHSGGAYDIAAGTQRWAVERHTLGFNRTRGAQQDRIEQPFGILGGCGHAQADRIGFTRPAGVADDAYHHGRHGVRAFLIGIIGGARRPGQRQQHQQHDQQQATDIQTCVKEARHGAFCATHRYRGLIRHLHPPFRPDPPPAGRGLTRKSSARLKGQSFC

SEQ ID NO: 148976 - protein, 192 aa, Glycine max
  Coding DNA Sequence Number=SeqID_32198
  Gene Ontology: Mol. function=shikimate kinase activity
  Homolog annotation: Hit_ID=Q81HR9; Match level="QueryCoverage=60%, HitCoverage=67%, E-value=3e-07, Identity=32%"; Hit description=ATP -binding protein
  Pfam annotation: Domain name=CPT; Domain location=7-180; Score=-58.2; E_value=0.029; Accession=PF07931.3; Description=Chloramphenicol phosphotransferase-like
  Pfam annotation: Domain name=NACHT; Domain location=8-177; Score= -38.6; E_value=0.059; Accession=PF05729.3; Description=NACHT domain
  Pfam module annotation: Pfam domain module=CPT::NACHT; Domain location=7-180::8-177
MAKLESAVIIAMKGHPGSGKSTLAKSIASSLRIPLLDKDDVKDCTQPLLLTSPATLLNDLSYDAIWHIASTQLRLGLSVLLDSPLSRRAHLDRLLHLAASASARLLVIECRPGNHREWRRRLEARGGGGGGHKPGTWEELETLLEGYGGCTEYDVGDVPKLVVDTTANLPLEEMCSAALDFIFAHAAKPTLI

SEQ ID NO: 148977 - protein, 52 aa, Glycine max
  Coding DNA Sequence Number=SeqID_32199
MGLDHVKASFVFATHVLINFKRAKWESRIEAGKNFNVVCKHLLWHAKACAGD

SEQ ID NO: 148978 - protein, 448 aa, Glycine max
  Coding DNA Sequence Number=SeqID_32200
  Gene Ontology: Mol. function=ATP-dependent helicase activity; Cellular component=intracellular; Biological process=multicellular organismal development
  Homolog annotation: Hit_ID=Q5ZAP0; Match level="QueryCoverage=99%, HitCoverage=35%, E-value=1e-136, Identity=56%"; Hit description =Putative DEIH-box RNA/DNA helicase
  Pfam annotation: Domain name=DUF1605; Domain location=160-277; Score =65.4; E_value=1.8e-16; Accession=PF07717.6; Description=Domain of unknown function (DUF1605)
  Pfam annotation: Domain name=HA2; Domain location=28-123; Score=79.0; E_value=1.5e-20; Accession=PF04408.13; Description=Helicase associated domain (HA2)
  Pfam module annotation: Pfam domain module=DUF1605::HA2; Domain location=160-277::28-123
VKLLDPSCKVEEFLRKTLDPPVFESISNAILVLQDIGAFSNDEKLTHLGEKLGSLPVHPLICRMLFFAILMNCLDPALTLACASDYRDPFTLPMLPEEKKRASAAKSELASLYGGCSDQFAVLAAFECWNNAKKMGLEARFCSQYFVSSSAMNMLSGMRRQLQAELIRIGFIHEDVSGYSVNTHDPGVLHAVLVAGLYPRVGRFLTNKGGKRVIVETTSGDKVRLHNHSTNFKLSFKKNLDNTLIVYDEITRGDGGMNIRNCTVVGPLPLLLLSTEIAVAPAEENDEGDVDDAVGSEDEAGSEDGMEFDAESSGGREDKLMSSPDNMVKVIMDRWLYFRSTAIDVAQLYCLRERLSAAILYKVTHPRNTLPPIMAASVHAIACILSCDGCIGVSAMLEGVDTLTTMVNATSLGKPATGTRRFGKRPKGSLAELLNYDGRQNSGPHFKA

SEQ ID NO: 148979 - protein, 343 aa, Glycine max
  Coding DNA Sequence Number=SeqID_32201
  Gene Ontology: Mol. function=cytochrome-c oxidase activity; Cellular component=integral to membrane; Biological process=electron transport
  Homolog annotation: Hit_ID=Q75HA3; Match level="QueryCoverage=97%, HitCoverage=97%, E-value=6e-62, Identity=64%"; Hit description =Expressed protein
  Pfam annotation: Domain name=DUF887; Domain location=26-343; Score =321.2; E_value=1.8e-93; Accession=PF05967.2; Description=Eukaryotic protein of unknown function (DUF887)
MVKFKSYQNQANLFLKEYLLADPLIPYTSIIGGIFACKMVYDLTQLFSTVHFKSYSSLTRIQRVEWNNRSMSTIHAIFITTISLYLVFCSNLYSDNQLSELITFRSSSSSTFALGMLYVESESLDIPEVKFGGHPCLVMKARQTDLEENIGCQDLLKKEKQDNPMFYIVHLFNFKACCNCSSDLYTSLSNVSVGYFIADLGMIFWFFPSLGGYEYVIHHLLSLVAVSFSMLTGEGQLYTYMVLISETTTPGINLRWYLDAAGMKKSNAYLINGVVIFIAWLVARILLFVYMFYHVYLHFDQIEQMHVFGQMLVIVVPLALSVMNLIWFSKIIKGLRKTLAKRQ

SEQ ID NO: 148980 - protein, 295 aa, Glycine max
  Coding DNA Sequence Number=SeqID_32202
  Gene Ontology: Mol. function=ATP-dependent helicase activity; Cellular component=intracellular; Biological process=multicellular organismal development
  Homolog annotation: Hit_ID=Q5ZAP0; Match level="QueryCoverage=89%, HitCoverage=22%, E-value=6e-64, Identity=53%"; Hit description =Putative DEIH-box RNA/DNA helicase
  Pfam annotation: Domain name=R3H; Domain location=33-88; Score=46.9; E_value=6.8e-11; Accession=PF01424.13; Description=R3H domain
METTTKNKREKKKGEPLFRQNPNVDEVTRIRISQILEHFRASNDEVYKFDADLSNQERALVHQMALKMGFRSKSYGLGKERRVCVQKMKKKVDTDNGFGSLPQFTFSGEAKWVLGDLFAHYPPGDGNSWEMVGENSDTATDRTKQRPDDIFSRPSMTKAEIARRLEALTSRMNNVSNLKQIIEGRSKLPIVSYKDSITSTVESHQVVLISGETGCGKTTQVPQFILDHMWGKGEFPRELLVREERLLEKMWDISNDTVRKQRWKAIINCAMYYWSAIKGAGFQRFSFVKDWACEG

SEQ ID NO: 148981 - protein, 243 aa, Glycine max
  Coding DNA Sequence Number=SeqID_32203
  Gene Ontology: Cellular component=endoplasmic reticulum
  Homolog annotation: Hit_ID=Q8S2K0; Match level="QueryCoverage=81%, HitCoverage=82%, E-value=8e-33, Identity=37%"; Hit description =Putative 24 kDa seed maturation protein
  Pfam annotation: Domain name=Reticulon; Domain location=59-240; Score= 147.0; E_value=4.9e-41; Accession=PF02453.8; Description=Reticulon
MSEKITAENLLNTLVETLTEKQKSGSFFEEDKSSSVSYQFNRLFGRQKPVHHILGGGKSADVLLWRNKKISASVLSAATAIWLKPALFSVGDRKPSKVPRFVLPDDIFVNIATVVGAEVNRGLRFLQDVSCGGSLKQFLIELAPRKGVGRLVGGGVGETDIQQEVVVSLWAGAVIGSWCNFLTVMYIGFVAAHTLPVLYERYEDQVDNFVYKVFDQMQNHYQKLDTGLLSKIPKGKLKGKKYE

SEQ ID NO: 148982 - protein, 648 aa, Glycine max
  Coding DNA Sequence Number=SeqID_32204
  Gene Ontology: Mol. function=molecular_function; Cellular component =cytoskeleton; Biological process=transport
  Homolog annotation: Hit_ID=Q9FNN2; Match level="QueryCoverage=87%, HitCoverage=99%, E-value=0.0, Identity=58%"; Hit description=WD -repeat protein-like
  Pfam annotation: Domain name=WD40; Domain location=329-367; Score =36.5; E_value=9.2e-08; Accession=PF00400.22; Description=WD domain, G-beta repeat
  Pfam annotation: Domain name=WD40; Domain location=374-412; Score =37.0; E_value=6.6e-08; Accession=PF00400.22; Description=WD domain, G-beta repeat
  Pfam annotation: Domain name=WD40; Domain location=416-454; Score =24.8; E_value=0.00031; Accession=PF00400.22; Description=WD domain, G-beta repeat
  Pfam annotation: Domain name=WD40; Domain location=498-536; Score =2.8; E_value=17; Accession=PF00400.22; Description=WD domain, G-beta repeat
  Pfam annotation: Domain name=WD40; Domain location=541-582; Score =13.8; E_value=0.61; Accession=PF00400.22; Description=WD domain, G -beta repeat
  Pfam annotation: Domain name=WD40; Domain location=586-625; Score =55.7; E_value=1.5e-13; Accession=PF00400.22; Description=WD domain, G-beta repeat
  Pfam annotation: Domain name=eIF2A; Domain location=287-471; Score= -101.1; E_value=0.1; Accession=PF08662.1; Description=Eukaryotic translation initiation fact
  Pfam module annotation: Pfam domain module=WD40::WD40::WD40::WD40::WD4 0::WD40::eIF2A; Domain location=329-367::374-412::416-454::498 -536::541-582::586-625::287-471
MERELGRETRDDLRNKQAQVEKEKVWDLERVWFWLVTEECVEAEEEGRRNRRCSTDDRISKLGSDHSFACSGTLFMGGVEDEEPSMKRMKLSSKGLVGLSNGSSKEPVRGLSSDLMAQPLLSKEDEHVVGSKGVIKKEEFVRIIAKALYSLGYGKSGAHLEEESGIPLQSPGVNLFRQQILDGNWDDSVATLYKIGLADESMVRSASFLILEQKFFELLNGEKVMEALKTLRTEIAPLCINNSRIRELSSCLVSPSPRLDILRVRSRSKLLEELQKLLPPTVMIPEKRLEHLVEQALILQHEACPFHNSLDKEMSLYSDHHCGKDQIPSSTLQILEAHDDEVWFVQFSHNGKYLASASNDRTAIIWVVGINGRLTVKHRLSGHQKPVSSVSWSPNDQEILTCGVDEAIRRWDVSTGKCLQIYEKAGAGLVSCSWFPCGKYILCGLSDKSICMWELDGKEVESWKGQKTLKISDLEITDDGEEILSICKANVVLLFNRETKDERFIEEYETITSFSLSKDNKFLLVNLLNQEIHLWNIEGDPKLVGKYKGHKRARFIIRSCFGGLKQAFIASGSEDSQVYIWHRSSGELIEALTGHSGSVNCVSWNPANPHMLASASDDRTIRVWGLNCMHNKYQNVHSNGIHYCNGGT

SEQ ID NO: 148983 - protein, 594 aa, Glycine max
  Coding DNA Sequence Number=SeqID_32205
MTSLDSYEEISYGESEIGPNAASVCSQFEGEKSWWMMAEADRRVVAEADQKPATMGAGDVGTNNREGGDRGLSTIGGGQTNTLTSINQATMVQDSFLEGPTKTHGLAHEESWINVSGSFSMGKECSATISKRRADNDNSIQKERGEDALPFSEGGVQLPYSGKDITSKHAPLVEDVAVQDNMEELNLGPKCNGPQSTWKVCMRTRKHKRGNGSGVVEGKETYEDTSLHKDMGRADAGLTNVLRPASPNLEGGSGLKEVATWDANMKRAYNEGSTSSSIYKSLRSCDAMMDAAYTWELAKNMGVSCGKDENGVLTRMVGLDGRDKYEFEKLGKRKVEMLCLQETKKEMLDRTMCQALWGNSEVKWAANPAVNSAGGILCIWSESSFELEKEETVKTSGGWPKRTRWGIMTEFNDWMPDLEVEDEPSVGHKFTWNYSDHYPILLKSIIADRGPKPFKTLDCWFQDKSFKKTVRDCWRECLVQGWGGHKLKRAEQKLNELKKKGEERDLTEEEIRLRKELQEEVWVTTHSKESFEAKSKNKVEPNKVREEETILYEKDEVRATVWECGSFKSPRHDGLNFKFIKEFWDVMKMDVLRF

SEQ ID NO: 148984 - protein, 300 aa, Glycine max
  Coding DNA Sequence Number=SeqID_32206
MVRRTWWSSGRETEGKIRDASNITSFYFTCFPKDTQEKDLWLVFKKWGNVREVFIATGTAAVESMVLSDSKSDNLIVAGLKLHVNLPKHGREDKKHLWKRESDRATSGGRDKCKVAQVQPHSQPNKGQQKTLDMEDVGTSTKQVVGSEADQDRRDCTGKAPFATVVANGGKHASWRGQPRTFTFDKLEEELMWGGGEETKPKYLGGDIVLLLGLDHVKAEDLCKEGVQSGLSMFHSLQKWSPKMCTGFRLVWIMCWGIPIHAWDMESIKKIAKSVDVVKIDEEVEDLQRLDRARVLVKTP

SEQ ID NO: 148985 - protein, 379 aa, Glycine max
  Coding DNA Sequence Number=SeqID_32207
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=96%, HitCoverage=28%, E-value=1e-146, Identity=75%"; Hit description =Similarity to kinesin heavy chain
  Subcellular localization annotation: CTP_CleavageSite=52; ConfidenceScore=5.48e-01
MPYFQLSSPLARGSANVQPRDIGRNGTNNNTSSRSMGVLPSPLATDKNDGTVALVKTGSEIVKTTPAGEYLTAALNDFDPDQYEGHAAISDGANKLLMLVLAAVIKAGASREHEILAEIKDSVFSFIRKMEPKRVMDTMLVSRVRILYIRSLLARSPELQSIKVLPVECFLEKTNTGRSRSSSRGSSPGRSPVLYVDEQIQGFKVNLKPEKKSKFSSVVLKIRGIDEQVTGGKLREITEEAKSFAIGNRALAALFVHTPAGELQRQIRSWLAENFEFLSLTGEDASGGSTGQLELLSTAIMDGWMAGLGAALPPHTDALGQLFFEYSKRVYTSQLQHLKDIAGTLATEEAEDAAQVAKLRSALESVDHKRRKFCHCIGY

SEQ ID NO: 148986 - protein, 166 aa, Glycine max
  Coding DNA Sequence Number=SeqID_32208
MVWEPKAIYIQEDRNLITLAWDELLGILRVLEVHLQKRDHLPKKDSTALKFGETSYKIKENKSSFKALRVKMVEFDGSDNNFGGSTNDEMDLMSEKFKQMLEMKGKFQHFSKTKDTRFIKKYKEETNKIICFEYSEKSSSSNDEQVNIYLMANTNENVEISLEGKD

SEQ ID NO: 148987 - protein, 258 aa, Glycine max
  Coding DNA Sequence Number=SeqID_32209
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=85%, HitCoverage=17%, E-value=4e-75, Identity=66%"; Hit description =Similarity to kinesin heavy chain
  Subcellular localization annotation: CTP_CleavageSite=28; ConfidenceScore=5.20e-01
GSSKALMIVNVCPSISNLSETLSSLNFSARARNSTLSLGNRDTIKKWRDVANDARKELNEKEKEIHDLKQEGLKLKQALKDANDQCILLFNEVQKAWKVSSVLQTDLKSEHVLLSDKHKIEKEQNNQLRNQVAQLLRLEQDQKLQIQEQDSTIQSLQAKIRTLETQFNEAIKSSESRSTFVYETESADQSNSGPTGDGIDSSAVTKKLDEELKKRDALIEQFFSYKALLAISLYILKMQNGIHAGTWYEWTIVFDSNN

SEQ ID NO: 148988 - protein, 72 aa, Glycine max
  Coding DNA Sequence Number=SeqID_32210
MEGREGFNSGVTVIGAEAPSAYHMAPRSEAPSQVPPPVPEATAGAIGVSPVSVELDGTTAKKKSDSILAREC

SEQ ID NO: 148989 - protein, 203 aa, Glycine max
  Coding DNA Sequence Number=SeqID_32211
  Gene Ontology: Mol. function=zinc ion binding; Cellular component =membrane; Biological process=proton transport
  Homolog annotation: Hit_ID=Q9SVI4; Match level="QueryCoverage=53%, HitCoverage=43%, E-value=1e-36, Identity=65%"; Hit description=ES43 like protein
  Pfam annotation: Domain name=BAH; Domain location=4-116; Score=65.1; E_value=2.3e-16; Accession=PF01426.8; Description=BAH domain
MFLSWLCGLQHDLNLRQTSYVTRIEWIKADARNTNMKIDVRWYYRSEESIGGHRQFHGSKEVFLSYHFDVQSADTVEARCTVHSSKSYTKLNAIENDDFFYRFEYNSFTGAFNPDRVAIWKMIYYGDDWGGLFEAITGYGLGGSSMALFGRVVDGGIYTKVADVGVDLVRKVERNIPEDDPRNLAIRNIILKLGPLIWFLNIL

SEQ ID NO: 148990 - protein, 49 aa, Glycine max
  Coding DNA Sequence Number=SeqID_32212
MEEENERERGMEIEGEYAEKLNFEVTNTSGTSLRSKEGSFLGKQGRKLP

SEQ ID NO: 148991 - protein, 308 aa, Glycine max
  Coding DNA Sequence Number=SeqID_32213
  Homolog annotation: Hit_ID=O21999; Match level="QueryCoverage=27%, HitCoverage=58%, E-value=2e-21, Identity=62%"; Hit description=LacZ -alpha
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIVERVDHRSHQRQGIEQEATVHMGPSATAMERRAEHQAMREGRAYEPVTMVGQHNAGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148992 - protein, 131 aa, Glycine max
  Coding DNA Sequence Number=SeqID_32214
MSNNSTPIPIESQQPQTDQAHISQTMGETQEIPHHNLADFEPWLGYATEGQAVGGIPFENTLEGPQFLPQPQPLHFAVGRAPPAMAEKGKADHLKERLRAIKGGEDYAFANLEKLFLIPKHGHSQVQGAGL

SEQ ID NO: 148993 - protein, 70 aa, Glycine max
  Coding DNA Sequence Number=SeqID_32215
  Subcellular localization annotation: CTP_CleavageSite=49; ConfidenceScore=5.51e-01
MGPKSTLRLMRTLGSSLASLAQSSCSLLSNTLGGLVFLESNLGSILFTSSSARTSWPTGHPDRPGPFYQL

SEQ ID NO: 148994 - protein, 134 aa, Glycine max
  Coding DNA Sequence Number=SeqID_32216
MKDKRDEEEKLKKQKKKKDSKALSSKAKGKEKEGKDSSKKIVKKENHFATKGDIKIALLLKQSFYLLLSRETSLSTAIPLELEVIPRVKELLDEGLVRDKAIWYVLSQEEKNKSAYNCMSSLSLKKETLEEYSM

SEQ ID NO: 148995 - protein, 390 aa, Glycine max
  Coding DNA Sequence Number=SeqID_32217
  Gene Ontology: Mol. function=X-Pro dipeptidase activity
  Homolog annotation: Hit_ID=Q6ZJC5; Match level="QueryCoverage=48%, HitCoverage=74%, E-value=1e-73, Identity=69%"; Hit description =Thymidylate synthase-like
  Pfam annotation: Domain name=UPF0029; Domain location=54-156; Score =202.7; E_value=8.4e-58; Accession=PF01205.10; Description =Uncharacterized protein family UPF0029
  Subcellular localization annotation: CTP_CleavageSite=29; ConfidenceScore=5.06e-01
MPVAVTIPSYQHRIYASLIYIAKAKKTTMASTSSSNPGGAFTTLQERVTFEKEIKKSKFIAIAGPIPDEKSAMSFLSQVRDPRATHNCWAYKVGDQYRSNDDGEPSGTAGKPIQTAIDSSGIDRVMVVVIRYFGGIKLGTGGLVRAYGGVASECLRNAPTCLVKTKVPMGVEVPFELVGVLNHQSFHVEDIKQDYDTGKDGISMVTFKVDFDQAEKLEDAIKANCSRELHLENGGNGIRKFWFKEAVEKQVGLGNDTLFWKNQWVEGGSDCDTWRWMIDPSGGYTVNSAFKNLMETNCTSIEGGWKLLWNTLEFYNLYNVFASAARRWRNLSIICFLSADTSVVDCGKPVFSGWECSMSYTIRPSNMVCHDVGNLEMQKCNGLYRKTDQH

SEQ ID NO: 148996 - protein, 277 aa, Glycine max
  Coding DNA Sequence Number=SeqID_32218
  Gene Ontology: Mol. function=nucleic acid binding; Biological process= DNA integration
  Homolog annotation: Hit_ID=Q1SVD1; Match level="QueryCoverage=61%, HitCoverage=17%, E-value=2e-10, Identity=28%"; Hit description=Zinc finger, CCHC-type
  Pfam annotation: Domain name=zf-CCHC; Domain location=192-209; Score =15.3; E_value=0.003; Accession=PF00098.13; Description=Zinc knuckle
MDGGTRTQISAKLQGLECDVVCSFRRRIHQGAQLHKCQTNVGHSGYNILKNIIGKEEQAQSPHSKWRMYVTTLRVLKNLDSMSFEELVNTLKVHEQELQQDNGSKREKSLALSSQKNKKASSTREQVLRSSSKVHKVDDSSDNEYEEDSDEDELTFISRNIHKTWRNKGGSKWKNSSRRMSKERKDKDKNFIICYEYKKLGHFKFECSKLEKSQDKKKFFKIREKKGLGSSSSMESFASLISMVAEWRRKKDDWRHHFKEKMSQEEAHHHRKPWIRA

SEQ ID NO: 148997 - protein, 260 aa, Glycine max
  Coding DNA Sequence Number=SeqID_32219
  Gene Ontology: Mol. function=heat shock protein binding; Cellular component=integral to membrane; Biological process=protein folding
  Homolog annotation: Hit_ID=Q9ZU99; Match level="QueryCoverage=65%, HitCoverage=59%, E-value=1e-27, Identity=36%"; Hit description =Expressed protein
  Pfam annotation: Domain name=DnaJ; Domain location=76-139; Score =27.6; E_value=9.2e-06; Accession=PF00226.21; Description=DnaJ domain
MKQDTDNNGTLGGSEDSLLRSCLSLLTRRSFTACRESANQISRSDPTVSLHLDQILAVADVLTAAESRRGPSHPHDWYSVLRLHPGGADNRDLARQHFKTLVRLLDPNKNKLPFADEALMRVREAWCVISDPTRKARFDKEIEESARTASFWTMCPYCWYLHEYERKYEDCTLRCSNCQRTFHGAAVPPPPLEAVVAGKEEYYCYHMSLPVRYPVGERCRFGGEGNGARKRMRVKTVANRMKMKRFVDANNGESDNDGVR

SEQ ID NO: 148998 - protein, 174 aa, Glycine max
  Coding DNA Sequence Number=SeqID_32220
  Gene Ontology: Mol. function=nucleic acid binding
  Homolog annotation: Hit_ID=Q1SLA4; Match level="QueryCoverage=52%, HitCoverage=25%, E-value=3e-14, Identity=34%"; Hit description=Zinc finger, CCHC-type; Lipocalin
MGGAGLGNEPLNDGGGGFEGLCVPWQYALAVKLLGKWIGYKCFDMIDIDNDYFMVKFDLEGDRVNVMEGVPWMNFDHYPTYTLGFGNCIGRPIRVDSNTLDACKGRYAMWMLWAFVKGCKVSVQSPMEESSKLDQNSTVVQISPNQTALANSSMSMNANDSNIGVMDTIITINS

SEQ ID NO: 148999 - protein, 173 aa, Glycine max
  Coding DNA Sequence Number=SeqID_32221
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=74%, HitCoverage=17%, E-value=1e-72, Identity=98%"; Hit description =Photosystem I P700 chlorophyll a apoprotein A1
QAIRQGDSEVAESWFNQAAEYWKQAIALTPGLFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGG

SEQ ID NO: 149000 - protein, 172 aa, Glycine max
  Coding DNA Sequence Number=SeqID_32222
MSFESPHQEMNIPSMEITPIHIEHFFDINELDKVGLKLYETLLLCSARNLGGMDDIYYPAFMNKMLWDQGVYRVFDKLDDDLKHNLKIKGSMVAKQQSFSKTNLKAMKVVMEEQKLIPQVDVEAIKQRKQKRLTKAIANKDKGLNSFGITKKIQNIMKEKQQRKKTKRQSRH

SEQ ID NO: 149001 - protein, 243 aa, Glycine max
  Coding DNA Sequence Number=SeqID_32223
  Gene Ontology: Mol. function=mismatched DNA binding; Cellular component=mitochondrion; Biological process=response to DNA damage stimulus
  Homolog annotation: Hit_ID=Q6D8C1; Match level="QueryCoverage=99%, HitCoverage=28%, E-value=1e-116, Identity=86%"; Hit description=DNA mismatch repair protein mutS
  Pfam annotation: Domain name=MutS_I; Domain location=13-125; Score =253.4; E_value=4.8e-73; Accession=PF01624.10; Description=MutS domain I
  Pfam annotation: Domain name=MutS_II; Domain location=133-243; Score =107.8; E_value=3.1e-29; Accession=PF05188.8; Description=MutS domain II
  Pfam module annotation: Pfam domain module=MutS_I::MutS_II; Domain location=13-125::133-243
MKESTDKDFSTHTPMMQQYLRLKADHPDILLFYRMGDFYELFYDDARRASQLLEISLTKRGASAGEPIPMAGVPYHAVEGYLAKLVQLGESVAICEQIGDPALSKGPVERKVVRIVTPGTISDEALLQERQDNLLAAIFQSQRGFGYATLDISSGRFRLSEPGDVETMAAELQRTNPAELLYPEDLQAMTLIDQRRGLRRRPLWEFEIDTARQQLNLQFGTRDLSGFGVEQAHLALRAAGCLL

SEQ ID NO: 149002 - protein, 148 aa, Glycine max
  Coding DNA Sequence Number=SeqID_32224
MGQLQRQAFRKAYGIRPPKASRKWGGRNTEKIFGAIDVFLAYHNHKESPVVAMLADLYDTFDRRCEESNARIVCCTPALYVGLVSHLFLQEGRLVYPLQGYRSCVEKGKANWDQLLASMGGRLLIGSLARRKEESRFYLHAKDVQMFP

SEQ ID NO: 149003 - protein, 63 aa, Glycine max
  Coding DNA Sequence Number=SeqID_32225
  Homolog annotation: Hit_ID=UPI00005F6C65; Match level="QueryCoverage =96%, HitCoverage=40%, E-value=2e-18, Identity=73%"; Hit description =COG3518: Uncharacterized protein conserved in bacteria
MAKENPAFRHKFRAIAYQTNFLQFRVDGITQFARLCLFEHLHTEAVQPRFVFEQYRGQRGHLL

SEQ ID NO: 149004 - protein, 203 aa, Glycine max
  Coding DNA Sequence Number=SeqID_32226
  Gene Ontology: Cellular component=integral to membrane
  Homolog annotation: Hit_ID=UPI00005F87B0; Match level="QueryCoverage =89%, HitCoverage=38%, E-value=6e-44, Identity=49%"; Hit description =COG3515: Uncharacterized protein conserved in bacteria
  Pfam annotation: Domain name=ImpA-rel_N; Domain location=40-101; Score=70.4; E_value=5.8e-18; Accession=PF06812.2; Description=ImpA -related N-terminal
MTTYPKRHLTTGGDPRTLADYAKLREEMHKLSHPARPDVDWLYAERLCLSLFDRNGVELQTAAWYTLARTQLTGLCGLNEGLAILETLITRQWGSLWPQPVHARMEILSGLGKRLQQALRTLTLTYADLSLIYEAEAHLKALDAALQRLELKHASQFDALLNLMHNAAVRLENSDGVTSVDTLPHVVAMENASTYLDERVERT

SEQ ID NO: 149005 - protein, 355 aa, Glycine max
  Coding DNA Sequence Number=SeqID_32227
  Gene Ontology: Mol. function=RNA-directed DNA polymerase activity; Biological process=RNA-dependent DNA replication
  Subcellular localization annotation: CTP_CleavageSite=20; ConfidenceScore=5.39e-01
MDRLTTMMNALLSAQNSQAAAAAVEQPLVSTTPLSTVTSPPLFLPPGCTWGMPPPVCGSPQPAVSEVPLPFAQQSAPVPQPGTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIIPPLEEREMTKIFLKTLSQFYYEKMVASAPTDFTEMVNMGVRLEEGVREGRLTGESTPAASNAKKFGGHFAKKKDQEVGMVAH

SEQ ID NO: 149006 - protein, 120 aa, Glycine max
  Coding DNA Sequence Number=SeqID_32228
  Gene Ontology: Mol. function=DNA binding; Cellular component =intracellular; Biological process=DNA integration
MCDASDYAVGAVLGQRKSRIFHTIYYASKVLNDAKINYATLEKELLAIVYALEKFRSYLVGSKIGSENVVADQLSRLVNEEVTLKEAGIKDEFPDESLFLIAETPWFADLANFKAAGIIP

SEQ ID NO: 149007 - protein, 75 aa, Glycine max
  Coding DNA Sequence Number=SeqID_32229
MTWKYDLLIDVGNALAYACCVCSWGALCTDLSGSLALAFGHVHTLDVVYDRGGALCTDLPGSLALAFGHDHMSYE

SEQ ID NO: 149008 - protein, 117 aa, Glycine max
  Coding DNA Sequence Number=SeqID_32230
GLRLQDTQWTRRSPTGSWSCQALITGLCQFYGVSVAPSKVIRPPYQSSFHQEVLRPQAGAGRNTTAALGWPVVGNRHTATTSSAKRLERCLRHMADQQATKSKAKGKQSTRSVTDKS

SEQ ID NO: 149009 - protein, 103 aa, Glycine max
  Coding DNA Sequence Number=SeqID_32231
  Subcellular localization annotation: CTP_CleavageSite=74; ConfidenceScore=5.29e-01
MWTRCPLKARACSPLKFRTCRPLKARACSPLKVRMRSPLEVRSFNLLMVKAYSPLKARKCMPLKGRMYSPLKVRACSPWKVRTSNPLKARACSPLKRGRVVSE

SEQ ID NO: 149010 - protein, 86 aa, Glycine max
  Coding DNA Sequence Number=SeqID_32232
MAQGLCCYLSLKEMKQATNNFDEPNVIGVGGFGKVYKGVIDNGFKVAIKRSNPQSRRHQLTKKSDVYSFGVVLSEALYLRKVALDT

SEQ ID NO: 149011 - protein, 85 aa, Glycine max
  Coding DNA Sequence Number=SeqID_32233
MSGFGQRFGDKGDVPHYFHDTQATMMIKKFYAKLVMHAPMWTLKHQGRSLPPSSPRRAQLAQASKVALSRSNNLLEEESGRPKWA

SEQ ID NO: 149012 - protein, 195 aa, Glycine max
  Coding DNA Sequence Number=SeqID_32234
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=5e-20, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDVLALRRLHVLALRGLHILAFRGLHVLDFRGLHVITLRGLHALAFRGLHVLGFRGLHVLAFRGLHALTVSGLHILAFRGLHVLTVKGLHTPAFRGLHVLAFRRLHVLAFRGLVALVVLDFIGLHILAFRGLHVLALRGLHVLAFRGLYVLTFRGLHVFAFRELKFLGHPLDLGGGPTMRAQPEKEAIAQLLCIP

SEQ ID NO: 149013 - protein, 130 aa, Glycine max
  Coding DNA Sequence Number=SeqID_32235
  Gene Ontology: Mol. function=polyamine-transporting ATPase activity; Cellular component=membrane; Biological process=polyamine transport
  Homolog annotation: Hit_ID=Q87PH3; Match level="QueryCoverage=40%, HitCoverage=14%, E-value=2e-16, Identity=67%"; Hit description =Spermidine/putrescine ABC transporter, ATP-binding protein
MAMLGGRFSDVALIQMDTSAVGVFQPGDQAQNRGLTAAGGAKQGDKFAMTDGQHSRRRQLAVMKGAIIPEKCAIAMFRHGITLKSLQIAGVCSSGQPDGWLAGRISAHDWAERANLKDNDLTQHGDNQAP

SEQ ID NO: 149014 - protein, 147 aa, Glycine max
  Coding DNA Sequence Number=SeqID_32236
SLQVVAPPRTILIVEQFMEKVAWPGTQPSLVREGGGPSAQVPQQVHNASSEATIPVPFVFKVGGTQVRKEAATPERSPQISPDLPLPMVDQSSPQQLADPPTPVHEMPVDPSTPLLKIPKDPATPVLGLTTTPPATLVLHFTDEEGT

SEQ ID NO: 149015 - protein, 62 aa, Glycine max
  Coding DNA Sequence Number=SeqID_32237
  Subcellular localization annotation: CTP_CleavageSite=39; ConfidenceScore=5.01e-01
MVSRTSVATVKFPKTLDRGVNSNLSLGPSGTFWKLGCLRRKQLGGKLLHIFEKWFPGLPWLP

SEQ ID NO: 149016 - protein, 224 aa, Glycine max
  Coding DNA Sequence Number=SeqID_32238
  Gene Ontology: Mol. function=transferase activity, transferring phosphorus-containing groups; Cellular component=integral to membrane; Biological process=two-component signal transduction system (phosphorelay)
  Homolog annotation: Hit_ID=UPI00005F916C; Match level="QueryCoverage =82%, HitCoverage=44%, E-value=9e-67, Identity=62%"; Hit description =COG0642: Signal transduction histidine kinase
RHAGGEIARRQAVGARHQTLDRGQHAARQQPGHRRRQQGGERDDNPTGAPLLAIEVDVGIARQALDRGGEHPADDLVVVADRVARPLFRQGARMPDQTIELAVHHPKLGAPALGRQIVAAVAVLLERAHDLRFAQHVDALLVAALDVIDKAALKADAHPPMHGDQHQHAGSENGQEQFPGNAYPHCNLVEPVPGSLVSVRLGALSAGTRAKASAGRAIINAIQQ

SEQ ID NO: 149017 - protein, 249 aa, Glycine max
  Coding DNA Sequence Number=SeqID_32239
VEVDLETPRGSVNVDVLATDVRSVDKIRYIVECKNWGSSIPQTVVHSFTTVMHETGANIGFIISKHGLQQGAKKYTQNTNIIGMTYLEFQQRYFEAWWNRYFCPRIGDAADEPLQYVEPVNYKRDREYAKLNLREQEKFDRLRQEKGVSVMALSMLNYRFMSKALNTGNLLNVPKSLDDFKTRVLTQICPHMEWHCDTYRELLEIILEYLSDTKAEFDAIFGGTIFEPLGTITGVTAAGPSLDDGIYHN

SEQ ID NO: 149018 - protein, 222 aa, Glycine max
  Coding DNA Sequence Number=SeqID_32240
  Gene Ontology: Mol. function=nucleotidyltransferase activity; Biological process=DNA modification
  Homolog annotation: Hit_ID=UPI00005F74CD; Match level="QueryCoverage =98%, HitCoverage=28%, E-value=8e-94, Identity=75%"; Hit description =COG3378: Predicted ATPase
  Pfam annotation: Domain name=Pox_D5; Domain location=119-218; Score =76.9; E_value=6.2e-20; Accession=PF03288.6; Description=Poxvirus D5 protein-like
EKWSGDGAGIKAITGGDAVAIDPKYRDAYSTHIPAVILAANNNPMRFSDRSGGVSRRRVILTFPEVIPAKERDPHLLDKISTELAVIVRHLMQRFASPDEARELLQAQQSSGEALEIKRQADPLVDFCGYLMPLSTPNGLFIGNANIRPMNPKRYLYHAYLSFMESRGHQHPLSLTAFGQAVPQTLKEYEPTLLKRRTNNGIQTNLMLHEDSEADWLPTCSD

SEQ ID NO: 149019 - protein, 727 aa, Glycine max
  Coding DNA Sequence Number=SeqID_32241
  Gene Ontology: Mol. function=hydrolase activity; Cellular component =chromosome; Biological process=DNA metabolic process
  Homolog annotation: Hit_ID=Q6D8Y1; Match level="QueryCoverage=68%, HitCoverage=94%, E-value=0.0, Identity=69%"; Hit description=DNA repair protein
  Pfam annotation: Domain name=NAD_kinase; Domain location=7-266; Score= 279.3; E_value=7.5e-81; Accession=PF01513.11; Description=ATP-NAD kinase
  Pfam annotation: Domain name=SMC_N; Domain location=228-719; Score= -64.7; E_value=6.4e-07; Accession=PF02463.9; Description=RecFRecNSMC N terminal domain
  Pfam module annotation: Pfam domain module=NAD_kinase::SMC_N; Domain location=7-266::228-719
MNKHFNCIGIVGHPRHPTALTTHEMLWRWLTDKGYDVIVEQQIARELNLQDVRTGSLADIGQYADLAVVVGGDGNMLGAARVLARYDIKVIGINRGNLGFLTDLDPDNAQQQLDDVLQGDYFVESRFLLEAQVCKEECSPRIGSAINEVVLHPGKVAHMIEFEVYIDEVFAFSQRSDGLIISTPTGSTAYSLSAGGPILTPSLDAIALVPMFPHTLSARPLVINSDCMLAQLTISNFAIVRELEIDFHRGMTAITGETGAGKSIAIDALGLCLGGRAEADMVRQGASRADICARFQLKASPSAQRWLVENQLDDGNECLLRRVISADGRSRGFINGTSVPLSQLRELGQLLIQIHGQHAHQLLLKTDHQKHLLDAYAAHDDRLAEMRQHYQRWHHSCRALAQHQQLSQEREARRELLQYQLKELNEFAPQPGEFEQIDEEYKRLANSGQLLSTSQQALQILADSDDTNLQSLLYSARNMLSELVSLDDKVSGVFNLLEEAAIQLSEASDELRHYCERLDLDPNRLYELEQRLSRQIALARKHHVSPEALPVLYQQLLDEAEQLSQQESDQESLQSDVVAHHQAALACAEALHQQRVTSAQELSQLITQSMRTLAMPHGEFAIVLEFNADQLTAEGASRIDFRVTTNPGQPLQPLGKVASGGELSRIALAIQRSDGRCCWPDAAPVGRIDSGNVRNSPAAGGGLWSSALLRQQRDRRCDDRNPHAAAG

SEQ ID NO: 149020 - protein, 175 aa, Glycine max
  Coding DNA Sequence Number=SeqID_32242
MEVMLSMKKIMESNTAAVATTSAATEVDPTHPSSLNQVNPPISDMVGQGEEALGSTGSPHVMQSKNSFPPYGLPPNYTPPNVAHALDENVNNSTPMLIESQQPQSVPRDHTLADSEPCLGYATKGQAVPPAMVERERFDHIKKRLRVLEEGENYAFADMTELCLMLDVVISLKFK

SEQ ID NO: 149021 - protein, 252 aa, Glycine max
  Coding DNA Sequence Number=SeqID_32243
  Homolog annotation: Hit_ID=Q8GSM4; Match level="QueryCoverage=30%, HitCoverage=21%, E-value=1e-17, Identity=55%"; Hit description=Ovate protein
  Pfam annotation: Domain name=DUF623; Domain location=181-240; Score =99.5; E_value=1e-26; Accession=PF04844.4; Description=Protein of unknown function, DUF623
  Subcellular localization annotation: CTP_CleavageSite=72; ConfidenceScore=5.24e-01
MAKRFKLKFNIPSFQMCRSKDLSSFPGNPVPAIYRLSPVNHNARDTKHPSLLPSPSPSPSKITSIAQRCKMCCDKDSLKKLKSSVPSRRSDFLIDNVEEDESETLISCMTSFSDEFCLGEEKDLSSSSSLRRKKMGSVKKVRRVRFQSSEKRRGTEVKKTTVTRRSVEGKVKESFAVVKKSKDPYEDFRKSMMEMITEMEMSEAEDLEQLLQCFLALNSRSYHAVIVRAFMEIWQQMFVMKNLQTNVKTQEK

SEQ ID NO: 149022 - protein, 119 aa, Glycine max
  Coding DNA Sequence Number=SeqID_32244
MGETHEVPQDHALADFEPHLGYATEGQTFEERLRAIEGGKDYPFVDMAELCLVPDVVIPPKFKVPNFDKYNGTTCSKNNLKMYCRKMGAYAKDEKLLMHFFQKSLVGVAITWYTNLDSS

SEQ ID NO: 149023 - protein, 154 aa, Glycine max
  Coding DNA Sequence Number=SeqID_32245
PRVGSRAPGHYYHGYYRPEPKEGKERTKARSSLAIHSEGGWGSTSFMTHGPIETRFSDMDFFEMVNHFFNREREVIQNPLAPVQNRWKFPTPIPQRRLSVHFPEIEEIYSSVAENIMSRDLEISAEISIETLRGWVEEIKENPKSPKILSLGNT

SEQ ID NO: 149024 - protein, 53 aa, Glycine max
  Coding DNA Sequence Number=SeqID_32246
VCVSGLYQLVLDEIYHSPEKSALKELKDEDVLDIVSDIVDPAQSVKDITDLCV

SEQ ID NO: 149025 - protein, 136 aa, Glycine max
  Coding DNA Sequence Number=SeqID_32247
MSRNFTDCLTMGVKFLEVVMRRSHPTKQMISSCATSSKLWFWHLYNKAFNLSHVLHRGSSDPWCRNLPFGGKATRGLTGASSKGGKCAESPPTFICGKRQKNRRKPVMKNIPDSGVVFTFEEGISTSHVCPKGQQP

SEQ ID NO: 149026 - protein, 121 aa, Glycine max
  Coding DNA Sequence Number=SeqID_32248
  Subcellular localization annotation: CTP_CleavageSite=36; ConfidenceScore=5.47e-01
MNVLKTKPQESMLKSMFSLSNSHSEPPLSVSRNRLRACSASGLGIEVRGGEWFGVGNSFLGEKDHVTGGREWISEHVSYCHGHVWTLGLRVCDDASLSEIGGMHMVLKKVFDFCVTIDNFT

SEQ ID NO: 149027 - protein, 123 aa, Glycine max
  Coding DNA Sequence Number=SeqID_32249
  Gene Ontology: Mol. function=transition metal ion binding; Cellular component=cytoplasm; Biological process=fucose metabolic process
MLPKENTLPKNHYKVKKILCPVGKEYKKIHACPNDCILYRNRFVEMCKCPTCGVSLYKVKDDEFSDDASKNNSRLAKMTEKVMDCSDIRLILHNGRQLIVSIFCRRARKPKAWSCFGRNESFW

SEQ ID NO: 149028 - protein, 135 aa, Glycine max
  Coding DNA Sequence Number=SeqID_32250
  Homolog annotation: Hit_ID=Q69MJ7; Match level="QueryCoverage=75%, HitCoverage=20%, E-value=3e-22, Identity=51%"; Hit description =Pentatricopeptide (PPR) repeat-containing protein / CBS domain- containing protein-like
  Pfam annotation: Domain name=PPR; Domain location=83-117; Score=19.9; E_value=0.009; Accession=PF01535.11; Description=PPR repeat
  Subcellular localization annotation: CTP_CleavageSite=25; ConfidenceScore=5.57e-01
MLLTHIHVFSPFTRFTYALHASPVRASSAPTRRRLVKTAAPQEPKNLRHLTSRIVQLTRRKQLRQILDEVEVAKKHFGKLNSIVMNAVVEACVRCGDIDSAIRIFDEMKKRDGCGVDTVTYATLLKDLLFLVVEN

SEQ ID NO: 149029 - protein, 65 aa, Glycine max
  Coding DNA Sequence Number=SeqID_32251
MTNANCPQESLHSVSNGNLSWVYVYYGNLSTIALSLKDPVSVKERREGFLQGLGLADSTNQLSCA

SEQ ID NO: 149030 - protein, 129 aa, Glycine max
  Coding DNA Sequence Number=SeqID_32252
MEVLRLCEDGLMKRFVWMIFVMVTGCCGFKELWYFLVFDFVAGDADHEVLGFMDDFKHIDADYEALGFMDGLTHVDVDHKTLDFMDGFSHVDADHEARASWTISHMWMPTMTLLASWTILLMWMPTMTL

SEQ ID NO: 149031 - protein, 188 aa, Glycine max
  Coding DNA Sequence Number=SeqID_32253
MCTNPYNNFRDKRIMKRSVNQVELAESHFELGQQIMALSRKIERFMKAKSQAIITSLHILLMIDVGMYMLQALTKEKKDENEVLTPAQKLPPKLIDPENFSIPFTISSLQIDRLLCDLATNKMKTIVAKPRPSVRKEDRLKRNIILKNHHEGGTRDENMRDDSTIQVLGYGVDDHIEGSFYEKIINPF

SEQ ID NO: 149032 - protein, 49 aa, Glycine max
  Coding DNA Sequence Number=SeqID_32254
MSPPPLITHRLISCSQDGFLFTLSSLPVFAQLKLVALLVLARLVQLWLA

SEQ ID NO: 149033 - protein, 68 aa, Glycine max
  Coding DNA Sequence Number=SeqID_32255
  Gene Ontology: Mol. function=zinc ion binding
MCLVFVCDEEERVLGRQTAPGACPYCGGMVQAIDVESQWRFCFLPLCFKTKRKYYCTMCTRRLETNTM

SEQ ID NO: 149034 - protein, 234 aa, Glycine max
  Coding DNA Sequence Number=SeqID_32256
  Gene Ontology: Mol. function=RNA-directed DNA polymerase activity; Cellular component=nucleus; Biological process=RNA-dependent DNA replication
MTKVWRKRFSLMKATSKGEILYLSTIPNNIQGRGSNTPHDEGNNDRREIKIMQDLLQIVPYNPVIILQQVNLKGNYTLLGFGMMGVVDNFLGHKGILRSASPNDKISLKRVDNIILIRPKTLHKNFSDDFICHITQANGPEVLELLVFAFSLYSLTLSVFSLSLLLFDSHLGFRSRNYTCWCSHLPTKPSVCLPNNKNNSSTITHPTLSECTVQHAPKQSIFSRSQRSSSRTAI

SEQ ID NO: 149035 - protein, 54 aa, Glycine max
  Coding DNA Sequence Number=SeqID_32257
  Homolog annotation: Hit_ID=Q84ML9; Match level="QueryCoverage=92%, HitCoverage=7%, E-value=1e-16, Identity=74%"; Hit description=1 -deoxy-D-xylulose-5-phosphate synthase
MVVMVASDDAEIFHTVATAAAISDQPCCFRYQKGNGVGVEIPPGNKGIPLEEKE

SEQ ID NO: 149036 - protein, 42 aa, Glycine max
  Coding DNA Sequence Number=SeqID_32258
MPSTPMRLWDLCSSQRERTCRLEDGGVPGTIEAVGTDVSGGE

SEQ ID NO: 149037 - protein, 73 aa, Glycine max
  Coding DNA Sequence Number=SeqID_32259
MTSGLAPVMFTQLGGSSAFLQDQWVPQKLADDISFKRNPLAPHPRAYVSGPLFRRPGISIKLHDYFKTELSHG

SEQ ID NO: 149038 - protein, 133 aa, Glycine max
  Coding DNA Sequence Number=SeqID_32260
MMSSASHPPFYINAIEIKWEHNDTLHVDHFFGFLSCHRMPDVPGARIRIIDFCFSWTQPKPSYNCFVTPMPKVVIPSESHSLFFDVMMSSTGSNSSSKDTNAISPLMSPRSLLPKSWVPLGVDVVDLVSVDEG

SEQ ID NO: 149039 - protein, 153 aa, Glycine max
  Coding DNA Sequence Number=SeqID_32261
METMKFRKGKWITTIVNKADTVVEGVEDEELEVDEGEDLEDCNEGMGVVEVGLTVGPIKELDAREDVAVGGAKAKDEGSYYLTFVNHVLMEDAMTFWEIRKELEVEDVDWEGDDARKVYVAWSEHKLRMEDMKDLDLRWVENGGDKGERIWEK

SEQ ID NO: 149040 - protein, 228 aa, Glycine max
  Coding DNA Sequence Number=SeqID_32262
  Gene Ontology: Mol. function=nucleic acid binding
  Homolog annotation: Hit_ID=Q1SKJ3; Match level="QueryCoverage=36%, HitCoverage=9%, E-value=1e-20, Identity=51%"; Hit description=Zinc finger, CCHC-type; Endonuclease/exonuclease/phosphatase
  Pfam annotation: Domain name=zf-CCHC; Domain location=64-81; Score =6.3; E_value=0.092; Accession=PF00098.13; Description=Zinc knuckle
MVFYDESFLLYLASVVGKPIKMDTNMLHAYRGRFPRVCVQVDLSKPAMGRVNIWYHIEYESLHLLCVLYGHYGHQKKDCSKNVVRKKKGNWNKNLSLTYDWIKSGNNYSQNILFDLKSNIVSPSKDQDERAHNVYAQDLERKRSCKEQILPFHTGGIVGNSSTQKNLKQKSVASSSNEEAKTHPSKSSNTTIPLVSMKTSATIADKAPINEDRDIQMLDAIEVDIRPK

SEQ ID NO: 149041 - protein, 186 aa, Glycine max
  Coding DNA Sequence Number=SeqID_32263
MRGTFSESTCKKIYPIPLRRIKMNDFLIWKFTNDAIYTVKSGYYQALGDNHTSNLSSSSFSGDIWGNIWKIKTVHKGEEPIDLSKEENPYPFCDRQVQLLKGGGSRAESGDHDGEVLAAASLFVETLYDPHVAETLALHWAMETARFLLQKLVQYETDCKRLVDAWTDGRVLQKDYFTRVLLDRKN

SEQ ID NO: 149042 - protein, 195 aa, Glycine max
  Coding DNA Sequence Number=SeqID_32264
  Gene Ontology: Cellular component=integral to membrane; Biological process=defense response to bacterium
  Homolog annotation: Hit_ID=Q9LH79; Match level="QueryCoverage=98%, HitCoverage=99%, E-value=3e-62, Identity=53%"; Hit description=MtN3 -like protein
  Pfam annotation: Domain name=MtN3_slv; Domain location=15-104; Score =81.5; E_value=2.6e-21; Accession=PF03083.6; Description=MtN3saliva family
MSLFGAYSICEVGKDAAGVAGNIFAFGLFVSPIPTFRRIIRNGSTEMFSGLPYIYSLLNCMICLWYGTPLISPDNLLVTTVNSIGAAFQLVYIILFLMYAEKARKVRMVGLLLAVLGIFVIILVGSLQIDDSAMRRMFVGFLSCASLISMFASPLFIIVPNGIGTVLGIIQLVLYFYYKGSSSEECREPLIVSYE

SEQ ID NO: 149043 - protein, 124 aa, Glycine max
  Coding DNA Sequence Number=SeqID_32265
MVIKFHDDPTVNKSEIIVFLRQVWWAAGKRKNFERRRRKTKMRERRCTVNVKTDLTLFIACCKRLLMIHEDDVTRKCDPDLQAEPKNSITASTSWYLLQANFFGADNAQPGQDVRDEKRQHHND

SEQ ID NO: 149044 - protein, 67 aa, Glycine max
  Coding DNA Sequence Number=SeqID_32266
MESNPSKAQKKGKSSKRKHVCALNECVPLSEAPAFSARLKNLEENLPCKHTLSALSLAKRVIRHLPG

SEQ ID NO: 149045 - protein, 125 aa, Glycine max
  Coding DNA Sequence Number=SeqID_32267
MWAFLTGRQIDWAHLVRYRMHKALRANAPLPYPHLITLFLRHFQIPLDDESFVQVKHSFAIGAGAVTSFGYHKDRNGQWLKKDALPPQDERTPSPPLFRYCIVIIKKGEIVDAIAFDVLMMIMMI

SEQ ID NO: 149046 - protein, 113 aa, Glycine max
  Coding DNA Sequence Number=SeqID_32268
  Subcellular localization annotation: CTP_CleavageSite=54; ConfidenceScore=5.16e-01
MSTWRLPQKESLSMSSIVVHLLPQTKVSDHHRKTRQQVSRSPYRAQETRPMVISLSHKGVPNRVTCLQVQVFSLMKNSDPTVNESGITVLPERVWVKLEISQFQHRSIKLHIT

SEQ ID NO: 149047 - protein, 265 aa, Glycine max
  Coding DNA Sequence Number=SeqID_32269
  Gene Ontology: Mol. function=transcription factor activity; Cellular component=nucleus; Biological process=regulation of transcription, DNA-dependent
  Homolog annotation: Hit_ID=Q336Q9; Match level="QueryCoverage=41%, HitCoverage=19%, E-value=4e-23, Identity=54%"; Hit description =Expressed protein
MDTDAVGSEGYSPLKELRLEIEVKEGTFSLCFWLYLTSSTTFPVTIIQQVFSDISESAPFLVIDDNKRIHMLPVLLLHEEAPETGNINSWTEVPHATVDFEFLLEKWVHVGCECPPLKLSIDESSVSEIEEESDGVWGIVGGKASCRRNFSLDVVLSDAFGQPVDKENEVFASLLYADTGAPVENTADDEAPLLASYDGIEFSSCERPSKLLLGRASFKLKISQNGVADFEHKAVRGAWHGGIWQLQCVWKRNKPIIERVCWEKD

SEQ ID NO: 149048 - protein, 476 aa, Glycine max
  Coding DNA Sequence Number=SeqID_32270
MEDEDGGWGEMFYSLQKWDPQLRPAYRLTWMHCWGIPLIAWDIHHIKQIVSSIGDMMDADEDVEELRKLDMARVLIKTPWKPLIQHTVNVQIQGEVYAVHIVEDSEKSCVNCRRQRWNDYSSLEDICSEESEAEISRGDSLPTWWNCMRPQNRMVASGEPSGGVTVSGEENDGEHPAVAREARTTEVKNKLACGEGMEAQTSLHDAEQPLSERPSEDGVTVNIGAHQQQRETTPAQRSPEKLADSLNLASEEAVSGKRTIGSGDGPELEDMAITRWARTQTDSDQSAEDVAQLYRRDEVVLVQTDLHKKGEKEHNGKGANEDSREKFHGNGKMGADVNVEDIGRFKPVREEPRDGQVERGVEKAIRRMVIEQHIDMLCLQETKKEMVEKSMCAALWGGSEIGWESYPSSNSAGGILCIWNVNSFRVENKISGTGCQGQQVEVLVDSSNMSFYFGLGFVTLRRTLGQAITTGQAIFD

SEQ ID NO: 149049 - protein, 357 aa, Glycine max
  Coding DNA Sequence Number=SeqID_32271
MAINKEVHPCFTQWRNGAQPYALDPAMGEMVDMDDDAEDKRRLDRVRVLVKTPRTPTIKHTVEVYIGDERFNVFIVEECGGDSHDCRRSRCSFCESSEEIDSNESYNGSISPRSINTLGIRRSSTPLSRCSFCESSEEIDFDESYNGSITPRSINTLGMEDEGHVAVVLVTAQPRSLADSPNDDAEDRGTKLLPSSIRDHHSTPGKASIPRVQGSRCQVTSCKQTMPAVPQPMVTCHRDMLTKCGKQQGIGSATLEEMLEPNHEKGKKCFGRKLQRWFKKKKYMGQNSPKTMTETGTSSLQGQHLQDEIQQGNASNINCDSTTRSAIQVEDPEEIMETQCIQQATNIWSMAKHLGAT

SEQ ID NO: 149050 - protein, 108 aa, Glycine max
  Coding DNA Sequence Number=SeqID_32272
MKLYEFRNDTYFPSARLRIHTDYVFTHSLAFEEVTEPHRLRKNTSFRLPPHYEISRIAQAYFLLISETSPDFIYSMSSKYFLKLDCFLTPPTQLAWASWAATSSPFFL

SEQ ID NO: 149051 - protein, 241 aa, Glycine max
  Coding DNA Sequence Number=SeqID_32273
  Gene Ontology: Mol. function=DNA binding
  Homolog annotation: Hit_ID=Q1SDS1; Match level="QueryCoverage=80%, HitCoverage=35%, E-value=1e-16, Identity=31%"; Hit description=IMP dehydrogenase/GMP reductase
MGCLEYQGNVWKQKQESWQVAIDAFLAFHDHKESSVVAILADLYDTFDRRCEKNSARIICCTPALYVWLVSHLFRQEVRHACPLEGHRSCTEKKKASWDRLLASKERASVNWFPQWKEGRTGILISCRGFPNFLLMGTRGCINYNPILAIRQLGYPMRGAPLEEGLTPIIARGFNSTNAGALQKVRKAWEMMQKKGKELRGSSNGPIGGYHGWLKAYTQDLDWFPNLRPTKRLEFETPEER

SEQ ID NO: 149052 - protein, 301 aa, Glycine max
  Coding DNA Sequence Number=SeqID_32274
LAASDKKLAALSAEKQQQEKNIATLQQALKEAQQQQSAGSAQLTKQLSDARAAATQSADALKTLKAENDKALAALQAESKKQLSAQQAGNDKKLAALSAEKQQQEKNIATLQQALKEAQQQQSAGSAQLTKQLSDARAAATQSADALKALKAENDKALAALQAESKKQLSAQQAESDKKLAALQAESKQQLSAQQAESAQKLAALQTQQAEREKQLAALDSDKQQQAHNLAQLTRELEAAKQQPAAAPKLSAPKSDAERDGYTLGQFIASNAVVQLQMVKDIGLSISMDQLIAGLTTQLQS

SEQ ID NO: 149053 - protein, 67 aa, Glycine max
  Coding DNA Sequence Number=SeqID_32275
MNEMAPRKLASKRSRKDKAAEGTSSTPEYDSHRFRSAEHQQRFEAIKGWSFLRERRVQLRDDKYTNF

SEQ ID NO: 149054 - protein, 218 aa, Glycine max
  Coding DNA Sequence Number=SeqID_32276
  Gene Ontology: Mol. function=transcription factor activity; Cellular component=nucleus; Biological process=regulation of transcription, DNA-dependent
  Homolog annotation: Hit_ID=Q336Q9; Match level="QueryCoverage=81%, HitCoverage=30%, E-value=7e-45, Identity=49%"; Hit description =Expressed protein
  Pfam annotation: Domain name=SH2; Domain location=85-167; Score= -11.0; E_value=0.073; Accession=PF00017.14; Description=SH2 domain
MSPNNHHIPWENAVYEIEEQFMKIASCCSRSLSPQDLNLLRRIAGCQEYLTQENFEKLWCWLYPVAFIISRDWINPIWNSTSPKWIEGFITKEEAESSLQGPTGFQEPGTFILRFPTSRSWPHPDAGNLVVSYVGNDYKLHHRLLSMHHVYGSGDNRVDVKPLQDMLLAEPELSRLGSVFDSWATVQDNKKPLGTLELLQKVPQHPVKVAFKVGFGGS

SEQ ID NO: 149055 - protein, 43 aa, Glycine max
  Coding DNA Sequence Number=SeqID_32277
MAQRPPICGSQGILELGTVIVGLETRGKEAFVVMREVEFDGKM

SEQ ID NO: 149056 - protein, 208 aa, Glycine max
  Coding DNA Sequence Number=SeqID_32278
MIRRHCLQHFIQNLEILVQFATIVDHDVGCDTEAYHTWEQQDQLLLSWLQSTISNPMPRKLIGCTSLWLLWDKIHNYFHAHMNVKARQLRIDLCLLEHYDSSIAFISNKLELHSIDEIEKFLKKNVASLLMLHQLPLLLRSLIQTLFKLILCNNPLIKIKFLIRVSIRIIPKLIRISICSPTSVVVVEGKGVVVVAAPFNVLSASIWT

SEQ ID NO: 149057 - protein, 115 aa, Glycine max
  Coding DNA Sequence Number=SeqID_32279
MQEVRRLPQSTTTLSFGEFFLFSSEAWGGRQCVRLGFGRGLEKNIALFVIGRDGLRKRGIQSRVGLGFIDFGGRLGFGRGLEVSEKNIASPSPLFGRGLGSVLRLLVRNEKTRVG

SEQ ID NO: 149058 - protein, 126 aa, Glycine max
  Coding DNA Sequence Number=SeqID_32280
MGTKEKLKGVVIRVRKECNRLRDISMSTIDALEREMRRAKGEETNRKRYQGASSDNSNELKLRRTKRDQAKTERRDLATIHGHALRNEQAEVLALQGERETREEVMTDIYFAHNEVHSLFDYYQHM

SEQ ID NO: 149059 - protein, 340 aa, Glycine max
  Coding DNA Sequence Number=SeqID_32281
MDTLPVVYYEKIVGYMLVSFVDLVFAGERIEVGLKQGKFDYVASTNSGNRRPVMNGVKKREVEAHVMATERSVNLDFPDGINPNIKCATNLLPYLLDNQMEVLTFQDDSPNMRTNPLANHGSSYVNAIKEGEVGMVEYDGNEENQWPLHPREFHDVDIWLVSKKLLQRLINEGRIEIGHVRKEEDVTTHMPQGFQPAMVRTPSPFPYESNKTVSWRYGVHVSDGGQDVSVMRVGSSMPTVKVTNIFGMSGMTCSGHVCTPLELLAGSKNKGKTNENVIEREKMDPIMNNETPIEKPTKKEENSSKKKMMQSYPVRALDRRLQVDWVRDAREGLRVLMSLR

SEQ ID NO: 149060 - protein, 147 aa, Glycine max
  Coding DNA Sequence Number=SeqID_32282
MFSLSLNLNNVNWYVLNPYYQLWDFMMQNPGPKITNVYVRWPKKGTAVDESFNGNDAPDPKSESQNCCIAEYGSPEKNSLLARKRWPAANSCERLFRIQKNARYSARYHAGAEQPLRRRPLSLGGMKERSSCLQLRQSGTAQSWVLL

SEQ ID NO: 149061 - protein, 129 aa, Glycine max
  Coding DNA Sequence Number=SeqID_32283
  Gene Ontology: Mol. function=nucleic acid binding
  Homolog annotation: Hit_ID=Q1T1R1; Match level="QueryCoverage=96%, HitCoverage=24%, E-value=2e-27, Identity=49%"; Hit description =Probable Ta11-like non-LTR retroelement protein [imported] -Arabidopsis thaliana
MPFSITISKEEYKLGSKNWKNNLHGHFILAKGDQPFHYQDLHAKLTKLWKPLGDWCMTPQDKDSMNSVSPQQMICIAFGLLELGTFSPGSSTYINGLLILIPTSRNSPILNVGLTYVTYPKNIGGPRPS

SEQ ID NO: 149062 - protein, 101 aa, Glycine max
  Coding DNA Sequence Number=SeqID_32284
  Subcellular localization annotation: CTP_CleavageSite=60; ConfidenceScore=5.55e-01
LPSLVTDVWGANTFPARKCNSRAFHLKVRRSRLFRFFRRFPQINVGGDSARIPFMEHASRESRFASRRRKKKEGVETRVVITERARTDEISVLSLLSSYLR

SEQ ID NO: 149063 - protein, 93 aa, Glycine max
  Coding DNA Sequence Number=SeqID_32285
MVGKDLGSMGGPHYVQIPNKHAFPPYGLPPNYTPPNVAYTPAEDTHEMPHHNLADIEPCLGYATEGQAVGGIPLQNTLEGLQFRPQPPLAFHS

SEQ ID NO: 149064 - protein, 77 aa, Glycine max
  Coding DNA Sequence Number=SeqID_32286
MAIGVPISINDVTLKYTFGHFARLLIVINLSKNLHQQILVQREGTRHVPKDLSAEPTLNCPPHNLPQAMLRNPLMKP

SEQ ID NO: 149065 - protein, 78 aa, Glycine max
  Coding DNA Sequence Number=SeqID_32287
ARQAQGGNPQAPDAPPPPTQADPAASFDTEWAEVAWPGDWPEAQAGEAPAEAPDDADEARVDEEITDLLDFLGGSGAT

SEQ ID NO: 149066 - protein, 92 aa, Glycine max
  Coding DNA Sequence Number=SeqID_32288
  Subcellular localization annotation: CTP_CleavageSite=51; ConfidenceScore=5.45e-01
MAQPKPSAGLKGKPHQHALTFMPSCISKKQRLGPPRPKSCFGIYPNFRKLSASQKWILGCLPAALPACPELDMGRRSVDHGPSLYSRSSLST

SEQ ID NO: 149067 - protein, 113 aa, Glycine max
  Coding DNA Sequence Number=SeqID_32289
  Gene Ontology: Mol. function=peptidase activity
MASSNPLFPEANSIRRPPIFNGEGYHYWKTHMQIFIEAIYLNIWAAIEIGPYIPTVVDVSTSTVEARLHDECDEQKAQRSKNNSRESRTIQEFKNQEEFKTQEESLESRIKIQ

SEQ ID NO: 149068 - protein, 385 aa, Glycine max
  Coding DNA Sequence Number=SeqID_32290
  Gene Ontology: Mol. function=guanyl-nucleotide exchange factor activity
  Homolog annotation: Hit_ID=Q93ZY2; Match level="QueryCoverage=53%, HitCoverage=38%, E-value=6e-59, Identity=58%"; Hit description=Rop guanine nucleotide exchange factor 1
  Pfam annotation: Domain name=DUF315; Domain location=90-385; Score =91.8; E_value=2e-24; Accession=PF03759.4; Description=Domain of unknown function (DUF315)
MYPSTLHYQTLLTTYERCPSLAKVFTTFKRVLQEKDFTCWHGNNKQQQHRFLACGRFCVGGKAAMEDEALIDYKSEGVEGSIECESGCNDESFADLIKEKGGERSSNSEILLSEMTELDGQSQGSAEDTSSSTSMGFQEMSASNSTSPRGSEDAEKKDLCNENFEEQVSGLSMSVLEHELMKERFAKLLLGEDMSGSGNGVPAALTISNAITNLCATLFGQLWRLEPLAPEKKAMWRREMECLLSVSDYIVELKPTWQTFPDGSKLECTLVQFQEIAHTKHSLFFPKEILDSFVDPEFRYVDQGVLAPDADGSSSFRQALQRLEEKWWLPVPQVPPSGLHEDSRKQLMHKRDSTKQILKAAMAINSITLADMEIPDTYLESLPKV

SEQ ID NO: 149069 - protein, 54 aa, Glycine max
  Coding DNA Sequence Number=SeqID_32291
MGEQDSGEGDVEKQAEWNQAFTGNQCDVLDLCLKMDSIFSESFNNYSITIELPH

SEQ ID NO: 149070 - protein, 59 aa, Glycine max
  Coding DNA Sequence Number=SeqID_32292
MLSPLYESIIGVEDRKERERAMPGSLRPRFVIFGSSIVQFGFYDEGWVAILSHLYARKG

SEQ ID NO: 149071 - protein, 84 aa, Glycine max
  Coding DNA Sequence Number=SeqID_32293
MMQGIPDGSLQKVLFQATPYLIYAKFTGPHLKFAKDNDKGNNLDRQYKAEQERQKKSRLTHLYKYLIPRRDSKVWPNISWAAVA

SEQ ID NO: 149072 - protein, 260 aa, Glycine max
  Coding DNA Sequence Number=SeqID_32294
  Homolog annotation: Hit_ID=Q658I5; Match level="QueryCoverage=73%, HitCoverage=37%, E-value=4e-74, Identity=70%"; Hit description=LMBR1 integral membrane family protein-like
  Pfam annotation: Domain name=LMBR1; Domain location=3-260; Score= -110.3; E_value=0.0017; Accession=PF04791.6; Description=LMBR1-like membrane protein
  Subcellular localization annotation: CTP_CleavageSite=35; ConfidenceScore=5.37e-01
MGLLKLRLLCVNFSLQAAVRDRCVAAGARRRRSCRCVAAGGRRGCVRVWGAGGTRLVQGRLAVGFSLRWKCSAFSASPSSEKTWTMRTTFPEYVVALATIVGSVLFAIFGGVGIACLPLGLIFSFIRRPKAVITRSQYIKEATELGKKARELKKAAEALHQEERSGSKGRKFRKNVKEVEKELFQLEEDVKLLEEMYPQGEKAETTWALTVLGYLAKFVLGILGLIVSVAWVTHIIIYLLIDPPLSPFLNEVFIKLDDVW

SEQ ID NO: 149073 - protein, 631 aa, Glycine max
  Coding DNA Sequence Number=SeqID_32295
  Gene Ontology: Mol. function=RNA-directed DNA polymerase activity; Cellular component=chromatin; Biological process=chromatin assembly or disassembly
  Pfam annotation: Domain name=RnaseH; Domain location=299-463; Score= -27.3; E_value=0.02; Accession=PF00075.14; Description=RNase H
  Pfam annotation: Domain name=zf-H2C2; Domain location=445-482; Score =13.7; E_value=0.0055; Accession=PF09337.1; Description=His(2)-Cys(2) zinc finger
  Pfam module annotation: Pfam domain module=RVT_1::RnaseH::zf-H2C2; Domain location=89-258::299-463::445-482
MEGTKEVQENRVKGEPQAVLESILEIFAEVFKEPTGLPPPRAREHNITLQPGVAPINVRPYRYPHLHKNEIERQVKELLANGHIRYSQNAYSSPVILVKKRNNKWRMCVDFRALNRVTIPDKFPIPVIEELLDELQGAKYFCKLDLSSGYHQVCMRTKGIPKTAFRTHESHYEYLVMPFGLMNAPSTFQALMNDVFRDYLRKGVLVFFYDILVYSKGWQEHLQLLQQVLEVLRHNKLFARHEKCTIGQEQVEYLGHIIFVQGVAVDPAKVKSVLEWPRPKNVKGKRMTKAPVLRLPNFEEQFELECDVSGTGIGAILMQNSQPIAYFSKALGGKNLSKSAYEKELMAVVLAIQHWRTHLLGRKFAVFSDQRSLKQLLSQRVLTGADALSRSLEDAELTNMIYYPKWLDWQQLTHEGVLLYKGRLVMHEKSPWIQKLLEEFHSTPQAGHSGFYRTYRRLASNLFWKGMKEDVKQFVQACDICQRQKYSPTSPGGLLQPLPIPEQVWEDVSVDFITGLPRSRGYEAILVVVDRLTKYSNFVPLKHPYTAKGIAEIFVREVGTMLKMSTAYHPQTDGQTEAEFWINTTHQESIGTTPFAVVYGREHPKIIPCIPGEVRVESAQRELIDRDEALR

SEQ ID NO: 149074 - protein, 165 aa, Glycine max
  Coding DNA Sequence Number=SeqID_32296
DHAHETPSGPGEVQQGPGVSSSGYGPLSVLQGARPPPARSCHRDTAKYARVAPTRHPVDLEEPNRSLGFPALVTGLCRSYRAPVPPASSCHRDIGITPARHSVDLEKSNRVLGFPALIMGLYQFYGVPVTPYKVIKPPTNRAFIKKYCAPRQALGETPQQPGDSR

SEQ ID NO: 149075 - protein, 92 aa, Glycine max
  Coding DNA Sequence Number=SeqID_32297
  Gene Ontology: Mol. function=DNA binding; Biological process =regulation of transcription, DNA-dependent
  Homolog annotation: Hit_ID=Q7MYX2; Match level="QueryCoverage=93%, HitCoverage=65%, E-value=2e-23, Identity=59%"; Hit description =Complete genome; segment 16/17
  Pfam annotation: Domain name=DUF1323; Domain location=1-90; Score= -9.0; E_value=0.019; Accession=PF07037.2; Description=Protein of unknown function (DUF1323)
MARREGWISRRRKGVQGKALEYHIDSLPSDVRNLLVLKEDGAAYDVERQDPLAVWIEYYYHLTESEREKMVAFLMREGIGGLLARIDEESNT

SEQ ID NO: 149076 - protein, 116 aa, Glycine max
  Coding DNA Sequence Number=SeqID_32298
  Subcellular localization annotation: CTP_CleavageSite=35; ConfidenceScore=5.42e-01
MHTRSFTNPQFLKIGLTHINSPQWSRQLSQRALLRASEARLTGALSKGGKMRGVVTNVYLSETSKKLEETGKTKVTNPYGLCIYSFLAFEEVTKTHGLRKTPPFDFRHITEFSRIA

SEQ ID NO: 149077 - protein, 76 aa, Glycine max
  Coding DNA Sequence Number=SeqID_32299
MTEGSGEGFCIANVPGDAFSLWGNFFEAKKQMMADAKVGGAGLWPRAKFRIGWPPPPPRDQFCCQDFANFGLRPVG

SEQ ID NO: 149078 - protein, 126 aa, Glycine max
  Coding DNA Sequence Number=SeqID_32300
MPRKVQGDAPQATNAPPPPHQADPVGSLGIERYLQHLVRQQAANHRGQVQIHDCLYQLSLSQQGQGFTPFACPTLDQFRAEVAWPGDLPEAQAGEAPVGAPGDAEEARMDEEMTDLLGFLGGSGAM

SEQ ID NO: 149079 - protein, 328 aa, Glycine max
  Coding DNA Sequence Number=SeqID_32301
  Homolog annotation: Hit_ID=Q1RTB4; Match level="QueryCoverage=38%, HitCoverage=27%, E-value=1e-07, Identity=32%"; Hit description=IMP dehydrogenase/GMP reductase
KIAAVVGDSARELDRMKQTRNGVVGLSWKYLEGKARDMVNQEEWVPFADILALLIFGVVLFPNVDGLVDLAVIDAFLAYHHSKESLVVAFLADLFDTFDRRVDWDQYLAGIGGRTINWFPRWKEGKEGVLFSCGDYPNIPLIGTRDFGAQSFKIVQRVHKVWESPLRKDKELRGIRNGIIGGYHEWLKVHTRGLDWLSKLKIINEENFEASEEDEDVRALKIELGKARLAKEKFKLVATDEELATCSRSKKSLARHLEATEQSMLAIIGQYKEELNQSLTHEQKLVEDFAQAYAEKEERGRVIDALHQEATMWMDRFALTLNGSQDIP

SEQ ID NO: 149080 - protein, 396 aa, Glycine max
  Coding DNA Sequence Number=SeqID_32302
  Gene Ontology: Mol. function=transporter activity; Cellular component= mitochondrial inner membrane; Biological process=transport
  Homolog annotation: Hit_ID=Q8LCT8; Match level="QueryCoverage=86%, HitCoverage=79%, E-value=1e-127, Identity=68%"; Hit description =Putative carrier protein
  Pfam annotation: Domain name=Mito_carr; Domain location=184-271; Score=106.8; E_value=6.3e-29; Accession=PF00153.17; Description =Mitochondrial carrier protein
  Pfam annotation: Domain name=Mito_carr; Domain location=278-376; Score=74.4; E_value=3.5e-19; Accession=PF00153.17; Description =Mitochondrial carrier protein
  Pfam annotation: Domain name=Mito_carr; Domain location=84-180; Score= 110.8; E_value=3.9e-30; Accession=PF00153.17; Description =Mitochondrial carrier protein
  Pfam module annotation: Pfam domain module=Mito_carr::Mito_carr::Mito_ carr; Domain location=184-271::278-376::84-180
  Subcellular localization annotation: CTP_CleavageSite=43; ConfidenceScore=5.20e-01
MPISASPTEERATLSWRKIPHFKYDAVQPRLRRNTTTTLTFATATGGSKFASVSVAEPKLHHDFMPTPSQLFKNPLAAFAIVPRDAALFSAGAIAGAAAKTVTAPLDRIKLLMQTHGVRLGQDSAKKAISFIEAIAVIGKEEGIQGYWKGNLPQVIRVVPYSAVQLFAYEIYKKIFKGENGELSVAGRLAAGAFAGMTSTFITYPLDVLRLRLAVEPGYRTMSEVALSMLREEGFASFYRGLGPSLIAIAPYIAVNFCVFDLLKKSLPEKYQKRTETSILTAVLSASLATLTCYPLDTVRRQMQLKGTPYKTVLDALSVLLYFKKCWKGALDGIVARDGVAGLYRGFVPNALKSLPNSSIKLTTYDIVKRLISASEKEFQTIAEENRIKHKNTNNQ

SEQ ID NO: 149081 - protein, 199 aa, Glycine max
  Coding DNA Sequence Number=SeqID_32303
  Gene Ontology: Mol. function=transporter activity; Cellular component= membrane; Biological process=transport
  Homolog annotation: Hit_ID=Q0KM33; Match level="QueryCoverage=95%, HitCoverage=21%, E-value=4e-21, Identity=33%"; Hit description=TonB -dependent receptor precursor
RTAAAGVVQRGRRINANALGIRRNCTEEERGVVGQLVVAVQQQRVKRHQCFLGRGRAVVEAAAGRADADAVLEGVAVGDAGAAGAGAGEGRARIVRADAPGQPCIFDLFLDVTVVHQLAFLMVDHERLVATVGSDATGQAAGATGRADFRIFIADAEAQAFIILTQDHVDHSAHGIPTVHCICAFTQDFNALDGGRRNQ

SEQ ID NO: 149082 - protein, 67 aa, Glycine max
  Coding DNA Sequence Number=SeqID_32304
MEREQGLSYMEKERDRERGRHYSGRESKFAYGPGDAILPRKGSVTRTMSKRLQEDWTRAAEESPRFS

SEQ ID NO: 149083 - protein, 653 aa, Glycine max
  Coding DNA Sequence Number=SeqID_32305
  Gene Ontology: Mol. function=oxidoreductase activity; Cellular component=cellulose and pectin-containing cell wall; Biological process=lignin catabolic process
  Homolog annotation: Hit_ID=Q7XIF0; Match level="QueryCoverage=71%, HitCoverage=86%, E-value=1e-176, Identity=63%"; Hit description =Putative pollen-specific protein NTP303
  Pfam annotation: Domain name=Cu-oxidase; Domain location=206-342; Score=198.1; E_value=2.1e-56; Accession=PF00394.12; Description =Multicopper oxidase
  Pfam annotation: Domain name=Cu-oxidase_2; Domain location=422-549; Score=98.5; E_value=2.1e-26; Accession=PF07731.4; Description =Multicopper oxidase
  Pfam annotation: Domain name=Cu-oxidase_3; Domain location=80-196; Score=182.4; E_value=1.1e-51; Accession=PF07732.5; Description =Multicopper oxidase
  Pfam module annotation: Pfam domain module=Cu-oxidase::Cu-oxidase _2::Cu-oxidase_3; Domain location=206-342::422-549::80-196
MAKVQGQCSLQDLVSVTAEERTTQNWYISLNLKVKVMLQVSVPNAMGSTSLLHLLLGVVLALLSVSLVEGEDAYKYYTWTVTYGILSPLGSPQQVVLIDGQFPGPQLDLVTNENVVLNLVNKLDEPFLLTWNGIKQRKNSWQDGVLGTNCPIPPNSNYTYKFQVKDQIGTYTYFPSTSLHKAAGGFGGLNVYHRSVIPVPYPYPDGDFTLLIGDWYKTNHKVLRESLDSGKSLAFPDGLLINGQAHTTINGDQGKTYMFRISNVGMSTSINFRIQGHPLKLVEIEGSHIVQNTYDTLDVHVGQSAAVLVTLNQPPKDYYIVASTRFSRKVLTATAVLHYSNSNSPASGPLPSPPIYQYHWSVKQARTYRWNLTANAARPNPQGSYHYGKITPTKTIVLSNSAPLINGKLRYAVNKVSYVNSDTPLKLADYFNIPGIYSVDSIQTLPSESTPASIATSVVPTSLHDFIEVVFQNNENAMQSWHLDGYDFWVVGYGFGQWTPAKRRTYNLVDALTRHTTQVYPNAWTTILVSLDNQAHRRWNGSIRKELEGIEEGLLQIVHVRVKPSGTVPPRLPGDLRAITPDLCGYGDTAALPDAFLYSAFHIIVDLVGQRSMLTLHFTAMYSTVMFLGTKDTLGVQPVVDIERTVLYHEKAI

SEQ ID NO: 149084 - protein, 201 aa, Glycine max
  Coding DNA Sequence Number=SeqID_32306
  Gene Ontology: Mol. function=structural molecule activity; Cellular component=coated pit; Biological process=ER to Golgi vesicle -mediated transport
  Homolog annotation: Hit_ID=Q1S9H2; Match level="QueryCoverage=66%, HitCoverage=17%, E-value=3e-35, Identity=57%"; Hit description =Adaptin N terminal region, putative
MLPLLLKRSQLKIWLYLFDFFKTRINISRKVHKLMFQLICDPSGVVVETTLKELVLAVIMWGNKLDHVITKLLYLLNQGETFTKVKATKFFFPVTKLFQSKDMGLRRMVIIVTSSIMKDMNNKIDMYRANSILVLCRITDGTLLSQIERYLKQAIVDKNPVVASAALVSGIHLLQVKEMLEYRCCIQNAGGIASFSAPQRN

SEQ ID NO: 149085 - protein, 99 aa, Glycine max
  Coding DNA Sequence Number=SeqID_32307
CAKKGIGHPEASQGSFVPHGRQDVLTATIGRPEHPGRSHAAGVGVMIKQYFGPAPRTSHTSSSMAPEDLEQLSQQIRDQLVESITENVTRQPMLSFSQM

SEQ ID NO: 149086 - protein, 45 aa, Glycine max
  Coding DNA Sequence Number=SeqID_32308
MAKTARVVQGNQQNLPKHEGGVSVTATTMPERDYARLNVEDQGQC

SEQ ID NO: 149087 - protein, 105 aa, Glycine max
  Coding DNA Sequence Number=SeqID_32309
MELRDIDAKMENKNLTMILLAFLPTSYENFLRLKASRNDDEAFASGLLVTKRWYISCGSVLVEGTSTRLLKENKGGYIPCGSLLVKDFTRLKRNLKNRRSLGDWM

SEQ ID NO: 149088 - protein, 166 aa, Glycine max
  Coding DNA Sequence Number=SeqID_32310
  Gene Ontology: Mol. function=zinc ion binding
  Homolog annotation: Hit_ID=Q6H591; Match level="QueryCoverage=90%, HitCoverage=63%, E-value=3e-60, Identity=74%"; Hit description =Putative zinc-finger motif
  Pfam annotation: Domain name=BAH; Domain location=34-149; Score =142.0; E_value=1.6e-39; Accession=PF01426.8; Description=BAH domain
MAKTRPGRKDVDSYTIRGTNKIVRGESYRLRKCLGFAAGDCVLMRPSDTSKPPYVARVEMIEQDNRNNVKVRVRWYYRPEESIGGRRQFHGAKELFLSDHYDVQSAHTIEGKCVVHSFKNYTKLENVGAEDYYCRFEYKAASGAFTPDRVAGVVIDCGDGYFGLQD

SEQ ID NO: 149089 - protein, 210 aa, Glycine max
  Coding DNA Sequence Number=SeqID_32311
MSLNLIKHSCQHQQLLCILSGIQTTEQAITSPMMRATFLLRLIRQGMVENIPRRLIFKASLARVFMFFPTFSIKTTFMLSILQQILHSQSWSFGIQDLLMPLLKLLDQYLVIVVYHCDTTDSSAVAVSSPIASYVPQNTHPMTTRAKAGVFKPKTYASYKEGSYDHIVEPHTIKEAMAKPEWLKAMKEEHDGLKASLMLMDVFKGTRTSW

SEQ ID NO: 149090 - protein, 67 aa, Glycine max
  Coding DNA Sequence Number=SeqID_32312
MFGVYNDNFPLYIKHEDLSKIAHGGQCLSISVIKLWIMHMIKASMQAGNANVYGFLEPQSIQRSGQS

SEQ ID NO: 149091 - protein, 150 aa, Glycine max
  Coding DNA Sequence Number=SeqID_32313
SNNESYESSDNKDPKVDFEQLINQAKKGEPRFEENGGTRRKASEATLRGNRSCELRRWWREKRGQGYARFELEHRAIQLPLNPKCSLVKQKLRRMKPEMSLKIKEEVKKQFDAGFLVVAWYPEWVANIVPEWVTNMDDEELPSPVNSDII

SEQ ID NO: 149092 - protein, 142 aa, Glycine max
  Coding DNA Sequence Number=SeqID_32314
MQIWKDKKKKKLRSVKDFIAASINTQGDALEAGITIEVGGDGTEGSQISSLPQEASSSSGPPWPCRTTTVHRIRPRHLLKPLSSSLFSQSKAEGSGGSAESGSSDSVQVPAAEVGDGESGATQAEGRQRVQGREETKYVGED

SEQ ID NO: 149093 - protein, 94 aa, Glycine max
  Coding DNA Sequence Number=SeqID_32315
MGDLEEVQEQVKADMSAVKDQMASMMEAMLGMKRLIESNVAIAAAANTAVEADPVQRDDFPQESFEDVFLENRGITHPFGTPTWKHHASAHGRT

SEQ ID NO: 149094 - protein, 107 aa, Glycine max
  Coding DNA Sequence Number=SeqID_32316
MKKIHGRVVQEAPPAPQPTAIPSLLFLLLRPPPWMLQAMEHPSGPTSSSLEPWSLLLLLLSSPQMSPLRQLAIATEPDTIEQGLDEDYIANVSTTQTAAWNPLFTQD

SEQ ID NO: 149095 - protein, 415 aa, Glycine max
  Coding DNA Sequence Number=SeqID_32317
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=93%, HitCoverage=94%, E-value=1e-165, Identity=70%"; Hit description =Putative CBL-interacting protein kinase 23
  Pfam annotation: Domain name=NAF; Domain location=323-367; Score =24.0; E_value=2e-05; Accession=PF03822.5; Description=NAF domain
  Pfam annotation: Domain name=Pkinase; Domain location=22-277; Score =343.1; E_value=4.8e-100; Accession=PF00069.15; Description=Protein kinase domain
  Pfam annotation: Domain name=Pkinase_Tyr; Domain location=22-275; Score=81.5; E_value=2.7e-21; Accession=PF07714.7; Description =Protein tyrosine kinase
  Pfam module annotation: Pfam domain module=NAF::Pkinase::Pkinase_Tyr; Domain location=323-367::22-277::22-275
MTSRSGQGSSGGGSSRTRVGKYELGRTLGEGNFAKVKFARHVETRENVAIKILDKEKLLKHKMIAQIKREISTMKLIRHPNVIRMYEVMASKTKIYIVLEFVTGGELFDKIARSGRLKEDEARKYFQQLICAVDYCHSRGVFHRDLKPENLLLDANGVLKVSDFGLSALPQQVREDGLLHTTCGTPNYVAPEVINNKGYDGAKADLWSCGVILFVLMAGYLPFEETNLSALYKKIFKAEFTCPPWFSSSAKKLINKILDPNPATRITFAEVIENDWFKKGYKPPVFEQANVSLDDLDSIFSDSTDSQNLVVERREEGPMAPVAPVTMNAFELISKSQGLNLSSLFEKQMLKIQGEKTGRKGHLSVATEVAPSLYMVELRKSEGDTLEFHKFYKNLATGLKDIVWKAEPIDEEKDG

SEQ ID NO: 149096 - protein, 86 aa, Glycine max
  Coding DNA Sequence Number=SeqID_32318
MEVVELLVQRRITFKEVGGEVEGLKVGVGGEKQHRSREVNVKANLEWERGGMVAGLERFVDFRVNKYYCYRKRELKTCVLSFCALQ

SEQ ID NO: 149097 - protein, 195 aa, Glycine max
  Coding DNA Sequence Number=SeqID_32319
  Homolog annotation: Hit_ID=Q1S4N4; Match level="QueryCoverage=24%, HitCoverage=13%, E-value=3e-09, Identity=50%"; Hit description =Ribonuclease H
MVSLWHDRWPSKGIVCHLFNDINIVNVNGHTPDGIYTALFAYRWLSRAHEFTLVNEKGEVVGFGHSKFQKISNTLFGLLIIEASQQICFELIAMLPLTLFISGVAARKNPLSFRLYRRLILVLAYIGGIYGGGILGSPTSPASVLGPIARLSFLRHVGGSLRHIGGICGGGMLGSSTSPASVLGVQLIYLLDNFT

SEQ ID NO: 149098 - protein, 124 aa, Glycine max
  Coding DNA Sequence Number=SeqID_32320
MTLKMTKNEKEDRGGVQVVIGLLRVDLDVDSGSAGFEMEAKNKLKIEDSTTESPTSVLEDKLFYGTMCASKEEVKLEEEVTANVKDDGTSLISKTMVEEEENLIEVGMKEEEAQCEEALDLNGT

SEQ ID NO: 149099 - protein, 244 aa, Glycine max
  Coding DNA Sequence Number=SeqID_32321
  Homolog annotation: Hit_ID=Q6Z542; Match level="QueryCoverage=39%, HitCoverage=30%, E-value=5e-18, Identity=46%"; Hit description=Zinc finger protein-like
  Pfam annotation: Domain name=zf-C3HC4; Domain location=117-184; Score= 25.1; E_value=0.00024; Accession=PF00097.15; Description=Zinc finger, C3HC4 type (RING finger)
MIKKRKTKQEEQNVQLNAKEPHFQLHFSLFLTISTFRVFNSRFVVPMSDHLVVFVDCLARPVPVDPVAQTTQVPFEPSPPPAVVDADAAGSSDTSPSEDCDDEGDDEEEQLIQMAECHICQEEDGVSNLETPCACSGSLKFTKPANAFAWIEGFEFCDFVVCYAHRKCVQHWCDEKGDITCEICHHSLGCPGIARVYLDGDWEGSGSPKWLFVFFPSILTLPHLMIIVLPLGIGTDCRPIRVLD

SEQ ID NO: 149100 - protein, 97 aa, Glycine max
  Coding DNA Sequence Number=SeqID_32322
MANSNNNISTPNNTFQTILTKFNLQGLDLVALSEEPEPNLEKKARCNYCEGLIKFENRAIAMWNHLDRCNKKAGNVSKKQKINFIHDKCFFSFIGKG

SEQ ID NO: 149101 - protein, 79 aa, Glycine max
  Coding DNA Sequence Number=SeqID_32323
MVMREKENEDASIKLAKNKPVPRMRNNRAHDLSEKLKLELKFLFLGAEKVKNVRGDSNNNNPCPEHGHVRFQLLCLACA

SEQ ID NO: 149102 - protein, 67 aa, Glycine max
  Coding DNA Sequence Number=SeqID_32324
MEVDEPWLGLWLPSHYRVDRGQVGFVADLGMAFVDDLVFFVDRVVVNEKGRYWLSNDIVGLVGNLAM

SEQ ID NO: 149103 - protein, 152 aa, Glycine max
  Coding DNA Sequence Number=SeqID_32325
MYKKMDSESFVRVSSNGTRVSSGGDRVFEEPSKKRMIFYVKAIGRLRSTIRIMLKIDKVTTIQVGGIRFKFVSSLILINRFNYEGLHFISFKCSRYGHKESMHVETVMTQGTSFDNVNIVEKQGKWSNSEAAPLVNVMEGAILNQPLKGGKP

SEQ ID NO: 149104 - protein, 74 aa, Glycine max
  Coding DNA Sequence Number=SeqID_32326
MSKESRPCELDVVGRQKECGHIDQMPHTSLLITVSTATSPKDLHFPDYWSGLKTSTLSGYGSALRCSRIRSGPQ

SEQ ID NO: 149105 - protein, 123 aa, Glycine max
  Coding DNA Sequence Number=SeqID_32327
MPISPCGRCLSPPARSCRHEIGKDHARKTPSGPGEVQQGPGVSSSDYGPLSVLWSARRLQQGAGRDTTAARGWPTAGNKRTTATSQAPQLIYKGLSVAYDPWPTSRRPSPKPKVARDLGYACI

SEQ ID NO: 149106 - protein, 73 aa, Glycine max
  Coding DNA Sequence Number=SeqID_32328
MPSVNGKVALGKLMMDRDTLGCSGQRGSWDLGELAIGDYPTFGALILRGKFTGLTLLFLTGSETMLFELGAGD

SEQ ID NO: 149107 - protein, 129 aa, Glycine max
  Coding DNA Sequence Number=SeqID_32329
  Homolog annotation: Hit_ID=Q0ZCB7; Match level="QueryCoverage=47%, HitCoverage=4%, E-value=2e-08, Identity=46%"; Hit description =Integrase
MVLDCLVFESWNGAIAQSQSLLLRNLLNWSLVPSFQPQVSMKLLSVLKDNNEVFGWITHDIKGLDPTLSTHKFNIEEGFPPKWLFQKRLNPNIMEVVKREDVKPTFKTNAHKVKVYYEGFQQLQNIVHH

SEQ ID NO: 149108 - protein, 529 aa, Glycine max
  Coding DNA Sequence Number=SeqID_32330
  Pfam annotation: Domain name=Transposase_23; Domain location=183-253; Score=12.1; E_value=5.3e-05; Accession=PF03017.5; Description =TNP1ENSPM transposase
MARTKKTGEMTTEAAKEIAEKIVSHFQLTITIMFEYFENAMYHCVFSVQDSFEEQATQGSFVPHGRQDVLTAAIGRPEHPGRVCAVGAGVTIKQYFGSAPRTSRNASSLPPDELQQLTQQIRDQLEEPITEKVTRQVMASFSQLQSQMQSQGPPEPLVGPGPFVPRVSTKGSCVDPSGNDPETGDSDRCGLYIEADPARLVVVGRVYEGSTLVHNTPLLPSQVKVSVDEVKDAHAAVPVPTAEVSLVGQALHTFLAWSTHLIKSLSNQVAVSPPKPPPKPNLEVDDPLYLMTLTIPELFLRPYQVRWDATVLGVVNPDFPLYIKHEDLSEIEHGGQCLSISVLQLWILHLTETCMRAGNSDIYGFLEPQSIQRSGQSQFESESYIKSWMQSSQCDVYLGAYLNGFHCSGHWQMVVILPKEHLVVWFCSLHNKPNNYLKGIINSAIKGLDDAPQPKSKAPARWIVVKCNRQKGTTECGYYVMHWMSTIILGSFRNNWKAYFNDPRPLEPERLKALRIQWAQFYLRVRDQA

SEQ ID NO: 149109 - protein, 117 aa, Glycine max
  Coding DNA Sequence Number=SeqID_32331
  Gene Ontology: Mol. function=RNA-directed DNA polymerase activity; Biological process=RNA-dependent DNA replication
MLWKGEALESFKPNRVDSDLWKPIQVGRNGPKLSHLAFANDLILFAEASLDQVEVITACLEFFYNSSGEKLNDDKTRIFFSHNVNGRVKVDISQAIGFQRTNDLGSTWESNFITGEF

SEQ ID NO: 149110 - protein, 69 aa, Glycine max
  Coding DNA Sequence Number=SeqID_32332
MNSTNANSTMWLQSWKCNPDVPQWISGKDDLHKHDLHNVVAVTEAQATLTQGERRRTIGFKRKEKEEER

SEQ ID NO: 149111 - protein, 109 aa, Glycine max
  Coding DNA Sequence Number=SeqID_32333
MEMQRKIKEKRNISRICQRHLRIFQEYVKGILEYSKNMSKHMGKEWTQPWLMGSEIYPEVHENPRAFFSNSSPIFLEPLTHGSSDWSLPREDCITTYRSNFKHKNGFRM

SEQ ID NO: 149112 - protein, 102 aa, Glycine max
  Coding DNA Sequence Number=SeqID_32334
MDRDIVGYSGWRGSKKLVELASGDYLAFGALIWHEKLTDLTLLRYYGNLCLYFGLEEPHHNLEFKLTLVGYDERDNVISYYMDPMSIAEVIKDKGDHYDMTF

SEQ ID NO: 149113 - protein, 64 aa, Glycine max
  Coding DNA Sequence Number=SeqID_32335
MVDIHIKSFTTEEDMVADGVTREVLDILNDEGDPTYNNMIFDRATAEKVFHTSHILKAYEEVSG

SEQ ID NO: 149114 - protein, 317 aa, Glycine max
  Coding DNA Sequence Number=SeqID_32336
MGVDKGHNLEDTVNAREKEVNASNLSTGKDDVSPNEISGKKDLQLSNDGMEDCFGSWMMDHVEGAVIEHEIEGDMIEEKSKENISINSSNVGPRDEELISKFDDPKAFKWHMSSGSFEGEASGVKVGPTSEYEKAETGIKEEEKSSDKEKEDMEIERIDGEQIQTEDVVDYCMPVQQEMVERSVQGHMVFMEIQCLEGGSLAVGGLIHSYEDVGFEEPKLTWKRGDLQVRLDRVLINQCWRLRFPRAKVSHLFHYKSDHPLLHVFLDVGIPMNQRRRPFRFRAAWLSHDGLASLVRDNWCNNMEWNAHLVEFTKTIK

SEQ ID NO: 149115 - protein, 516 aa, Glycine max
  Coding DNA Sequence Number=SeqID_32337
  Gene Ontology: Biological process=autophagy
  Homolog annotation: Hit_ID=Q4A189; Match level="QueryCoverage=50%, HitCoverage=50%, E-value=1e-122, Identity=85%"; Hit description =Beclin 1 protein
  Pfam annotation: Domain name=APG6; Domain location=144-493; Score= -47.0; E_value=2.3e-08; Accession=PF04111.3; Description=Autophagy protein Apg6
MKKGENKGRTRTFPVDPNVPRWVCQNCRNPLCIVGADSYADKFFNDPSRYGMQGSSIHVASSVLSTTKMDNSYVVLPKQKPQAQGNPPRPRGDAAAQPGKAMEESFVVVYKSESGTDGNAVHSSGTGADSGGHLPPHNSGFNSTITVLTRAFEIATTQMQVEQPSCLDCMRILSDKLDKEVEDVNRDIEAYEACLKCLEGEARDVLSEADFLKEKLKIEEEERRLEAAIEATERQNAEVNAELRELELKSSRFKELEERLNLVPKRVDPALPVVRCYLSFPMATAVGCHHIFQRSLDLVCLATCDPAQKASSGPDSVISSSFSSPLVAVWIRLVTRPSSSVLVQSSSRPPSCCLYTMSRGDHTECTFCKRIGHTWITCFHLFGFPNKTASKFKRVEAKFFDEEYQEYLRLKASRQAQPPLTSSISTACVSQSMDIQGPWVIDSGSSNHISGNASLFTSISSPKFPHLITMANESKALKHSVTWELVSLRPKKKVVGFRWVYAIKVGPNGEVDRLKA

SEQ ID NO: 149116 - protein, 443 aa, Glycine max
  Coding DNA Sequence Number=SeqID_32338
  Gene Ontology: Mol. function=RNA-directed DNA polymerase activity; Cellular component=exocyst; Biological process=RNA-dependent DNA replication
MVTANEVVKEGKRCQNPCILFKVDYEKAYDFVSWEFLTYMMSRMGFCSKWIQWIEGCLKSASVSILVNGSPSSEFLPQKGLWQGEPLSPLLYNIVAEALNGLMSQALEKRLYKGFLVGINKVEVSILQYADDMIFFGEETMENVRAIKAMLRAFELVSGLKINFAKSNFGAFGVPDQWKIVASNYLNCSLMSFPFTYLGIPIGANPRRSQTWDPIISKCERKLAKWKQKHLSFGGRVTLIKVPKKVVDKLVRLQRNFLWGGGHEQNKIAQIKWESVCMRKEDGGLGVKDINSFNLSLLWKWKWNLFQHQGELWARVLESKYGGWRNLNDAPRINSESIWWKDLKMVAQHPQYGQILKNSTLWKVGCRDKFKFWEDNWMGGVGTLIEKYPRLYTISSQQNQFIQHMGAFKDLGWEWEFRWRRPLFDNELDMAISFLKDVESHRI

SEQ ID NO: 149117 - protein, 406 aa, Glycine max
  Coding DNA Sequence Number=SeqID_32339
  Gene Ontology: Mol. function=RNA-directed DNA polymerase activity; Biological process=RNA-dependent DNA replication
HEKGKWEAEKTVRVMGKGALSSEKPRDQEARDTLGPISAIHTPDKKQYATFPKDAMGQQVTPTPPNMQGSEHMPERDREQKDHYLSSQQPTLEEVLLVNNKIQEAEKLWEMTKELRVTGGHVQRNNFGQQLEALWGDSDVRWEALPSVNSSSGILCIWGEKSFKLERKITGAGYIMLVGKWQHEAQTLNIINIYSLTSEERVGACNKGMKVSNSREFKEWIADLEVEEAPWVGRKFTWIRPNGTARSKLDRFMHRGWGGFVLKEKIKSLKDRIKVWNKDQFGDTLRKYKRIEEDLNKMEEESDDRQLTDQQLLAKKKLQQDLWEAAQAHESLLRQKARSRWIKEGDCNSRYFQLMINASRRNNCLKEVMIDGSWIEDLTSVKEEVRSHHKDMLVERFQEEEVKKAM

SEQ ID NO: 149118 - protein, 100 aa, Glycine max
  Coding DNA Sequence Number=SeqID_32340
MSENSSEEKNEGSIYSQEEDLLIRSKKKVKEGKSLINEGVRGVDGGSCPYKDIFLKHIEGDVVGDVVEIEKSDIVMEEESSVETEKESVYVRDGVEIIVT

SEQ ID NO: 149119 - protein, 769 aa, Glycine max
  Coding DNA Sequence Number=SeqID_32341
  Gene Ontology: Mol. function=nucleic acid binding; Cellular component= nucleus; Biological process=meristem development
  Homolog annotation: Hit_ID=Q6J738; Match level="QueryCoverage=92%, HitCoverage=94%, E-value=0.0, Identity=68%"; Hit description=AML5
  Pfam annotation: Domain name=RRM_1; Domain location=281-347; Score =55.1; E_value=2.3e-13; Accession=PF00076.12; Description=RNA recognition motif. (a.k.a. RRM, R
  Pfam annotation: Domain name=RRM_2; Domain location=670-743; Score =138.5; E_value=1.8e-38; Accession=PF04059.3; Description=RNA recognition motif 2
  Pfam module annotation: Pfam domain module=RRM_1::RRM_2; Domain location=281-347::670-743
MARVKSPSHILKKIYNRVSVSPFVVKLFPAMLVMQEPKRMIALNLQTGSWGDAMRQSFDPSSLGPSKIPSIKIPGKAGNGAWEALSGSDSYHASSDASLFSSSLPVLPHEKLNLNETANAYQSIDDISSGFKKLHQDAEGNGSLEDGDTHAIGPALPDDEEELLAGIMDDFDLSGLPGSLEDLEEYDLFGCGGGMELETDPQESLTVGISKLSFADSTVGSVLPPYSFPNGVGAVAGEHPYGEHPSRTLFVRNINSNVEDSELRALFEDNPSDKDINQGTLVVFNLDPSVSNEDLRQIFGAYGEVKEIRETPHKRHHKFIEFYDVRAAEAALKSLNRSDIAGKRIKLEPSRPGGARRNLMLQLNQELDQEESRSFRYQVSSPVANSPPGNWLQFNSPVEQNSMQTINHSPGSRIISPTTGNHLPGLASILQPQVSNAVKAAAIGNDLGRSSQGEHIFSGMNSSHGATFQSHSLPEPKFSQYRGALSSIGPSTSNGSSVETLSGPQFLWGSPTLYSEHTKPSVWPRSSVGHPFAASNGKSHAFPYSTQNSSFVGSSQHHHHHHVGSAPSGIGLGHNDGNYMVNAGGSVNPNTTIPRNISDNGSSNLRMRSSPRLSPVFLGNGPYPGLPPTTLESLADRARSRWIENNGSQVDSKKQFQLDLDKIRSGEDTRTTLMIKNIPNKYTSKMLLAAIDENHRGAYDFLYLPIDFKTFNGKKWEKFNSEKVASLAYARIQGKSALVSHFQNSSLMNEDKRCRPILFHSEGSEVGDL

SEQ ID NO: 149120 - protein, 374 aa, Glycine max
  Coding DNA Sequence Number=SeqID_32342
MAMLVGSANMDHLEASKWGASIQHDNLASKISEIGMLYDGQRIHSPPNVALVLQNIKQEVKSLDVDYLEEKTPYSTRRKLFADIHGVPRNRRERRERTKARQREGTCLSIAGNRKGYQQSYMRENWRDHKDVTSFYFTWFPDDATEEDLWGGGQTPIREEVGLVFGGLKMYANLPKFGRVRDRKSHQDVEGRSYIKQGEKENRDAYLQMKQGVSLDMKRGSYADVILGINYEQNRGIQQTRKATGHNHRVEDDILWDFDDNKSPKYIEDDMILLLGLTDDKARQLMDDENEDGTTMFHTLEKWNPGMRPANEEDGAGIGDLVEVDDDMEEPRKLDIGDMKQMKKMVACIGDLVEVDDDVEELQKLDMARILLKT

SEQ ID NO: 149121 - protein, 230 aa, Glycine max
  Coding DNA Sequence Number=SeqID_32343
  Gene Ontology: Mol. function=DNA-directed RNA polymerase activity; Cellular component=nucleus; Biological process=transcription
  Homolog annotation: Hit_ID=Q9LSZ5; Match level="QueryCoverage=84%, HitCoverage=83%, E-value=8e-26, Identity=35%"; Hit description =Arabidopsis thaliana genomic DNA, chromosome 5, P1 clone:MQM1
  Pfam annotation: Domain name=RNA_pol_Rpc34; Domain location=1-227; Score=-63.0; E_value=1.6e-07; Accession=PF05158.3; Description=RNA polymerase Rpc34 subunit
MSVLQGKRKRQVLLASTQSSSMNNEERAVYTIIRERKEMGIWQGDIKREKNIHIPDSLLKKTLKMLITKNLIKEVVNVHNKSKKLLMATDFEPSKEISGGEWYTDGKFDTEFIGALSDACLSNIRRRKVATCDGIVGWIRKVGSDVFPGGVSKGQVEQILKNLVMENKVQEVTSTGFGDFESVPVGEVCYRLVKKGAGGVGAMASIPCGVCPRIHSCTPDEEIGKLPYAA

SEQ ID NO: 149122 - protein, 40 aa, Glycine max
  Coding DNA Sequence Number=SeqID_32344
MSGKGLQHVRKSLSQYQRLRACLEIKWDTNWERGFVVYVK

SEQ ID NO: 149123 - protein, 51 aa, Glycine max
  Coding DNA Sequence Number=SeqID_32345
MDVRRRAKAKARSQIKVCSNTILYNLGTNNLLPVCEVPSQPSHHCNSVSNL

SEQ ID NO: 149124 - protein, 621 aa, Glycine max
  Coding DNA Sequence Number=SeqID_32346
  Gene Ontology: Mol. function=nucleoside-triphosphatase activity; Cellular component=membrane; Biological process=transport
  Homolog annotation: Hit_ID=Q84ZB2; Match level="QueryCoverage=93%, HitCoverage=93%, E-value=0.0, Identity=83%"; Hit description =Putative iron inhibited ABC transporter 2
  Pfam annotation: Domain name=ABC_tran; Domain location=432-597; Score= 147.8; E_value=2.9e-41; Accession=PF00005.17; Description=ABC transporter
  Pfam annotation: Domain name=ABC_tran; Domain location=93-311; Score =96.4; E_value=8.6e-26; Accession=PF00005.17; Description=ABC transporter
  Pfam annotation: Domain name=Miro; Domain location=95-201; Score= -8.8; E_value=0.039; Accession=PF08477.3; Description=Miro-like protein
  Pfam module annotation: Pfam domain module=ABC_tran::ABC_tran::Miro; Domain location=432-597::93-311::95-201
MVSDASKKKAAQKKAAAAAKRGGKAAAAAVMEASSKAANKVANGIADIQISDRTCTGVLCSHPLSRDIRIESLSVTFHGHDLIVDSELELNYGRRYGLLGLNGCGKSTLLTAIGCRELPIPDHMDIYHLTREIDASDMSALEAVISCDEERLKLEKEAEVLAAQDDGGGESLERIYERLDALDAATAEKRAAEILHGLGFDKQMQAKKTRDFSGGWRMRIALARALFMNPTILLLDEPTNHLGILSALERVPLVCPNNFYLSYAVIGWDDLEACVWLEESLKKFERILVVISHSQDFLNGVCTNIIHMQSKKLKIYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDMEMSALQFMIKEYPGNEEEKMRGAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGDIMEFKAHLKSKAGLSD

SEQ ID NO: 149125 - protein, 128 aa, Glycine max
  Coding DNA Sequence Number=SeqID_32347
  Homolog annotation: Hit_ID=Q8S8L5; Match level="QueryCoverage=85%, HitCoverage=90%, E-value=4e-12, Identity=41%"; Hit description =Expressed protein
  Pfam annotation: Domain name=Auxin_inducible; Domain location=21-120; Score=58.2; E_value=2.7e-14; Accession=PF02519.5; Description=Auxin responsive protein
MARLNVRSSSKRRVLDGVLKLKSVFEKLQKSLLLRRNKSSSSYYGDYDTTACVLEGHFAVIAEHEKETIKRFLVPLSYLRNSTFLGLLEQAAEEYGFDQHGALTIPCRPSELERLLLAQQRKGRERFF

SEQ ID NO: 149126 - protein, 589 aa, Glycine max
  Coding DNA Sequence Number=SeqID_32348
  Gene Ontology: Mol. function=nucleoside-triphosphatase activity; Cellular component=nucleus; Biological process=protein transport
  Homolog annotation: Hit_ID=Q9LZF6; Match level="QueryCoverage=96%, HitCoverage=85%, E-value=0.0, Identity=70%"; Hit description=Cell division control protein 48 homolog E
  Pfam annotation: Domain name=AAA; Domain location=255-416; Score =218.1; E_value=2e-62; Accession=PF00004.19; Description=ATPase family associated with various cellular activities (AAA)
  Pfam annotation: Domain name=AAA; Domain location=505-589; Score =29.1; E_value=1.3e-06; Accession=PF00004.19; Description=ATPase family associated with various cellular activities (AAA)
  Pfam annotation: Domain name=CDC48_N; Domain location=27-113; Score =125.0; E_value=2.2e-34; Accession=PF02359.8; Description=Cell division protein 48 (CDC48), N-t
  Pfam module annotation: Pfam domain module=AAA::AAA::CDC48_N; Domain location=255-416::505-589::27-113
MSHQVESSDSKSWKKDSSTSILERKKSPNRLVVDEAVNDDNSVVAMHPQTLKKLQLFRGDTILVKGKKRKDTVCIALRDENCEESKIRLNKVLRSNLRVRLGDAVSVHSCPDVKYGKRVHILPIDDTIEGVTGNLFDAYLKLVVMRSYYCLLWVWLGKKRDLVLVIIFLVQGGMRSVEFKVIEIDPGEYCVVARDTEIFCEREPVKREDEERLDEVGYDDVGCVRKQMAQIRELVELPLRHPQLFKSIGVKPPKGILLYGPPGSGKTLKARAVSNETGAFFFCINGPEIMSKLAGESKIDSIAPKREKTHGEVERRIVLQLLTLMDGFKSRAHVIVIGATNRPNSSPALRRFGRFDREIDIGVPDEVGRLEVLRIHTKNMKFSDDVDIERIAKDTHGYVGADLAAICTEAALQCIREKMDVIDLEDENIDAEVLNSMTVSNEHFHTALGTSNPSALRETVVEVPNVSWEDIGGLENVKRELQETVQYPVEHPEKFGKFGMSPSKGVLFYGPPGCGKTLLAKAIANECQANFISVKGPELLTMWFGESEANVREIFDKARQSAPCVLFFDELDSIATQRGSSVGDAGGCC

SEQ ID NO: 149127 - protein, 380 aa, Glycine max
  Coding DNA Sequence Number=SeqID_32349
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-31, Identity=29%"; Hit description= UPI00006A17C9 related cluster
GQHVLAFRGLHVLPFRGLHVLTARGLHALPFRGLHAFTFRELLVLAFRGLHPLAFRGLYVLILRGLHVLMFRGLPSSLSEDCTSSPSEGYTPLPSEDSTSSPSEGSTPTPSDDKMSSPLEDYTSSPSKDYTGLHALALRGLHVLGFRGLHVLAFRGLHLLPFRGLHVLAIRVLHALPFRGLHALAFEDYTVARPRLHRATRLYLQRTIRLRLQRATRPHLQRATCLRLQRATRPRFQRTISPHLQRTTCPHLQRTTRPRHQRTTHPRHQRAIRLRVQRTPRPRLQRTACPRLQRATRLRLQRTTRPPLLRTTRPRLHALALKDLHAIAFRGLHAFAFRGLYILAFRGLHVLAFRGLHVHPFRGLHVLAVRGLHALALEDY

SEQ ID NO: 149128 - protein, 173 aa, Glycine max
  Coding DNA Sequence Number=SeqID_32350
  Gene Ontology: Mol. function=nucleic acid binding; Biological process= DNA integration
  Homolog annotation: Hit_ID=Q1S9T9; Match level="QueryCoverage=98%, HitCoverage=16%, E-value=3e-31, Identity=35%"; Hit description =Peptidase S8 and S53, subtilisin, kexin, sedolisin; Integrase, catalytic region; Zinc finger, CCHC-type
CPSTTIDMRTPKEVWSGHPPNLNRLKVFGCVAYAHIRQDKLEPRVVKCLFLGYLKGVKGIRVVVLKTCTDRTQKDESKGLALEVEPKDKVDEVQDRIKRETKPPDRYRYANLIAFSLIARNEVLEDEPTSLKAVLASEEKDKWKTTMEEEMKSIYDKNTWEFIKKPIGSRVVN

SEQ ID NO: 149129 - protein, 761 aa, Glycine max
  Coding DNA Sequence Number=SeqID_32351
  Gene Ontology: Mol. function=sequence-specific DNA binding; Cellular component=nucleus; Biological process=regulation of transcription
  Homolog annotation: Hit_ID=Q94IB3; Match level="QueryCoverage=99%, HitCoverage=100%, E-value=0.0, Identity=55%"; Hit description=WRKY DNA-binding protein
  Pfam annotation: Domain name=WRKY; Domain location=323-381; Score =146.1; E_value=9.5e-41; Accession=PF03106.6; Description=WRKY DNA -binding domain
  Pfam annotation: Domain name=WRKY; Domain location=540-599; Score =148.6; E_value=1.7e-41; Accession=PF03106.6; Description=WRKY DNA -binding domain
  Pfam module annotation: Pfam domain module=WRKY::WRKY; Domain location=323-381::540-599
MAGIDDNVGLTGDWGLASPSPRTFFSRMFEEDSVTRSISEHSGSGRTGDLFSGHREPSETGKENMNDRAQDGDSGAQLTDVSFQTEQKSSSRGGLVERMAARAGFNAPRLNTESIRSTDLSLNPDIQSPYLTIPPGLSPTTLLDSPVFLANSLAQPSPTTGKFLFMANGIMRNSELSSDAPEKCKDNGFDDIYTSSFAFKRATDSGSFYHGAGRKMINPTTLPQQSLPGIEVSAQSENSFQSQSVDAVKAQTENKSGFRLQADFAESPPQKDNGIKMFSADQRAFDVVGGGNEHSTPIEEQVDEGDQRGNGDSMASGVGGAPSEDGYNWRKYGQKQVKGSEYPRSYYKCTHPNCQVKKKVERSHEGHITEIIYKGTHNHPKPPPNRRSGIGLVNLHTDMQVDHPEHVEPHNGGDGDLGWANVQKGNIAGAASWKHDNLEAASSASVGPEYCNQQPPNLQTQNGTHFDSGEAVDASSTFSNEEDEDDQGTHGSVSLGYDGEGDESESKRRKLESYAELSGATRAIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSEVHNGIGRLERPSLGSFNLPGRQQLGPSHGFSFGMNQSMLSNLVMSGLGHAQAKLPVMPVHSFLAAHQQQQQHQQQQNQQQRAANDLGFMLPKGEPNVEAIPERGGLNLSNGSSVYQEIMSRMPLGPHM

SEQ ID NO: 149130 - protein, 130 aa, Glycine max
  Coding DNA Sequence Number=SeqID_32352
  Subcellular localization annotation: CTP_CleavageSite=77; ConfidenceScore=5.65e-01
MASMLGLHLLLHLLYFTHYSTSSTGSDMGLNQFRFSTWSMTSSSRRSNDVTQSIFCPNFCKVVTSILQLDSMNLFVKARAWFNPITQGMAILIANTSTTFHRDERFGNTHAMYGKCNYEIEMPKETSFLN

SEQ ID NO: 149131 - protein, 109 aa, Glycine max
  Coding DNA Sequence Number=SeqID_32353
  Gene Ontology: Mol. function=transferase activity, transferring glycosyl groups; Biological process=metabolic process
  Homolog annotation: Hit_ID=Q9ZWQ3; Match level="QueryCoverage=65%, HitCoverage=21%, E-value=3e-14, Identity=66%"; Hit description=UDP -glycose:flavonoid glycosyltransferase
MNVTTERDSKRVREEWPQVLMGREKANTRRGNKAYSRHNSRGMFRLEFKGRGLVVRSWAPQVEVLSRGSVGAFARDGVEMNVAVAVEQREEDEFVSEEEVEKRLREVIV

SEQ ID NO: 149132 - protein, 98 aa, Glycine max
  Coding DNA Sequence Number=SeqID_32354
  Subcellular localization annotation: CTP_CleavageSite=42; ConfidenceScore=5.34e-01
MAIFWMFLGISSPRPTSGSPGPWNPFILKQLARLGKLIPSASCKRRVSGADSWRNRGKTQEEEDKKKKAKLRYRRIEPWIVSYIISLASLFITLMGPL

SEQ ID NO: 149133 - protein, 89 aa, Glycine max
  Coding DNA Sequence Number=SeqID_32355
MEPLMSTEAATAATDESAAAARTGISTFVTRREGNCMSHGGGDSLQRLSQQQWGAAPATTVEGGLRGERRQRQSEVMDLMTWCSIKKPC

SEQ ID NO: 149134 - protein, 72 aa, Glycine max
  Coding DNA Sequence Number=SeqID_32356
MAFSFKKPCRGRVSGVDSWRIRVKTQEEEDKKKKAKPRRRSIEPWIVSYIISLASLVPCATVVRLEGNRKRK

SEQ ID NO: 149135 - protein, 234 aa, Glycine max
  Coding DNA Sequence Number=SeqID_32357
  Subcellular localization annotation: CTP_CleavageSite=45; ConfidenceScore=5.20e-01
MYQYLPQQYQYSANISHSYYSPPYQPRVPNHLQRPPLNLPQNPPVAHPRPNTTPNTNQNTNQGRNFLEKKLVEFTPIPIPYADLLPYLLNNAMVAINPTKIPQPPFPRGYNSNVTCAHHGGVLGHFIEHCMTLKHKVQSLIDVGWLRFEEENRLWILTWSWQTTTTYTSEPYIGAMIGTMHELQANLGADKKSSHDRLKTQKGGLGKSYGNKKGKTIRGVLSKVLSQNPNCKSL

SEQ ID NO: 149136 - protein, 147 aa, Glycine max
  Coding DNA Sequence Number=SeqID_32358
MLSPMKDKGEDFESYENIKVRTLSPMKDKGDDFDSCENIKARTLSPMKDKGEDFESYENIKIKARTLSPMKDKSDDFESYENIKARTLSPMKHKAKDVESYESIKQRTLSPAKLKAKNVESYENIKQKTLSPAKLKAKNVESYEACQ

SEQ ID NO: 149137 - protein, 77 aa, Glycine max
  Coding DNA Sequence Number=SeqID_32359
MAYTHIPVEDSTSNSPQISASPYQLDFTLYASGSYNAQWNAPGLLHDKHTLRSSRILRKMEVEVVFVIGSAVDRLSG

SEQ ID NO: 149138 - protein, 84 aa, Glycine max
  Coding DNA Sequence Number=SeqID_32360
MSLNDTFICSQSFGKYEAIARTATPESEEVEVEEVGYKGFYGGGFGDFGEGGVYVGGVSFDEVEGFCGEACDGGGGGGAEAMHY

SEQ ID NO: 149139 - protein, 95 aa, Glycine max
  Coding DNA Sequence Number=SeqID_32361
MVEKRQICIYLKSNNVIPNLVALVSPLTHYYLSPPTIVHDDKKLLNCKIVFHGFAAPTTLSSFTICRNETPAPKPQPWHPHRFLSAPQHHGECGR

SEQ ID NO: 149140 - protein, 209 aa, Glycine max
  Coding DNA Sequence Number=SeqID_32362
MKQRDKLGQIQQHWDQALSRQKFPMSAMYHGLTEEHQRVPWRSVMCGNKARLRAVICLWLACHKKLSTKDRLRRFGMIQSSDCSICNCADESINHLFFNCSGTREIWGNILDWLGRRHDPREWDMELAWIIENTKGGASFESAKHVPSAKALTAIGSSSGNVFTTIPSLHQGLCPDTACPKTQKKVGNRVEALETLAQRVTLAQRAILA

SEQ ID NO: 149141 - protein, 275 aa, Glycine max
  Coding DNA Sequence Number=SeqID_32363
  Homolog annotation: Hit_ID=Q53KU9; Match level="QueryCoverage=34%, HitCoverage=10%, E-value=3e-11, Identity=42%"; Hit description =Probable protein kinase [imported]-Arabidopsis thaliana
EWDEQVIHRNITSSAVTLEPDMTPRLVGLKSLSGVKVVDFRQPEVLLVNEVHQFEGRKRPLEALADMGLNGEYNLKELMTLVSLGATRTHSDPKLRPTTRHIVSILGYIYLGLTENKRGYISCGSVLVEGTSTRFKENKGGGRSISTEKFLSKEESRIQAPTKPSKEQDKIQTPTKKANANGTVEEPEKYSKLRTSIGKKSAEVSNSGLPGNLVKVTLSNTKVTDASVQWASLPSSISKIGREVMKHRDAAQIAATEAMQEPIAAESLLQCLRYE

SEQ ID NO: 149142 - protein, 188 aa, Glycine max
  Coding DNA Sequence Number=SeqID_32364
  Homolog annotation: Hit_ID=Q8S2T0; Match level="QueryCoverage=99%, HitCoverage=28%, E-value=1e-56, Identity=56%"; Hit description=Golgi- localized protein GRIP
  Pfam annotation: Domain name=GRIP; Domain location=114-156; Score =69.9; E_value=8e-18; Accession=PF01465.10; Description=GRIP domain
MQKELEELKQRCKKLKEEHASFHDLADRMIEEKDYEISRLLDENKNLRQSLQSRPSILARQQAQREEELALSQRHILALQEEIEELERENRLHSQQEAMLKDELRSMERSKKREGVDMTYLKNVILKLLETGEVEVLLPVIGMLLQFSPEEIQKCQQAYHNSTDVPPPNPASDTSGSGLSLFSRFTFS

SEQ ID NO: 149143 - protein, 344 aa, Glycine max
  Coding DNA Sequence Number=SeqID_32365
  Gene Ontology: Mol. function=DNA topoisomerase (ATP-hydrolyzing) activity; Cellular component=chromosome; Biological process=release of virus from host
  Homolog annotation: Hit_ID=Q9FKX9; Match level="QueryCoverage=99%, HitCoverage=38%, E-value=4e-81, Identity=50%"; Hit description =Similarity to myosin heavy chain
MAKVLVAEKESRIAEMEAASTGEAARLRAAVESVKGELSHLKEEHEKERESWETASQALKAKLEIAESNCIRAEVEVAKIRSQLESEVSTQTRILNMRDAELLAAKEELKECQTVLVEHQHIFLFSLESMVCDNVMSYRIPVVGENPVSEISSLEKEFSSYKVRAHALLQKKDAELAAAKDSEQLKALEETLREVENEVLSITEERDRVLQDLQSAMANHEKEIAERDTALENVKQQIRSFEIKLDSANVKHLKEKEEWGLSLQNVEETWRIRCEAMKAENEATATKDMQKELEEFKQRCKKLKEEHASFHDLADRMIEEKDYEISRLIDENKNLRQSLQSRPP

SEQ ID NO: 149144 - protein, 452 aa, Glycine max
  Coding DNA Sequence Number=SeqID_32366
  Homolog annotation: Hit_ID=Q10S58; Match level="QueryCoverage=38%, HitCoverage=48%, E-value=6e-71, Identity=75%"; Hit description =Serine O-acetyltransferase family protein, expressed
  Pfam annotation: Domain name=Hexapep; Domain location=100-117; Score =5.1; E_value=35; Accession=PF00132.14; Description=Bacterial transferase hexapeptide (three rep
  Pfam annotation: Domain name=Hexapep; Domain location=118-135; Score =7.6; E_value=18; Accession=PF00132.14; Description=Bacterial transferase hexapeptide (three rep
  Pfam annotation: Domain name=Hexapep; Domain location=74-91; Score =14.9; E_value=0.28; Accession=PF00132.14; Description=Bacterial transferase hexapeptide (three rep
  Pfam module annotation: Pfam domain module=Hexapep::Hexapep::Hexapep; Domain location=100-117::118-135::74-91
LFLTFNDDVLRPQGYHALQVHRVAHALWHQGRKVLALALQSRVSEVFGVDIHPAAKIGEGILLDHGTGVVIGETAIVGNRVSLMHGVTLGGTGKEIGDRHPKVGEGALIEASATILGNIKIGEGAMIAAGSLVLKDVPPHCIAAGIPAKVISALQEHDPSLTMKHDASKDLFTHVATNFIDEKPNDCLGHSETAAFSTLLTVHAGVRSIPPPIPPPPALPAFKSIKLVYLLISLPLSFCSTVSPHSDLCCKRLIASGEGDTGGMMDTHAEDSARSEENFPDVTHHNEDGSNGNLILENGLSDGNQGPADTHDQLLQMVMDLRFQNDFLKSQFEGFKNVDSVHSDSNIQKGVGGLEDGESDIVKELKDKIQLLNKEFLEEKQTRIASEEALKHLQTAYSEAEAKAQELSEKLAEAQTKLDQEVKEREEKYLELDSKFNRLHKRAKQRIQEVQK

SEQ ID NO: 149145 - protein, 102 aa, Glycine max
  Coding DNA Sequence Number=SeqID_32367
MAERGHGMYYTPQTFAEYPTQMYQYPFQGHDTDTSAIQQSFGGFAETQAHFSWPIMTPSQQYHGPIPTPNALLGTQWNVPGQISNTGDLFGVDLRHAFFVLN

SEQ ID NO: 149146 - protein, 66 aa, Glycine max
  Coding DNA Sequence Number=SeqID_32368
MTMRMSKHSNGDSNEYNKETYLPITINVMCMPFDDRIPFEEYGAPTSFQLHEIAKNRSHGTIFDQQ

SEQ ID NO: 149147 - protein, 487 aa, Glycine max
  Coding DNA Sequence Number=SeqID_32369
  Gene Ontology: Mol. function=transferase activity; Biological process= DNA integration
MTVATLVGKLREYELELGRLKDEEEIDKKKKGLTLKTSTSYHEACHIKADCPTYLKKQQGGDKKQNKPFKKKRAYISWDDNDDSSSSDLSKEEEANLCLMANIDEDETKSNVSDSSSKSNTNYENLLDAFKELHEKVQRLTFVNKTLKGQVRWHIEKFSTLQKEVHDLRKEKVDLEKSIEDSICTCKYNNIASSSYYENCKHLQCKIDYLEKPLAKFTSGRANLDALLSSQKYVMGRTRLRHMTRDKSKHVSLTTKQEGFATYGDRNKGKILGYGNVGNFESSSYLEETRPLILEKQIVDTSKKSTKELPKEWSTSRNLSLDNIIGDINKGKFGMEKSKESPTPMPPHATLIWMKKESHLVVVKRVLKYIKGTLKVGLWHPKGASINLVEYSDSDYAGCKVDRKSTSDTCHFLRSALVSWHYKKQACVALSISEAEYIAAGGQSGSRCFARMLQPYGISIGLKEHSNPVTPKAYTPKSPSGPLPSDS

SEQ ID NO: 149148 - protein, 65 aa, Glycine max
  Coding DNA Sequence Number=SeqID_32370
MATGRRAGAEEEGNKKGSERLMEDFWSIFPNSTPLKNSIILQAHMISNSFLGLYQNIQKGYINQQ

SEQ ID NO: 149149 - protein, 394 aa, Glycine max
  Coding DNA Sequence Number=SeqID_32371
MLLQSYKEHTTRRVWIDEPKAVLKLVSHGGNVMPHPTQPTMKGDGTRRPPPSTFLLERITLNDMSCPLHMPITGHIVDHTDTSYTKKEITGQSLLNEIRPEKRKRTWEVIQVEFAEQNVWILTGKYYPNVDLNQVTKWGFELMIKELVVDLEILRIFMYLSDLGRCNEYACKEFALAFLYDQFAYASKQMRDYMTLLILKIYFMFYRHRCSSIIQAFLVEKRELGPFEDQAYSFGHIRVGTNMWLYLPKRVLRKFGYDEWEQHALSLGEVAPHRALWACSTNYMPWYYEHLHPYLILPQEGKALHNHDRFPIMQTTTTTNIDLSSKLEPVVAIDPRIRTMISLANVVFLGLNRRARISLGEHPTIAYNSIDPLELNSKKKKHIFPISLSSLSSI

SEQ ID NO: 149150 - protein, 58 aa, Glycine max
  Coding DNA Sequence Number=SeqID_32372
MATTSHFECVVPILVTTLVLAEFPKVEWVWKQCWDIWIHDPEFKTKWINEALTFPSIH

SEQ ID NO: 149151 - protein, 124 aa, Glycine max
  Coding DNA Sequence Number=SeqID_32373
DGDLDLNASPQALDKLLGHVFSFKVRIQSNFKNAVVLRYSKDLDLINAVLEMLPDSEACSKIDPSNVDCNDATHAESNHDPVAGLPLTPKKRMSSDETDDELRSSQISPAQLSSNKLTRHSHKS

SEQ ID NO: 149152 - protein, 178 aa, Glycine max
  Coding DNA Sequence Number=SeqID_32374
  Gene Ontology: Mol. function=transferase activity, transferring hexosyl groups; Biological process=carbohydrate biosynthetic process
  Homolog annotation: Hit_ID=Q9M8J2; Match level="QueryCoverage=64%, HitCoverage=32%, E-value=8e-33, Identity=61%"; Hit description =Putative glycosyl transferase
MERKVLTARCTSGSSNGEDYDSSPSITINVVMTLNTNYLRGTMLHHSILLLPRLHRRLGLVQGLSNGLGYLATDPIGVKPINLHLEVREGGLDAREEFRSIVMGGEEVEGQVLRARRMLKHGEHRGHGVAKVVGVEGHGYINGGEGRGVALLAIVKGGGLPEERELRGRTAGNNNLRC

SEQ ID NO: 149153 - protein, 249 aa, Glycine max
  Coding DNA Sequence Number=SeqID_32375
  Gene Ontology: Mol. function=DNA binding; Cellular component=oxygen evolving complex; Biological process=DNA integration
  Homolog annotation: Hit_ID=Q0KIN0; Match level="QueryCoverage=56%, HitCoverage=8%, E-value=2e-54, Identity=73%"; Hit description =Integrase core domain containing protein
MKQPTLFPLSRPYFHVSEQGIQDHAMPLWKFLAIESSLIYATLLLLKSSGVSTGLHAGRYRSCSIQGWSSYLPKEVCLHILEEAGLLNAKPVDTPMDPSVKLLPDQGEPISDQGRYRRLVGKLNYLTVTGPDIAFAVSVVSQFMNSPCQDHWDAIMRILKYIKCAPGKGLTYEDKGHTQVVGYVDADWAGSPSDRRSTSGRLSQGTLLQVLSTLVSCDQLADIFTKSLRGPRISFTCSKLGTYDLYAPA

SEQ ID NO: 149154 - protein, 59 aa, Glycine max
  Coding DNA Sequence Number=SeqID_32376
  Subcellular localization annotation: CTP_CleavageSite=24; ConfidenceScore=5.18e-01
MDLDGGCSSTVSTGAQAIPGRSTRHGARRAFGRFSTGNIELFPVEKLSIALLALYPNNL

SEQ ID NO: 149155 - protein, 188 aa, Glycine max
  Coding DNA Sequence Number=SeqID_32377
  Gene Ontology: Cellular component=membrane
  Homolog annotation: Hit_ID=Q10CF0; Match level="QueryCoverage=73%, HitCoverage=39%, E-value=2e-37, Identity=56%"; Hit description=LEM3 family/CDC50 family protein, expressed
  Pfam annotation: Domain name=CDC50; Domain location=14-161; Score= -83.3; E_value=1.2e-06; Accession=PF03381.6; Description=LEM3 (ligand- effect modulator 3) family  CDC50 family
MVPKWLSNLYVLYSKISHTVVGPFEVQHLIEHSTSNWMPDDFEVQYRYVKSRSDLQLLHGLGYNDTSSCKPLESSHNLPIVPCGLMAWSLFNDTYTFSRGPSELKVNRKNIAWKSDRDHKFGNHVYPFNFQNGTLIGGGKLDPSIPMVSESIPDPLIGHPPYYPHTKPKSTGCKGVYWEKLSPSLARE

SEQ ID NO: 149156 - protein, 147 aa, Glycine max
  Coding DNA Sequence Number=SeqID_32378
MARAVEVLKDKVPSFERRSDPEAYLKWEMKTKLVFACCQYSEVEKVKNIKGHMEEERKIRANERDKRLGWRSKQKREGISTSAKLTTSIHPTRSRELECVMYSGKWHMTSQRLGWKALTNELKEKEIKENELRENEMREKQVEGKRK

SEQ ID NO: 149157 - protein, 192 aa, Glycine max
  Coding DNA Sequence Number=SeqID_32379
  Gene Ontology: Mol. function=cellulose synthase (UDP-forming) activity; Cellular component=membrane; Biological process=cellulose biosynthetic process
  Homolog annotation: Hit_ID=Q1EG93; Match level="QueryCoverage=84%, HitCoverage=25%, E-value=7e-47, Identity=55%"; Hit description =Cellulose synthase
MANELETNTAKAQKTPEEGWTMQDGTLWPGNNSRDHPGMIQVYPLFLLTSLVLAINNWYKFQVRVSAVLTNAPFILNLDCHHYVNNSQAVREAMCFLMDPEVGRDVNMKGLDGIQGLTIFMAIALFLCPTYQDLHVAASPQRSPPMMSRTFKEMQKGKNLRPPFLISRNLTANKAQTAHRGMNPSRTKGAKG

SEQ ID NO: 149158 - protein, 177 aa, Glycine max
  Coding DNA Sequence Number=SeqID_32380
  Gene Ontology: Mol. function=protein serine/threonine kinase activity; Biological process=protein amino acid phosphorylation
  Homolog annotation: Hit_ID=Q39030; Match level="QueryCoverage=38%, HitCoverage=21%, E-value=1e-21, Identity=56%"; Hit description =Serine/threonine-protein kinase AtPK19
  Pfam annotation: Domain name=DUF822; Domain location=5-145; Score= -11.5; E_value=0.0015; Accession=PF05687.4; Description=Plant protein of unknown function (DUF822)
MGFKSGNERTIGGEKGEKESLQRRYTPTLGRKGITIFPKHCNNNEVLKALYTEAGWTIKEDRIIYRKHTKMNLLKIFLISYVYLYPIFSIIVDKSLKDEDGNLKKIKRVSIEDFEILKIVGQGAFAKVYQVMWKDRIMEKNHAEYMKAERDIWTKIEHPFVVQLRYSFQLYHQGLFR

SEQ ID NO: 149159 - protein, 198 aa, Glycine max
  Coding DNA Sequence Number=SeqID_32381
MDSFKQIWGSAEGCSSSESGWTMYIASPMQEDAAGCSNENDGYHDNIYAENRRKKQGAKVDEEESDDSMASDASSGPIHYHHAYAHSQGSHGTAASKKDKQDHGSKCSSKKNANKQEKKRVDSRKDVEVKQEKVKHCCKNVEFAVEISLVDYVCKSCIELVDRRNKKSGQGGVRDVAKRLRIILAQREEVFCMGKTFQ

SEQ ID NO: 149160 - protein, 51 aa, Glycine max
  Coding DNA Sequence Number=SeqID_32382
MIGKEGTLAPTTTSPFHSTPNITLTTPVNSGLYIGQSHCVKLHKAGLVNTI

SEQ ID NO: 149161 - protein, 38 aa, Glycine max
  Coding DNA Sequence Number=SeqID_32383
MKKCMMQLRNRRELSTTTHHQKKKALDEALLSSSESET

SEQ ID NO: 149162 - protein, 615 aa, Glycine max
  Coding DNA Sequence Number=SeqID_32384
  Gene Ontology: Mol. function=motor activity; Cellular component =myosin complex; Biological process=SRP-dependent cotranslational protein targeting to membrane
  Homolog annotation: Hit_ID=Q8SWQ7; Match level="QueryCoverage=79%, HitCoverage=51%, E-value=8e-16, Identity=20%"; Hit description=Non -muscle myosin II heavy chain
  Pfam annotation: Domain name=EzrA; Domain location=31-493; Score= -324.5; E_value=0.1; Accession=PF06160.3; Description=Septation ring formation regulator, EzrA
  Pfam annotation: Domain name=Prefoldin_2; Domain location=276-369; Score=-7.4; E_value=0.066; Accession=PF01920.10; Description =Prefoldin subunit
  Pfam module annotation: Pfam domain module=EzrA::Prefoldin_2; Domain location=31-493::276-369
MDTQSGEDTVDIDLGGVSSSGEAIGDLGDDIVTVLTGLELNVACFSEKVANFSNFVMHLETLGFELEGLDLEKEDNDVDNMDCVGKFLEFDLLCGVLGSEIVELDRFLDTLHAEIADSGERVASCKTWQDKLVDSEQCLRQSEMQFSEIKKQSASFERTLSSYKRGGNDNVEEGEIILEDDESLNVSTVINMQTPEQQRHVLRMLEKSLANEIDLEKNFIDSRQIEEKLKQKMVSLEQELILMEEEATDACERWLEADNASEILTGISKQLLGRLQISQFNLNGLSQRESELRTKLETCIEQLKEKDVVSDKIEQLNDKLILANSQVVALSVEVCSLEKQLKESECQVLNVKASADEYQKQYNILCSEVRDMEEVIVELKENVSNAESRANTAESLCKLLTETNDELNKQLALLKDGGGKSERVESLERQLRESDLQLQQAVASAEASQEKQSMLYSTIKDMEHVIKDLKSKVSKAESRADSAEEKCIILSESNSDLNEELNFSRSRLECLEGSLHQVEEAKVASAKDIGKQTKVFKNLVMQLAVERERLNKQLSSLASENKILVVKLKQTNKHPSQEVTVTFATDHEVGTSDFIIFDFYCYMWLMCKNLLIKLT

SEQ ID NO: 149163 - protein, 875 aa, Glycine max
  Coding DNA Sequence Number=SeqID_32385
  Gene Ontology: Mol. function=binding; Cellular component =intracellular; Biological process=metabolic process
  Homolog annotation: Hit_ID=Q6Z0F9; Match level="QueryCoverage=93%, HitCoverage=94%, E-value=1e-148, Identity=30%"; Hit description=PPR -repeat protein-like
  Pfam annotation: Domain name=PPR; Domain location=104-138; Score =22.5; E_value=0.0015; Accession=PF01535.11; Description=PPR repeat
  Pfam annotation: Domain name=PPR; Domain location=205-239; Score =30.3; E_value=6.8e-06; Accession=PF01535.11; Description=PPR repeat
  Pfam annotation: Domain name=PPR; Domain location=306-340; Score =24.4; E_value=0.0004; Accession=PF01535.11; Description=PPR repeat
  Pfam annotation: Domain name=PPR; Domain location=407-441; Score =26.5; E_value=9.6e-05; Accession=PF01535.11; Description=PPR repeat
  Pfam annotation: Domain name=PPR; Domain location=42-76; Score=15.6; E_value=0.11; Accession=PF01535.11; Description=PPR repeat
  Pfam annotation: Domain name=PPR; Domain location=442-476; Score=5.2; E_value=1.8; Accession=PF01535.11; Description=PPR repeat
  Pfam annotation: Domain name=PPR; Domain location=508-542; Score =40.3; E_value=6.6e-09; Accession=PF01535.11; Description=PPR repeat
  Pfam annotation: Domain name=PPR; Domain location=609-643; Score =46.1; E_value=1.2e-10; Accession=PF01535.11; Description=PPR repeat
  Pfam annotation: Domain name=PPR; Domain location=644-677; Score=9.3; E_value=0.6; Accession=PF01535.11; Description=PPR repeat
  Pfam annotation: Domain name=PPR; Domain location=680-714; Score =12.6; E_value=0.24; Accession=PF01535.11; Description=PPR repeat
  Pfam annotation: Domain name=PPR; Domain location=7-41; Score=1.5; E _value=5; Accession=PF01535.11; Description=PPR repeat
  Pfam annotation: Domain name=PPR; Domain location=746-780; Score=5.9; E_value=1.5; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=104-138::205 -239::306-340::407-441::42-76::442-476::508-542::609-643::644 -677::680-714::7-41::746-780
MNPTKKLTFSHILQKCSNLKALNPGKQVHTQMIVTGFVPTIYVANCLLQFYCKSSKMNYAFKVFDRMPQRDVISWNTLIFGYAGIGNMGFAQSLFDSMPERDVVSWNSLLSCYLHNGVNRKSIEIFVRMRSLKIPHDYATFAVILKACSGIEDYGLGLQVHCLAIQMGFENDVVTGSALVDMYSKCKKLDDAFRVFREMPERNLVCWSAVIAGYVQNDRFIEGLKLFKDMLKVGMGVSQSTYASVFRSCAGLSAFKLGTQLHGHALKSDFAYDSIIGTATLDMYAKCERMFDAWKVFNTLPNPPRQSYNAIIVGYARQDQGLKALDIFQSLQRNNLGFDEISLSGALTACSVIKRHLEGIQLHGLAVKCGLGFNICVANTILDMYGKCGALMEACLIFEEMERRDAVSWNAIIAAHEQNEEIVKTLSLFVSMLRSTMEPDDFTYGSVVKACAGQQALNYGTEIHGRIIKSGMGLDWFVGSALVDMYGKCGMLMEAEKIHARLEEKTTVSWNSIISGFSSQKQSENAQRYFSQMLEMGIIPDNYTYATVLDVCANMATIELGKQIHAQILKLQLHSDVYIASTLVDMYSKCGNMQDSRLMFEKAPKRDYVTWSAMICAYAYHGLGEKAINLFEEMQLLNVKPNHTIFISVLRACAHMGYVDKGLHYFQKMLSHYGLDPQMEHYSCMVDLLGRSGQVNEALKLIESMPFEADDVIWRTLLSNCKMQGNVEVAEKAFNSLLQLDPQDSSAYVLLANVYAIVGMWGEVAKMRSIMKNCKLKKEPGCSWIEVRDEVHTFLVGDKAHPRSEEIYEQTHLLVDEMKWAGYVPDIDFMLDEEMEEQDPYEGLKTTVCSERPSTWLWLAIVDLTESFGGGYRAI

SEQ ID NO: 149164 - protein, 364 aa, Glycine max
  Coding DNA Sequence Number=SeqID_32386
  Gene Ontology: Mol. function=isomerase activity; Cellular component =intracellular; Biological process=proteolysis
  Homolog annotation: Hit_ID=Q1T2S5; Match level="QueryCoverage=98%, HitCoverage=96%, E-value=1e-50, Identity=36%"; Hit description =Cyclin-like F-box; F-box protein interaction domain; Galactose oxidase, central
  Pfam annotation: Domain name=F-box; Domain location=1-48; Score=22.3; E_value=0.0017; Accession=PF00646.23; Description=F-box domain
MMNTYIPRELTEKILIKLPVKSLVSFKCVRKEWNNLISDPEFAERHFKYGQRAETLMITTPDVNHFKSINPIKSLHDESSYQSLSLSFLGHRHPKPCVQIKGSCRDFLLLESCRSLYLWNPSTGQNKMIQWSSNVSFITPGDSFLFCHGLGYDPRTKDYMVVVISFAEYDSPSHMECFSVKENAWIHIPLAADLHYKSCNLWNGRNLTGTFFNNALHWLVYKYEAYMHVVLAFDLVGRTFSEIHVPNEFEFYCLPHALNVFGESLCLCVMREMEQVETSIQIWELKQYTDHTSWTKTNTLIINDIWSGSALPVCNAENGCIVGSDPAGVLVKWNQDGEVEEQRSFDYIRDGYQVTAYRETLFTI

SEQ ID NO: 149165 - protein, 875 aa, Glycine max
  Coding DNA Sequence Number=SeqID_32387
  Gene Ontology: Mol. function=protein serine/threonine kinase activity; Cellular component=plastid chromosome; Biological process =positive regulation of transcription, DNA-dependent
  Homolog annotation: Hit_ID=Q6ZLH4; Match level="QueryCoverage=58%, HitCoverage=80%, E-value=7e-44, Identity=25%"; Hit description =Putative pentatricopeptide (PPR) repeat-containing protein
  Pfam annotation: Domain name=PPR; Domain location=190-224; Score=4.2; E_value=2.4; Accession=PF01535.11; Description=PPR repeat
  Pfam annotation: Domain name=PPR; Domain location=225-259; Score =36.8; E_value=7.6e-08; Accession=PF01535.11; Description=PPR repeat
  Pfam annotation: Domain name=PPR; Domain location=260-295; Score=1.9; E_value=4.4; Accession=PF01535.11; Description=PPR repeat
  Pfam annotation: Domain name=PPR; Domain location=296-330; Score =26.6; E_value=8.9e-05; Accession=PF01535.11; Description=PPR repeat
  Pfam annotation: Domain name=PPR; Domain location=331-366; Score=6.3; E_value=1.3; Accession=PF01535.11; Description=PPR repeat
  Pfam annotation: Domain name=PPR; Domain location=367-401; Score =37.2; E_value=5.6e-08; Accession=PF01535.11; Description=PPR repeat
  Pfam annotation: Domain name=PPR; Domain location=402-436; Score =31.8; E_value=2.4e-06; Accession=PF01535.11; Description=PPR repeat
  Pfam annotation: Domain name=PPR; Domain location=437-471; Score =48.7; E_value=1.9e-11; Accession=PF01535.11; Description=PPR repeat
  Pfam annotation: Domain name=PPR; Domain location=472-506; Score =34.3; E_value=4.3e-07; Accession=PF01535.11; Description=PPR repeat
  Pfam annotation: Domain name=PPR; Domain location=507-541; Score =41.0; E_value=4.2e-09; Accession=PF01535.11; Description=PPR repeat
  Pfam annotation: Domain name=PPR; Domain location=643-677; Score=1.8; E_value=4.6; Accession=PF01535.11; Description=PPR repeat
  Pfam module annotation: Pfam domain module=PPR::PPR::PPR::PPR::PPR::PP R::PPR::PPR::PPR::PPR::PPR; Domain location=190-224::225-259::260 -295::296-330::331-366::367-401::402-436::437-471::472-506::507 -541::643-677
  Subcellular localization annotation: CTP_CleavageSite=65; ConfidenceScore=5.82e-01
MASTPTPRPHFSSVPPRPSSNNNQRRYHSQNRSHHRRNNNQNRWSSSSTRYYSSPASSAGAGIPSAAATASAAFLSSLSPWLGAQKTRLAPEFSGRPSNRNPGKMNSGGPRAVPNNQQHSKAAEEVLHSLTNAGNDVAAIDNVLLNYRLYVAEDYVYLLKEFANTGDLLLATRTYNFAMSRATDNTFMGKLTSNMIRTLGRLKKIELALNLFEESRNRGYGNTVYSFSAMISALGRNDCFSEAVSLLRSMGNFGLEPNLVTYNAIIDAGAKGELPFEIVVKFLEEMIAAGCLPDRLTYNSLLKTCVAKGRWQLCRDLLAEMEWKGIGRDVYTYNTYVDALCKGGRMDLARHAIDVEMPAKNILPNVVTYSTLMAGYSKAERFEDALNIYDEMKHLLIRLDRVSYNTLVGLYANLGWFEEAVGKFKEMECCGIKNDVVTYNALIEGYGRHNKYVEVRKLFDEMKARRIYPNDLTYSTLIKIYTKGRMYAEAMDVYRELKQEGMKTDVVFYSALIDALCKNGLIESSLRLLDVMTEKGSRPNVVTYNSIIDAFRIGQQLPALECAVDTSFQANEHQIKPSSSRLSAGNFQDQKTGNNDEIMKMLEQLAAEKAGLMKKDKRSRQDSFYLVQIFQKMQEMEIKPNVVTFSAILNACSCCETFQDASKLLDALCMFDSHVYGVAHGLLMGHGQGLWNQAQTLFDELEHLDSSTASAFYNALTDMLWHFGQKLGAQTVVIEGRNRNVWKGGWSTECLDLHLTSCGAACAMVHTWLLELRTTVFGGQKPPPILSILTGWGKHSKVVGNGTLRKAVEALLNGIGAPFQISECNLGRFKSEGPEVTAWLRQPSTLNVLLLHDCIVYSQPVERNQTFNIPSLGAQ

SEQ ID NO: 149166 - protein, 558 aa, Glycine max
  Coding DNA Sequence Number=SeqID_32388
  Homolog annotation: Hit_ID=Q8H612; Match level="QueryCoverage=95%, HitCoverage=95%, E-value=1e-131, Identity=45%"; Hit description =Pentatricopeptide (PPR) repeat-containing protein-like
  Pfam annotation: Domain name=DUF247; Domain location=31-538; Score =282.9; E_value=6e-82; Accession=PF03140.6; Description=Plant protein of unknown function
MSYFRPTTPNASKTNFDEFRWVIQIRETLNEGHEDDDQFPVSIFNVPKPLMATDPDSYIPQQVAIGPYHYWSQELYEMERYKIASAKRFQEQLQSLKLEHMVDQLIRLEHRIRACYHRYLNFNGETLMWMMAIDASFLLEFLQVYTIHDGAMIPGVSSRMSHLMDYAGRRIAHNEILKDIVMLENQLPLFVLRKMLEFKFSSLELADDMLLSMLLGLLKEFSPFKVIEKDCPEVIVSECAHLLDFLYAMIVPKLEEQTDLVQLEDQHRDKEDSEKSIVNHVKQFLGEVWRVLSKLATALISLINKVLQCRAMKIITLLPWTVISNLPGVGLIKQPVEYLFFSQDKEATEEENGNLSSENVMNKPPLMEEIAIPSVTELSKSGVCFMATNGDISTIGFDVKTVTLYLPTIGLDLNSEVLLRNLVAYEASTASGSLVFTRYTELMNGIIDSEEDAKILREKGVILNRLKSDEEVANLWNGMSKSIKLTRVPFLDKVIEDVNQHYNGRMNIKVWKFIKLYVFASWKFLTFFAAIFLLFLMSLQVFCSFYKCNRRSQVSVTK

SEQ ID NO: 149167 - protein, 722 aa, Glycine max
  Coding DNA Sequence Number=SeqID_32389
  Homolog annotation: Hit_ID=Q5VR92; Match level="QueryCoverage=92%, HitCoverage=82%, E-value=1e-162, Identity=48%"; Hit description =Putative adaptor protein kanadaptin
  Pfam annotation: Domain name=FHA; Domain location=93-160; Score=62.9; E_value=1e-15; Accession=PF00498.16; Description=FHA domain
  Subcellular localization annotation: CTP_CleavageSite=44; ConfidenceScore=5.38e-01
MTNSMGPPPPKNPNPPDTAPPSMPPPPPRDSAEPSPPPPPPPARDSSNAPSQGVAVPYKIPPWGAAPCHQFYLEVLKDGSIIDKFDVFEKGAYMFGRLDLCDFVLEHPTISRFHAVVQFKRSGDAYLYDLGSTHGTFLNKNQVEKNTYVDLHVGDVIRFGRSSRLFIFQGPSDLMPPETNAKLMREVKMREAMLDKEASVRRARQEASLAEGISWGMGEDAIEEDEDDVEEVTWQSYKGQLTEKQEKTREKIIKRMEKIANMKKEINSIRVKDISQGGLTQGQQTQIARNEQRIMQILEELENLEETLNDSIRESMGARTGKLSHGKKKGAVEDEEEYLSDDDDDEFYDRTNKKPLHQKPGDNQVETADTLLDKREVITKEMDEKKELLMMEKNKILSKSESTTQDEVDDSLDAYMSGLSSQLVHDKSEQLEKELSTLQSELDRICYLLKIADPTGEAAKKRELKVHEPKPKKSEEVIITIKKKPPAEAQKSSEPCVKADNKNPPVETQKISETPVKEDGSIEGEKAGASTLGLDKSEPDSDRLKAENVVFAVPKPQWLGAVEDRVIDDTQQLLPSLHLHEIDESNQFVDYKDRSKILGSGDNANTSVESKIESAAGLIIRKRKQVETTATNSNDASQQLTSSTSGEKMAEDAVALLLKHNKGLYTNDDEERYEGQERRGPKRVLGPEKPSFLNNEMDYDSWVPPEGQSGDGRTSLNDRYGY

SEQ ID NO: 149168 - protein, 367 aa, Glycine max
  Coding DNA Sequence Number=SeqID_32390
  Gene Ontology: Mol. function=calpain activity; Cellular component =intracellular; Biological process=proteolysis
  Homolog annotation: Hit_ID=Q1T2S5; Match level="QueryCoverage=98%, HitCoverage=96%, E-value=3e-50, Identity=35%"; Hit description =Cyclin-like F-box; F-box protein interaction domain; Galactose oxidase, central
  Pfam annotation: Domain name=F-box; Domain location=1-48; Score=24.4; E_value=0.0004; Accession=PF00646.23; Description=F-box domain
MMNTYIPRELTEEILMKLPVKSLVSFKCVRKEWNNLISDPEFAERHFKYGQRTEKLMITTSDVNHFKSINPIKSLHDESSCQSLSLSFLGHRHPKPCVQIKGSCRGFLLLESCRTLYLWNPSTGQNKMIQWSSNVSFITRGDSLLFCHGLGYDPRTKDYVVVVISFAEYDSPSHMECFSVKENAWIHIQLAADLHYKSCKFWTGRNNLTGTFFNNALHWFVYNYEAYMHVVLAFDLVGRTFSEIHVPNEFEYKMYCQPHALNVVGESLCLCVTREMGQVEASIQIWELKQYTDHTSWTKTNTLIINDIWFGLFLPICNAENGCIVGSDHAGVLVKWNQDGEVEEQRSFDYIPDGYQVTAYRETLFTI

SEQ ID NO: 149169 - protein, 763 aa, Glycine max
  Coding DNA Sequence Number=SeqID_32391
  Gene Ontology: Mol. function=helicase activity; Cellular component =plastid chromosome; Biological process=positive regulation of transcription, DNA-dependent
  Homolog annotation: Hit_ID=Q10Q32; Match level="QueryCoverage=58%, HitCoverage=74%, E-value=1e-115, Identity=38%"; Hit description =Expressed protein
  Pfam annotation: Domain name=PPR; Domain location=318-352; Score =15.5; E_value=0.11; Accession=PF01535.11; Description=PPR repeat
  Pfam annotation: Domain name=PPR; Domain location=353-387; Score =16.2; E_value=0.091; Accession=PF01535.11; Description=PPR repeat
  Pfam annotation: Domain name=PPR; Domain location=425-459; Score =22.5; E_value=0.0015; Accession=PF01535.11; Description=PPR repeat
  Pfam annotation: Domain name=PPR; Domain location=460-494; Score =31.2; E_value=3.7e-06; Accession=PF01535.11; Description=PPR repeat
  Pfam annotation: Domain name=PPR; Domain location=495-529; Score =36.9; E_value=6.8e-08; Accession=PF01535.11; Description=PPR repeat
  Pfam annotation: Domain name=PPR; Domain location=530-564; Score =35.4; E_value=2e-07; Accession=PF01535.11; Description=PPR repeat
  Pfam annotation: Domain name=PPR; Domain location=565-599; Score =17.2; E_value=0.06; Accession=PF01535.11; Description=PPR repeat
  Pfam annotation: Domain name=PPR; Domain location=601-634; Score =16.1; E_value=0.093; Accession=PF01535.11; Description=PPR repeat
  Pfam annotation: Domain name=PPR; Domain location=636-670; Score =19.0; E_value=0.018; Accession=PF01535.11; Description=PPR repeat
  Pfam annotation: Domain name=PPR; Domain location=715-749; Score =29.9; E_value=8.8e-06; Accession=PF01535.11; Description=PPR repeat
  Pfam module annotation: Pfam domain module=PPR::PPR::PPR::PPR::PPR::PP R::PPR::PPR::PPR::PPR; Domain location=318-352::353-387::425-459::460- 494::495-529::530-564::565-599::601-634::636-670::715-749
MPLLLSFPFQFHTCLHKLCYCPFLSAPTRANAYVCTRDNYLGIVFLSQSKYSIGSTGFHESTPLSKDTVPTVVDFDLCEEEEEECNDDVVFEGSETVDTTPFVSKKEMPPWGEVEVEDDDDDDDIDVREEFGTSLVSKEKFPLWGEVELEDDDDDIEGTEEFRTSLVSKEELHSWGEVELEDDDDDRRVEGVKACFVSKKEFPPSGGAEEIIDGVDDDGEDNIERRANGDSYFVTKKELPALGEVEDDDDHDDFDNSVERRANGDVYFGAKKELPPWGGVEDDGHHDSRPVETTSSAPQGIGLLNEHGVLFLEELDENVLSNRILVLSRTNKIRSAMEYFRSMELSGLSPNIHACNSLISSLLRNGWFDNCIKVFNFTRAKGITTGHTYSLILMAHAKAHGCDSALGLFRELESECDVEKDFDAIVYNTMISICRDVDNWSEIERLWRSMKANGCAGTHVTYHLLINSFVRFDQSDLALYAYREMVQNGYEPDNNTLNVIISVCAKEGKWDAALSVFNKMLKVELKPNLVACNALINSLGRAGELKQVFQVYNTMKSLDLKPDAYTFNALLSSLNKADRHHKALELFEMIERDQTSQFNVHLYNTVLMSCSKLRLWDRAIEILWQMEASGLSDLTMSYNLVIRTCELARKPTIALQVYKHMVHQKCSPDIFTYLSVIRCCVRGDLWEELEEILNKPLTATFANHAEYYQTMPNATLYNAAVQGLCLRKNGDMANKIYTKMLESGFQPDVKTQVLMLRMIRKRR

SEQ ID NO: 149170 - protein, 461 aa, Glycine max
  Coding DNA Sequence Number=SeqID_32392
  Gene Ontology: Mol. function=transporter activity; Cellular component= integral to membrane; Biological process=transport
  Homolog annotation: Hit_ID=Q76IH8; Match level="QueryCoverage=90%, HitCoverage=89%, E-value=1e-166, Identity=63%"; Hit description=High- affinity nitrate transporter
  Pfam annotation: Domain name=MFS_1; Domain location=99-405; Score= -5.6; E_value=0.00057; Accession=PF07690.6; Description=Major Facilitator Superfamily
MDYVKYSFCLMLKALAADGNFIGIVNAFPYYKYNHTPCLSLTTLGLQFGNKTFIASVASPVVPTDTTANFALPVDSEHKSKVFKLFSMANPHMRTFHLSWISFFTCFVSTFAAAPLVPIIRDNLNLTKSDIGNAGVASVSGSLFSRLTMGAVCDLLGPRYGCAFLITLSAPTVFCMSFVNDAAGYITVRACEGTAAGWGNMGGGATQLIMPLVYELIRRAGATPFTAWRIAFFIPGWMPVVMGIMVLTLGLDLPDGNLGALQKKGNVAKDKFSKVRLFLLYMFEDTINIYVELLEMTWIFALLCGYSMGVELTTDNVIAEYFYDRLWNLWILQTLGGAFCIWLGRANSLPIAVLPMILFSIGAQAACGATSGIIPFISRRSLGIISGLTGAGGNFGSGLTQLVFFSTSKFSTSTGLSLMGIMIVCCTLPVTLVHFPQWGSMFLPPSKDINMSTEEYYYTAE

SEQ ID NO: 149171 - protein, 178 aa, Glycine max
  Coding DNA Sequence Number=SeqID_32393
  Gene Ontology: Mol. function=nucleotide binding; Biological process =fatty acid biosynthetic process
  Homolog annotation: Hit_ID=Q7XYX6; Match level="QueryCoverage=65%, HitCoverage=100%, E-value=1e-40, Identity=67%"; Hit description=AKIN beta3
  Pfam annotation: Domain name=AMPKBI; Domain location=81-170; Score =126.5; E_value=7.7e-35; Accession=PF04739.5; Description=5'-AMP -activated protein kinase, beta subunit, complex-interacting region
MADQVWHCHVCKCCLLRLTNKLASSLYALKTKLLFLQVYWNLTWVLIDAFTPLAAGLQFSKMSNSHSENHDEATVVGFEVPKSPDSSYNNVYPGNEDEARDPPMVPSHLQHTLLNYPANRDTAGTVPLPKNVILNHLYIENRESPRSVVALGFTHRFRSKYVTVVLYKPVQRRGNTSI

SEQ ID NO: 149172 - protein, 110 aa, Glycine max
  Coding DNA Sequence Number=SeqID_32394
  Gene Ontology: Cellular component=cell surface
  Pfam annotation: Domain name=DnaJ_CXXCXGXG; Domain location=9-64; Score=-36.6; E_value=0.04; Accession=PF00684.9; Description=DnaJ central domain (4 repeats)
MAVAVTVVGAAATLLVKRSKTSESTQIQFKVCEDCGGSGICSECKGEGFVLRKRSDESAEKARVQAKNMATRFTAGHSTQLLVPGFQRSGAIAQSALLVDPVQPVVAVES

SEQ ID NO: 149173 - protein, 40 aa, Glycine max
  Coding DNA Sequence Number=SeqID_32395
MSCLERCVEAALSGGCTLSPQGLLSVTAPYSTSRFQPLLT

SEQ ID NO: 149174 - protein, 42 aa, Glycine max
  Coding DNA Sequence Number=SeqID_32396
MKRVETWNESVAAFKRENGVLGMKDAVVPTTAQKPSSVTGEI

SEQ ID NO: 149175 - protein, 979 aa, Glycine max
  Coding DNA Sequence Number=SeqID_32397
  Gene Ontology: Mol. function=DNA-directed RNA polymerase activity; Cellular component=mitochondrion; Biological process=transcription
  Homolog annotation: Hit_ID=Q8L6J3; Match level="QueryCoverage=83%, HitCoverage=75%, E-value=0.0, Identity=70%"; Hit description=DNA -directed RNA polymerase 2B, chloroplast/mitochondrial precursor
  Pfam annotation: Domain name=RNA_pol; Domain location=668-979; Score =336.0; E_value=6.3e-98; Accession=PF00940.10; Description=DNA -dependent RNA polymerase
MWRHAAKHVCRGIIRQNFHPPRLLALSHGSVFSPKREVLLSSVAKLNCIARGDFQFQFGAKGYSGVAEAVSSTDVEEDGGTAVDEIQQLLWQEMNDEVESQLGEEEGAPIDEIQQLLLQEMNEEEKNELVEEEAAPVDGIQELLQGMKKEKQKKVVGYRWKNQGKGVGQSRYQELRRRQVKIETEMWEEAAKEYRELLMDMCEHKLAPNLPYMKSLFLGWFEPLRDAIVKEQEMYSEGKNRMAYAPYFVQLPADKMAVIAMHKLMGLLMTGNERVTIGTARVVQAACGIGDAIENEKKNIIMFECFLEAGMKSKMGSTLLATQTDSYLLKSHTHIDMYTIKVRIHKFLEKTKKKKGDRSNKNKAGESVADIKEEQKLRKKVIDLMKKQKLVAVRGLVKGKDDTKPWGAVIKTKVGSRLIELLLQTAYIQPPSDQLPDAAPDIRPAFVHSFKTVTKESIKASRRYGIIQCDPLILKGLERTAKNMVIPYMPMLVPPVNWTGYDKGGHLFLPSYVMRTHGVRQQREAVKRAPRKQLEPVFEALDTLGHTKWRVNKKVLSVVDRIWASGGRIADLVDRDDVPLPDEPDTDDEAKIKKWKWKYKSLQKENRERYSQRCDIELKLAVARKMKDEEGFYYPHNLDFRGRAYPMHPHLNHLGSDLCRGILEFAEGRSLGKSGLRWLKIHLANLYAGGVDKLSYEGRLAFTENHFEDIFDSADKPLEGRRWWLKAEDPLQCLAVCITLTEALRSSSPETFISHIPVHQDGSCNGLQHYAALGRDKLGAAAVNLVTGEKPADVYSGIAARVSNIMQRDAQKDPAVFRDALHARTLVNQVDRKLVKQTVMTSVYGVTYIGAREQIKRRLKERNAISDDKELFGASCYAAKVTLTALEEMFQGARGIMSWLGDCAKVIASENQPVRWTTPLGLPVVQPYRKLGKHIIKTSLQILTLQRETDKATPASILPAQQFCLAGWCGFICKMREYV

SEQ ID NO: 149176 - protein, 108 aa, Glycine max
  Coding DNA Sequence Number=SeqID_32398
  Subcellular localization annotation: CTP_CleavageSite=52; ConfidenceScore=5.63e-01
MGDFAKIFNRSSTFFVHSSVFNRLPSLMTDAWGANTFPVRKYNSRTFHFKVRRSLLFRFFRRFPQINVGGDSARIPFLEHAPASHASPSRRRVGCDSWRLHWGLFFES

SEQ ID NO: 149177 - protein, 141 aa, Glycine max
  Coding DNA Sequence Number=SeqID_32399
MTHPILTIALAATVKSHMCRGYPWFKTRHLFFKAWKFIYDHFGSVEENEGKGKTREVKEFWNLCSDDSDDTNKNVMAMLIDKGASDSVNDSSSSGNSVGGGDGCSGIVNGGCWSTSVRSNFTSDKNEKVEYRINENKTYKP

SEQ ID NO: 149178 - protein, 1000 aa, Glycine max
  Coding DNA Sequence Number=SeqID_32400
  Gene Ontology: Mol. function=nucleic acid binding; Cellular component= beta-galactosidase complex; Biological process=DNA integration
  Homolog annotation: Hit_ID=Q1RWN2; Match level="QueryCoverage=99%, HitCoverage=99%, E-value=0.0, Identity=34%"; Hit description =Peptidase S8 and S53, subtilisin, kexin, sedolisin; Integrase, catalytic region; Zinc finger, CCHC-type
  Pfam annotation: Domain name=rve; Domain location=410-559; Score =49.3; E_value=1.3e-11; Accession=PF00665.16; Description=Integrase core domain
  Pfam module annotation: Pfam domain module=RVT_2::rve; Domain location=635-800::410-559
MATNSNFEQVTIPRFDARKGTSLTEPQKADLEARRLKDLKAKNYLFEAIDRPILETILCKETFKDIWDSMKKKYQGSARVKRAQLQALRRDFETLAMKDDVTIVEKILRSLTPTFDYVVCAIEESKDIDAPSLDELQSSLLVHEQKMNRSSNLTAEEQALKASTNTHSTGRGRGRGRGRGRGQGRGRSNYRGNQQQQQEKERGRWSHQTSLTLNVLDVIEEEKEEVCLLTSCQEEKESSKSLWYLDTACNNHMSGDKSIFINLDVTYRDKVKLGDESRILIMGKGEVTILNKDNTKETIFNVFFVPDLKTNILSVGQLLENGYELFFKDGACKNQDSKSILIAEATKTGNRMFPLYLHITNHTCFSVKLKDDAWLWHFQYGHLNFGGLRTLQQKNMVTDLPKITPLSEICEECVVGKQHSSQFPKGKSWRAKDVLELVYSDIYGQNKSEASSTFKSFKACVENEARKTIQTLRTDHGGEYCSKEFDVYCEHHGIRRELTTTYTLQQNGVSERKNRTILNMAWSGRQPSVDHLKFFGCIAYAHIPDEKRKKLDDKAEKCVFVGVNETSKQPNSIIVDNEDVKELQLPVNTVLTSPNASQIAPETEISTTTNVGTIDATIVAQSKCLRRRPAWMSDYKLIDLPKGHKTIGVKWVFKTKLKENGEVDKYKVHLVAKGYKQEYEISNLHSCMDTWRNKYLLNNLGYIKIGHEHKVYRLKKALDGLKQAPRAWYTRIEAYFMKTEFKKSMMDEFEMSSVMHYFLGIEVVNASDGIFISQKKYIGEILDKFQMKDCNPTNTPTEFVLKLNKDHEGKKVDNTLYKQIVGSLMYLTATRLDIMKGGKSILFGFIDNDYAGDQDDRKSTSWYVFMFGTGAISWSSKNQSIVTLSSTKAEFVATTTCACQAIWLRRILEELKLKQREATTIVCDNSSIIKLSKNPVLHGRSKHIDVRFYFLRDLTNEGVIDLKFCISDEQLADTFTKSLKVSVFQNLRRLIGVCTLGDPI

SEQ ID NO: 149179 - protein, 145 aa, Glycine max
  Coding DNA Sequence Number=SeqID_32401
MKKPKTVVGGYTHEHGTAKTLRHDLICAFKPREVVTFPTLLFVGVRDNPRLSSIYRLFWRPRGAAVLALYVLTTSQIYDEYSFSTERCWDLNVVDIVSELVCISETVQIIENGKWPGNMDIHEHRHIMDMVKALALVGLVTHSSG

SEQ ID NO: 149180 - protein, 255 aa, Glycine max
  Coding DNA Sequence Number=SeqID_32402
  Homolog annotation: Hit_ID=Q2HTI9; Match level="QueryCoverage=24%, HitCoverage=19%, E-value=1e-24, Identity=87%"; Hit description=2OG -Fe(II) oxygenase
  Pfam annotation: Domain name=2OG-FeII_Oxy; Domain location=148-249; Score=58.8; E_value=1.8e-14; Accession=PF03171.10; Description=2OG -Fe(II) oxygenase superfamily
MGKANGCAIVLTLWGEKDGGLHIITGINSPKESKCLNDKLYDQKQSSKSFWNFKRSSSCGTGPRRSFCPLPLLSRSNSTGSSTPSVKRNPLSKEGVNNIKHKHSSTRLPHHSFVPNNYHHHQKPPLNYKTHHGSYGTSVRVNPVLNIPPAKLFAPEVIEDQVEGLGMHTDMSCITILYQDEIEGLQVRSNEGEWIDINPSEGTLVVNIGDMLQAWSNDFHAFVMPQVASTTLTTQEQGLSRISELFKHITRGSMA

SEQ ID NO: 149181 - protein, 99 aa, Glycine max
  Coding DNA Sequence Number=SeqID_32403
  Gene Ontology: Mol. function=nucleic acid binding; Cellular component= nucleus
  Homolog annotation: Hit_ID=Q05196; Match level="QueryCoverage=94%, HitCoverage=20%, E-value=1e-12, Identity=32%"; Hit description =Polyadenylate-binding protein 5 (Poly(A)-binding protein 5)
MSINDEKLKELIFEFGTITCCKVVLESNGHSKGYGFVAFSPVEDASTITPLPVGIPGYHPGTPRLAPPWLYFGQGAPGLVPPQPAGYGFPAAPLPRHAS

SEQ ID NO: 149182 - protein, 194 aa, Glycine max
  Coding DNA Sequence Number=SeqID_32404
  Gene Ontology: Mol. function=amino acid binding; Cellular component =membrane; Biological process=metabolic process
  Homolog annotation: Hit_ID=UPI00005F76B8; Match level="QueryCoverage =98%, HitCoverage=88%, E-value=8e-65, Identity=63%"; Hit description =COG1285: Uncharacterized membrane protein
  Pfam annotation: Domain name=MgtC; Domain location=1-118; Score =151.6; E_value=2.1e-42; Accession=PF02308.7; Description=MgtC family
MRAKEAGLRTHILVGIGSAMFMLVSKYGFADMLTNDHVALDPSRIAAQVVSGMGFLGAGTIIIQKQIVKGLTTAAGLWVTAAIGLVIGSGMYEIGIYGTVLALVVLETFRRISHWLIGRHHTLIVHLKAKSVPLVLLVLQRENLRYGHIAVVNRNEESGLCELSVEVTLSRRFPMHSIYDKVMEIKGVQSLEMF

SEQ ID NO: 149183 - protein, 244 aa, Glycine max
  Coding DNA Sequence Number=SeqID_32405
  Homolog annotation: Hit_ID=Q1S5C0; Match level="QueryCoverage=21%, HitCoverage=6%, E-value=4e-12, Identity=69%"; Hit description =Polynucleotidyl transferase, Ribonuclease H fold
MDMELMALQNYNTRSLMSLPVGKKPVGSKWVYKIKRRADGSIERYKARLVAKENVKRAKQKNKQVKLLPVNKREEKKKRHLEGVTRFATHELERALQNGTRVAEGLFPLGVIDHHYVKYLPHLAHRTQPAKDYSFIHSQTQHAIRRRRKLTSTVSKQKQKQKCPLPDIHATRPHTERNLTATTTTMLQRRLLKKIEKRKKKKKPRARMFLSHCLKNGLLKGAAFRFGLWESHDGVHLALLFQLH

SEQ ID NO: 149184 - protein, 121 aa, Glycine max
  Coding DNA Sequence Number=SeqID_32406
MKNVVLSMLAKISQIDATTKQLTARVEAQSLLIGALVLAVSKKGGVTEVIESANKAINMVIESAEADDMLKSDAAILLSEFQDLLTISRAVDSADDVINQQALEGITGVSSASDDDKQDPS

SEQ ID NO: 149185 - protein, 804 aa, Glycine max
  Coding DNA Sequence Number=SeqID_32407
  Homolog annotation: Hit_ID=Q8T1P1; Match level="QueryCoverage=41%, HitCoverage=34%, E-value=2e-74, Identity=43%"; Hit description =Similar to Arabidopsis thaliana (Mouse-ear cress). Hypothetical 80.1 kDa protein
  Pfam annotation: Domain name=APS_kinase; Domain location=187-279; Score=-101.9; E_value=0.04; Accession=PF01583.10; Description =Adenylylsulphate kinase
  Pfam annotation: Domain name=AT_hook; Domain location=66-78; Score =14.9; E_value=0.061; Accession=PF02178.9; Description=AT hook motif
  Pfam module annotation: Pfam domain module=APS_kinase::AT_hook; Domain location=187-279::66-78
MRMLRWMCGKTRQDKIRNEAIRERVGVVPIVEKMVENRLRWFGHVERRPVDSVVRRVDQMERRQTIRGRGRPKKTIREVIKKDLEINGLDRSMISQRVFELTRKENSTDVLKPEVEALSDFDVFKRNFVKRDGKSVPFELYKRRTSAFVRREIFLDIACDALAEYKYVGPNQRADLVLACRIRERKESVTVLLCGTSGCGKSTLSALLGSRLGITTVVSTDSIRHMMRSFANEKENPLLWASTYHAGECLDPVAVAEAKARRKAKKLAGVSHLVSKEDVTEGHNSSKSDIRTLETSSGPTELLSPKQMAIEGFKAQSEMVIDSLDRLITAWEERKESVVVEGVHLSLNFVMGLMKKHPSIIPFMIHITNEDKHLERFAVRAKYMTLDPAKNKYVKYIRNIRTIQEYLCKRAEKHLVPKINNTNVDKSVAAIHATVFSCLRRREVGEQLYDPVRNTVTVVYEEYRNQCAANSLSSKGMFQLIQRKGSSRNLMALVNTDGSVAKAWPVNLVDCNGKPVWCHGPENGVGHPMYGPLRIGKAEPINLQFGFYGISAWPSDGGTSRAGSVDESRADGTDTGSRYVSSCCSSPRMSDVAAKELKEDFSVHGSDEEIDDQPEVGSDEDFSDDGDKHALEEVKPNMTLTQNYVHWYFSVLLSNSWNLTRTMLFFRDGELSLGNELMLISIVLVVGSVDEESTKSDEEYDDLAMQDVLENGYWSDDEEYRIRVDGVTGELGSKMHGGYKYRRNLDLFLRSRSELAEPLFSYSSLLVEKNERKAKLRTRSLSIPALGKHRSAVNDPILSGAPHR

SEQ ID NO: 149186 - protein, 128 aa, Glycine max
  Coding DNA Sequence Number=SeqID_32408
MVIPKFKVLDFDKYKGTTCLKNHLKMYCQKMGEYAKDEELLIHSFQESLTGVAVTCTILIWLRIGCNYRTCAKKEHESFKEYAQRWRDLAAQVAPPMTKREMITVIVDTLPVFCYEKWWATHLQALLI

SEQ ID NO: 149187 - protein, 35 aa, Glycine max
  Coding DNA Sequence Number=SeqID_32409
MPTSSRRLGGSSSESYSLHPANVILLPRTMFTIIT

SEQ ID NO: 149188 - protein, 179 aa, Glycine max
  Coding DNA Sequence Number=SeqID_32410
  Gene Ontology: Mol. function=chitinase activity; Biological process =cell wall catabolic process
  Homolog annotation: Hit_ID=O81934; Match level="QueryCoverage=99%, HitCoverage=35%, E-value=8e-23, Identity=67%"; Hit description =Chitinase precursor
  Pfam annotation: Domain name=Glyco_hydro_19; Domain location=17-132; Score=-21.5; E_value=2.7e-08; Accession=PF00182.9; Description =Chitinase class I
MNLDTIFAFTLAYILLVITSSEFPSVAGDDGFYSFNAFLTAARSFGGFGTTGDFNTRKREVAAFLALTSHETTTNRVPGYGVITNIINGGIECGNGPTLGSEFPSVAADDVSSIISASQFEQLLKHRNDQICEGKNGFYSYNAFVTAARTFDGFGTTGDVNTRKREVAAFLAQTSHETT

SEQ ID NO: 149189 - protein, 93 aa, Glycine max
  Coding DNA Sequence Number=SeqID_32411
MRRGKKSNRYGKHEKSKGLDDRDGLKKWEKDVGRECGSEVMIKDVPLQHVEEPFQFPPINEKAKVALCPVPTLVVVGLIVRKENKGVIVLSLG

SEQ ID NO: 149190 - protein, 165 aa, Glycine max
  Coding DNA Sequence Number=SeqID_32412
  Homolog annotation: Hit_ID=Q0PGG3; Match level="QueryCoverage=48%, HitCoverage=35%, E-value=1e-18, Identity=46%"; Hit description =Vacuolar H+-ATPase subunit C
MAESRSEKRLKYRSGRVRTEELEQHKLVNLRVGVVADISNLIPAPTPVLCYRGKPESDPESGQSGFYLSKSRRVQFGSHGVVSLPIQNSASTLWNKLQEQISEHSFDTLLYRGVSHMIRRQIEELESVWHGDQWYPTMLPLKEIIDGIHGQVAKNEDDLKVIHVS

SEQ ID NO: 149191 - protein, 97 aa, Glycine max; identical to SEQ ID NO: 127786
  Coding DNA Sequence Number=SeqID_32413

SEQ ID NO: 149192 - protein, 300 aa, Glycine max
  Coding DNA Sequence Number=SeqID_32414
  Homolog annotation: Hit_ID=Q1S065; Match level="QueryCoverage=95%, HitCoverage=95%, E-value=2e-25, Identity=31%"; Hit description =Arabidopsis conserved protein
  Pfam annotation: Domain name=DUF241; Domain location=58-297; Score =176.6; E_value=6.1e-50; Accession=PF03087.5; Description=Arabidopsis protein of unknown function
METISKFPCSHQPVRSISFPTRVHPVSQRIEALLNHLKPHHSQPFSSTTCFEAETIQSDLVALSELYNCMEELFHSPQSQQTLLRYQDGKLVEEALCGSVTLLDTCESARDLLLVLKEHMQTLHSAVRRRKGYSNIESIISAYESFKKKAIAKQRGQLKRMKNKVDSFSLLDQDQQLAFLARVIKEASAITISILHSLLVFLSMPTIGTKGSSLISKLKPTVLFSSQKEQKNTNGVADLNNVLCSLLRREKNGDSSGEFQRTQTVLETLNVNIGGLEGGLDCIFRCLVKNRVSFLNMLAH

SEQ ID NO: 149193 - protein, 609 aa, Glycine max
  Coding DNA Sequence Number=SeqID_32415
  Gene Ontology: Mol. function=methyltransferase activity; Cellular component=chromatin; Biological process=chromatin assembly or disassembly
  Homolog annotation: Hit_ID=O50037; Match level="QueryCoverage=94%, HitCoverage=78%, E-value=1e-163, Identity=48%"; Hit description =Chromomethylase
  Pfam annotation: Domain name=BAH; Domain location=96-188; Score=29.1; E_value=1.6e-05; Accession=PF01426.8; Description=BAH domain
  Pfam annotation: Domain name=Chromo; Domain location=351-407; Score =59.4; E_value=1.2e-14; Accession=PF00385.14; Description='chromo' (CHRromatin Organisation MOdifier
  Pfam annotation: Domain name=DNA_methylase; Domain location=351-607; Score=-129.5; E_value=0.0034; Accession=PF00145.8; Description=C-5 cytosine-specific DNA methylase
  Pfam module annotation: Pfam domain module=BAH::Chromo::DNA _methylase; Domain location=96-188::351-407::351-607
MAKKRSASDATDDAQNDTVSLLPSQRKKPKHSAPNPDACFVGKPIPSAEARAKWPHRYPSEVKKKAPARSSEEVTSENSEVMLARCHYRQAKVDGVVYNLYDDAYVKAEDGKPDYIARIVEMFETVDKEQCFMAQWFYRAEDTVIKNHGDLVDKKRVFISDVKDVDLASKKAKLPFCDYYYDMKYTVPYLTFSNLVNETVKTESDASSTISSESGSIGCVNNANLAKRKTTQNNSSGSSQWTLLDLYSGCGAMSTGLCLGASLAGIKLVTMWAVDINAHACKSLKLNHPETHVRNEPAEDFLNLIKAWAKLCEEFALLGSERSDSDPDMDEDENEAVQKEESGNQSDLEEFEVEKLLAVCYGDPNGVKKPGLYFKVRWLGYDSSYDTWEPIDGLSDCKEVMKDFVTKGYKKRLLPLPGDANFICGGPPCQGVSGFNRFRNAEAPLEDTKNKQLLVYMDIIDFLKPKYVLMENVVDILKFSGGYLGRYAIGRLVAMNYQARMGMMAAGSYGLPQFRMRVFLWGARPTEQLPPYPLPTHEVVSRGFVPTEFEEITVAYDKKDTCQLAGALLLDDAISDLPPVTNDENQDERNYGAPARTEFQRYIRLKKNG

SEQ ID NO: 149194 - protein, 299 aa, Glycine max
  Coding DNA Sequence Number=SeqID_32416
  Homolog annotation: Hit_ID=Q1S066; Match level="QueryCoverage=95%, HitCoverage=95%, E-value=1e-23, Identity=29%"; Hit description =Arabidopsis conserved protein
  Pfam annotation: Domain name=DUF241; Domain location=54-296; Score =163.9; E_value=4e-46; Accession=PF03087.5; Description=Arabidopsis protein of unknown function
MVGSHTAKEFHYHVRSITLPCRLHPSLSEIEKELKRLKTWELASSHSQTEGIKAGLTWVEELYNFVEELVGCPLTQQALLRCDGKHVEKPLDMSVCLLDMCGSARELLSLMKENVLDLQSALRRKGVNSRVNSQICAYICFRKKARKDITERLKALKTMESGFKSYSCPLLLDLDHHLLMVISVLREISKINISFFRKLLLYMCTPVLKNNTGGWSLFTRIVSSGSDKQKRVISEMGDIDNVLCTFHGCFKKIDTKTDVQIMKRRLGELEGSIRELEAGLDCRFRCLIQQRVFLNLFTS

SEQ ID NO: 149195 - protein, 224 aa, Glycine max
  Coding DNA Sequence Number=SeqID_32417
  Gene Ontology: Mol. function=transferase activity, transferring glycosyl groups; Biological process=metabolic process
  Homolog annotation: Hit_ID=Q2PEP3; Match level="QueryCoverage=94%, HitCoverage=49%, E-value=2e-45, Identity=46%"; Hit description =Putative glucosyltransferase
MVELAKLLETHSYSITILFTTGFHDHPSVDAYNHRISTSNPSISFNHLPHITPTITSTTVSFAANGFDFIKRNTSNVATTLTQISKSTTTIKAFVIDLFCTTAMEAASSLGIPVFYFFTSGYGRGGTARDGKRAAEGGEHAATHILEREDPAYWDMLQFRTRLPKARGIIVNAFEELEPVAVSAVADGACFPDANEAPVVYYVGPLIAEPQQSGPYFELVFFIQ

SEQ ID NO: 149196 - protein, 292 aa, Glycine max
  Coding DNA Sequence Number=SeqID_32418
  Homolog annotation: Hit_ID=Q1S066; Match level="QueryCoverage=98%, HitCoverage=96%, E-value=9e-37, Identity=30%"; Hit description =Arabidopsis conserved protein
  Pfam annotation: Domain name=DUF241; Domain location=48-289; Score =223.2; E_value=5.8e-64; Accession=PF03087.5; Description=Arabidopsis protein of unknown function
MTNKFHVRSNSFPAVSHPSTIRMEEELSNVKTWEATSTSTSTSKSIGIGLSLLQDLHTCLEGLLNMGSTQKLISNHQGEKCMEELLDGSVRILDICGITRDTMLQIKENVQSLHSALRRRKGDSSIEKIIAQYNFFSKKMKKIAKKLITSLKQMESKFGVSPLLNQDQQLVALVRVIREVIVMNMSIFQSLLSFLAVPASKSKATKWLLVAKLMHKGVTACDENQVNSNELLCVEASLSTLVSEGTNVAKMQGAHERLEALENAIESIENGLEIVFRRMVKTRASLLNIMTH

SEQ ID NO: 149197 - protein, 198 aa, Glycine max
  Coding DNA Sequence Number=SeqID_32419
MTSASSTASSKLRFPAIRQPLILQFKAAFHCDKDAIEIPDFYQRQWLPNYPEIVEFKYDGATYEIQARQHKGKLYFADGLTRMRTELQIYESVIINFLACDHHSKFDLHFTPPLHQQTCKNRRATRKHIWTYEITQSMLGAPYPLGIADKYITQPWYKFLQEGDFSHADELSFYYRRAEKIWEVVIRCAIDWDDSDID

SEQ ID NO: 149198 - protein, 216 aa, Glycine max
  Coding DNA Sequence Number=SeqID_32420
  Gene Ontology: Biological process=nitrogen fixation
  Homolog annotation: Hit_ID=Q9M2C3; Match level="QueryCoverage=84%, HitCoverage=89%, E-value=4e-39, Identity=48%"; Hit description =Nodulin-like protein
  Pfam annotation: Domain name=DUF125; Domain location=49-216; Score =191.2; E_value=2.5e-54; Accession=PF01988.9; Description=Integral membrane protein DUF125
MASLDDHKTNEEISINHVEIPIHAIGVEPKPNQEVKERRNIDYSQRAQWLRAAVLGANDGLVSVASLLMGVGAVKENITAMLLAGFAGLIAGACSMAIGEFVSVYTQYDIEIAQIKRDKENNNIGEEAQREKLPNPFQAALASALAFSVGAVIPLLAAAFIRNYKIRLVVVAVVASLTLLLFGGVGAVLGKTPVRKSCIRVLLGGWMAMTITFGHQ

SEQ ID NO: 149199 - protein, 290 aa, Glycine max
  Coding DNA Sequence Number=SeqID_32421
MLLKTPWHPTINHNVLVSINEVDNVVHIVEETCYSLKRCRCNRGYLEGSSDEISSDESGEEMSLLSGKTLHVGVSDDTQVVGVEKGEQTRNREKNLWSGGQCNEKEPMDNNQEPLICGPTNLRSSDSVPRLGDATIHFFDGVQIPTRVPAGKYGKQQQRGKISGEKDNKVDAIEGSVVIGGEKTESRDDNGKHWEERGPLMNQNFELKEVQLLHSSSSSSPPIFFATIATIVAVFRRKVWVFAFVLLLRVCASSSRFYFFFEVSLSFAFWFLPAITENVVGKLLGCLRIT

SEQ ID NO: 149200 - protein, 153 aa, Glycine max
  Coding DNA Sequence Number=SeqID_32422
  Subcellular localization annotation: CTP_CleavageSite=64; ConfidenceScore=5.31e-01
MSDPYIPIGSTGLQVSSGDISTAGITNGLKSASASNPYSFSFPFATNVSAISTNKIDILLDTVVFNVKKNAETIIVVPYRLTYSTSAPVDPSTDPALSLLMESCKSRAPLRMSYSVTLYLRLVSWTGYHPTSSGTFSIACPSSIADLLGNISN

SEQ ID NO: 149201 - protein, 372 aa, Glycine max
  Coding DNA Sequence Number=SeqID_32423
  Homolog annotation: Hit_ID=Q1T0R3; Match level="QueryCoverage=35%, HitCoverage=80%, E-value=9e-14, Identity=33%"; Hit description =Hypothetical mitochondrial protein atmg00310
MQPACNSAGGLLCIWNEEAFKVEKKMRGNGFIYLKGAWAADGAKVIIVNIYSPCDIVLKRNLWKQIRQLRTANIGELWSILGDFNNVRRPSERVGISQRMQDESIVKEFNDWIAELEVEDVLCVGLKVHLVLQKGAKEDGRQVGKATDVVLVGRKPRSEEDFLGELGNNMYAKGGRGPGYQGFEKVQLCFTWEMVLELVSSSRDLSFICNQAEEGSWFNNNIKWKVGGGNVAEGEVSKTVPDFSTIYSTNGDNKKCRLGMTTAVEEGLVVQVQQQVTWTWGGDSSGKYSVGNAYILLNRVVEINDASCSFCRSHEEDASHLFSSCDKVLLLWWESMSWINTVGAFSETPKNHFLQFSNCNSDGFRGQRWQSW

SEQ ID NO: 149202 - protein, 305 aa, Glycine max
  Coding DNA Sequence Number=SeqID_32424
  Gene Ontology: Mol. function=voltage-gated chloride channel activity; Cellular component=integral to membrane; Biological process=chloride transport
  Homolog annotation: Hit_ID=Q8RXR2; Match level="QueryCoverage=79%, HitCoverage=30%, E-value=6e-90, Identity=71%"; Hit description =Chloride channel protein CLC-f
  Pfam annotation: Domain name=Voltage_CLC; Domain location=8-289; Score=-108.9; E_value=3.3e-06; Accession=PF00654.10; Description =Voltage gated chloride channel
MTSAIFRYAIRHIFMADFLLSAMNRHPPLTTLIPIIALPLRADVLVAALYDASFSLSGFNAPVAGCFFAIETVLRPLRAENSPPFTTAMIILASVISSTVSNVLQGIQSAFTIPEYDLKSAAELPLYLILGMLCGVISVALTRLVAWFTKLFKTIQDKFGIPTVVCPALGGFGAGIIALKYPGILYWGFTNVEEILRTGKSASAPGIWLLAQLVFAKVIATALCKGSGLVGGLYAPSLMIGAAAGAVFGGFSAEVINSAIPGNTAVAQPPAYALPGPHKEKSTICQFRNIKGLTMEDDIISELPD

SEQ ID NO: 149203 - protein, 67 aa, Glycine max
  Coding DNA Sequence Number=SeqID_32425
  Gene Ontology: Mol. function=nucleic acid binding
MTLQFVDHSITRPYSVVVDVLVKVRQFTFPMDFVIMDIEEDVEILLILGRPFMLTAKCDTLYPSHIY

SEQ ID NO: 149204 - protein, 178 aa, Glycine max
  Coding DNA Sequence Number=SeqID_32426
  Gene Ontology: Mol. function=RNA-directed DNA polymerase activity; Biological process=RNA-dependent DNA replication
RVHLLGLLTENKRGYISCGSVLVEGTSTRFKENKGGYIPCGSLLDTVFLFDEECLKAFNTLKTSLVSSPRKGRVFHAIYYVRKVLNNAQLNYATTEKEMLAIVYALEKFRSYLMDPVATRVLPYPNFLQGPLFVSMRPSFDHFKMFNTYHRGIRKVLGCFREKPAKNMKMGVYLANWG

SEQ ID NO: 149205 - protein, 124 aa, Glycine max
  Coding DNA Sequence Number=SeqID_32427
MAELRSGFLKKCHRIAVAWRVEDGGAMADMADMAARRKMAEFVLFFWSAVGVGLTRPNPTRATSEPIDDPCNQPRQQPHVTRCTQQPAATTHGVNGGDEHGSDDPQRERRRRARRERRQRARRR

SEQ ID NO: 149206 - protein, 170 aa, Glycine max
  Coding DNA Sequence Number=SeqID_32428
  Homolog annotation: Hit_ID=Q1SKA8; Match level="QueryCoverage=64%, HitCoverage=43%, E-value=9e-07, Identity=29%"; Hit description=Zinc finger, CCHC-type
  Pfam annotation: Domain name=zf-CCHC; Domain location=95-112; Score =8.6; E_value=0.038; Accession=PF00098.13; Description=Zinc knuckle
MSLATLFGKLQDHEMELMRLHQHEENNKKREGIALRASSSSIQEENDKKDLTEIEEDDDFRFFMKRFNKFLRNKRNQKKSNINPKKKREDSSLAPKFYECDQPGHMRFDCLVFKRRMEKSNKRNFKEKNEKKAYITWEDNDMDSSSDSKNEIINLGLMAKDYESGEELTH

SEQ ID NO: 149207 - protein, 60 aa, Glycine max
  Coding DNA Sequence Number=SeqID_32429
MACLQVGGDLDVGDGGERREDMYKKQKELKMICGARSKDENRMFKNFKLKRKEIITSPFA

SEQ ID NO: 149208 - protein, 226 aa, Glycine max
  Coding DNA Sequence Number=SeqID_32430
AIDVVEEAKVNDLQHCPIYLEAIFNDAKAIANLAYGGGVEGECSPRKLDPGVPNSFSNETNRPSHGLFLLIVTTITALTSLNLNLASTSAATATLWFCGVSQRVFEGINDFMYELVDGRGEFVTWDLDGDLNMHLAKAGAVYNKTMRLYGIACIDAYFCGSSSSSFTSLETLYFSNMKEWEEWECLKRLVIRDCRQPMASAPLALKIHELELEDYGKLQFDYHLTF

SEQ ID NO: 149209 - protein, 108 aa, Glycine max
  Coding DNA Sequence Number=SeqID_32431
  Gene Ontology: Mol. function=oxidoreductase activity, acting on the aldehyde or oxo group of donors, NAD or NADP as acceptor; Biological process=metabolic process
  Homolog annotation: Hit_ID=Q9SAK4; Match level="QueryCoverage=48%, HitCoverage=17%, E-value=4e-11, Identity=66%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
MIWLKPKRKHLDLLHPERKLSELLMTLMQVAPFGGFKKYGLGREGSKYGMDEYLELRDCVELLIALLDVLDQWVWPDTWGPRRMHCVMDSIPATAIEIGGVAPIQTVG

SEQ ID NO: 149210 - protein, 227 aa, Glycine max
  Coding DNA Sequence Number=SeqID_32432
  Gene Ontology: Mol. function=protein binding; Cellular component =membrane; Biological process=defense response
  Homolog annotation: Hit_ID=Q6R271; Match level="QueryCoverage=86%, HitCoverage=23%, E-value=4e-38, Identity=44%"; Hit description =Disease resistance protein
MPMHLGKLKNLQVLSSFYVGTTTEFGIQQLGELNLHGRLSIGELQNIQNPWDALAADLKNKIHLAELELEWNQNSDDLTKERDVFENLHPSKHLKKLSIRNYGDKQFPTLEMLTISGHSMEASTLERIGYILSNTSLELLFIDSCPNINISISHCYDFLINLEISNGCDSLTTFWLDLFPKLCLFDLMCRNLQTISQGLLIIISRIKKLVDVQSLNHFPVKDYLHPG

SEQ ID NO: 149211 - protein, 344 aa, Glycine max
  Coding DNA Sequence Number=SeqID_32433
  Gene Ontology: Mol. function=receptor activity
  Homolog annotation: Hit_ID=Q1SBD8; Match level="QueryCoverage=53%, HitCoverage=37%, E-value=5e-24, Identity=39%"; Hit description =Unnamed protein product; contains similarity to elicitor-inducible receptor EIR gene_id:T5M7.12
  Pfam annotation: Domain name=LRR_1; Domain location=103-126; Score =9.0; E_value=5.9; Accession=PF00560.23; Description=Leucine Rich Repeat
  Pfam annotation: Domain name=LRR_1; Domain location=128-150; Score =11.9; E_value=1.7; Accession=PF00560.23; Description=Leucine Rich Repeat
  Pfam annotation: Domain name=LRR_1; Domain location=152-187; Score =5.9; E_value=22; Accession=PF00560.23; Description=Leucine Rich Repeat
  Pfam annotation: Domain name=LRR_1; Domain location=2-24; Score=15.4; E_value=0.2; Accession=PF00560.23; Description=Leucine Rich Repeat
  Pfam annotation: Domain name=LRR_1; Domain location=31-53; Score=6.5; E_value=17; Accession=PF00560.23; Description=Leucine Rich Repeat
  Pfam annotation: Domain name=LRR_1; Domain location=55-77; Score =10.1; E_value=3.7; Accession=PF00560.23; Description=Leucine Rich Repeat
  Pfam annotation: Domain name=LRR_1; Domain location=79-101; Score =4.4; E_value=43; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=103-126::128-150::152-187::2- 24::31-53::55-77::79-101
MKLKKLVLAGNYLTGRIPDAFYGLNELLIFQLLFFELSSSSLSGSLPLTLGSLTSVLKLDVSNNHLEGNLLNQFAHLNNLTLTDLRNNRFTGGLTLSLQEMSSLEELVLSNNPLGGDVIYLRWENFNNLAILELSNMGLIGEIPESLSELKRLTFVGLSDNNLTGTHTLKFNVPSTKRIEVQGFAELQYEMLRIIRLCHSSGNYECKSKCKSTEKNRIRLHLRKGGEGEELALDLGFRVLLERHLFSCEINVVLHELVVRVEKLEPRTLNLVQFNLQGFNVNRVQRKVFNVNRLQCLESETANRVHNNETRMLKGSIEGHRVVYSVQRNNNAEGSQGCLQGSNK

SEQ ID NO: 149212 - protein, 226 aa, Glycine max
  Coding DNA Sequence Number=SeqID_32434
MGTSKLKASSRIVVRLAVRDCPRTCRGLGRGAWNATLPRGHAVRPTSGILCTKSFDEGVEAVCGPRWKSTIPVKKASRCSSGSIVPSYHLRLSDFHHKAMCERSARHPGNIRLESLVDHGQPLPFLTPPRGVAPSLRCVFGVVVHYMCLSLIPDEDGNLQEGSHVRPNRMLTMDEQEKVDKRLWGMFHHGPTWALRLLTSALRGAFVKMTGDATCKTKDSDALVSI

SEQ ID NO: 149213 - protein, 130 aa, Glycine max
  Coding DNA Sequence Number=SeqID_32435
MSNIRTTKQTEEERKTEVDKDNNNNDMNDNLHKNRNLPRTSEGIHLVNKDDPVVVSIIIANFMVSRVLINYGTSTNILYWKTFQRLEAGQQMKAKAQGAADAVSEFDLVSLEINHVLYIDFHIYEFDSQT

SEQ ID NO: 149214 - protein, 61 aa, Glycine max
  Coding DNA Sequence Number=SeqID_32436
  Gene Ontology: Mol. function=metal ion binding
  Homolog annotation: Hit_ID=Q9M047; Match level="QueryCoverage=72%, HitCoverage=22%, E-value=1e-13, Identity=84%"; Hit description =Transcription factor L2
MEGVLYCKPHFEQLFKESGSFSKNFQSPAKLADKTTHELGIQTPSSTWKHLLTKNNQRFTE

SEQ ID NO: 149215 - protein, 129 aa, Glycine max
  Coding DNA Sequence Number=SeqID_32437
MQTEEERKTEVDKDNNSNGMNDNLHKNRNLPRTSEAGQQMQAKAQGATNAVSELDLVSLEINPVLYTADASCGRRKGDRSYAGDEHANTEGDAVDVCDKVIDDGGVVEGGGAVDPRAKAEPKMALRWWL

SEQ ID NO: 149216 - protein, 559 aa, Glycine max
  Coding DNA Sequence Number=SeqID_32438
  Gene Ontology: Mol. function=protein dimerization activity; Biological process=DNA integration
  Homolog annotation: Hit_ID=Q2R1C3; Match level="QueryCoverage=98%, HitCoverage=76%, E-value=1e-135, Identity=45%"; Hit description=HAT family dimerisation domain containing protein
  Pfam annotation: Domain name=DUF659; Domain location=168-333; Score =99.7; E_value=8.6e-27; Accession=PF04937.6; Description=Protein of unknown function (DUF 659)
  Pfam annotation: Domain name=zf-C2HC_plant; Domain location=10-72; Score=22.6; E_value=8.5e-05; Accession=PF07567.3; Description =Protein of unknown function, DUF1544
  Pfam module annotation: Pfam domain module=DUF659::zf-C2HC_plant; Domain location=168-333::10-72
MFASSEYQDDHAPLWSFVTIKEKIGDGGGNRLWSCNFCEKVVKSSYSRVKAHLLRICGSEIATCPKVTDAYLVDLRSVCEEAENRLKSKNVPLPTNKRTPTPPTLPPKRRKSSNIESAFNIEDRNHLRAEIARMFYSAGLSFHLATNPHFVSSYSFAANCNLSGFLPPSYNALRTILLQQERSHIERLLQPIKSLWSLKGVTLVVDGWTDAQRRPLISFMAISEEGPMFFKAIDGSKEYKDKHYMFDLLKDVIKEVGPQNVVQVITDNVHVCKAVGLLIEAEFPHIFWTPCVVHTLNLGVKNICAAKNVDGNENVFNECGWIAEVIGDASFIKVFIMTHSMRLAIFNEFSSLKLLSIAETHFASMIVMLKRLKLLKRCLQNMVISDQWICDTDASNLHLVYEMWDSMIEKVKTTIYRHDEVLENEVSNFFEVIHEILNSRWSKSCNPLHCLAHSLNPRYYSDNWLNEVPNRVPPHRDDELSSQRNKCLKRYFPHVNVRKKVYEEFSKLSSCAGDFGSFDSIEDRWALDPKTWWVMQGSSTPILQKVALKLLVKPCSSSC

SEQ ID NO: 149217 - protein, 70 aa, Glycine max
  Coding DNA Sequence Number=SeqID_32439
MDYYHTNVNSAPSTTMSMTISYEKLATSSTLDKPATATFQEGHLEIYLKEIEAHEGILTVCEKDDVEQDQ

SEQ ID NO: 149218 - protein, 102 aa, Glycine max
  Coding DNA Sequence Number=SeqID_32440
  Gene Ontology: Mol. function=drug transporter activity; Cellular component=integral to membrane; Biological process=response to antibiotic
  Homolog annotation: Hit_ID=P28246; Match level="QueryCoverage=82%, HitCoverage=21%, E-value=8e-24, Identity=60%"; Hit description =Bicyclomycin resistance protein
MVHFNVNKRPGIKKGKQPGKREAACQHIAEGAFVPHQRDKIAQRGAQVKTLPLLGLKRFADLRYHQHGGNQRRQRQRPEDGVPVPQQQQPAADDRGQQRRNG

SEQ ID NO: 149219 - protein, 50 aa, Glycine max
  Coding DNA Sequence Number=SeqID_32441
MDYQNMSYNAGQAKGQAQEKAGNMQQGGHQMQAKAQGAADAVKNATWMNN

SEQ ID NO: 149220 - protein, 153 aa, Glycine max
  Coding DNA Sequence Number=SeqID_32442
  Gene Ontology: Mol. function=sequence-specific DNA binding; Cellular component=integral to membrane; Biological process=regulation of transcription, DNA-dependent
  Homolog annotation: Hit_ID=P76446; Match level="QueryCoverage=94%, HitCoverage=27%, E-value=3e-49, Identity=64%"; Hit description =Protein rtn
MRADQLFRAQRAAKQIPLQMRDAPINQPGRLVAGFHSFRHSFQVEFLCQQQHGVKHRRSYGFGADTLHKAAIDFQVVERIFFQVDQRAMASAKIIDGNLEIVFMQPGEDFAGVLLPHHGALGDFKYIVKMIGGHTGDPCLHVTAKTGRCQMLR

SEQ ID NO: 149221 - protein, 89 aa, Glycine max
  Coding DNA Sequence Number=SeqID_32443
MASPATEKRKEMSSSQRASIVAASVGVVEALKDQRQKRKGRGWSYMSSCKIANLLVSSLEKEKEVLLKSLTEQRYACKEAQDNIKDATQ

SEQ ID NO: 149222 - protein, 476 aa, Glycine max
  Coding DNA Sequence Number=SeqID_32444
  Gene Ontology: Mol. function=protein binding; Cellular component =integral to membrane; Biological process=protein amino acid phosphorylation
  Homolog annotation: Hit_ID=Q1T2W0; Match level="QueryCoverage=96%, HitCoverage=58%, E-value=4e-49, Identity=34%"; Hit description =Leucine-rich repeat; Leucine-rich repeat, cysteine-containing type
  Pfam annotation: Domain name=LRRNT_2; Domain location=33-75; Score =33.9; E_value=5.6e-07; Accession=PF08263.3; Description=Leucine rich repeat N-terminal domain
  Pfam annotation: Domain name=LRR_1; Domain location=105-127; Score =14.2; E_value=0.48; Accession=PF00560.23; Description=Leucine Rich Repeat
  Pfam annotation: Domain name=LRR_1; Domain location=129-151; Score =12.9; E_value=1.1; Accession=PF00560.23; Description=Leucine Rich Repeat
  Pfam annotation: Domain name=LRR_1; Domain location=201-224; Score =5.8; E_value=24; Accession=PF00560.23; Description=Leucine Rich Repeat
  Pfam annotation: Domain name=LRR_1; Domain location=247-268; Score =8.5; E_value=7.4; Accession=PF00560.23; Description=Leucine Rich Repeat
  Pfam annotation: Domain name=LRR_1; Domain location=272-294; Score =14.8; E_value=0.3; Accession=PF00560.23; Description=Leucine Rich Repeat
  Pfam annotation: Domain name=LRR_1; Domain location=296-319; Score =9.8; E_value=4.1; Accession=PF00560.23; Description=Leucine Rich Repeat
  Pfam annotation: Domain name=LRR_1; Domain location=321-346; Score =2.1; E_value=1.2e+02; Accession=PF00560.23; Description=Leucine Rich Repeat
  Pfam annotation: Domain name=LRR_1; Domain location=349-369; Score =1.2; E_value=1.7e+02; Accession=PF00560.23; Description=Leucine Rich Repeat
  Pfam annotation: Domain name=LRR_1; Domain location=372-394; Score =17.3; E_value=0.056; Accession=PF00560.23; Description=Leucine Rich Repeat
  Pfam annotation: Domain name=LRR_1; Domain location=396-417; Score =6.8; E_value=15; Accession=PF00560.23; Description=Leucine Rich Repeat
  Pfam annotation: Domain name=LRR_1; Domain location=420-441; Score =12.9; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=33-75::105-127::129-151::201-224::247-268::272-294::296 -319::321-346::...
  Pfam module annotation: Domain location=349-369::372-394::396 -417::420-441
MRIPHVPFLSFIFCYFFLIHHNVYYTGVSAQIVEDQQQSLLKLKNSLKFKTNKSKKVLSWNQSIDFCEWRGVACDEEGQVTGLDLSGESMYGGFDNSSTLFSLQNLQILNLSANNFSYEIPSGLNKLKNLTYLNLSHAGFVGQIPTEISSLTRLVTLDMSCLSYLYGQPLKLENIDLQMLVRNLTMLRQLYMDEQIFWVATLSVVDLSFNYHLYGSLPQFLLNSPLQTLIDNLLDGSLPSYIFYVPLLRSIRLSNNNFQDQLNKFSNISSSKLEILHLSGNDLNGSIPTDIFQLRSLSVLELSSNKLNRKLKLDVIDRLVNPTTLGLSHNHLSIDKIFADVGLISSIPNMTNVELVSCNLIEFPTFLRNQSKITTLDLSSNNIEGSIPTSIWKLNSVVQLNLSHNLLSNLEGLVQNSSSNLKVLDLHDNHLQGKLQIFSMHAIYLDYSSNNFLFHQILVIFCLTQLSCLLEKTIYV

SEQ ID NO: 149223 - protein, 42 aa, Glycine max
  Coding DNA Sequence Number=SeqID_32445
MSGKGLEHVRKSLSQYQRLRACLEIKWDTNWERGFLVYVIFK

SEQ ID NO: 149224 - protein, 189 aa, Glycine max
  Coding DNA Sequence Number=SeqID_32446
  Gene Ontology: Mol. function=Rab GTPase activator activity; Cellular component=intracellular; Biological process=regulation of Rab GTPase activity
  Homolog annotation: Hit_ID=Q8LAF3; Match level="QueryCoverage=82%, HitCoverage=44%, E-value=9e-76, Identity=89%"; Hit description =Putative plant adhesion molecule
  Pfam annotation: Domain name=TBC; Domain location=1-127; Score=-73.9; E_value=0.026; Accession=PF00566.9; Description=TBC domain
MGFLAGLLLLYMSEEDAFWLLVALLKGAVHAPMEGLYLAGLPLVQQYLFQFECSVREHLPKLGEHFSYEMINPSMYASQWFITVFSYSFPFHLALRIWDVFLYEGVKIVFKVGLALLKYCHDDLIKLPFEKLIHALKNFPEGAMNPDTLLPLAYSIKSLSKKGITEPNFVFILTSVPALLPLSNSWTWD

SEQ ID NO: 149225 - protein, 183 aa, Glycine max
  Coding DNA Sequence Number=SeqID_32447
SVAEATDSIAKRTIEVAKVDRRKAICNGYVKGYKEMLQSSDEENPEVAKFREKDLKFLPKMKFLFKGIIATGFAAYAPSKDSRQYEGFNIKTEETNDSIDDNTDMEVNEPEIDTTTQNMSLAKESGQRKRGREGDKRIGVAAKLSSQLDRIIQTFESSASAQDPTSITACVEKLKDLLGLECG

SEQ ID NO: 149226 - protein, 138 aa, Glycine max
  Coding DNA Sequence Number=SeqID_32448
  Gene Ontology: Mol. function=Rab GTPase activator activity; Cellular component=intracellular; Biological process=regulation of Rab GTPase activity
  Homolog annotation: Hit_ID=O81347; Match level="QueryCoverage=96%, HitCoverage=31%, E-value=6e-34, Identity=57%"; Hit description=Plant adhesion molecule 1
MEKKRLDDYEPGPVPSPRALDRFGFVKQDVNTSEGLVKNRSAYEYESMSEYKKCGHWFYLYFHLPLIRYREERRVRKWRKMIGVGGSDWKHYLRRKPHVVKRRIRKGIPDCLRGLVWQLISGSRDLLLMNPGVYENIF

SEQ ID NO: 149227 - protein, 185 aa, Glycine max
  Coding DNA Sequence Number=SeqID_32449
MVHVVAQTPNTLPTTQDQPNPTFVRESIPTTPVRDASPSAPDDSVTPEYPPDPNCEHIVDERPFIRAYKGEFQPTYGCSNIIWAKFDEPAPSWLKVSVDLCDRWFGEFKSKEFQRPPTAWEVMRKLTNLKLGEWVNDKSREFAEKYQHRRDEILQRSTEEDTSTQDSPNTVTSVNDNEIYLNVVG

SEQ ID NO: 149228 - protein, 90 aa, Glycine max
  Coding DNA Sequence Number=SeqID_32450
MEKINQNIVQSTLMYIWLKIVGENKKGRVHNMGHNLELIRGSNEIIEGNIDAILPRKGPATKAMSKRLQENWVRAAEEGPRVLTNLRTDF

SEQ ID NO: 149229 - protein, 89 aa, Glycine max
  Coding DNA Sequence Number=SeqID_32451
MVTKRVKKLEKIMTHDRYRVAEVEWIQDIMPPEGTRERETLQQQTYNAAEDAHYKFTYQHRFFKKPMLVLVSELVPDFIITKQLLLLKN

SEQ ID NO: 149230 - protein, 104 aa, Glycine max
  Coding DNA Sequence Number=SeqID_32452
MANKNISSNETYPPTLIPKTIPKLQNSLRVGKGNIGSKGLSKELIQGRLIWLEAYKNKMPKSSPNMHVKQEVSTRVKPRLLWKQSMGQNTPNKIDDDGSNSHQG

SEQ ID NO: 149231 - protein, 161 aa, Glycine max
  Coding DNA Sequence Number=SeqID_32453
  Homolog annotation: Hit_ID=Q9FMB3; Match level="QueryCoverage=35%, HitCoverage=39%, E-value=2e-16, Identity=68%"; Hit description =Arabidopsis thaliana genomic DNA, chromosome 5, TAC clone:K15E6
MLEMTLTKDTKNNMMAFIDPTWLHYIAEVGRECRADVDTFTKSDVDYMQRPTVEVIGHKAHGPVPQPGSIVIARVTKVMARSASADIMCVGPKSVREKFTGIIRQNLTTENIVGERTTMTDAASDSRNDAVVKATNKLKVVGDFISSVPGIKMGELSLGVS

SEQ ID NO: 149232 - protein, 114 aa, Glycine max
  Coding DNA Sequence Number=SeqID_32454
MESCNIFTRTYIRSKRVFPFKVRAGLRRYLWGDSPFPLVRQALTWTVPPLSLARQANMDGPAIVTGDTHVTGGYRHCHWRGKHRLRSRTLNSSRLGFSFSEHIAIRNGEIPFDR

SEQ ID NO: 149233 - protein, 151 aa, Glycine max
  Coding DNA Sequence Number=SeqID_32455
  Homolog annotation: Hit_ID=Q5L391; Match level="QueryCoverage=89%, HitCoverage=31%, E-value=1e-07, Identity=28%"; Hit description =Lantibiotic biosynthesis protein
ESTYNAPLGWCYGDNIIALGLLKSAVFLEDSYLYSIAEQVAINALKRDHERFVVKDAMICHGTAGVSYIYEKLYKITSNEKLKESSQKWFETTLDFYSVDEESHGYRTYVGDDEYTSTISLLNGKIGIAIMLLMRENSNLDSDWDNILLLN

SEQ ID NO: 149234 - protein, 117 aa, Glycine max
  Coding DNA Sequence Number=SeqID_32456
MIVYLITYILTPSSSNHAQVTDDDLQIVYGLKSEIQMNWVLLIEDIILKCRRLVDYEFPYVVLASRFIDYFKVVVSNEIVDYTKASSEITKRHLKKLGMRYANHEWIMAKGACCKKH

SEQ ID NO: 149235 - protein, 128 aa, Glycine max
  Coding DNA Sequence Number=SeqID_32457
MALSSVNAIVYYDGTIKTTKHGSTFAIGNNISLPNGEVVKDIHFRFPVSFIGDCGKYTTCMLHDDEDVMTMVFMFIDISKLTCLELYITSVDSPTQTCAHPPLISSNSFNYEDLDEYLAQAMNLESSF

SEQ ID NO: 149236 - protein, 83 aa, Glycine max
  Coding DNA Sequence Number=SeqID_32458
  Homolog annotation: Hit_ID=Q1S1N3; Match level="QueryCoverage=82%, HitCoverage=21%, E-value=2e-11, Identity=47%"; Hit description =Calcineurin-like phosphoesterase family protein, related
  Pfam annotation: Domain name=DUF1723; Domain location=29-78; Score =58.4; E_value=2.3e-14; Accession=PF08330.1; Description=Protein of unknown function (DUF1723)
MASTVGPLLWKQHLHRFGEVYVARLGQVKIENNLVITLVERWRPKSHTFHFPISKCTITLEDVALQLGLRVDGRPVIGPTYYD

SEQ ID NO: 149237 - protein, 64 aa, Glycine max
  Coding DNA Sequence Number=SeqID_32459
MFVKPFHCHNIVGILGLQCLYACESFPDTTCLHCNNCADGTSSDDGSPGDNSEDNLFVGVTIAS

SEQ ID NO: 149238 - protein, 170 aa, Glycine max
  Coding DNA Sequence Number=SeqID_32460
  Gene Ontology: Mol. function=zinc ion binding
MSSEGGFQVLELSKVPTLIAHIKSIKGYTTTYRKTWLTKQKVVEDIYGNWERSYHDLLRLLQAMQQFLPSMVVGKETLPMPAQGGQPVKDCVMGALLVAVAQDDNNKILLIAFVVVKSESVEAWLFFLRNLKRHMKPMFNYYYNMLREEADVDRAIKWLIEIPREKWNLA

SEQ ID NO: 149239 - protein, 166 aa, Glycine max
  Coding DNA Sequence Number=SeqID_32461
  Gene Ontology: Mol. function=hydrolase activity
  Homolog annotation: Hit_ID=Q6DAC2; Match level="QueryCoverage=100%, HitCoverage=60%, E-value=3e-72, Identity=77%"; Hit description=CAMP phosphodiesterase
MRVAQAVLIEPGAAGRQRMMVQQQQRIALGVSMQAALHPLELVFAQFAVRHAEHLAVQHQHLPAVAQQHLFGRRDAGGGQCIDHRRLKIMVARQPHAGSRQLRDAGGEVAVGLLRMILRQISRGDDQIDVAALRLDGVQHRVIAAIGIDAEQRLVFAGKKVGICYL

SEQ ID NO: 149240 - protein, 82 aa, Glycine max
  Coding DNA Sequence Number=SeqID_32462
  Pfam annotation: Domain name=zf-BED; Domain location=4-50; Score =48.5; E_value=2.2e-11; Accession=PF02892.5; Description=BED zinc finger
MRTSIAWDYFERFANDEGISKVKCKKCGKEYVARNDSGTSNMKKHVKICDVDGRISSYPLLDQENYTDKVFELVWIEYLKGD

SEQ ID NO: 149241 - protein, 121 aa, Glycine max
  Coding DNA Sequence Number=SeqID_32463
  Homolog annotation: Hit_ID=Q2HUA4; Match level="QueryCoverage=51%, HitCoverage=15%, E-value=2e-07, Identity=39%"; Hit description =Ribonuclease H
MAYDLGILLGGGNGLLGVPACTTTTMKTREGQPTSWKMPQVDMVIQELRIGDGEEVQWNKIWDIEIPPKGAHMIWRAMLDRMPTRDNLLHRGINLVNTNCPICHQQEESFNHVLDTMMYTI

SEQ ID NO: 149242 - protein, 125 aa, Glycine max
  Coding DNA Sequence Number=SeqID_32464
MGDVLTSKNSTRKPPSSQYPSPPIYLVHQHFLPYGLEATSWIHDVHGVSIEEEKGKGGCFLPNLFVTLSNNKCQANYVTIFLDVACLVENFLLNTKHGTSNTKEFVEIYVSLAKKQGVTKSDMAS

SEQ ID NO: 149243 - protein, 32 aa, Glycine max
  Coding DNA Sequence Number=SeqID_32465
MDTHLCVIGDPMNGVQQSCFVSHSYDEVYCKL

SEQ ID NO: 149244 - protein, 110 aa, Glycine max
  Coding DNA Sequence Number=SeqID_32466
  Subcellular localization annotation: CTP_CleavageSite=77; ConfidenceScore=5.51e-01
TLPSLTLHFAFTLGWLIEVSSSLSQMPHHGQSSVTNSSLQDFFTTTSSSVVRGAQLAVWESSITNSSSSSHKLPQSCCSGRVDTVDVSLSEAYALNEQHPLSETSVCLAN

SEQ ID NO: 149245 - protein, 58 aa, Glycine max
  Coding DNA Sequence Number=SeqID_32467
MTKKSPYGRTSWWLPMTQRDTNDDDGSVIRPQWMTMKKCSKPLFWQCLNFAFWGMRDL

SEQ ID NO: 149246 - protein, 730 aa, Glycine max
  Coding DNA Sequence Number=SeqID_32468
  Gene Ontology: Mol. function=RNA-directed DNA polymerase activity; Cellular component=nucleus; Biological process=RNA-dependent DNA replication
MYTWTNGRVWSKLDRALCNQLWLNSFENSSCQVVGFESISDHASLVVITEVLVPRGNSPFKFNNAIVDHPNFLSIVSDGWSHQVSGCFMFKVCKRLKTLKAPLKLLFKQEFSHIANWMEQDEVEYNRQLNSLQKNPLDSSLLMAQELHHPASLVVCNSGPKVPIDCFASLLSPITKQDVWNVISGMDNNKALGPDGYNTLFFKKAWNIIGDDIFVVVNEFFMSGKLLKQIHHALIALIPKSDQASQVNHFRPISCCNLLYKIISKILVNRIAPMLEHIIGASQFAFLKNRKMMDNIFLVQELLRKYARKRISPRCLLKIDLHKAYDSISWEFLDWMLKSVGFPAQFCSWIMECITTTSFSVVVNGSIYGHFKGQHGLSQVDPLSPYLFVLCLEHFPVIFIASRLSHLAFADDIMLLSRGDLPSVSATFAKLQHFCNILGLSISTNKSSIYSAGVDQDVLSDIQQLTGFSLGCFPFRYLGVPLLSSRLNVCHYAPLLSHITSLIQGWSSKTLSYAGKVELIRAIIQGIANFWMGTFPLPQSVLDRINASCRNFLWGKVEMGKNKPLVDWSDICSPKKEGGLGLFNLKDWNFTLLSRILWDFHSKKDSLWVRWVHHNYFKGDNVWDFISPASDSVLIKKIIHIRDIITIKEGNVEAAKQTLNSWSSNEQLLAGKAYDYIRGVKPAVNWNFVVWNPAIPPKMSFILWLATKNHLLTLDRVAFLNKCLLSFLQN

SEQ ID NO: 149247 - protein, 66 aa, Glycine max
  Coding DNA Sequence Number=SeqID_32469
MTVKVPQPKLRTTVSKILHLISTDVNAIESVIGRKDTVETSYKEPGEIQRSTNVAQVNPQRPSSHH

SEQ ID NO: 149248 - protein, 97 aa, Glycine max
  Coding DNA Sequence Number=SeqID_32470
MVAITPARFPQPPFFRGYDSNAMCAYHGGAPGHSIEHCMTLKRKLFLVLGKFFLQESTASFILPCYQVVKTKMDTSEPYTGAMRGIMHEPQVNLGAD

SEQ ID NO: 149249 - protein, 73 aa, Glycine max
  Coding DNA Sequence Number=SeqID_32471
MPGCHAEDDSSTKEYTYPSNGSDSNPQVGNGEASMPWINLFKDNKKPSKGFGLKFVDAIGFDVLMMIMMMCCN

SEQ ID NO: 149250 - protein, 82 aa, Glycine max
  Coding DNA Sequence Number=SeqID_32472
MATLLCESHVACKPPLVLAIQGSGAATVVLQGGAGCAEGQIASNGGDLAVQIFFYKAMQEQVKFLFLFGLHFLVACHKTYLR

SEQ ID NO: 149251 - protein, 178 aa, Glycine max
  Coding DNA Sequence Number=SeqID_32473
METQPYRLCSRQFPRKKALPECCQKWGVKFSYSTHESDWLVFKFDSEDDMNHVLFAGPYFIFQRPLLLKVMPHFFDFGPTAGSPSVQSQDVEVVAFTETNPNNPSGKSKEDQVGLSTQPCMQQPQATDNIPTLQTPFDISGVENSKTSLHQDSTEDPGDGFVRVKTKPRKIGKKVKIQ

SEQ ID NO: 149252 - protein, 213 aa, Glycine max
  Coding DNA Sequence Number=SeqID_32474
  Gene Ontology: Mol. function=hydrolase activity; Cellular component =membrane
  Homolog annotation: Hit_ID=Q1RX76; Match level="QueryCoverage=99%, HitCoverage=39%, E-value=3e-77, Identity=65%"; Hit description =Glycoside hydrolase family 79, N-terminal
  Pfam annotation: Domain name=Glyco_hydro_79n; Domain location=34-213; Score=59.9; E_value=4.4e-17; Accession=PF03662.4; Description =Glycosyl hydrolase family 79, N-terminal domain
MGSRIQLLPICFWLHLTCFSFFFGSIVSVRGDATVQGSVAIDGKAVIGTIDEDFVCATLDWWPPEKCDYGRCSWGLASLLNLDLNNKIFLNAVKDMVASECAAAFSPLKLRLGGSLQDKLIYGTEDNHQPCTPFVKNPSEMFSFTQGCLPMDRWDELNYFFEKAGAKIIFGLNALAGKSIHGGSAKGPWNYTNAESFIRYTVRNGYTIYGWEL

SEQ ID NO: 149253 - protein, 88 aa, Glycine max
  Coding DNA Sequence Number=SeqID_32475
MHGANKLPVGLAGLRARRQGHRPCSRPCSYACIAFFFFFFILLQFFILLQYIAVLLVFFLDNACSCYYYVVSPLASYYVVFLVGLVRM

SEQ ID NO: 149254 - protein, 469 aa, Glycine max
  Coding DNA Sequence Number=SeqID_32476
  Homolog annotation: Hit_ID=Q338W3; Match level="QueryCoverage=84%, HitCoverage=53%, E-value=6e-66, Identity=39%"; Hit description =Expressed protein
MKLEGCESYHKSANTNYRGSNFCSADGCTFASSGTEKRNDRIHNPNGPNPKRQCINELCRMRLDVPLLDQLVREYCVYRGIVDSASGKQPIPEPVKINQQDPGYCSSRDCSLELDCNASKHSDGETSVTNAQMDGSPENNSDVTSMRRIDFEVRYASELASIHEDCSTSGSQQHEDASVLQRCRLSGNGERSKRKRWRGRYDGNSYMSDASLEENSKQEHSIGTVVSTILKEKQGSEKLSVHDINNVEDRYEILLGMKELASKGMAAEAVEEVEFLKLVSSGDYNAALKVACTHLGPLAASDPALLKPLKETLLALLRPNEDALGNALPLHALAASLQVAVGRRLGVEEPQLMKIMRATLYTHNEWFKLQMWKDRFEGLLRLDSLKEANTPFLAPVTTSKSYADSCTNGSSHFQATVSSGTRMSEDGSSPTQASSRDVICDEGAILKVMQYIGEVLLQLQRHYVQQLYP

SEQ ID NO: 149255 - protein, 87 aa, Glycine max
  Coding DNA Sequence Number=SeqID_32477
MYQYPFEGHDIDMSASEHSFGGVAETHPHFSWPTMTPSQQHDAPMATPNAPLAPHWDVPEAIPDMGDLLGVDLRHEFSAEAEQQGRR

SEQ ID NO: 149256 - protein, 82 aa, Glycine max
  Coding DNA Sequence Number=SeqID_32478
MHAWCKQTASETGGFATGEGLATHSGDMHMASGNRQSNWRVPGWFVGLLFQVASGVLAFSGQKASCNCHWRVKGKLQLPLAI

SEQ ID NO: 149257 - protein, 443 aa, Glycine max
  Coding DNA Sequence Number=SeqID_32479
  Subcellular localization annotation: CTP_CleavageSite=19; ConfidenceScore=5.34e-01
MATPPSSPPPPPHPPLPTDAASHSPSILKRKIKSKRMRSLFIGPIGAERPLVHVDPATGKADSPNRKKLRTYLGIVARDKVDVTYENGKQVLATQKDLIWEDIQAEFDIPEASNLRTKKKILQTNDISKEKWTQFCQSCRDPSWEVIQKQNTTPHVLSRGGYEYLENKLMEEKKKKQLEEAAQSRSTDTIIDLPSPIRRHVKWKKACTKKFGQMTSEAAKKIDEKIEHASQGSFIAHRRQDVLTVAIGQPEHPGHVCAARVGVTIKQYFGPAPRISHTSSSMAPEDLEQLTQKLKDQGLAMPPKPKVGPSATHVSTKESCVDPSGNDLDTGESEKYGLYIEENPPRLVAIGRLYEGSTTVHNIPLANDQVKVGVEEVRDADAHIPGAVGPGKPTDRSDHDVDDPLYLMTLIIPQLFLKPMQVMWDATMFGVYNDNFPLYIKHE

SEQ ID NO: 149258 - protein, 165 aa, Glycine max
  Coding DNA Sequence Number=SeqID_32480
MSQSFDMIGAIDDNKETFKLIVRIVDRVCPSPDTVHAIFKKDDMESWEVGLKEGKAQVDLAEIPLQSYEFMSFEYITHGNYDPIMLIDVIGVVEEVKFQLPNGNPTRLVLNLKDLRLSSVCLGEPSNVSQSLSIGQYSQDSDFSELDRFLYKSKVLSISNIRDAA

SEQ ID NO: 149259 - protein, 687 aa, Glycine max
  Coding DNA Sequence Number=SeqID_32481
MQARQRSPRGFYASEYRQQRDGGLGRGRRGGGACGSDIFVEAGRLAAEYLVSQGQLPPNALPPPKWQNHKTPAEGGRQSALARLGSADGRRKLGGFDEFGQKGGRRRGSFSRSNGMDWGREYRRNGSWSDRFRGGAVDVRDGEDDDYESGGFSVRHQDEEDQHQYQQQQHQNSVDDASMKSNSNLNEFAPRSEDGGDLNDKDGDKERVNAELMGVKQSGIGKDVSDVDMEVGVGNDLESVSVGVKEVKDGSGGDDDSERLRNVSDQWSDQENSSSGGVVADLVSLCKSVKVPTRTRSSVTRKNLKAGNNGDRSGTAQDVGDLQGAEEVVPENESVKGSSSGDLLGEKSYDIVYVDVDVAEVEPVHATEDVKELDAVCKAEEVLSLGCQSGQDRGFMQDTNQESGATLPGYGGCSSLAEEHGEKRVAENDDDVREDNKKLREWVPSLVPKTGGGGYFLHSNPIEVKESSGEDEISHIDKVTIASDQGRLMSSGSQFTEGDRPFLQCSEEKPSLPSSFRTCDLNLIEASEVHENHVDHPVLLYPPAVSETKKAVPIDIDLTMSHASVSGKFNTHATNGKEIEVIDLENDDSIQEEKSINSMDRKTETMFPGLEGFSNHAQNAADMHDVQDGYGLMISELLGPDFPNCTSVPGDINSVHNEMSLHGGTGTLAEDDSIYMSLGELSMPDFY

SEQ ID NO: 149260 - protein, 175 aa, Glycine max
  Coding DNA Sequence Number=SeqID_32482
  Gene Ontology: Mol. function=hydrolase activity; Biological process =metabolic process
  Homolog annotation: Hit_ID=Q2BFD2; Match level="QueryCoverage=99%, HitCoverage=43%, E-value=1e-51, Identity=51%"; Hit description =Glucuronyl hydrolase, putative
MDVQTGEPRFGNTHQGYSDTSCWSRGQAWGIYGFLLSYQHTGDKQMVELSRSLAHYFLNRLPEDDVCHWDLALLGTDAMRDSSAAAIAACGLLELVKALPLLDANRAYYEEMALRIALSLTDNYLAHDDDPTEGLLQHSVYHMGSGKGVDQCCSWGDYFYLELLARLRQIWHPYW

SEQ ID NO: 149261 - protein, 709 aa, Glycine max
  Coding DNA Sequence Number=SeqID_32483
  Gene Ontology: Mol. function=binding; Cellular component =intracellular; Biological process=RNA processing
  Homolog annotation: Hit_ID=Q8GTX9; Match level="QueryCoverage=99%, HitCoverage=99%, E-value=0.0, Identity=77%"; Hit description=Cell cycle control crn (Crooked neck) protein-like
  Pfam annotation: Domain name=HAT; Domain location=105-137; Score =23.4; E_value=0.00083; Accession=PF02184.7; Description=HAT (Half-A -TPR) repeat
  Pfam annotation: Domain name=HAT; Domain location=139-171; Score =12.4; E_value=0.18; Accession=PF02184.7; Description=HAT (Half-A -TPR) repeat
  Pfam annotation: Domain name=HAT; Domain location=173-204; Score =15.8; E_value=0.044; Accession=PF02184.7; Description=HAT (Half-A -TPR) repeat
  Pfam annotation: Domain name=HAT; Domain location=206-237; Score =48.7; E_value=2e-11; Accession=PF02184.7; Description=HAT (Half-A -TPR) repeat
  Pfam annotation: Domain name=HAT; Domain location=239-274; Score=9.3; E_value=0.62; Accession=PF02184.7; Description=HAT (Half-A-TPR) repeat
  Pfam annotation: Domain name=HAT; Domain location=276-310; Score=7.1; E_value=1.6; Accession=PF02184.7; Description=HAT (Half-A-TPR) repeat
  Pfam annotation: Domain name=HAT; Domain location=354-395; Score=2.6; E_value=10; Accession=PF02184.7; Description=HAT (Half-A-TPR) repeat
  Pfam annotation: Domain name=HAT; Domain location=398-434; Score=0.6; E_value=22; Accession=PF02184.7; Description=HAT (Half-A-TPR) repeat
  Pfam annotation: Domain name=HAT; Domain location=469-501; Score =16.3; E_value=0.036; Accession=PF02184.7; Description=HAT (Half-A -TPR) repeat
  Pfam annotation: Domain name=HAT; Domain location=503-537; Score=3.4; E_value=7; Accession=PF02184.7; Description=HAT (Half-A-TPR) repeat
  Pfam annotation: Domain name=HAT; Domain location=539-570; Score =23.0; E_value=0.0011; Accession=PF02184.7; Description=HAT (Half-A -TPR) repeat
  Pfam annotation: Domain name=HAT; Domain location=71-103; Score=4.0; E_value=5.6; Accession=PF02184.7; Description=HAT (Half-A-TPR) repeat
  Pfam annotation: Domain name=Mad3_BUB1_I; Domain location=505-600; Score=-53.4; E_value=0.043; Accession=PF08311.2; Description =Mad3BUB1 homology region 1
  Pfam annotation: Domain name=TPR_2; Domain location=125-158; Score =7.9; E_value=4; Accession=PF07719.7; Description=Tetratricopeptide repeat
  Pfam annotation: Domain name=TPR_2; Domain location=225-258; Score =14.1; E_value=0.52; Accession=PF07719.7; Description=Tetratricopeptid e repeat
  Pfam annotation: Domain name=TPR_2; Domain location=422-455; Score =7.4; E_value=4.6; Accession=PF07719.7; Description=Tetratricopeptide repeat
  Pfam annotation: Domain name=TPR_2; Domain location=91-124; Score =18.9; E_value=0.019; Accession=PF07719.7; Description=Tetratricopepti de repeat
  Pfam module annotation: Pfam domain module=HAT::HAT::HAT::HAT::HAT::HA T::HAT::HAT::HAT::HAT::HAT::HAT::Mad3_BUB1_I::TPR_2::TPR_2::TPR _2::TPR_2; Domain location=105-137::139-171::173-204::206-237::239 -274::276-310::...
  Pfam module annotation: Domain location=354-395::398-434::469 -501::503-537::539-570::71-103::505-600::125-158::225-258::422 -455::91-124
MSSSKDADPSLGYLTRKDTEVKLPRPTRVKNKTPAPIQITAEQILREARERQEAEIRPPKQKITDPTELGEYRLRKRKEFEDLIRRVRWNIGVWIKYAQWEESQKDFKRARSVWERALEVDYKNHTLWLKYAEVEMKNKFINHARNVWDRAVTLLPRVDQLWYKYIHMEEMLGNVAGARQVFERWMKWTPDQQGWLSYIKFELRYNEIERARGIFERFVECHPRVGAWIRYAKFEMKNGEVARSRNVYERAVDKLSDDEEAEQLFVAFAEFEERCKETERARAIYKFALDHIPKGRAEDLYRKFVAFEKQYGDREGIEDAIVGKRRFQYEDEVKKNPLNYDSWFDYIRLEESVGDKERIREVYERAIANVPPAEEKRYWQRYIYLWINYALYEELDAGDMERTRDVYKECLNQIPHLKFSFAKIWLLAAQFEIRQLNLKAARQILGNAIGKAPKDKIFKKYIEIELQLGNIDRCRKLYEKYLEWSPENCYAWSKYAELERSLSETDRARAIFELAIAQPALDMPELLWKAYINFETAEGEFERARALYERLLDRTKHLKVWLSYAEFEATAMDMDSLDLPEDEQKKQCIQCARRVFEQALNYFRSSAPDLKEERAMLLEKWLNMEATSGELGDVSLVQSKLPKKLKKRRHVATEDGSTRYVTNSVYLSTSSQGIEEFIDYLFPEESQTTNLKILEAAYKWKKQKLSSDD

SEQ ID NO: 149262 - protein, 60 aa, Glycine max
  Coding DNA Sequence Number=SeqID_32484
MRPKLQLFMGTKDGERTICKLAKGILLLKQEVGGLIPSSFEWSEPGWEGSTLLPLYPGGD

SEQ ID NO: 149263 - protein, 343 aa, Glycine max
  Coding DNA Sequence Number=SeqID_32485
  Gene Ontology: Mol. function=transporter activity; Cellular component= mitochondrial inner membrane; Biological process=transport
  Homolog annotation: Hit_ID=Q6I583; Match level="QueryCoverage=99%, HitCoverage=92%, E-value=1e-140, Identity=73%"; Hit description =Putative peroxisomal Ca-dependent solute carrier
  Pfam annotation: Domain name=Mito_carr; Domain location=119-211; Score=128.8; E_value=1.5e-35; Accession=PF00153.17; Description =Mitochondrial carrier protein
  Pfam annotation: Domain name=Mito_carr; Domain location=16-107; Score= 121.1; E_value=3.1e-33; Accession=PF00153.17; Description =Mitochondrial carrier protein
  Pfam annotation: Domain name=Mito_carr; Domain location=222-339; Score=91.7; E_value=2.2e-24; Accession=PF00153.17; Description =Mitochondrial carrier protein
  Pfam module annotation: Pfam domain module=Mito_carr::Mito_carr::Mito_ carr; Domain location=119-211::16-107::222-339
MAADDGVKPPTLEFLSICKSLLAGGVAGGVSRTAVAPLERLKILLQVQNRQDIKYNGTIQGLKYIWKTEGFRGMFKGNGTNCARIVPNSAVKFFSYEQASMGILWLYQRQPGNEEAQLTPILRLGAGACAGIIAMSATYPMDMVRGRLTVQTEASPCQYRGIFHALSTVFREEGPRALYKGWLPSVIGVIPYVGLNFSVYESLKDWLIRSKPFGIAQDSELSVTTRLACGAAAGTVGQTVAYPLDVIRRRMQMVGWKDAAASVVAGEGKSKIEYTGMVDAFRKTVQHEGFGALYKGLVPNSVKAEKHFDCKLHSFQVVPSIAIAFVTYEMVKDILGVEMRISD

SEQ ID NO: 149264 - protein, 202 aa, Glycine max
  Coding DNA Sequence Number=SeqID_32486
  Homolog annotation: Hit_ID=Q9FQZ4; Match level="QueryCoverage=74%, HitCoverage=94%, E-value=2e-31, Identity=52%"; Hit description =Avr9/Cf-9 rapidly elicited protein 194
MAEREEASLYGDVLAHTKKTGQSHRILGSAECIMEKLDLATKSSSYPPSNNVWDCGSTLYDSFELNSFKRQLDSAIANSPISRTLSMPHLPERSLHALSEQPATVMSRKSFKISRSFQKLLRSVFKSNNKSTTTSTSLSFQVPEKYSRERFYVVYDKSGPVLSTIPEVPEFEIGALSPEISSFVRRSASERFTPTAIGVSCA

SEQ ID NO: 149265 - protein, 88 aa, Glycine max
  Coding DNA Sequence Number=SeqID_32487
MAFLGETSSQTIVNSRLAFIFQNGTVIHNECGVYFQSSGPVPMRVPNLCDFSTLKSRIHNSLRLNNNEVVDEIHYRRPVEDTEQQMQF

SEQ ID NO: 149266 - protein, 84 aa, Glycine max
  Coding DNA Sequence Number=SeqID_32488
MTPSQQYHGPIPTPNAPLGTQWNVPGQIPNTGDLFGVDLRHAFSAVADEEEAGRHRGRRNPDRQARRWDRPCGTSSRHHGHQNE

SEQ ID NO: 149267 - protein, 864 aa, Glycine max
  Coding DNA Sequence Number=SeqID_32489
  Gene Ontology: Mol. function=protein-tyrosine kinase activity; Cellular component=integral to membrane; Biological process=protein amino acid phosphorylation
  Homolog annotation: Hit_ID=Q9AXB6; Match level="QueryCoverage=74%, HitCoverage=93%, E-value=1e-145, Identity=43%"; Hit description =Phytochrome / protein kinase-like
  Pfam annotation: Domain name=DUF1221; Domain location=21-232; Score =418.4; E_value=1e-122; Accession=PF06760.2; Description=Protein of unknown function (DUF1221)
  Pfam annotation: Domain name=Pkinase; Domain location=233-501; Score =95.3; E_value=1.9e-25; Accession=PF00069.15; Description=Protein kinase domain
  Pfam annotation: Domain name=Pkinase_Tyr; Domain location=233-501; Score=77.8; E_value=3.3e-20; Accession=PF07714.7; Description =Protein tyrosine kinase
  Pfam module annotation: Pfam domain module=DUF1221::Pkinase::Pkinase _Tyr; Domain location=21-232::233-501::233-501
MEQFRHIGEVVGSLKALMVLRDEIQINQRQCCLILDIFGLAMETIAEEIRQNLKLEERNTKWKALEFPLRELCRVLKEGELYIRQCLDSKDWLGKALTLSHNRECVEFHIHNLLCYFPAVIEAIENAGLVSGSDPDEKEKKKVMLARKYDLEWNDPKLFQWRFGKQYLVPRDICKQLEHAWREDRWSLVEAIKDKKKKKKKKSEQRLADMLLKKLLNGSEIVPIEVLIGSNDYQVRRRLGRGGKEFKEIQWLGQCFALRHFQGERQAHEAEVSTLLSLSHPNILQYLCGFYDEEKKEYSLVMELMNKDLWTYMKDNCGPRRQILFSVPVVVDLMLQMARGMEYLHSKKIFHGHLNPCNILLKPRNSQEGYFQAKVSGFGLSSVNNININSDAHEDHDPLTWFAPEVLTELEQTPDAYANSTCTSEKADAYSFGMICFELLTGKVPFEDNHLRGARTSQNIKAGERPLFPYRSPKYLVSLIKKCWQTDPAQRPTFSSICRILRYTKKFLAMNTESHIMNPELNNQIELQAPPVDCCDIETTFLKGFSMERTTSGVFAVSQIPYEMFAYKVAEKLKINPNNSSKCCEHQKEEPSSCRSESDEQSDNASTVEDPFPLLTSPTSVCGDARSVCSEAPFRKTVRMKKPTPVKANKEQGTPKLLVTKSLPSSLSNRVLRTTKVNQSSLAPSTLSPAAADRRRPPVVSDKGNQSPLVSSSVRRKKYDGSLSDSKGSLRLEKRDQPPLALQGSSKMKKSQLKLNPSLSPRRLRRSNTETNLKGLTPTHTLCSQRICTNRSRSYHVSDLDNGLKMTKGRLSSLALSPYMRRKKTSGHVSDSESSFVKKRGSLSPFALSPLSPYVRTTCGHVSD

SEQ ID NO: 149268 - protein, 561 aa, Glycine max
  Coding DNA Sequence Number=SeqID_32490
  Gene Ontology: Mol. function=protein kinase activity; Cellular component=nucleus; Biological process=protein amino acid phosphorylation
  Homolog annotation: Hit_ID=Q0WP97; Match level="QueryCoverage=90%, HitCoverage=45%, E-value=1e-179, Identity=63%"; Hit description=COP1 like protein
  Pfam annotation: Domain name=WD40; Domain location=210-248; Score =12.1; E_value=1.4; Accession=PF00400.22; Description=WD domain, G -beta repeat
  Pfam annotation: Domain name=WD40; Domain location=259-298; Score =18.8; E_value=0.019; Accession=PF00400.22; Description=WD domain, G -beta repeat
  Pfam annotation: Domain name=WD40; Domain location=302-341; Score =35.2; E_value=2.3e-07; Accession=PF00400.22; Description=WD domain, G-beta repeat
  Pfam annotation: Domain name=WD40; Domain location=345-383; Score =16.4; E_value=0.1; Accession=PF00400.22; Description=WD domain, G -beta repeat
  Pfam annotation: Domain name=WD40; Domain location=388-425; Score =35.0; E_value=2.7e-07; Accession=PF00400.22; Description=WD domain, G-beta repeat
  Pfam annotation: Domain name=WD40; Domain location=437-475; Score =5.0; E_value=9.5; Accession=PF00400.22; Description=WD domain, G -beta repeat
  Pfam module annotation: Pfam domain module=WD40::WD40::WD40::WD40::WD4 0::WD40; Domain location=210-248::259-298::302-341::345-383::388 -425::437-475
MHLENLFQEEEGHVLRREILQSELINGLQELFSEELSSSIDQEDAESELLLHFLVLLKEQKQNNAFKLVEDIKCLESDIEEVDRRHDSRKSLVSSGLQNDYSCQKEIMPLKKESLSLEMLPSISPISNSNEVRLMRNICHLESAYFSMRSKLQLSETDASTHPDKDILRNRENWNVAEKSEEQPKKDTLGAFFDGLCKYARYCKFEVRGVLRNADFNNPANVICSLSFDRDADYFASAGISKKIKIFEFSALCNDSVDIHYPAVEMSNRSKLSCVCWNNYIKNYLASTDYDGIVKLWDASTGQEFSQFTEHEKRAWSVDFSAVCPTKFASGSDDCTVKLWSISERNCLGTIRNVANVCCVQFSAHSSHLLAFGSADYSTYCYDLRNLRSPWCVLAGHRKAVSYVKFLDSETLVSASTDNTLKIWDLNKTSPVGASINACSLTLSGHTNEKNFVGLSVADGYIACGSETNEIYTYYRSLPMPITSHKFGSIDPISVCFKCMLEREIRHAYCGQFKWVCKSVTDGLKERFPVAATFLQFCEFLEFCTCRPCTQAKSHQPAGSI

SEQ ID NO: 149269 - protein, 59 aa, Glycine max
  Coding DNA Sequence Number=SeqID_32491
MDMEDPTGDGIPTRKSIEESRSTEESNRRQPNVQIRPGLWIILHMGNPILGRGMTYLIT

SEQ ID NO: 149270 - protein, 1005 aa, Glycine max
  Coding DNA Sequence Number=SeqID_32492
  Gene Ontology: Mol. function=nucleoside-triphosphatase activity; Cellular component=membrane; Biological process=defense response
  Homolog annotation: Hit_ID=Q2L3S2; Match level="QueryCoverage=96%, HitCoverage=97%, E-value=0.0, Identity=52%"; Hit description =Putative ATPase
ATTTALVSHLWEEFLFMDSERADNNQGTNATHTAISSTLKIKIASSSKQGEESLDCSNLPSPNINNAIESSPYGSPLVSPPSSAFVSALQSPYISPRAIIPDPPNGSSPLENQPSLPITTTTATTSTPEDVPSSSYTPPSDQYEFSDDTADTRLKYVTCFPEAAPERISFSFQVPRISFTKGPVSPATNAKLRSCDVYIGFHGQNPNLVRFCKWLKSELELQGIDCMLADRAKYSDSQSHEIADRVICSVAFGVVVVTSSSFLNHYSTEEVRFFAQKKNLIPLLFDTGPSEIMSLLNCNSVDKECKETIDGLMKCNELNLEATDGNWRSCIVKAASILRARLGRKNAEQKDNMQGYESLPFPRNTYFVGREKEIMEIEGLFFGRGNCMEQVQDHCRAFTKGEASGSGQSEGLADEESEPVIGRCGRYFSLEMGRSKEPTLGAWVEPTIGNNSVKRLKNKKSKSGNYKSLCSSVICINGVSGIGKSELALEFSHRYHQRYKMVLWVGGEARYLRQNLLNLSLNLGLDVGADSEMERGQIRSFEEQEFEAFMRVKRELFGEIPYLLIIDNLETEVEWWEGKDLYDLIPRNTAGTHVIVTTRLSKVMSYDTIQLPPLPLSDAMILMIGRKRKDYPADEIDILEKFNEKLGRSSFGVWIIGSLLSELAIGPSSLFEAINQEPLNEDSNSCYTSIAEEQWCKSNPFLMKTLLFCLETLEKTKAKGNLLAIRMLLVSGWFSPAPISDSLLANAAKSIPMVENRLKKWTKSLSLTPSCLSLRTWKNEEDSAMLLVKMGLARRANQHDGCWLHFHPITQAFAKRKGGLQYAKAAIQGVRKMGSQVNSDHLWASAFLVFGFKSEPPLVQLKAIDMVLYIKRTALPLAIQAFTTFSRCNSSLELLRVCTNALEEVEKSFVSQIQDWSSHNSICWKRRLQRDQKVDEYVWQDVTLLKATLLETRAKLLARGGRLDSAKELCRTCISIRTVMLGHNHAQTLAAQETLARLVRMRSKI

SEQ ID NO: 149271 - protein, 222 aa, Glycine max
  Coding DNA Sequence Number=SeqID_32493
MGCYSAQIVLGDLCLVDAAHLIVVGALFGMKCDFAGDVVEGEIVCGNDVDSEDGFHSEEVDENDESNKTPYKFDDQDEFEDFDEERSFEDHKYEGEQKEAEEEEVDGIDVELEDLIGLSTNLKVDGIVIDEVVDILKFEMHNMTIVDVHAKKGIGRCFDNGLSYWDTNLVVKCVTLVHISREDCDYAHRDQEDYDHFIELLGAKLSRLKHKYSSLPSTEEGK

SEQ ID NO: 149272 - protein, 313 aa, Glycine max
  Coding DNA Sequence Number=SeqID_32494
  Gene Ontology: Mol. function=DNA binding
  Homolog annotation: Hit_ID=Q1RUD8; Match level="QueryCoverage=82%, HitCoverage=64%, E-value=1e-24, Identity=41%"; Hit description=IMP dehydrogenase/GMP reductase
PQGIGTIDGTSPKASLTEAVISLAQYYDQPLRCFTFGDFQMVPTIEEFEEILGCPLGGRKPYLFTGFLPSLSKIAAVVGDSARELDPMKQTRNGVVGLPRKYLEGKARDMASQEKWGPFAGYTSIVDFWGCPLSEHGRGDVRTTVHELSVVYPLSVCGWFHTYSNKTQDTREGKEGVLFSCGDYPNVPLIGTRGCINYNPALAIRQLGYPMRGAPTKGSLSPFLVRDLGAQSLKVIQRVHKAWRSPLKKDKELRGLRNSIIGGYHGWLRVHTRGLDWLSKLKVINEENFEAPEEDEEVQALKLELGKARLAKE

SEQ ID NO: 149273 - protein, 83 aa, Glycine max
  Coding DNA Sequence Number=SeqID_32495
MEIFNHKKRWTIIDTYPRLLAAGRKIFDSLNEKLNVSCSQMDSSMFKHEGNFKVTPSPWNLLQQNLQGYQANIGSFNTETQIL

SEQ ID NO: 149274 - protein, 113 aa, Glycine max
  Coding DNA Sequence Number=SeqID_32496
  Gene Ontology: Mol. function=shikimate kinase activity; Cellular component=plastid; Biological process=aromatic amino acid family biosynthetic process
  Homolog annotation: Hit_ID=Q30CZ9; Match level="QueryCoverage=78%, HitCoverage=30%, E-value=2e-19, Identity=56%"; Hit description =Putative shikimate kinase
MSNTFQAYAYYSLIDFNTGKSSFPVEALAHRITVVGTDSHPFLHFEAGNAHMEAVKHLSIIHKERSEAYANANARVSLKTKLGQRDVSDFLTTAIAMEAMEQIKCFLISEDGF

SEQ ID NO: 149275 - protein, 165 aa, Glycine max
  Coding DNA Sequence Number=SeqID_32497
  Gene Ontology: Mol. function=catalytic activity; Biological process =metabolic process
  Homolog annotation: Hit_ID=Q84P23; Match level="QueryCoverage=79%, HitCoverage=27%, E-value=6e-18, Identity=38%"; Hit description=4 -coumarate-CoA ligase-like protein
MELSLLSVMEREEAGEPVGADSGVGISVPGSKVKEASQYDSMAILLSPGNTRHVKGVFLTHHNFIALIGGFYHLRNVVDHDPHPMSLFTLLLFHVFRLCMLVRAIAVKETLIFMQMFNFEGMLKSELVKKCDMSSLRNLGCDDTLLENKVSKNFRAKFPNMKIGQ

SEQ ID NO: 149276 - protein, 481 aa, Glycine max
  Coding DNA Sequence Number=SeqID_32498
  Gene Ontology: Mol. function=nucleic acid binding; Cellular component= intracellular; Biological process=DNA integration
  Pfam annotation: Domain name=rve; Domain location=154-300; Score =31.8; E_value=2.4e-06; Accession=PF00665.16; Description=Integrase core domain
  Pfam module annotation: Pfam domain module=RVT_2::rve; Domain location=380-475::154-300
MLLVNTSVGTVRIKMFDDVVRTLGNVKHVLDLKRNLISLSTLDSKGYKCTGEGGVLKVSKGALIVMKGQRKTANLYVLQGTTVIGDAAVVSNTLSDDDVTKLWHMPIGHMSENGMTELSRRGLLNSQSISKLEFCEHCLFGKQKRVKFMKGIHNTKGMLDYLHSDLEFHLTEESLGILLEAEGDVYTTFKEWKTMIEKQTGKQIKHLRTYNGLEFCFGEFDALCKTEGIVRHHKVHHTPQQNGVAERMNRTIMEKLQQLVFSLICPPQLPLTKELLEVWSAYAHVDNGKLEPRSVKCVFLSYKSGVKGYKLWCPETHKTIISRDVSFYETSMLQGLSITDSGDTSEKKPGMQRYAEADLVAYALNVAEDIDTTEGPSTYSEAEEMESLHKNDTWKLAHLPKDKKAVCSMHDFELEQLDVKTASLYGELEEDIYMQQPEAKDKEEIKAVKAQLNKKFEMKRLGSCKEDSKIHRDRDKRANFT

SEQ ID NO: 149277 - protein, 50 aa, Glycine max
  Coding DNA Sequence Number=SeqID_32499
MLGARSNSLAWSGSLGVVWCSAEVTLGCCGDGLGWRSRAEVARICLEDEE

SEQ ID NO: 149278 - protein, 47 aa, Glycine max
  Coding DNA Sequence Number=SeqID_32500
  Homolog annotation: Hit_ID=Q9M3D5; Match level="QueryCoverage=93%, HitCoverage=13%, E-value=5e-07, Identity=55%"; Hit description =Pectate lyase-like protein
MLAADKEVGASGTIRSKGDIFLNGAQEGLMTKDVGSNMFHPTEHYPS

SEQ ID NO: 149279 - protein, 452 aa, Glycine max
  Coding DNA Sequence Number=SeqID_32501
  Gene Ontology: Mol. function=binding; Cellular component=thylakoid; Biological process=photosynthesis
  Homolog annotation: Hit_ID=Q6K378; Match level="QueryCoverage=93%, HitCoverage=48%, E-value=1e-115, Identity=50%"; Hit description =Tetratricopeptide repeat protein-like
  Pfam annotation: Domain name=PB1; Domain location=25-102; Score=57.5; E_value=4.5e-14; Accession=PF00564.15; Description=PB1 domain
IDEKKDDVKEVIEEKSNGRSEDIPKKTAKLIFGEDIRWAELPLNCSLLQLREVICDRFPRLGAVLVKYRDQEGDLVTITSDEELRWAETGSQGSIRLYIVEANPDHDPLFEKFNVKNGEKVNTYSSPVNGSVVKAKDIISSSCIEDWIILFAQLFKNNVGFESDRYLDFHEFGMKLYSEAVEETITSDEAQGIFDIAGGKFQEMAALALFNWGNVHMSRARKKVYFTEDSSKEHMHEQIKSSYEWAQKEYAKAGEKYETAIDIKPDFYEGFLALGQQQFEQAKLSWDYALCSNVDLATWPSTEVLQLYNSAEENMEKGMLIWEESGGQQLSEIFDPKDIGLHLQNMGLDGLFKNMSSDEIAAQVENMKSQINLLWGTMLYELSIVEFKLGLPVWHESLEDAAEKFELAGASATDIAVMLKNHCSNNTDGLGFKIDEIVQAWNEMYEAKKWQK

SEQ ID NO: 149280 - protein, 232 aa, Glycine max
  Coding DNA Sequence Number=SeqID_32502
MDMNVGALISGQITLMAQSNSSRLGFLALITALCMAQGVTSDSLIFESLSPAINLAYIKKNCWNLDDPTVSFPWTHKATARGSEGPSSAPPQTSTAPSPIPSAPVPVTSGPSAQSIDLMMAMLKSIHQGQYLVAWPRVQPSSHGRGEASVAQELEPNPETTPAAQEDDLEATPPESFVPEIDPEADPMITEASPQASPVSTPVLELSTPQGSPAGMPGLHLTDDEAMDRDPP

SEQ ID NO: 149281 - protein, 161 aa, Glycine max
  Coding DNA Sequence Number=SeqID_32503
  Gene Ontology: Mol. function=binding; Cellular component=thylakoid; Biological process=photosynthesis
  Homolog annotation: Hit_ID=Q6K378; Match level="QueryCoverage=94%, HitCoverage=17%, E-value=4e-36, Identity=48%"; Hit description =Tetratricopeptide repeat protein-like
  Pfam annotation: Domain name=TPR_1; Domain location=114-147; Score =28.2; E_value=2.9e-05; Accession=PF00515.18; Description =Tetratricopeptide repeat
  Pfam annotation: Domain name=TPR_1; Domain location=40-73; Score =17.2; E_value=0.048; Accession=PF00515.18; Description =Tetratricopeptide repeat
  Pfam annotation: Domain name=TPR_1; Domain location=78-113; Score =12.5; E_value=0.17; Accession=PF00515.18; Description=Tetratricopepti de repeat
  Pfam annotation: Domain name=TPR_2; Domain location=114-147; Score =27.2; E_value=5.9e-05; Accession=PF07719.7; Description =Tetratricopeptide repeat
  Pfam annotation: Domain name=TPR_2; Domain location=40-73; Score =21.4; E_value=0.0032; Accession=PF07719.7; Description =Tetratricopeptide repeat
  Pfam annotation: Domain name=TPR_2; Domain location=78-113; Score =8.8; E_value=3.1; Accession=PF07719.7; Description=Tetratricopeptide repeat
  Pfam module annotation: Pfam domain module=TPR_1::TPR_1::TPR_1::TPR _2::TPR_2::TPR_2; Domain location=114-147::40-73::78-113::114-147::40- 73::78-113
MGKKKKQVGETSEDRGNHKKVEDKSPNSYDNDTLAFISMAQELKDEGNKFFQKRDAEGALVKYEKALKLLPRNHVDVSYLRSNMAACYMQMGLGEYPRAIRECNLALEVSPKYSKALMKRARCHEALNRLDLALKDLSAVLKIEPNNIMALEVLGKVKHAL

SEQ ID NO: 149282 - protein, 169 aa, Glycine max
  Coding DNA Sequence Number=SeqID_32504
  Gene Ontology: Mol. function=ubiquitin thiolesterase activity; Biological process=ubiquitin-dependent protein catabolic process
  Homolog annotation: Hit_ID=Q1SJA3; Match level="QueryCoverage=64%, HitCoverage=43%, E-value=7e-25, Identity=55%"; Hit description =Peptidase C19, ubiquitin carboxyl-terminal hydrolase 2
TQRKARRCGVVREEATKAARHRVKKTMKRVTVSPRKMMLAMSNYIPNFNLTSQQDATEAFLHLLCLLREEFGGCYAPKMSSLAEIFASNNRILTPIQSDCQSDKWFERINFEIPNEVYRPPVEAYRGCCRQIEKRYQRNNSPRYYISILEGDKDGNQSEAEESNNIPKI

SEQ ID NO: 149283 - protein, 113 aa, Glycine max
  Coding DNA Sequence Number=SeqID_32505
MGSNQAHAFKKRVSLSQGQVWKKECALRHPYQTRARAIEGGRDYAFADMAELNLVPIVVIPPKFKVLDFDKYKGTTCPKNHLKMYNRKMGAYSKNEKLLMHFFQESLTGAAVT

SEQ ID NO: 149284 - protein, 411 aa, Glycine max
  Coding DNA Sequence Number=SeqID_32506
  Gene Ontology: Biological process=cell redox homeostasis
  Homolog annotation: Hit_ID=Q10S76; Match level="QueryCoverage=56%, HitCoverage=65%, E-value=6e-59, Identity=50%"; Hit description =Expressed protein
  Pfam annotation: Domain name=VKOR; Domain location=189-326; Score =137.4; E_value=3.9e-38; Accession=PF07884.4; Description=Vitamin K epoxide reductase family
MDKVPTSESPSDLVGEILLHVAPHPHFVSVFIVAAVGSSSTAYEIKYKTYVDQLYPKHYTAPPTMENQTTGREKRAYLNNANELKKKTPTDASRREKRMLKSEAAEDQNKAEEEGVKKGVAEEGVTEEGVAEEEKAAGAQNFLKYAGEGNEWDAPIRHHRSPNRIGLLPPLKCSSLEPETAPPPPFDWTHKLIAGVAGVGFLETSYLTYLKLTGADAFCPVGGGTCSKILDSDYALVFGIPLPLIGMAAYGLVAALGVQLASKNFRFGIEKPTAEAVLLGATTSMAAASAYFLYILTTRFSDSSCSYCLLSAFLSFTLFFVTLKDIGLQEVSKQLGLQLLVASLVILSLNASYSNSKSASSSLAENDLPYFATEITTPSSPFALSLARHLHSIGAKMYGAFWCSHCQEQKE

SEQ ID NO: 149285 - protein, 324 aa, Glycine max
  Coding DNA Sequence Number=SeqID_32507
  Gene Ontology: Mol. function=protein serine/threonine kinase activity; Cellular component=membrane; Biological process=protein amino acid phosphorylation
  Homolog annotation: Hit_ID=Q1RX25; Match level="QueryCoverage=98%, HitCoverage=53%, E-value=1e-115, Identity=58%"; Hit description =Protein kinase; Amino acid-binding ACT
  Pfam annotation: Domain name=Pkinase; Domain location=92-297; Score =123.8; E_value=4.9e-34; Accession=PF00069.15; Description=Protein kinase domain
  Pfam annotation: Domain name=Pkinase_Tyr; Domain location=92-297; Score=150.7; E_value=3.9e-42; Accession=PF07714.7; Description =Protein tyrosine kinase
  Pfam module annotation: Pfam domain module=Pkinase::Pkinase_Tyr; Domain location=92-297::92-297
MGLNIQEAHAFSTTDGFSLDVFVVEGWPNEETEELKGVLEKEIFKVKEQNLSNQGIHYATNEQYQARMEPSPHCIQIPSDGADVWEIDTNQLKYENKVGSGSFGDLYRGTYCSQDVAIKVLKPERISTDMLREFAQEVYIMRKIRHKNVVQFIGACTRPPNLCIVTEHERKASLKYLVLQQVVKVADFGVARVQTQSGVMTAETGTYRWMAPEVIEHKPYDQKADVFSFGIALWELLTGELPYSCLTPLQAAVGVVQKGLRPTIPKNTHPRLSELLQRCWQQDPTQRPNFSEVIEILQQIAKEVNDHKDKASHGFLSALRRAHH

SEQ ID NO: 149286 - protein, 484 aa, Glycine max
  Coding DNA Sequence Number=SeqID_32508
  Subcellular localization annotation: CTP_CleavageSite=44; ConfidenceScore=5.06e-01
MCDVDQQTKKKNGLKQRESSLGMHVSLITSLVATTLPTPLIGTMSAMVFTTISTPDETPTVMTTSFISQKIDLGIHDIMCKLSRLLAEIVKPMVQNERQQSKEFEDNLGKINPISPTKYGFYVYMAKYGDLSQLASKDNQIEQFIQENELRRANKGQGSHLIVNVDEENGEAIVEEAEIMTYEILRGKPYSCPSLKLGRIKYCAGWEIALEEGRFKLVDKGCNQNGNRYRSFSKTGYQYGHPGKILRKDLTTLAQVWSVLSYSNLAPTSHTSDLTVDRARQIFGLVSQMDMNVGALISGVASDSLVFERLSPVINLAYIRKNCWNPDDLTVTIRGARRARTRPTEAPSTSTAPPPTRTLAAPSTSAPVDFRRLEAMLQSIHQGQIILLQNLQMVAPPDSIPSVEQFNESVAWPGTQSFLHREDEGSTAQVPQQMEDESSETTTPEPLVRRKKTDQTQEAATTFEKSLEATSEPSEPVADTASLQ

SEQ ID NO: 149287 - protein, 215 aa, Glycine max
  Coding DNA Sequence Number=SeqID_32509
MTRNDQHGRPHPLSKAQCLPTETTKFSLFLHPEESEPDDTQRPTWSSAPFVERLNVYRPRLLKSPRFFIQRKVSPMTRNDQHGRPHPLSKAQCLSAKTTKVSPFRHLETIVSDDTQRPSWSSAPFGRRLNTMMVTRFHCSETIKVPLSSRDKQGGVPITGPIWNILEEGYFRWKQPSLPGQAEQAGRQPPPPFFYKMAWMGAEEGVDVDVEEELG

SEQ ID NO: 149288 - protein, 155 aa, Glycine max
  Coding DNA Sequence Number=SeqID_32510
MAAQVLHKYFFIFLALVVCHGSLVAHGRKINVKPLNQQHYSLNTKTVANNNPYPSLPSLKTKVESPQYEEANKLGDSGADNTNAFRSTTPGGSTGVGHKIITSSEDNKMKTMVVVQSPDVEVFVTKGSKDDFKPTDPGHSPGVGHVYQNKIGQAN

SEQ ID NO: 149289 - protein, 237 aa, Glycine max
  Coding DNA Sequence Number=SeqID_32511
GISSLSSFSIPLPFIFQEAKESIDEEDPRPISSNGAYITNVETLQKFENSKKGGVEAPEDDEEVQALRAELEQAQTVKERFKSAALKIRKENAELRDINIATTKALEQETKRARREEHGRNKFRVALWGSNSELKLRREERDQSQVESLILKDELKVCSRSKRNMSQRLCETETNMLAIISKYQEEQNLATAHEHRVADEYAQVYTEKEARGRVIDSLQTPTLPLRRSTDFSAIVSI

SEQ ID NO: 149290 - protein, 310 aa, Glycine max
  Coding DNA Sequence Number=SeqID_32512
  Homolog annotation: Hit_ID=Q10K64; Match level="QueryCoverage=99%, HitCoverage=91%, E-value=5e-99, Identity=62%"; Hit description =Nodulation protein, putative, expressed
HSGYEASEEIATVVKDVGVDLFNGPSRSSISSINRLNLTHDVPLLHYPEPVSFNRSECAGNPVRFFAILSNQRSGSGWFETLLNSHINVSSNGEIFSVRERRVNVSTIVQTLDKVYNLDWLSSASKNECSAAIGSKWMLNQGLMDHPKEIADYFNSRSVSVIFLFRRNLLRRMVSMLANSYDRYAKLFSGTHKSHVHSKEEADTLSKYKPTINSTSLLADLKDMEMRTAKALEYFNTTRHMILYYEDLIQNRTKLKDVQEFLGLPQMELTSRQVKIHRGPLSDHIKNWDDVNRTLAGTIYESFLHADYSS

SEQ ID NO: 149291 - protein, 99 aa, Glycine max
  Coding DNA Sequence Number=SeqID_32513
  Pfam annotation: Domain name=zf-CCHC; Domain location=58-75; Score =22.0; E_value=0.00023; Accession=PF00098.13; Description=Zinc knuckle
MLRSLSKPWRPQVIALRASKNLENLSLEELVGILKVYSDGKVKARSFTKKKKKDKSPIICYECKKPRHFKSECTDLEKNKDKKKKLFVKKKGKKGLMSM

SEQ ID NO: 149292 - protein, 57 aa, Glycine max
  Coding DNA Sequence Number=SeqID_32514
VYPNLIECTLTYKFVTALHTDREFRKVLNIQEGVTTAYAALEIERLDIQSSLHATTR

SEQ ID NO: 149293 - protein, 103 aa, Glycine max
  Coding DNA Sequence Number=SeqID_32515
MELTQAMISAPHPLVLRMHALTYVDVAKKNMIVLVDHNHLLLWNLTLHDAEIGLQCVAEPWYQYLRDNDFSAGDEICFYFRLNQKVWELVIRKQVAWDDSDSN

SEQ ID NO: 149294 - protein, 74 aa, Glycine max
  Coding DNA Sequence Number=SeqID_32516
MAWVASRGNQSLNPESSSKIYPSISMVSESDSDPPSPRSAKLMASLAKHMDKLQRNVEWRMGRDLMRYKEALKS

SEQ ID NO: 149295 - protein, 124 aa, Glycine max
  Coding DNA Sequence Number=SeqID_32517
  Gene Ontology: Mol. function=zinc ion binding; Cellular component =integral to membrane; Biological process=spore wall assembly (sensu Fungi)
  Homolog annotation: Hit_ID=Q2QQX2; Match level="QueryCoverage=52%, HitCoverage=19%, E-value=2e-26, Identity=66%"; Hit description=DHHC zinc finger domain containing protein, expressed
  Pfam annotation: Domain name=zf-DHHC; Domain location=1-48; Score =34.5; E_value=4.9e-08; Accession=PF01529.11; Description=DHHC zinc finger domain
MQPPRAKHCHDCDKCVLQFDHHCVWLGNCIGQGNHCKFWWYLFEETALCLWTGVLYISYLKAHITRVCQILTSRGVNLDLQTGIPAGIHQEKENKPIQIYTFKRGNNTQTWSDNPKHPFSDMRG

SEQ ID NO: 149296 - protein, 70 aa, Glycine max
  Coding DNA Sequence Number=SeqID_32518
METRDATMAGDETIFGDPTMCFIVDANEDDVRPREGVAVVAGGVDECGHGGEEEDTEKERKKIQRRRGRR

SEQ ID NO: 149297 - protein, 549 aa, Glycine max
  Coding DNA Sequence Number=SeqID_32519
  Gene Ontology: Mol. function=protein binding; Cellular component =ubiquitin ligase complex; Biological process=ubiquitin cycle
  Homolog annotation: Hit_ID=Q2HTR2; Match level="QueryCoverage=99%, HitCoverage=100%, E-value=0.0, Identity=73%"; Hit description=Cyclin- like F-box
  Pfam annotation: Domain name=F-box; Domain location=63-109; Score =41.0; E_value=4.2e-09; Accession=PF00646.23; Description=F-box domain
  Subcellular localization annotation: CTP_CleavageSite=37; ConfidenceScore=5.07e-01
MGQSVSSAAVASRRERDPGHLSVNTSKTRSTALITPMAGYSSGAGEDESENRRGEAVTDETTDYISDLPNECLASVFQFLSSADRNRCSLVCRRWLQIEGQSRHRLSLNADEDLFPAIPSLFSRFDSVTKLALKCDRRSVSISDDALVLISQRCPNLTRLKLRACRALTDAGMEAFAKNCKGLKKLSCGSCTFGSKGMNAVLDNCAALEELSVKRLRGITDAAAAEPIGPGVAAASLKIVCLKELYNGQCFGTLILGAKNLKTLKLFRCSGDWDRLFQLMADRVTNMVEVHLERLQISDVGLQAIANFSSLEILHLVKTPECSDIGLVAIADRCKLLRKLHIDGWKANRIGDEGLIAVAKGCPNLLELVLIGVNPTKASLEMLASNCRNLERLALCGSDSVGDTEISCIAAKCVALKKLCIKSCPVSDQGMEALANGCPNLVKVKVKKCKGVTPEGGDWLRRTRGSVAVNLDTGEAELQEASASDGGAQDNVVEFPQMPAQIVAAAASASSSTTRSSSFKLRLGLLSGRSLVASTFKRWSGGSTSARHG

SEQ ID NO: 149298 - protein, 138 aa, Glycine max
  Coding DNA Sequence Number=SeqID_32520
MPLANRATFSKIYLGDYQKYPKIVILEEWVDCEMIAPDETSQKRKATSFSTESKGYKKNTTDKSDGKIKLPPKPPKTKDHVKENLGKNYSTFSESRKVIETHLSNGILRDTSWLSYSQDVNVVDLSSSQVHSNPKDGK

SEQ ID NO: 149299 - protein, 271 aa, Glycine max
  Coding DNA Sequence Number=SeqID_32521
  Gene Ontology: Mol. function=protein binding; Cellular component =integral to membrane
  Homolog annotation: Hit_ID=Q7X990; Match level="QueryCoverage=93%, HitCoverage=84%, E-value=3e-67, Identity=55%"; Hit description =Putative Mannose-P-dolichol utilization defect 1 protein homolog
  Pfam annotation: Domain name=PQ-loop; Domain location=198-251; Score =25.0; E_value=4.8e-05; Accession=PF04193.5; Description=PQ loop repeat
  Pfam annotation: Domain name=PQ-loop; Domain location=79-131; Score =30.7; E_value=5.2e-06; Accession=PF04193.5; Description=PQ loop repeat
  Pfam module annotation: Pfam domain module=PQ-loop::PQ-loop; Domain location=198-251::79-131
MEYLGIDLSCAVGSLRHGQLPEKDCLLPLISKLLGYAIVAASTTVKLPQALIVNRFLQFFFTFAACVSFIMHIFRLLLKTALGVRVRIMKILKHQSVRGLSMISFELEVIGYTIALAYCLHKGLPFSAYGELLFLLIQGVLIVFAYVLVSVYSSCRTLILYEFASRELRGIMIYCAVAPTVLAGQIDPLLFEALYASQHAIFLFARIPQIWQNFSNKSTGELSFITSFMNFGGSMVRVFTTIQENAPKSGRLASQFVFIMSSVVVIIVNEC

SEQ ID NO: 149300 - protein, 68 aa, Glycine max
  Coding DNA Sequence Number=SeqID_32522
MHQHDKVGMLAVRGGCMDPNPWTGERKHQLKKRERGKASRFKNMVFKSNRKISTNNSSMDFTGASTHI

SEQ ID NO: 149301 - protein, 122 aa, Glycine max
  Coding DNA Sequence Number=SeqID_32523
MALQQSTIPPSVNIEASQVDADPMDADPFAFIDVLSSNSMPSKASQSSLNRHFTHFDEVVAFDELHEEMESILNVFNNAFEAHQLVTNMLLTLLKLNLRQSMIELNSFKLKKDFRKPKKVLC

SEQ ID NO: 149302 - protein, 92 aa, Glycine max
  Coding DNA Sequence Number=SeqID_32524
  Gene Ontology: Mol. function=catalytic activity; Cellular component =plastid; Biological process=metabolic process
  Homolog annotation: Hit_ID=Q1SB22; Match level="QueryCoverage=94%, HitCoverage=14%, E-value=3e-39, Identity=88%"; Hit description=AMP -dependent synthetase and ligase
MEFFKEFKIVDSETDEVLPPGSKGILKVRGPQVMEGYFKNSLATNQALDGDGWLNTGDIGWIVPHHSTGRSRNSSGVIVVEGRAKDTIVLST

SEQ ID NO: 149303 - protein, 359 aa, Glycine max
  Coding DNA Sequence Number=SeqID_32525
  Homolog annotation: Hit_ID=Q9FH18; Match level="QueryCoverage=75%, HitCoverage=49%, E-value=1e-14, Identity=32%"; Hit description =Arabidopsis thaliana genomic DNA, chromosome 5, TAC clone:K24C1
MDLGSESVEENEVNHDGNGNGGSYDDEKIGLGLEGNSDVNGSDQKGTVGEVEVGSAEGVNSKGTPTKGFGLKKWKRIRRNVVKDPNSSVDSGKVLKRGLSGNANLSESQPFLRDVKEKNEGSSNMFGNVVFSDGNVIHGSSSDSRYALGSGFVVGTDSENSEDQSSKSSTAASEPKLRQEKSRSKNVNSKHLANSAQRVQPGKGRTEGSKKPGGGGRVKIEKENSFSSLESDSRSSNFKQGVFSVTSNGKHTSRPNVYDGVNSGEAHTNEHFTEGVEAGYGNENVVEDEYLLQENLGTNLSWDVTEEKSVNNQSSAVEDPIIESVSCLQAVQEALQEVDIVMFLGFIILGRMYVNILPN

SEQ ID NO: 149304 - protein, 94 aa, Glycine max
  Coding DNA Sequence Number=SeqID_32526
  Homolog annotation: Hit_ID=Q00M75; Match level="QueryCoverage=32%, HitCoverage=5%, E-value=6e-08, Identity=87%"; Hit description=PPR -repeat containing protein
MVNENARTFNWISGFSISNTVSAFEVKYGGGILYATSPLHMKRGCFWIQTHNQQVTKAQLYRCARACPQVTKDKLSSSFRGPTFLDTGTWETNF

SEQ ID NO: 149305 - protein, 109 aa, Glycine max
  Coding DNA Sequence Number=SeqID_32527
MAHQTQNDHNLFLCATGNDRLWMAKRAQNLYLRVYPISLLFLNDKGHRICIYAAQNLYLCVYPLSLLFLNDKGRRICIYAFTHSACYHALSLRDSERKFLRITTLGGIL

SEQ ID NO: 149306 - protein, 94 aa, Glycine max
  Coding DNA Sequence Number=SeqID_32528
  Homolog annotation: Hit_ID=Q9LZ20; Match level="QueryCoverage=43%, HitCoverage=7%, E-value=3e-08, Identity=65%"; Hit description=Amino acid transport-like protein
MARVMSKITATTTKSISLKPLGRDSTVRRHLEEEIPIVVPRYAIKPLATVTLESTDQSGAFQFLYLTLNFLVNQGQKDHLNETCQPLESLTELA

SEQ ID NO: 149307 - protein, 407 aa, Glycine max
  Coding DNA Sequence Number=SeqID_32529
  Gene Ontology: Mol. function=L-xylulokinase activity; Cellular component=integral to membrane; Biological process=carbohydrate metabolic process
  Homolog annotation: Hit_ID=Q2K1Z6; Match level="QueryCoverage=99%, HitCoverage=80%, E-value=1e-103, Identity=44%"; Hit description=L -xylulose kinase protein
  Pfam annotation: Domain name=FGGY_C; Domain location=236-407; Score =8.7; E_value=1.4e-07; Accession=PF02782.6; Description=FGGY family of carbohydrate kinases, C-terminal domain
  Pfam annotation: Domain name=FGGY_N; Domain location=1-233; Score =152.6; E_value=1e-42; Accession=PF00370.11; Description=FGGY family of carbohydrate kinases, N-
  Pfam module annotation: Pfam domain module=FGGY_C::FGGY_N; Domain location=236-407::1-233
AVLFDLSGRVLSVAECAGETHQPQEGYAERPVEDIWRGVSNAVSRCLQQAGTRGSEVIAVGAAGHGNGLYALDRQQRPLFGIQSIDHRASATVQALESSGAAQQIYALSLQKPWPAATPVLISWMRQHQPERWAQIGHLLCAKDVIAHFLCGNVSADYSDAAGAGLIDYRQRGYSGELLALYGIEEALALLPPLRESCEVTGVVSARAAQLTGLPAGIPVVAGMFDVVASAVGSGVVNCGEASIVAGTWSINQVVVDKPDYLRPVFMNSIIERDRYMAIEASATSAANLDWFLREFDDGRAGQGAARSSDSVAQVRPDAQLPLYHPYLYSGRKAEPAKAGFYGLGGWHTRADMLFALFEGVTFAHRAHIDRLRAAGITVNQATLSGGATRSSVWPQMFADVLGMPIR

SEQ ID NO: 149308 - protein, 140 aa, Glycine max
  Coding DNA Sequence Number=SeqID_32530
MGPNKLPHQHQCIKNYEICMNRVSYAHREHLHEFVPLVRRSHCYLPINTRFVVGHHRRESNRQHHDVFARKPDPTRNWILVLFLRVSKSLVAFTAFYEHNLRWVSCSCCGDVVVASNTAKKEKKEGGGAKATSMPSRMSK

SEQ ID NO: 149309 - protein, 132 aa, Glycine max
  Coding DNA Sequence Number=SeqID_32531
MVAWPGTQPSLHREDEGPTAQVPQHVEDESSEATILEPFIRGEEEGDTQVRQVAVATSERSLEATSESPAPAEDLSSPHHAANPSTPILEIPKDPTTLVLTLDTSPPATPIFHLIDEEDVQTQDTQDQSQEF

SEQ ID NO: 149310 - protein, 349 aa, Glycine max
  Coding DNA Sequence Number=SeqID_32532
  Gene Ontology: Cellular component=plastid; Biological process =peroxisome organization and biogenesis
  Homolog annotation: Hit_ID=Q9SXF7; Match level="QueryCoverage=77%, HitCoverage=59%, E-value=5e-80, Identity=50%"; Hit description=Amino acid transporter-like protein 1
  Pfam annotation: Domain name=Aa_trans; Domain location=102-349; Score= -136.7; E_value=0.012; Accession=PF01490.8; Description=Transmembrane amino acid transporter protein
  Subcellular localization annotation: CTP_CleavageSite=25; ConfidenceScore=5.07e-01
MGEAKEIWSAPITPRTASVVGTPVVASPPVSCPPSQLHSPSLTRSPLLHPEDGDAPRPNKTSKTPKTPRTPRTPRTPLRISNLTPKFLTPLGSPVRKALRFTKLDPQDAWLPITESRNGPCSPCGLHFSWLLGYLQVTTEQDVGNHKYDSGVHMATLYLMAAGEKLGKILALFPILYLSAGTCTTLIIIGGSTARTFYQVVCGETCTAKPMTTVEWYLVFTCVAVVLSQLPNLNSIAGVSLIGAVTAVGYCTAIWVTSVARGALKDVSYNPVRTGSSIENAFGVLNALGIIAFAFRGHNLILEIQSTMPSSEKHPSHVPMWKGVKVSYTIIAACLFPMAIGGYWAYGQL

SEQ ID NO: 149311 - protein, 38 aa, Glycine max
  Coding DNA Sequence Number=SeqID_32533
MVHFESFLSPTMVVFMIVVMVVPTIIVTDMRMVINYQV

SEQ ID NO: 149312 - protein, 239 aa, Glycine max
  Coding DNA Sequence Number=SeqID_32534
  Subcellular localization annotation: CTP_CleavageSite=16; ConfidenceScore=5.37e-01
MCPPPSSLEPCVVIPQCNSPFSTLFRSPMNCIFIHVSSTFEFGAMRSDCLVQFSILNLFRSPMNCVFVHVSSTFEFGAMHSDCLVQFSIRNLFRTPMNCIFIHVSSTFKFGAMRSDCLVQFSILNLFRSPMNCVFVNVFSTFEFGGMRSDCLVQFSILNLFRSPMNCVFVHVFSTFEFGAMRSDCLVQFSILNLFWSPMNCVFVHVSSTFKFGAMSSDCLVQFSILNPFWKPMNCVFVH

SEQ ID NO: 149313 - protein, 274 aa, Glycine max
  Coding DNA Sequence Number=SeqID_32535
  Gene Ontology: Biological process=protein modification process
  Homolog annotation: Hit_ID=UPI0000E476FA; Match level="QueryCoverage =95%, HitCoverage=39%, E-value=1e-08, Identity=26%"; Hit description =PREDICTED: similar to NEDD8 ultimate buster-1
  Pfam annotation: Domain name=UBA; Domain location=136-174; Score =17.8; E_value=0.028; Accession=PF00627.21; Description=UBATS-N domain
  Pfam annotation: Domain name=UBA; Domain location=4-43; Score=34.2; E_ value=4.7e-07; Accession=PF00627.21; Description=UBATS-N domain
  Pfam annotation: Domain name=UBA; Domain location=76-115; Score=29.6; E_value=1.1e-05; Accession=PF00627.21; Description=UBATS-N domain
  Pfam module annotation: Pfam domain module=UBA::UBA::UBA; Domain location=136-174::4-43::76-115
MLQVPDEALSLVMSMGFVERDAKRALRMNNQDVGGAIDFLAEEKAKKLQKREEDIRRRNEIKEQKQYGMTPLKKAVDLERLKELVSIGFDKELAAEALRRNENDTQKALDDLTNPETNSALQVNIESRKRKRQKQARDSEIRNVVQMGFERSRVVAAFEAGGSLEEVLQRLTAQPGTDPTQPQENSASASHGGASSSAPLPDNVDSDIAMNEVEDPSITEQRDVEMEDELSADIAKADALADYDIEVNVEGEAITEYLSLVESAGSCGKTAPSQ

SEQ ID NO: 149314 - protein, 157 aa, Glycine max
  Coding DNA Sequence Number=SeqID_32536
MHCSRWAEAQRLGQQGRATGYVHYAKTIDDIAGLRQSHWRHTFSLNSCFFLLCCRFLVSGKYVALQICDDEDVETIIESFQQQDQTSVLELYIEKDVVGGSMFHDVNSLTSCGNNLFNNKPELSKNISNLHGDDDDDYLVSNSYIEESLEKDDSVDT

SEQ ID NO: 149315 - protein, 308 aa, Glycine max
  Coding DNA Sequence Number=SeqID_32537
  Gene Ontology: Biological process=protein modification process
  Homolog annotation: Hit_ID=UPI0000D55C95; Match level="QueryCoverage =85%, HitCoverage=53%, E-value=3e-13, Identity=22%"; Hit description =PREDICTED: similar to CG15445-PA, isoform A
MARLKIGGTWAGVLEEVDLQAWTLATLRDLVAARSNSPSSDSINLICAGKILKDDAVPPQTLAQLGVKNNAKILATRTSTPQQGHSFLAQEERSSRLARIRAAANAMADRHADGALPVEDFNIEVEDQSGQKVRLGSETDQSVELECWNVMIKILLCRAVMMGLMLHAKGKRLIRQGNYKDALEVLSMGEESFSLCDPKVIELIDNVPILQIDMVWCYFMIRDIRWLSDAGKRLEMAREGIERAHGKDSFRLRLLQVGRYPELALHLRLELLEGVVAYHIGQLEKSKKTLASARTKFIQSFNSVFGFN

SEQ ID NO: 149316 - protein, 191 aa, Glycine max
  Coding DNA Sequence Number=SeqID_32538
MQNWDTHDSSYIYLIEHRHNHFLVLVLTTLVDEGIHFPILVCHISCCCEKNIIITKPRIILDINVEAIPYLSSTTLTNHYLRCTDIMPSLVEWVWFNGFIAHGGVHLANRLKRMFWWSDMKRDVTNYVATCSTCQKAKVEHHSLGELTYNNSYHASIGMALFEALYGKRCRTLLCWYPDGVNITVGPEFLQ

SEQ ID NO: 149317 - protein, 96 aa, Glycine max
  Coding DNA Sequence Number=SeqID_32539
  Gene Ontology: Mol. function=DNA binding; Cellular component =chromatin; Biological process=DNA integration
MGEHVFLKVMPTMSVGRAIKSKKLTPKFLGPYQILRCVGHVAYEMDLPPFLANLHNVFYVLQLRKYNLDPTHVFELDTMQVHEDLTYETLPTRIED

SEQ ID NO: 149318 - protein, 586 aa, Glycine max
  Coding DNA Sequence Number=SeqID_32540
  Gene Ontology: Mol. function=calmodulin binding; Cellular component =integral to membrane; Biological process=cell death
  Homolog annotation: Hit_ID=Q56BA5; Match level="QueryCoverage=91%, HitCoverage=95%, E-value=1e-112, Identity=40%"; Hit description=MLO1
  Pfam annotation: Domain name=Mlo; Domain location=4-499; Score=521.4; E_value=1e-153; Accession=PF03094.6; Description=Mlo family
MDIGKERSLEETPTWAVSVFCFFFLMISLIIEGGLHKLAEIFRKRKEKSLGKALTKTKTEMMKFGFMSFILTISEVPISKICISKGVANSFLPCKDVVDFTGSATRTSTSGLDVAPATNESAIEVNYCEAKFYQVKEYAQLENQGMVSLISSDGILQLNIFISFLAVFHILFCTLTMCLGKAKMRRWKRWEDETQTLEYQIANDPRRFQYTGQTLIGKRHLKFWSYHSPLLWMVCFIRQFYGSVSKDDYFTLRNGFIAANISLGSNFNFKKFLSRTYDEDFEKVMGIRPKNHEPQAFDALAGFGSGFSPYFSYFLARTVALLAGTKLQVIITKMCVDSCKEKSVIKGSLLVTPSDAHFWFHRPEWLLHLLKFILIQNSFQLAFFTWTWYEFGPRSCFNRKREDIGIRIVMGVAVQLFCGYVTLPLYALVTQMGSSMRREIFTERVSRDLKNWHKRAKQSVSKNNSTSSKHSDTLHSKECDNSVRGSVDIVHTSDNVVLTSPPSHMISGEEEKSIAPTNEQEISSNSTSEIIKTTQEENPKIITRGTYDGEISFGSSWKNVGSSRGIGEIGSIIEEDDAEKLPELIP

SEQ ID NO: 149319 - protein, 167 aa, Glycine max
  Coding DNA Sequence Number=SeqID_32541
MGEENESLIFPNCSSKAKECLEQSRRCQEAFKCFFVRKVSHLTWSRRPDENHVKIVLSYTKIPQPSNKNLLIHLLSSTSATPIYLRITIFHLCVNIVRANNTDGFKMSALRVQIECVKLRVYNECIDGSKWSVDGRRSGGDVMAKEETMAMYVEASKRGNPFFNFEL

SEQ ID NO: 149320 - protein, 123 aa, Glycine max
  Coding DNA Sequence Number=SeqID_32542
LDSDTENISKLEYARILMRIASPQAISTSDNNKGLEIMSSHSECSSDATTFFGEEEEVENQVKMGKSDDQREERGYGLEQKCMEVDGKPGKGTWGGRCTISSRGKGFKKSNSRSASEDDVNRP

SEQ ID NO: 149321 - protein, 76 aa, Glycine max
  Coding DNA Sequence Number=SeqID_32543
MEGVVEFFKKFWMWKRSERTELEEKAILQSIGGDLNISFLVCFCLDHVDACSVRIIQHLEMFWSSLVQQEGSKDNA

SEQ ID NO: 149322 - protein, 119 aa, Glycine max
  Coding DNA Sequence Number=SeqID_32544
MDAIALLSRYGRVTLVDDGCPWLIGWNGSQNCGSNDFQDYFDNAKESRVKQVPKNQESKNFKNQVSKNQDSRIIKFQDSIKFQESRFKNNQDQDSRLKIQESREDSIKISTKKVFQNIE

SEQ ID NO: 149323 - protein, 45 aa, Glycine max
  Coding DNA Sequence Number=SeqID_32545
MSTWENLHTMKPRVMSLNISNPKIMNIGGAMCLMLRRRNCLFWTP

SEQ ID NO: 149324 - protein, 77 aa, Glycine max
  Coding DNA Sequence Number=SeqID_32546
MSGKGHNVRVLLKCSPLSIVAFLVLSRAPPPAALLGFPNVRENEKGLKPPFHGPTFDASFSHHRHYFANPNGEDVRK

SEQ ID NO: 149325 - protein, 318 aa, Glycine max
  Coding DNA Sequence Number=SeqID_32547
  Gene Ontology: Mol. function=O-methyltransferase activity; Biological process=lignin biosynthetic process
  Homolog annotation: Hit_ID=Q1T3W1; Match level="QueryCoverage=79%, HitCoverage=69%, E-value=1e-79, Identity=56%"; Hit description=O -methyltransferase, family 2
  Pfam annotation: Domain name=Dimerisation; Domain location=30-78; Score=73.5; E_value=6.7e-19; Accession=PF08100.2; Description =Dimerisation domain
  Pfam annotation: Domain name=Methyltransf_2; Domain location=92-305; Score=138.2; E_value=2.3e-38; Accession=PF00891.8; Description=O -methyltransferase
  Pfam module annotation: Pfam domain module=Dimerisation::Methyltransf_ 2; Domain location=30-78::92-305
MATQSEENATKFLQAYTQIDDHSLRFIHSMSLKCAIDLSIPDIIHKYGQPMPLSQLIASLPIHPSKTCYIHRLMRLFTHSGFFSRHDLVENEQEVITYELTDASRLLLKDHPFSLRPLLLVTLDPSVIKSWCQFSTWLTSEDRTPFQTENGVTYFDYAKRDPKFGHFYNDAMAKDTRFASSVVIENYKEVFEGLKSIVDVGGGIGTMAKAIAKAFPQVKCTVFDLPHVVDGLQGTENIEYVGGDMFEVIPAADCIMLKSPHSPGTTTQLSGARSTIELIARRTGLPPEPAMPKARETPSLSFLFSPHPCRPRVATWMG

SEQ ID NO: 149326 - protein, 79 aa, Glycine max
  Coding DNA Sequence Number=SeqID_32548
MKNGGKPWRNRQRKGLGSVTEAPRLGFSSRKQFLSLILSVLRYQEGSALLPLFIGEKREVVAAQLAQASWVASTRTHRH

SEQ ID NO: 149327 - protein, 336 aa, Glycine max
  Coding DNA Sequence Number=SeqID_32549
IEVERESSARISITEADDPLTRSTRKVKWKSDDGEHHAGSKIDAENDKGKGIGHADVCYGSPNKEVLLTPISQVDAGRFKEIPITDDEFSEWCKPWRGSLMVTVLGRKVGLRQLETKLKRDWEKKGSIKIIDVPRDYYQDKACVKQASNEVIRWVLEDGGKKEEVVADERQLVLELNASAIKDHNDNNENKGTNEDVMDTINGNDSSIYGPWLLVKKPVRRGEDGNINVFNNVASGPTTTKAHKEMSLVVKSKVFLLEEETLKFIKLIQEASQPKESKVATPNPSVMKGNKASSDMESENDMGTPSSMQADVVTCTLYPRFTFTLIAKLKSYQIRV

SEQ ID NO: 149328 - protein, 317 aa, Glycine max
  Coding DNA Sequence Number=SeqID_32550
  Gene Ontology: Mol. function=protein serine/threonine kinase activity; Cellular component=nucleus; Biological process=proteolysis
  Pfam annotation: Domain name=Transposase_21; Domain location=172-317; Score=160.5; E_value=4.5e-45; Accession=PF02992.5; Description =Transposase family tnp2
MDGSWMNACHMSLACEEGMEQLLQFSSKRSGPDEDEKHFFPCINCLNGRRQVVHDMLPKENRLSKSYYQAKKILCPMGMEYQKIHACPNDCILYIHDFEEMNKCHRCGVSWYKVKDYNDRSSDENSKKGPPAKVLWLTETLMECSAIRLMECSTIRLIPYMACTWEKLYMWKDLTWHAHGRNSNGMLCHPTDSSQWKKINRLYLDFDKEAINIRLGLATDGINPYGSISTQHSLWLVLLVIYNLPPWLCMKGEYMILSMMISGPRQPENDINVYLIPLIEDLTKLWDEGVLVFDGFQNETSDLRVMLFYTINDFPTY

SEQ ID NO: 149329 - protein, 241 aa, Glycine max
  Coding DNA Sequence Number=SeqID_32551
  Gene Ontology: Mol. function=oxidoreductase activity, acting on single donors with incorporation of molecular oxygen, incorporation of two atoms of oxygen
  Homolog annotation: Hit_ID=O48631; Match level="QueryCoverage=29%, HitCoverage=20%, E-value=2e-10, Identity=42%"; Hit description =Ethylene-forming-enzyme-like dioxygenase
MKDASSEFYNLPIEEKNKNAMTSNEIQGYGKGYLVSEEQTLDRSDVLMLHIYSTRYRKLQFWPKIPEGFKKGNCAEQPKVALSLIPTERKCVETPEGYKYVLSVKNTTFTLLFSQKLLPNSRPNFPPPKTTNGRRCLPLDPHTKRNTLIGAESSESSLKIRWRKSLNPPFQSFSECTDLLGSLTLALGHVHALDVVYKCTDLPGFLALALGHVHMSYVVYVHGGWSALTLSDGPDVGDKCG

SEQ ID NO: 149330 - protein, 334 aa, Glycine max
  Coding DNA Sequence Number=SeqID_32552
  Gene Ontology: Mol. function=oxidoreductase activity; Cellular component=cytoplasm; Biological process=flavonoid biosynthetic process
  Homolog annotation: Hit_ID=Q9LIF4; Match level="QueryCoverage=93%, HitCoverage=95%, E-value=5e-68, Identity=37%"; Hit description =Arabidopsis thaliana genomic DNA, chromosome 3, P1 clone:MHC9
  Pfam annotation: Domain name=2OG-FeII_Oxy; Domain location=181-275; Score=109.8; E_value=8.2e-30; Accession=PF03171.10; Description=2OG -Fe(II) oxygenase superfamily
MEEAPTLAPSIPLENVQEMVRNDPLHVPIGYVTSQEELEKANYMPHLSSEIPVIDLALLSNGNKEELLKFDVACKEWGFFQIVNHGVQTELMQKMKDAASEFFNLPIEEKNKYAMVSSETHGYGKGCVVSGEQTLDWSDSLILITYPTQYRKLQFWPKTPEGFMEIIEAYASEVRRVGEELLSSMSVIMGMRKHGLSPHSDTSSITLLMQDDDVTGLEIRHQGGWVPVNPIPDALVVNVGDVTEIWSNGKYKSVEHRAMTNKNKERISYGLFLCPQHDVEVEPLDHMIDSHNPKLFQKVRYGDYLRQSLKRKLEGKTHLNEAKLKESDLRNQDD

SEQ ID NO: 149331 - protein, 449 aa, Glycine max
  Coding DNA Sequence Number=SeqID_32553
  Gene Ontology: Mol. function=RNA-directed DNA polymerase activity; Cellular component=extracellular region; Biological process=RNA -dependent DNA replication
  Homolog annotation: Hit_ID=Q2HVE2; Match level="QueryCoverage=51%, HitCoverage=36%, E-value=5e-41, Identity=31%"; Hit description =Ribonuclease H
MGACGFGNLIKDICKEYETSILFLFETHASKEEGVERILPKLGFDSSFIQPAHGHLGGIWCLWNDDYWKDRCGGSVNPSRKNAIDFQRKMEDCDLIDAGFQGLVIEEFWCKELNWDDRLRDFRVELRRWNKEGDLERVLGSIKTRGTSLVSTVSSKMDQNRVWVGDQETLERLVIEYYALLCTDDTPDSQFCISGVGEPVDLEKAYDRLKWEFVLWNGEALSKFLPSRGIRQGDPILPYLFVLCIKRLFQLINHVVELGHWIPIQFSRFGPKLSHLAFADDLLLFAKATMDQAETLKKVMNVFCLSSGQEVSEEKTVVYFSTNVLWQQRDQIVSALDYQRMTNLGKYLGVPLHHDKGTKQSYQCLMDKMNQWLNNWKVSRLSLAGRVTLPKDMTSTKKVRWLNWNACCMPKRSDSFGLRKETSMNQAMLSKAGNKSVERNCEDLEHDVF

SEQ ID NO: 149332 - protein, 280 aa, Glycine max
  Coding DNA Sequence Number=SeqID_32554
  Gene Ontology: Mol. function=oxidoreductase activity; Cellular component=cytoplasm; Biological process=flavonoid biosynthetic process
  Homolog annotation: Hit_ID=Q9LIF4; Match level="QueryCoverage=91%, HitCoverage=70%, E-value=2e-66, Identity=44%"; Hit description =Arabidopsis thaliana genomic DNA, chromosome 3, P1 clone:MHC9
  Pfam annotation: Domain name=2OG-FeII_Oxy; Domain location=119-219; Score=152.7; E_value=9.9e-43; Accession=PF03171.10; Description=2OG -Fe(II) oxygenase superfamily
MVLKKSFCRKMKDAASEFFELPAEEKKKYAMDSSDIQGYGQAYVVSEEQTLDWSDALMLVTYPTRYRKLQFWPKTPEGFKEIIEAYASEVRRVSQELLSLLSVIMGMQKHVLLELHQESLQALRVNYYPPCSTPEQVLGLSPHSDANTITLLMQDDDITGLEIRHQGGWVPVTPISDALVVNVGDVIEIWSNGKYKSVEHRAVTNKNKRRISYALFLCPQDDVEVEPLDYMIDSHNPKLYQKVRYGDYLRQSMKRKMEGKAHIDVAMTEDSESDMRNKDE

SEQ ID NO: 149333 - protein, 545 aa, Glycine max
  Coding DNA Sequence Number=SeqID_32555
  Gene Ontology: Mol. function=protein dimerization activity; Cellular component=nucleus; Biological process=regulation of transcription, DNA-dependent
  Homolog annotation: Hit_ID=Q9XED8; Match level="QueryCoverage=97%, HitCoverage=82%, E-value=1e-129, Identity=47%"; Hit description =Auxin response factor 9
  Pfam annotation: Domain name=Auxin_resp; Domain location=214-303; Score=141.1; E_value=3.1e-39; Accession=PF06507.4; Description=Auxin response factor
  Pfam annotation: Domain name=B3; Domain location=118-192; Score=29.5; E_value=1.2e-05; Accession=PF02362.12; Description=B3 DNA binding domain
  Pfam module annotation: Pfam domain module=Auxin_resp::B3; Domain location=214-303::118-192
MSLNRGGGGEEDELYEQLWKACAGPHVEVPRTGQRVFYFPQGHMEQLEVSTNQELNQRIPLFKLPSKILCRVVNVHLLAEQETDEVYAQITLVPESNQAEPMSPDPCPAELPSPRVHSFCKVLTASDTSTHGGFSVLRKHATECLPALDMSKSTPTQELVAKDLQGYEWRFKHIFRGNNGELRVGVRRIAPVQSSMPSSVISSQSMHLGVLATASHAVATQTLFVVYYKPRASQFIVSVNKYLEAINQKCNVGMRFKTRFEGDESPENYKRYSKTRFIRFSGTIVGVEDISPHWVNSNWRSLKVQWDEPASFPRPDRVLPWEIEPILASVPTTSSQTAAIKNKRPRQASELADLGDTPLAFPTFWDAGLTQSDMAKLSVMAEIKRSDSSSHMWHHNSKSSNNGISMNQTEASWLSSPSQLYHDTTDDSKSISAWPISKPHSERLNNDHFLDQVDKEINKVEAATSYRLFGIDLIDHARNNSLSAENASGITSECKIDVNHVSDISKASKEWNQEQLQLSPKETQSKQVCSRSCTKVLDMSHVLLI

SEQ ID NO: 149334 - protein, 114 aa, Glycine max
  Coding DNA Sequence Number=SeqID_32556
MEWARKNQISVVENCKRYSTYKCLEELWWLLVVCFEISRRLDFCSVLEAKLWGIMYDLQMAAEAKMEHLHVAIDSLRAMMLIYDCMQFEGHNIASLLESEVKFQKLHLWPYWEK

SEQ ID NO: 149335 - protein, 68 aa, Glycine max
  Coding DNA Sequence Number=SeqID_32557
MPLSDSIRWDPIVDSITMLIAQKLIILKGSYNWFPNVRKKKGLEPPFHYLCARDISLTKDIISKIPTV

SEQ ID NO: 149336 - protein, 182 aa, Glycine max
  Coding DNA Sequence Number=SeqID_32558
  Pfam annotation: Domain name=Transposase_23; Domain location=33-103; Score=-4.7; E_value=0.0037; Accession=PF03017.5; Description =TNP1ENSPM transposase
GLALPPEPEVGPSGTRVNTKESCVDPSGQDQDTGELEKCGLYVDENPPYLVAFGRFYEGSTTVQNIPLGNDQVKVGVEEVRDADARILIPTQEVRLVGQTLNAFLAWPIHLVKRLSKHVMWDSIVFGVYNDNFPLYIKHEDLSEIAHGGQCLSIYVIQLWILHMSETSMGAGNVDVYGFLKP

SEQ ID NO: 149337 - protein, 109 aa, Glycine max
  Coding DNA Sequence Number=SeqID_32559
MMLLSFESMHAGWPQPTYCDFCGGEHVTGDCHLYFMKNSLLEQEVYVQHESLPQVSISFHHLNVKEERHEEFDKFISAFIALFTNTFSTKVWKLPLCYLTFMEFLPKMR

SEQ ID NO: 149338 - protein, 268 aa, Glycine max
  Coding DNA Sequence Number=SeqID_32560
  Gene Ontology: Mol. function=oxidoreductase activity; Cellular component=cytoplasm; Biological process=flavonoid biosynthetic process
  Homolog annotation: Hit_ID=Q9LIF4; Match level="QueryCoverage=95%, HitCoverage=71%, E-value=5e-62, Identity=42%"; Hit description =Arabidopsis thaliana genomic DNA, chromosome 3, P1 clone:MHC9
  Pfam annotation: Domain name=2OG-FeII_Oxy; Domain location=109-209; Score=152.3; E_value=1.3e-42; Accession=PF03171.10; Description=2OG -Fe(II) oxygenase superfamily
MKDASSEFFKLPIEEKNKYASASNDTHGYGQAYVVSEEQTLDWSDALMLITYPTRYRKLQFWPKTPEGFMDIIDAYASEVRRVGEELISSLSVIMGMQKHVLLGLHKESLQALRVNYYPPCSTPEQVLGLSPHSDTSTITLLMQDDDVTGLEIQHQGGWVPVTPIPDALVVNVGDVIEIWSNGKYKSVEHRAVTSKNKRRISYALFLCPRDDVEIEPLDHMIDAQKPKLYQKVRYGDYLRQSMKRKMEGKTHMDVARIEDSHLTKKDD

SEQ ID NO: 149339 - protein, 113 aa, Glycine max
  Coding DNA Sequence Number=SeqID_32561
MTRWMTLKNLMLEDAETQCSDKMIEGVTTTLVEARSKRTRTVELVDNDVGGCVTSQKGDGATVANGGYQKMIHKRGKGCWKVKAGYRNKYNDCKGPLGGNNFRYSLNLALDTI

SEQ ID NO: 149340 - protein, 82 aa, Glycine max
  Coding DNA Sequence Number=SeqID_32562
MSHNVEYDELVSEMEEAPSFASSIPVPNVQEMVPFIDLALLSRGNKEELLKLDLACKEWGFFQDNYYDIYVAYLKGSLNYAN

SEQ ID NO: 149341 - protein, 97 aa, Glycine max
  Coding DNA Sequence Number=SeqID_32563
MAVKNFEVIKRRSHADKQWSPDEIREEFEARLSQVKSNVASSVGKSQITPLDLVEEQRLRTRGWVATVGPKRKGHLYGIGDLAHTYKCGDNNFMQHT

SEQ ID NO: 149342 - protein, 87 aa, Glycine max
  Coding DNA Sequence Number=SeqID_32564
  Subcellular localization annotation: CTP_CleavageSite=74; ConfidenceScore=5.69e-01
MKSKCKARNHLVFRSGRQKIPRKKGKRVFSLFFLGPSPPRPAFGSPGPPNNFKAKGLARLGELTALGLSFSSPREAATAPRWPFAYK

SEQ ID NO: 149343 - protein, 134 aa, Glycine max
  Coding DNA Sequence Number=SeqID_32565
MAIESGHMLAEVNIEGSLEGVHNISKQKETLVKTPSSVLRSSKTYLESHPCHEKTISKASGASPPHPQTSIATPPHHLFTFLKLLTEPAYPILQHRRVPSMYHHPTQTPTPITCNTTHRPTTQPKILTCTTHDV

SEQ ID NO: 149344 - protein, 184 aa, Glycine max
  Coding DNA Sequence Number=SeqID_32566
MEDTNELLHLLVDAMNRGLRDANGSLSKQNVERIILPQFNAKTKFPKTYSHYLSRMKWFRNQYNMMSTLMRNNSGFGWDPIGKTFTAHEDVWKDYLKSTPPFLFKTQAELVLACAALHNFLRKECRSDEFPVEPTDESSSSSLVLPNYEDNDHEPIVQTQEQEREDANIWRTNIGSDMWRNANN

SEQ ID NO: 149345 - protein, 542 aa, Glycine max
  Coding DNA Sequence Number=SeqID_32567
  Homolog annotation: Hit_ID=Q1SH13; Match level="QueryCoverage=99%, HitCoverage=100%, E-value=0.0, Identity=60%"; Hit description =Nodulin-like
  Pfam annotation: Domain name=MFS_1; Domain location=79-497; Score =19.7; E_value=4e-05; Accession=PF07690.6; Description=Major Facilitator Superfamily
  Pfam annotation: Domain name=Nodulin-like; Domain location=11-258; Score=397.5; E_value=2e-116; Accession=PF06813.4; Description =Nodulin-like
  Pfam module annotation: Pfam domain module=MFS_1::Nodulin-like; Domain location=79-497::11-258
MLRVKGGSRPPWVGLGAAVWVQIASGNTFTFPLYSHSLKSVLGFDQRHVTLLGVAVDIGENLGLLPGLACNKFPPWLLLAVGSLAAFLGYGLLFLAISETLHSLPYITLWFALVVAANSSAWLTTAVLVTNMRNFPASRGSVAGILKGYGGLSAAVFTEIYSIVLHNSSSKFLLFIAVGIPVVCFSMMFLVRPCTPATGDDPVEPYHFLFVQGSSVVLGVYLLATTVVGNIIPFSGAVSYVLVAVMILLLIAPLAVPLKMTLFPRNGSKSDSPEQQVGSSEGKDENAEPLLASSSAGALGSFDDQDDLSEVAELLALGEGAVKQKKRRPKRGEDFKFTEAIVKADFWLLFFVFFVGVGTGVTVLNNLAQIGIAQGEEDTTTLLSIFSFCNFVGRLGGGVVSEHFVRTKTIPRTVWMTCTQTLMLVVYLLFAYAINGTLYPAIAFLGVCYGVQVSVMLPTVSELFGLKHFGVLSSFMSLGNPIGAFLFSALLAGNIYDNEAAKQHVCAAGIVLSIILTLRIKPVYQMLYAGGSFRLPQTSSNH

SEQ ID NO: 149346 - protein, 65 aa, Glycine max
  Coding DNA Sequence Number=SeqID_32568
MGNDADSNSGTEDDIHSSTNFEFYLQGLERAKIIVNKPLPQKRLETLIEAQKQALLEEVEEENSH

SEQ ID NO: 149347 - protein, 40 aa, Glycine max
  Coding DNA Sequence Number=SeqID_32569
MKIFITLKDVVEGHARNKVRHKTLKGVRGWGRFDYSTGRD

SEQ ID NO: 149348 - protein, 77 aa, Glycine max
  Coding DNA Sequence Number=SeqID_32570
MDIQNNNPFDHDNQQYPFAMSNNIAPPPSDIVKSASAEISGEGMIETFHNDNEALATVDNRVVLNVISHSLCLNNFI

SEQ ID NO: 149349 - protein, 152 aa, Glycine max
  Coding DNA Sequence Number=SeqID_32571
MNEKGGRKLKLASSTTFFLYRVRCASHVSWTLGLFRSRDHGLSHVETKEETHKELVKQREETRLELQAFVEQQRLENEQYRLSIQNVITDKFTIVNSVVHPSPAVTLPQPPLVTRPPQPSIPPPPVHSVPPPPAQSKAPPPPTQPQLPPTQD

SEQ ID NO: 149350 - protein, 101 aa, Glycine max
  Coding DNA Sequence Number=SeqID_32572
MERCISFPVLKDNSNTLWLRGSTGICLMMLESNSFNPKSSLCQTGLRFRDCNHIVEIVFVEIVFATYRLSSCLSQTGLRFRDCNHIVEFAFVEFVSALPSK

SEQ ID NO: 149351 - protein, 136 aa, Glycine max
  Coding DNA Sequence Number=SeqID_32573
MPLNVSRNKLDDIVFYVPNEDDKLKGQVGEDVNNDNADVDNLRIPDDDDDDEDVDDEDGARNATDDIVDGDGSYMEDKCELERCSRNGVWDNGNGKERNELVLERNRTARYSPSPDNNLQWLLALLDLHERNFWRN

SEQ ID NO: 149352 - protein, 50 aa, Glycine max
  Coding DNA Sequence Number=SeqID_32574
MKRLSVTIKVVLRQSEEKSAEGGVELVKEGFTHAKDFRLLLHFCSSLLHV

SEQ ID NO: 149353 - protein, 183 aa, Glycine max
  Coding DNA Sequence Number=SeqID_32575
SQLFILLLEQPSTGKKALRDMEDRKNTSFYREFEFKEEDNLVHTLSFSQAAFRTIECVYVGYSPSHKVEVPNHEFGSSNDSTDISTPLTNDLGVYNQISSNQNTGYGPYLSTVRPTNIHPQVYRAKAKSQMKMQETVVGEINFDDDSAKKVIMVVVEYAKTYPRFEENYKFISRELTILNRYY

SEQ ID NO: 149354 - protein, 76 aa, Glycine max
  Coding DNA Sequence Number=SeqID_32576
MAKRKVDELDNTEIIEKTRSKGIESSNNVALREETCKQISRYFYINVVPLKVAESEGFQKMCNHFGGPTFKPLSYM

SEQ ID NO: 149355 - protein, 64 aa, Glycine max
  Coding DNA Sequence Number=SeqID_32577
MGHHFKKRVSITTISIGMMAWQRGRQRRGEILGCGWWSEKGMVNISNLLCFTKHARAKVHKSEL

SEQ ID NO: 149356 - protein, 89 aa, Glycine max
  Coding DNA Sequence Number=SeqID_32578
MTHYCSGDERNNANGLIDDLKHTNSWERKELNDSTKKHKRGVFSKKGVQIAIRPTWAFQKVPTEGGAFWWKQSCSPGRAGRQPPPFSLL

SEQ ID NO: 149357 - protein, 98 aa, Glycine max
  Coding DNA Sequence Number=SeqID_32579
MASRKRKSIGSRPTSQYDTRRFSSLDAWTRYIDNVLGRNILPERKVEIYHSELDEFKAELERRNFHKHPTNLVDGSIDVTLVKEFYANLYSSEDHPPK

SEQ ID NO: 149358 - protein, 103 aa, Glycine max
  Coding DNA Sequence Number=SeqID_32580
  Subcellular localization annotation: CTP_CleavageSite=54; ConfidenceScore=5.59e-01
MVESSKKRKGSSASASASRAHRSGATSIHSTNSTLIVLFPSVFFRRTVETDNTLISEVFGIKMVIDQSLFHDLTKLPSDGVPFEGTLNDDWKFDFSAHDARQL

SEQ ID NO: 149359 - protein, 42 aa, Glycine max
  Coding DNA Sequence Number=SeqID_32581
MSEIRRFGSLGMEERRKRKGAAQGFLENVIFIEQDAWPSVLV

SEQ ID NO: 149360 - protein, 87 aa, Glycine max
  Coding DNA Sequence Number=SeqID_32582
MEEFDTRVAWPGDQPSSYGEGGASTAQEPMTKEPLAAIGTIEDEDELTPLEPFDFDAGVEPEQTIQDSLAAPALDLNEDQPQEEQGV

SEQ ID NO: 149361 - protein, 66 aa, Glycine max
  Coding DNA Sequence Number=SeqID_32583
MVNAVSRTFPLDLMMKTLHFQRKGESGKASASKLCAKHEISALSTAGAFSQAQRKTDAKPNSIYSR

SEQ ID NO: 149362 - protein, 91 aa, Glycine max
  Coding DNA Sequence Number=SeqID_32584
MELGLASSLSQFYRKNWICVHSLSAWLSRLAHESFFLRHAKRVTCAKCPMASRKRKATALVSHAGYDRSRFVSQKAWDHYSNNVLARNILP

SEQ ID NO: 149363 - protein, 53 aa, Glycine max
  Coding DNA Sequence Number=SeqID_32585
MEMKGFVRGTLGCMRFIGVKNPDDVKSREVEPQRQKDEEMKKREEWSLESEIH

SEQ ID NO: 149364 - protein, 161 aa, Glycine max
  Coding DNA Sequence Number=SeqID_32586
  Gene Ontology: Mol. function=nucleic acid binding; Biological process= DNA integration
  Homolog annotation: Hit_ID=Q2HSF9; Match level="QueryCoverage=47%, HitCoverage=11%, E-value=7e-14, Identity=52%"; Hit description =Polynucleotidyl transferase, Ribonuclease H fold
MGFVCWRVKEGGEIGEANCEVRSGSEAKDNIDTQIPLDVCRIWACKRVWRKPFIKRIGKGPQTSEYISSNVEFDVTKDSLNEFPGKGDQDEHARGVEGVEWWIVLLLEWVISVLLWVEGCICHRYFGHASMSRPLYDPSHKKKKGEIQHKHYCFDIILKWI

SEQ ID NO: 149365 - protein, 710 aa, Glycine max
  Coding DNA Sequence Number=SeqID_32587
  Gene Ontology: Mol. function=binding; Cellular component=thylakoid; Biological process=photosynthesis
  Homolog annotation: Hit_ID=Q10QD7; Match level="QueryCoverage=99%, HitCoverage=98%, E-value=0.0, Identity=53%"; Hit description=TPR Domain containing protein, expressed
  Pfam annotation: Domain name=TPR_1; Domain location=318-351; Score =9.3; E_value=0.41; Accession=PF00515.18; Description=Tetratricopeptid e repeat
  Pfam annotation: Domain name=TPR_1; Domain location=601-634; Score =6.1; E_value=0.99; Accession=PF00515.18; Description=Tetratricopeptid e repeat
  Pfam annotation: Domain name=TPR_1; Domain location=671-704; Score =17.7; E_value=0.042; Accession=PF00515.18; Description =Tetratricopeptide repeat
  Pfam annotation: Domain name=TPR_2; Domain location=134-167; Score =7.5; E_value=4.4; Accession=PF07719.7; Description=Tetratricopeptide repeat
  Pfam annotation: Domain name=TPR_2; Domain location=318-351; Score =13.4; E_value=0.81; Accession=PF07719.7; Description=Tetratricopeptid e repeat
  Pfam annotation: Domain name=TPR_2; Domain location=512-545; Score =5.8; E_value=6.9; Accession=PF07719.7; Description=Tetratricopeptide repeat
  Pfam annotation: Domain name=TPR_2; Domain location=567-600; Score =0.1; E_value=32; Accession=PF07719.7; Description=Tetratricopeptide repeat
  Pfam annotation: Domain name=TPR_2; Domain location=601-634; Score =4.9; E_value=8.8; Accession=PF07719.7; Description=Tetratricopeptide repeat
  Pfam annotation: Domain name=TPR_2; Domain location=65-100; Score =3.0; E_value=15; Accession=PF07719.7; Description=Tetratricopeptide repeat
  Pfam annotation: Domain name=TPR_2; Domain location=671-704; Score =20.4; E_value=0.0063; Accession=PF07719.7; Description =Tetratricopeptide repeat
  Pfam annotation: Domain name=TPR_4; Domain location=187-212; Score =6.4; E_value=6.4; Accession=PF07721.5; Description=Tetratricopeptide repeat
  Pfam annotation: Domain name=TPR_4; Domain location=318-343; Score =7.5; E_value=4.8; Accession=PF07721.5; Description=Tetratricopeptide repeat
  Pfam annotation: Domain name=TPR_4; Domain location=65-90; Score=8.9; E_value=3.2; Accession=PF07721.5; Description=Tetratricopeptide repeat
  Pfam module annotation: Pfam domain module=TPR_1::TPR_1::TPR_1::TPR _2::TPR_2::TPR_2::TPR_2::TPR_2::TPR_2::TPR_2::TPR_4::TPR_4::TPR_4; Domain location=318-351::601-634::671-704::134-167::318-351::512 -545::567-600::...
  Pfam module annotation: Domain location=601-634::65-100::671-704::187- 212::318-343::65-90
MLCACSGEQFKFEEAPPRSPDSLATRDFSASGLSSRTGDWESKFDETQVEDVESTLKEALSLNYEEARALLGRLEYQRGNFDAALQVFEGIDIRALAPRMIRAIAERIKQRKPRSKVDNGLPNVMSMHSVSLLLEAILLKSKSLEELGRYTEAAKECRIAVDTVESALPNGMPEGIGEACKLQEMFHRALELLPNLWIKAGLPDEAVTAYRRALVKPWNLEPRRLACVQKDLATTLLYGGVEVNLPPQLQVNGLTTPMSGTEEAILLLLILSGKMALQEIDWDPEIMDNLTFSLSITGMFESLADHVEKILPGVYDRAERWYFLALCYSAAGQNDIALNLLRKACGSSEAKHRPHFPSFLFGAKLYSLNPNHAREGIKLSQEVIDLAKHQNKHFLGQGQKFLGICHGAAARTSVLDSERIIFQRESLKFLSDAALNGNNDPEVMFSLGLENAIQRNLNAAYDNIMIYSDMMAGSSRRGWQLLALIVSAQQRFQDAKTIVDFALDEAGSIDQLELLRLKAVLQITQQQPKQAIETYRILLAVIEARKEHWLQAKTFRHEALTEQKLEMEAWQDLATIYADISSFLDAKACVDKAQLIEFFSPRSWHITGLLFEAQSLHKEAFVSFSVSLSIEPDYIPSIISTAKLLLKLGMQSLPIARSFLMNALRLDPTNHDAWFNLGLVSKMEGSLQQAADCFQAAYELKLSAPVQKFE

SEQ ID NO: 149366 - protein, 265 aa, Glycine max
  Coding DNA Sequence Number=SeqID_32588
  Gene Ontology: Mol. function=nucleic acid binding; Cellular component= chromatin; Biological process=DNA integration
  Homolog annotation: Hit_ID=Q2HSG0; Match level="QueryCoverage=90%, HitCoverage=63%, E-value=4e-58, Identity=57%"; Hit description=IMP dehydrogenase/GMP reductase
  Subcellular localization annotation: CTP_CleavageSite=59; ConfidenceScore=5.37e-01
MDVIASPSSNHSPLLDRASTLALFSPATRSMHNIHKPNKSFLLTTKHPLPSTIEPTCVSEAMKSPKWHEAMSNEFNALLAQGIEAIPTKTSLLLSQHKYICDLLEKAKMLEAKEVQTPLSTSTSLTLNDGTTIVDQAQYKSIIGAFQYLSMTRPDIAYSANRLAQFMHKPITIHMTALKLLLPYLKATIFHGLHLHRGSSPSLYAFSDVNWACNKEDYTSTSAHLVFYGRSLISWKSSKQRAIACSSTKAEYRSLATTLAELTWI

SEQ ID NO: 149367 - protein, 87 aa, Glycine max
  Coding DNA Sequence Number=SeqID_32589
MGLCFGCFGVDKRMSKEEERLASEEARAKAAEAAQKRQEQFENSAAGRAARAQQQAMAKQSANTNKGEPVLKVGLVIQDATYGFGNY

SEQ ID NO: 149368 - protein, 458 aa, Glycine max
  Coding DNA Sequence Number=SeqID_32590
  Gene Ontology: Mol. function=molecular_function; Cellular component =nucleus; Biological process=cell differentiation
  Homolog annotation: Hit_ID=Q6ZIP6; Match level="QueryCoverage=83%, HitCoverage=83%, E-value=1e-73, Identity=42%"; Hit description =Putative interferon-related protein
  Pfam annotation: Domain name=IFRD; Domain location=18-345; Score =211.3; E_value=2.3e-60; Accession=PF05004.4; Description=Interferon -related developmental regulator (IFRD)
  Pfam annotation: Domain name=IFRD_C; Domain location=390-448; Score =39.7; E_value=9.8e-09; Accession=PF04836.3; Description=Interferon -related protein conserved region
  Pfam module annotation: Pfam domain module=IFRD::IFRD_C; Domain location=18-345::390-448
  Subcellular localization annotation: CTP_CleavageSite=40; ConfidenceScore=5.04e-01
MGKRNSQRKNTAMLDNDDDSSSSVSSSSTSRTDHVSVSVSGNEEVHFDQDALLDQALDALDEKRDSTRERALSVIIGAFSSKMQHQFVDKKKDEINLVPVWKLNLGLKALKLGSKKASAKEIALTSHAIGLLSLTVGCSDNAREIFEESVRPLDEFLTSKSDLTKIPSLLECLAIITFVGGNGLEETERSMDILWRVIHPRLGSNVVAVKPSAPLITAVVSAWSFLVSTMSDLKLNSKNWQNSISYLSSLLDKEDRPVRIAAGEALVVIFEIGITEKFSADSKGASDMTQEEINRQESYTHLQGLKAKVINQVKNLSVEAGGKGSAKKDLNNQRNLFRDIVDFFEYGYSPEISMKIGGDSLQTSSWSQMIQLNFLKHFLGGGFVKHMQENEFLQEVFNFTPKRRYLNNNEHRMSSGEKRMFKSPNSVQNKARTQLLNKQRLLSEGRNLGHYAANMVDD

SEQ ID NO: 149369 - protein, 89 aa, Glycine max
  Coding DNA Sequence Number=SeqID_32591
MSLDFTGQDDKGAEDDILSGPKTFLYYSFAFFRSLIGNFLFFPFSSFKGKDGHSHPGSRVMVSWDFGLRLVERLDMIYVGVLVWPAVQG

SEQ ID NO: 149370 - protein, 97 aa, Glycine max
  Coding DNA Sequence Number=SeqID_32592
MKFSWNISLLLFENSVAGNRLQTSGNRLQVQNSNSKPFLIAIFQNCLLVIDYTAWFSEVFGLADEGFCDGDEGGGGAGHDVKESPNVCDNELFCVVL

SEQ ID NO: 149371 - protein, 71 aa, Glycine max
  Coding DNA Sequence Number=SeqID_32593
MLQGKKQHESNKEMNDNMTPYAVELPRTQDEDPMKFCHWVLMKTNQPTKTLSKSQAKAKNRSCEVKVQDQD

SEQ ID NO: 149372 - protein, 133 aa, Glycine max
  Coding DNA Sequence Number=SeqID_32594
MGPSSSQVRQLLLRPKVSFESHVDIVVTFPSNWKILNWKKNYKTRTTRRGHASVTVSRMGRWDRGGSGDLSGTTTSGGLSGATSSVGLLGATTSGILSGVSTSGGEPDTSLFPINSFSSVSFFVTRSFHSSLH

SEQ ID NO: 149373 - protein, 249 aa, Glycine max
  Coding DNA Sequence Number=SeqID_32595
  Homolog annotation: Hit_ID=Q9SLT9; Match level="QueryCoverage=71%, HitCoverage=74%, E-value=4e-16, Identity=36%"; Hit description=ZCF37 protein
MLNPFVCGTFHNEYDDEPCLASPNSSPRKYKRKVSKNNPYSARGLDKFSELLADLDEKRQKIYSQMNPHDISFVRFVYSNTNDDIVPVVVKVKNNKDQKHSKSQELKVVRARTTTMTLTHTSEYSMDKSATTDQENPAEERKQHQIETHAKVAKKKNNFSWDMGKPSFYVPVVMILILLLLIVFGRSVTTLSICIFWYVISTLKGSSSSNTSKSMTKKDYVRGLSEKKIVINEGTRKKNMLEGGVKKWW

SEQ ID NO: 149374 - protein, 56 aa, Glycine max
  Coding DNA Sequence Number=SeqID_32596
RKGYPSVERVKELVGKAFDWGKLKRRTSAASSDWNAARNSGSLERDVRSGNGGGDI

SEQ ID NO: 149375 - protein, 370 aa, Glycine max
  Coding DNA Sequence Number=SeqID_32597
  Homolog annotation: Hit_ID=Q9LHH2; Match level="QueryCoverage=92%, HitCoverage=32%, E-value=1e-57, Identity=38%"; Hit description =Ankyrin-like protein
  Pfam annotation: Domain name=F-box; Domain location=9-56; Score=32.9; E_value=1.1e-06; Accession=PF00646.23; Description=F-box domain
MANNENETCSFTDFPEDIQVSILSFLGPSEIATLACTSKKLGSLCSTVSKLWFSMCERRWGSNTRITQWAQKPAISFKQLYHTLHRWENLLGFWRRSGTGIPSLLFFEWGPSFISASRVSPSDSDSNTYGVTKTPFLWMSLSEEGHVVTFLDPDGRRSDFKPENRSELVAVDVSFMGKTHFVVEEKRVRGGDDDVVVAESGSPPERLMAEIYQHFANPRSPGSDRSRRQRRREKERLYGRKWEPQHFVKIVNCSPTPARPLQGLWKGICGDMSLAFYLVAYDDIGGIACRWIGDPPDHFSGQAPVFWTSNATFLESPFSPEEESLYDSRVHLQPLQLGNEVLEQFPLSDCELVNQIQQFQLSGNVALLEQ

SEQ ID NO: 149376 - protein, 33 aa, Glycine max
  Coding DNA Sequence Number=SeqID_32598
MASSLRTGRVERKPPAAQGYGAGAPVVGVQCRL

SEQ ID NO: 149377 - protein, 57 aa, Glycine max
  Coding DNA Sequence Number=SeqID_32599
MVEEELESTQRVILAIVDPVLIAVSKSAPALIAGKSSVLKPPTQKSMIYTNSLIEST

SEQ ID NO: 149378 - protein, 146 aa, Glycine max
  Coding DNA Sequence Number=SeqID_32600
  Homolog annotation: Hit_ID=Q1SN45; Match level="QueryCoverage=60%, HitCoverage=8%, E-value=5e-08, Identity=35%"; Hit description=AAA ATPase
MMLSTAKGAQSYNDIRIVNGVEANNWGTAHYLRKLFVKLLFMNTMDRPEYVWQQTWQWIANDIIFNHRKQEYATSQQKELARFSIHAIPNRICTKPRVPSIVQQRVPSISKRPVKGTDPENNRKTYFPVTRGSALDNGGHMNSARQ

SEQ ID NO: 149379 - protein, 53 aa, Glycine max
  Coding DNA Sequence Number=SeqID_32601
MALQIAEALGYGGFVRMLVDALGHVAEGEHVEEMKKMGFGSVSLLVDKDTDDF

SEQ ID NO: 149380 - protein, 39 aa, Glycine max
  Coding DNA Sequence Number=SeqID_32602
MRGGGFMTTRLGKLVASSRSNLLAQESLAHPKELIASPL

SEQ ID NO: 149381 - protein, 85 aa, Glycine max
  Coding DNA Sequence Number=SeqID_32603
MTEARLRGVQKVNDNKNKIEDRRRRRTNDECCRTGENLRVITQGNGTEAPQLGFSSRKQFSSAISREYEVPRRLNPFLLHSSPYF

SEQ ID NO: 149382 - protein, 265 aa, Glycine max
  Coding DNA Sequence Number=SeqID_32604
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PD62; Match level="QueryCoverage=54%, HitCoverage=19%, E-value=4e-40, Identity=58%"; Hit description=Two -component system sensor protein
  Pfam annotation: Domain name=Response_reg; Domain location=114-231; Score=125.9; E_value=1.1e-34; Accession=PF00072.14; Description =Response regulator receiver domain
MAQLDAVVERLRAVPRPGQPAPAWLLVDARARHIGEATLQQALAERGEDDALQVLWLQDDTLPARPRQRQLPSHFDDAALHALLAAPVAHARPAALLANAEQGQPTPTLPPLHLRVLLVEDNTVNRMVAEHLLRVFQCEVRNAADGEQALAALREGGVDVVLMDCQMPVLDGYAATRHWRAEEAETGRTRLPIIAMTANAMAGDRERCLQAGMDDYLSKPIARATLHALLQRWGGGKAASPGQPSVEPTLMSGGAFAVTHHPVSS

SEQ ID NO: 149383 - protein, 217 aa, Glycine max
  Coding DNA Sequence Number=SeqID_32605
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PD62; Match level="QueryCoverage=98%, HitCoverage=28%, E-value=3e-69, Identity=65%"; Hit description=Two -component system sensor protein
MMGRDALDACPQRCIGTEQQQRCWRARHRRQVARNLQQRDLEPERSALARRGLHADLPVHQVDDALADGQAQAGAAVDAGGGCVGLAEGLEQACLQCVVDADAGIDDLEAQLVLRGTFAQPQHAQLHLAAGGELDCVGQQVAQHLAQAHRVAAHRQAHRRIQLQAQGQALGVGGALHQLHHAIEQVAQVEAGDLQFQRLCFQPGVVDDVVDDAQQLL

SEQ ID NO: 149384 - protein, 94 aa, Glycine max
  Coding DNA Sequence Number=SeqID_32606
MASRKLPAKRSGKDATGEGSSAASQVDVDFDGHRFRSTKHQQRFEAQLVSPMAKFDPEIVMEFYANAWPTEEGVRDMHSWVRGQWIPFDRDAIS

SEQ ID NO: 149385 - protein, 49 aa, Glycine max
  Coding DNA Sequence Number=SeqID_32607
MESIRIKGQCTYLFRGKEKFTPPFLKLSGADMLAQVSQLAQVSQLAQAS

SEQ ID NO: 149386 - protein, 66 aa, Glycine max
  Coding DNA Sequence Number=SeqID_32608
  Gene Ontology: Mol. function=protein serine/threonine kinase activity; Biological process=protein amino acid phosphorylation
  Homolog annotation: Hit_ID=Q1SF45; Match level="QueryCoverage=71%, HitCoverage=13%, E-value=9e-14, Identity=75%"; Hit description =Protein kinase
MSPEYAMKGLFSEKSDVFSFGVLVIEIVSGRRNSKFYDDNNALSLLGFGLFVEYSSGGSAVHINVA

SEQ ID NO: 149387 - protein, 107 aa, Glycine max
  Coding DNA Sequence Number=SeqID_32609
  Gene Ontology: Mol. function=structural constituent of ribosome; Cellular component=large ribosomal subunit; Biological process =translation
  Homolog annotation: Hit_ID=Q1S7K3; Match level="QueryCoverage=98%, HitCoverage=99%, E-value=1e-20, Identity=46%"; Hit description =Ribosomal protein L24/L26
MKFNPRVSLSPRKSHKAHFIVLLSVRYVLMRAPFSIDLQSKYNVWSILVHKDDKVNDSRSITASGSSALTTSPDHKSLLNRKAKGRAAAIKEKGTKFSPEDIKQSVY

SEQ ID NO: 149388 - protein, 115 aa, Glycine max
  Coding DNA Sequence Number=SeqID_32610
MGEAEEVQEKMKADMEAMKEQMATMMEAMKSTEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 149389 - protein, 95 aa, Glycine max
  Coding DNA Sequence Number=SeqID_32611
  Subcellular localization annotation: CTP_CleavageSite=45; ConfidenceScore=5.25e-01
KSPIGLEIAKTGKKNRKKKKQATTKTSGKSSSSSDYLSTHKPLVENNMVDRGGEGNRPPRRTLGDYDYEQGPKHYNNIVIPLFSNKVVELKLNTA

SEQ ID NO: 149390 - protein, 81 aa, Glycine max
  Coding DNA Sequence Number=SeqID_32612
  Gene Ontology: Mol. function=transporter activity; Cellular component= integral to membrane; Biological process=transport
  Homolog annotation: Hit_ID=Q5K126; Match level="QueryCoverage=90%, HitCoverage=20%, E-value=3e-21, Identity=96%"; Hit description =Putative plasma membrane intrinsic protein
MPKEMLETPMFQKKVSLAFTILYQYFTKILAPLPIGFAVFLVHLATIPVTGTGINPARSLGAAIIFNKDQAWDDHVSLLHP

SEQ ID NO: 149391 - protein, 77 aa, Glycine max
  Coding DNA Sequence Number=SeqID_32613
MEVDRFFLGLLLSFGYRVSMVAGACGKFSHVGTNAILPRRGPITRAMARRLQEDWARDVGQGPRVFMSLRVDFGPMG

SEQ ID NO: 149392 - protein, 100 aa, Glycine max
  Coding DNA Sequence Number=SeqID_32614
MEELESPLSVQNKPNAHSRSPHNTCLARKRPTKKSKDALSAEACAKPEVSMKINLPSAYIRRRKQKKKTRSLITHALGLSLRENPLSLVIHHFLPSTYIP

SEQ ID NO: 149393 - protein, 266 aa, Glycine max
  Coding DNA Sequence Number=SeqID_32615
  Homolog annotation: Hit_ID=Q7A8Q6; Match level="QueryCoverage=13%, HitCoverage=5%, E-value=3e-08, Identity=77%"; Hit description =Putative integrase
QRAVQLLGRSLKARSSPHQQAAGRCHLRPDNPLVHTQCKAGLEPARISTVDFESTASTDFATSALKRMRKTWAIIPLRACGATGIDGDTYKHNEVEMKKATQRLVWGWGIAAALVAGSASAASWQDQLSSAASQLSQQNSGNTATSNTQNGGLSLSSLSGLLNGGDKAVSANSMTNAAGVMEYCVQHNVVDNNVKSVKDQVLNKLGLSSTTAQQQKTDYQQGIQGLLNTGNGQQLNLQSLSNSPMGEKLKTKACDVVLKQGKKYIG

SEQ ID NO: 149394 - protein, 313 aa, Glycine max
  Coding DNA Sequence Number=SeqID_32616
  Gene Ontology: Mol. function=nucleoside-triphosphatase activity; Cellular component=protein complex; Biological process=protein catabolic process
  Homolog annotation: Hit_ID=P46466; Match level="QueryCoverage=88%, HitCoverage=59%, E-value=1e-131, Identity=88%"; Hit description=26S protease regulatory subunit 4 homolog
  Pfam annotation: Domain name=AAA; Domain location=80-281; Score =268.7; E_value=1.1e-77; Accession=PF00004.19; Description=ATPase family associated with various cellular activities (AAA)
  Pfam annotation: Domain name=AAA_2; Domain location=77-222; Score= -31.9; E_value=0.0024; Accession=PF07724.4; Description=ATPase family associated with various
  Pfam annotation: Domain name=AAA_5; Domain location=80-228; Score= -12.7; E_value=0.017; Accession=PF07728.4; Description=ATPase family associated with various
  Pfam module annotation: Pfam domain module=AAA::AAA_2::AAA_5; Domain location=80-281::77-222::80-228
MDMDIDIIVFVLRSVISFCAVDMIRCWKCNASYHVEKAPLESYADIGGLDAQIQEIKEAVELPLTHPELYEDIGIKPPKGVILYGEPGTGKTLLAKHNQFGLTQRLAYFQAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 149395 - protein, 269 aa, Glycine max
  Coding DNA Sequence Number=SeqID_32617
  Homolog annotation: Hit_ID=Q9FH34; Match level="QueryCoverage=46%, HitCoverage=18%, E-value=3e-11, Identity=30%"; Hit description =Similarity to ankyrin-like protein
  Pfam annotation: Domain name=Ank; Domain location=8-38; Score=22.3; E_ value=0.0017; Accession=PF00023.20; Description=Ankyrin repeat
  Pfam annotation: Domain name=Ank; Domain location=80-115; Score=17.4; E_value=0.051; Accession=PF00023.20; Description=Ankyrin repeat
  Pfam module annotation: Pfam domain module=Ank::Ank; Domain location =8-38::80-115
MCLVRDKDEMLPLHFAAMRGRVEVIRELIKAKPNSIREMTETDDGSVLHLSIRYNHLEALKLRVESLRDDHHFLSLKDKEDNSLLHLAVKRRQIKIIKYLLSLSEMSMEINALNREGLKAMDMLERYQTDFVSQHTFIEGVEKPANEGIAQVVSSATLISNKEKTALPTYRRQQNSSQAQSITIELVQLDPPPQPSPQQTSSSSQTNINNIPEPPQPSPSNGPHQLQHVTSQNITSEQGQDKWNRFERFCKRNPSRSSLCSFSISNCPS

SEQ ID NO: 149396 - protein, 274 aa, Glycine max
  Coding DNA Sequence Number=SeqID_32618
  Gene Ontology: Mol. function=calcium channel activity; Cellular component=membrane; Biological process=detection of mechanical stimulus during sensory perception of sound
  Homolog annotation: Hit_ID=Q1RVU7; Match level="QueryCoverage=93%, HitCoverage=70%, E-value=1e-19, Identity=25%"; Hit description=IMP dehydrogenase/GMP reductase
  Pfam annotation: Domain name=Ank; Domain location=103-135; Score=7.3; E_value=2.7; Accession=PF00023.20; Description=Ankyrin repeat
  Pfam annotation: Domain name=Ank; Domain location=138-172; Score=4.7; E_value=6.6; Accession=PF00023.20; Description=Ankyrin repeat
  Pfam annotation: Domain name=Ank; Domain location=175-207; Score=7.8; E_value=2.4; Accession=PF00023.20; Description=Ankyrin repeat
  Pfam annotation: Domain name=Ank; Domain location=35-65; Score=21.6; E_value=0.0028; Accession=PF00023.20; Description=Ankyrin repeat
  Pfam annotation: Domain name=Ank; Domain location=69-101; Score=20.7; E_value=0.0054; Accession=PF00023.20; Description=Ankyrin repeat
  Pfam module annotation: Pfam domain module=Ank::Ank::Ank::Ank::Ank; Domain location=103-135::138-172::175-207::35-65::69-101
MRELYEASLNGCVSTLDTLIKKDPPILSRVSLYPFTETPLHIASLLGHLEFCQILLQNSPNLATELDSKGRCSLHLASAKGHTEIVKALLRTKPEMSLVRDKDAMLPFHFAAIRGRVGAIKELIEEKPNSIQEMIESDDGSVLHLCVRYNHLQALNLLVESLRGEHQFLSAKYKEDSTILLSAVKHRQIKIIKYLLSQSITSEQQGHGKWNRFEKFCRTYLLDQGNWIDKKTREQLMVAATVIATMTFQSMISPPGGVWQTDTHKSQDGCSCPN

SEQ ID NO: 149397 - protein, 478 aa, Glycine max
  Coding DNA Sequence Number=SeqID_32619
  Gene Ontology: Mol. function=nucleoside-triphosphatase activity; Cellular component=membrane
  Homolog annotation: Hit_ID=UPI00005F0F2B; Match level="QueryCoverage =96%, HitCoverage=83%, E-value=0.0, Identity=77%"; Hit description =COG1401: GTPase subunit of restriction endonuclease
  Pfam annotation: Domain name=AAA_5; Domain location=180-321; Score= -4.7; E_value=0.0041; Accession=PF07728.4; Description=ATPase family associated with various
EADVAEDDQEEEIATPQLPKNTILYGPPGTGKTYRTIDLAVRACDPAAYSQQLGKDESERRRELKTIYDRLVAEKRVRFITFHQSFGYEEFIEGLRAETTEDGDVSYEIKPGIFKQICEDATFGHAGVQQKLDDALIRLQERLAEEGNITLKTQHGKAFQLAYKLKTCFGIFPSQSKKADLGKGYNAYLKDIRLMYQDPQIKVHNPSYVRSILNYLIEKEKIPAHSEEAEPEMRQNYVLIIDEINRGNISKIFGELITLIETSKRAGEPEALSVMLPYSHDPFSVPNNLYLIGTMNTADRSLTALDTALRRRFEFQAMLPDTDVLKDTVVKGIDLKRLLQTLNDRIQVLYDREHSLGHAFFIPVVQAKDDEDLAFERLKRIMRNKVLPLLEEYFYNDWQKIRMVLGDNQKDNKSHLQFVREAKDQKQFADLFGLSGTDELHEIGASFQLTPEEDEVWDNPLAWQQIYVPYKEDAEPRE

SEQ ID NO: 149398 - protein, 130 aa, Glycine max
  Coding DNA Sequence Number=SeqID_32620
  Pfam annotation: Domain name=GRP; Domain location=32-124; Score=-2.8; E_value=0.00013; Accession=PF07172.2; Description=Glycine rich protein family
SIYIDPTPPQQAVSAMALKFHLPLPTALNREMAKWCMLVLVLALALAVATSARDAPEDVGLKDQKNFISYAGVGGYSGIGSNGLPFGGAGIGGGTTGIGGLGGFGGPIGGGTGGSVGGGVGGGSIPHPTP

SEQ ID NO: 149399 - protein, 214 aa, Glycine max
  Coding DNA Sequence Number=SeqID_32621
  Homolog annotation: Hit_ID=UPI00005F1A7F; Match level="QueryCoverage =90%, HitCoverage=62%, E-value=2e-37, Identity=43%"; Hit description =COG4268: McrBC 5-methylcytosine restriction system component
MYFDDITPVGDVSVAFDQIHLDRHMNHYEHALAWAKHILLGQSPHCMQGDANAISLLFPMEAVFESFVTAWMRHRYNDNWHVKAQVDSHTLVRLNGKGVFKLRPDIYLQLRGEYEEQVMICDVKWKMVEGGKATLEQSQADLYQMLAYGVNYQEGIGDMLLIYPSHEGFSQPLPHPYEFSHQKENPLRLWVVPFFIGDSLQTSGLRFPDEKSLI

SEQ ID NO: 149400 - protein, 292 aa, Glycine max
  Coding DNA Sequence Number=SeqID_32622
  Gene Ontology: Mol. function=sequence-specific DNA binding; Cellular component=intracellular; Biological process=regulation of transcription, DNA-dependent
  Homolog annotation: Hit_ID=Q5PMS1; Match level="QueryCoverage=95%, HitCoverage=97%, E-value=3e-97, Identity=61%"; Hit description =Possible AraC-family transcriptional regulator
  Pfam annotation: Domain name=AraC_E_bind; Domain location=137-292; Score=146.0; E_value=1e-40; Accession=PF06445.5; Description =Bacterial transcription activator, eff
  Pfam annotation: Domain name=HTH_AraC; Domain location=18-64; Score =39.7; E_value=1e-08; Accession=PF00165.13; Description=Bacterial regulatory helix-turn-helix proteins, araC family
  Pfam annotation: Domain name=HTH_AraC; Domain location=70-115; Score =37.9; E_value=3.4e-08; Accession=PF00165.13; Description=Bacterial regulatory helix-turn-helix proteins, araC family
  Pfam module annotation: Pfam domain module=AraC_E_bind::HTH_AraC::HTH_ AraC; Domain location=137-292::18-64::70-115
MPVNKNHHRETYRKRFDKVFDYIERHLDEALLLEQLSEVAHFSPYHFHRQFSAWCGMPPGRYIQLMRLKRASYRLAFNPHEKIIEIALDAGFQHAESFSRAFKQVFDVTPSEFRQQPVWMTWHQRMPQPPVKRRESMSVEIKMFPTTPVAMLTHHGDPQRINETAAQFIAWRKSSGASPVRSSQTFGVAPHDPTSTPAGDFQYHLCGSVTAPINEDNAFGVVNSTIPGGRCAVLRHHGSHSTLTELARSLYSEWLPASGEELRDFPLFFHYHNFVHEVAEHELLTDIYLPLK

SEQ ID NO: 149401 - protein, 259 aa, Glycine max
  Coding DNA Sequence Number=SeqID_32623
  Gene Ontology: Mol. function=oxidoreductase activity; Cellular component=integral to membrane; Biological process=electron transport
  Homolog annotation: Hit_ID=UPI00006DBEC4; Match level="QueryCoverage =99%, HitCoverage=99%, E-value=1e-102, Identity=67%"; Hit description= COG2249: Putative NADPH-quinone reductase (modulator of drug activity B)
  Pfam annotation: Domain name=Flavodoxin_2; Domain location=1-221; Score=304.8; E_value=1.6e-88; Accession=PF02525.7; Description =Flavodoxin-like fold
MNVLIVYAHPEPRSLNGSLKDFAVNHLQQAGHQVQVSDLYAMQWKAQLDAADTLAPPVGAHFDATLDSRFAYDNQLQAADIAAEQEKLRWADTVIFQFPLWWFSMPAIMKGWFDRVYANGFAYGVGEHNDHHWGDRYGEGTLAGKRAMLVVTTGGWESHYAPRGINGPIEDLLFPIQHGMLFYPGFSVLPPLVLYRVQKSAQERFADWCAALAQRLDRLAQDQPIAFRRQNGGEYEIPALTLREDLAEGERGFGVHVAR

SEQ ID NO: 149402 - protein, 217 aa, Glycine max
  Coding DNA Sequence Number=SeqID_32624
  Homolog annotation: Hit_ID=Q2HT93; Match level="QueryCoverage=84%, HitCoverage=30%, E-value=1e-37, Identity=44%"; Hit description=P -type trefoil
MSWEGDESMGSSSPLGLIAQHLCPTKHLSMHRRYLEFPSFMYATTVLVVSDATLEDTGCVAALAMAASALVVGLPESTHLVTKQLSVGQLVKVFVSTVVDSGRTGVAVHPVHVIYIRLYAKNTCERFDCNIETISASDNSTAAGFIAQVKSLSTTGAKLLQSIRSKQDGMHWEWPQTRIFHSHWIDPEDKLQDLELTIRVYGHCSINLYFFSCWGHR

SEQ ID NO: 149403 - protein, 224 aa, Glycine max
  Coding DNA Sequence Number=SeqID_32625
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=96%, HitCoverage=29%, E-value=6e-61, Identity=55%"; Hit description =Na+/H+ antiporter-like protein
MHEQIATAFQANGEVGQVTVHHLTSISLMATMHEDICHVAGKKGVAMIILPFHKRWGREDEEVTEDSGQGWREVNRRSTVGVPEGMNKNLRPVMSLGKECIIFIGGPYDRKVLELGSRMAEHPAIRLLLVRFTSYKEARGEGPKQNSPTSTTNWEKEKELDEEAINEFKAKWQESVEYIEKNATNITEEVLSIGKAKDYDLVIVGKQQQIESTKLTNIDFRPEH

SEQ ID NO: 149404 - protein, 372 aa, Glycine max
  Coding DNA Sequence Number=SeqID_32626
  Homolog annotation: Hit_ID=Q6D939; Match level="QueryCoverage=81%, HitCoverage=86%, E-value=1e-57, Identity=41%"; Hit description =Putative exported protein
  Pfam annotation: Domain name=DUF1176; Domain location=1-345; Score =202.1; E_value=1.3e-57; Accession=PF06674.2; Description=Protein of unknown function (DUF1176)
FASVSTPLWADEGVSFSHKDWELACDNTLTCRAAGYSAEEGAGGSVLLTRAGGPDSLTHGRVVLADTGDDDAQQVNALALWIDDRALGEVSKAENDEWTLSDAQTQALIAAIKGSARVEFRGAAEPFELSGNGAFATLLKMDEAQGRLNTPGALVRKGNQPEASVPAAVAMPVIQQVHVLKAAPRPLTPDELAQVKPKLIASLTDDDSCDNLAPSDDQPEEGAEPPTLTPVDAQQVLIAALCWRGAYNEGYGFWLLDNALQGTPQLITDSGSDYHDGVISEAQKGRGIGDCWSTAAWVWDGRQFVQSSEATTGMRLGHLIRHGFCRVPDGHDMGDGVIDLRTVDAVAHQHRHAQQKSVEGDGEGGGIGVGAQ

SEQ ID NO: 149405 - protein, 84 aa, Glycine max
  Coding DNA Sequence Number=SeqID_32627
MRRVSKVTHLEGPTGFEIKKQQSKARNDRKVLENVRNYQRWCQRKVGHVSETQGINIGATEQSKASQICMSKAEPQNRDYGAKK

SEQ ID NO: 149406 - protein, 337 aa, Glycine max
  Coding DNA Sequence Number=SeqID_32628
  Homolog annotation: Hit_ID=Q6H972; Match level="QueryCoverage=96%, HitCoverage=35%, E-value=5e-19, Identity=30%"; Hit description=SEU3A protein
MKNFVRDSKLKSDSLAKFPRRTSGSSGLHSQAQQSEDQLQQQSQPPQHMVPHTSNGDQNSVQTAAMQIASSNGVTSVNNSVNAASASASNTTSTIVGLLHQNSMNSRQNSMNNASSPYGGSSVQIPSPGSSGNVPQAQPNQSPFQSPTPSSSNNPQTSHPAITSANHMGTANSPANITLQQQQTSLPAEADPSDAQSSVQKIIHEMMISSQMNGPGGMAGTGLLGNDMKNVNGILPGSNSTGLNSGSGLAGNGAVNSSNSGVGVGGYGTMGLGPSGMTNGMRPVMGHNSIMNGRGGMASLARDQVMNHQQDLSSQLLSGLGGVNGFSNLQFDWKPSP

SEQ ID NO: 149407 - protein, 123 aa, Glycine max
  Coding DNA Sequence Number=SeqID_32629
  Gene Ontology: Mol. function=protein disulfide oxidoreductase activity; Cellular component=chloroplast; Biological process =glycerol ether metabolic process
  Homolog annotation: Hit_ID=Q2PXN7; Match level="QueryCoverage=98%, HitCoverage=88%, E-value=3e-31, Identity=50%"; Hit description =Chloroplast thioredoxin M-type
  Pfam annotation: Domain name=Thioredoxin; Domain location=43-123; Score=-5.5; E_value=0.00047; Accession=PF00085.10; Description =Thioredoxin
  Subcellular localization annotation: CTP_CleavageSite=65; ConfidenceScore=5.51e-01
MALENCVAVTTVGTSARPQCLHPFSKREKLVFPTFRGFKKSLTKTVLTNSSPLYSAAGQRNLVLSAMLVKQMIAPAIDELAKEYAGKIACFKLNTDDCPNIATEYGIRSIATVLLFKNGEKKA

SEQ ID NO: 149408 - protein, 83 aa, Glycine max
  Coding DNA Sequence Number=SeqID_32630
  Gene Ontology: Mol. function=RNA-directed DNA polymerase activity; Biological process=RNA-dependent DNA replication
  Homolog annotation: Hit_ID=Q8H6Q8; Match level="QueryCoverage=97%, HitCoverage=45%, E-value=2e-13, Identity=46%"; Hit description=CTV.20
MALFDTGADSNYILEGLIPTKFFEKTSEKLRTASGSSLKINYKLSNAIIENQGLRINTNFLLVKNLKNEVILGTPFIRSLFPI

SEQ ID NO: 149409 - protein, 94 aa, Glycine max
  Coding DNA Sequence Number=SeqID_32631
  Subcellular localization annotation: CTP_CleavageSite=53; ConfidenceScore=5.24e-01
MWFPGSFPFTSYPKFLNINQCTLRVRLIASEPNLRSCLMNKGLTSIVATCPSRASEGEAHGCAFQRRKDARSRHQHLFVGNVGKTEGNRSKRKF

SEQ ID NO: 149410 - protein, 58 aa, Glycine max
  Coding DNA Sequence Number=SeqID_32632
MRLKEMPPKKLSTKRSRRDAAAEGPNSTPEFDSHRFQSVDDMNPHGTRADLGSSRIKP

SEQ ID NO: 149411 - protein, 91 aa, Glycine max
  Coding DNA Sequence Number=SeqID_32633
MLWVKHPHHYMKGLRAFRVLQRDIILKFRSFQCDRGSVKRKHKAYNGGFQTQNNAKPRAKTDGSTPINGFLSLWSFNREQWRFVVVNGGYG

SEQ ID NO: 149412 - protein, 76 aa, Glycine max
  Coding DNA Sequence Number=SeqID_32634
MGEKEGILASLDKMANSFNRMVVEKMDGKVDGEDIQEVFREAALIPDLTDDPKQLAIVKALPIHQKTDYVLTHLGE

SEQ ID NO: 149413 - protein, 320 aa, Glycine max
  Coding DNA Sequence Number=SeqID_32635
  Gene Ontology: Mol. function=oxidoreductase activity; Cellular component=extracellular space; Biological process=metabolic process
  Homolog annotation: Hit_ID=Q8LCE7; Match level="QueryCoverage=99%, HitCoverage=96%, E-value=1e-103, Identity=59%"; Hit description =Putativepod-specific dehydrogenase SAC25
  Pfam annotation: Domain name=adh_short; Domain location=35-223; Score= -44.3; E_value=0.0046; Accession=PF00106.15; Description=short chain dehydrogenase
MVGVISLVTGMAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILMLFFNQCHKDTGGKHLPFALALAGGHFHLTNLLLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 149414 - protein, 37 aa, Glycine max
  Coding DNA Sequence Number=SeqID_32636
MDTRLRDDPMNEVQRGWGVRTHSLRIHLVSVVEGPPR

SEQ ID NO: 149415 - protein, 317 aa, Glycine max
  Coding DNA Sequence Number=SeqID_32637
  Homolog annotation: Hit_ID=Q761Y4; Match level="QueryCoverage=67%, HitCoverage=84%, E-value=8e-10, Identity=28%"; Hit description=BRI1 -KD interacting protein 130
MDTCSNTNVVLDDNFISNLGRTFNESLQIQDAHKSVLASEENDIYNVNEEKLCEAMKDQETNINMTCLKKSATFPIPNTMLPSSPSDKEADTSVTGPLNEHSAHQTYSLSVSPPAPLKLISAMKGSREKHGGSQVKLNVKWASDVYDPIPTLLSHTVRSNKKQQKSRKKKPEKKNGKKGQKGNSSRGGSNKDKQVRKLGGTSGLCYKSMDSCDKVLGASTELDALEVRSQDSYCGTSFLKKSVTEVHYSWEDPPSTAFLAFSAIITENMLRNCRCLQHTYDLPVCTTDENKATVNTVSKTQTRYWTAALVGLTPSNS

SEQ ID NO: 149416 - protein, 75 aa, Glycine max
  Coding DNA Sequence Number=SeqID_32638
MYRNIRTSVPANSFLIMLQTLKASDRAQERNQNKSDIDSYDNASETTTCECEVRAAKIETHRRKGKLVCRRKENK

SEQ ID NO: 149417 - protein, 234 aa, Glycine max
  Coding DNA Sequence Number=SeqID_32639
  Homolog annotation: Hit_ID=Q10N76; Match level="QueryCoverage=29%, HitCoverage=28%, E-value=3e-23, Identity=61%"; Hit description =Expressed protein
MSAFPNGSNSNLDNLLLQTMMGRLQLRAPINNPLVTQSLEDFLLTDLGDDDDDNEGEETFEGQSELAREEAKLEREVIKIILSGNGESVLMPNSGQAVSVRDHHICVGFQDEEGSGYRVWEWHGHIMAFDEEFGYNPEYIYGNYFQWFKARPFSVAAVADARADVEKEEEEEEEKLENQGLRELIDSKDSADARILHRNINAASPRLFKYYANRLFIFFMANLVNGAIDCLNGV

SEQ ID NO: 149418 - protein, 219 aa, Glycine max
  Coding DNA Sequence Number=SeqID_32640
  Gene Ontology: Mol. function=inorganic diphosphatase activity; Cellular component=cytoplasm; Biological process=phosphate metabolic process
  Homolog annotation: Hit_ID=Q6KBB0; Match level="QueryCoverage=79%, HitCoverage=94%, E-value=6e-63, Identity=61%"; Hit description =Putative inorganic pyrophosphatase
  Pfam annotation: Domain name=Pyrophosphatase; Domain location=76-192; Score=155.9; E_value=1.1e-43; Accession=PF00719.9; Description =Inorganic pyrophosphatase
MVETEMDAETVANVVPPKETPNSVSISHHSSHPPLNERIISSMTRRSVAAHPWHDLEIGNYVFFRNAGPGAPIIFNCVIEIGKGSKVKYELDKKSGLIKIDRVLYSSVVYPHNYGFIPRTICEDSDPLDVLIIMQEPVLPGCFLRAKAIGLMPMIDQDLDKKNENKEVAVNDFLPASAAFEAVKRSISQYQSLKVTFFYIEKELVCGLHSGELEAVADE

SEQ ID NO: 149419 - protein, 85 aa, Glycine max
  Coding DNA Sequence Number=SeqID_32641
MARKEVEVEREVIKIILEGNDKSILKLNSSCLSLDLFLMLLLLLSLSKREDEEKWENLDLRKFIYTKNYIEACILLRSVNVALPR

SEQ ID NO: 149420 - protein, 90 aa, Glycine max
  Coding DNA Sequence Number=SeqID_32642
MTNLLSSSKMWIWWRRNSLVFNQVWMSNSVMIANIRAILKDIKGSKISCTNLQYGVADVVNNVGGLENHTLKDCFIMNCDGALCQATEEG

SEQ ID NO: 149421 - protein, 142 aa, Glycine max
  Coding DNA Sequence Number=SeqID_32643
  Subcellular localization annotation: CTP_CleavageSite=12; ConfidenceScore=5.29e-01
MCSVISAQGVAVATAVAVSGTVILLALRLQKSFPPPQFSVHHQIPPSPSPVLRSCISNVGKKSKKKKKRVHFAEDVVESCRDGEEFRKRNSRSKVLKSYYNNNNGEEEEEEAKIGGIMPANRVALYNGILRGRVAQRLAYSC

SEQ ID NO: 149422 - protein, 52 aa, Glycine max
  Coding DNA Sequence Number=SeqID_32644
MAATKQCDMQISPMNIILLHQLYVDFAELRIANLLYCVKSNLKNDVLRLRGG

SEQ ID NO: 149423 - protein, 52 aa, Glycine max
  Coding DNA Sequence Number=SeqID_32645
MTRFQKRWMGEAERKVLGATKASGFSAWIRPTKHEWMCKGALRSFAGTPSIT

SEQ ID NO: 149424 - protein, 137 aa, Glycine max
  Coding DNA Sequence Number=SeqID_32646
  Gene Ontology: Mol. function=carboxypeptidase activity; Cellular component=membrane; Biological process=auxin mediated signaling pathway
  Homolog annotation: Hit_ID=Q1SU91; Match level="QueryCoverage=89%, HitCoverage=31%, E-value=2e-42, Identity=74%"; Hit description =Peptidase M14, carboxypeptidase A
MEIERKNDTKEKVDGIVCSGMAYYIQGAVMKDRGPVFVTTFNPLCMVIVAIMGSFFLAEIMYLGRAVGAIVIILGLYLVVWGKSQDYESSSPITKEHILASKQTVEENNGKEEDHSNHGVITLSNLGAGNIARDEQV

SEQ ID NO: 149425 - protein, 246 aa, Glycine max
  Coding DNA Sequence Number=SeqID_32647
  Gene Ontology: Mol. function=carboxypeptidase activity; Cellular component=membrane; Biological process=electron transport
  Homolog annotation: Hit_ID=Q1SU91; Match level="QueryCoverage=96%, HitCoverage=68%, E-value=1e-101, Identity=71%"; Hit description =Peptidase M14, carboxypeptidase A
  Pfam annotation: Domain name=DUF6; Domain location=23-135; Score =22.6; E_value=0.0014; Accession=PF00892.11; Description=Integral membrane protein DUF6
MAGNKQKLFNRLKPFIGVVFLQFGYAGMDVLSKAALNKGMSNYVFVVYRHVFAFVVTAPFALILEKPVIDQNLYFLGMKYTTATFAVSMYNVLPAITFVMAWIFRLEKVKLKSIRSQAKVVGTLATVAGAMVMTLIKGPVLDLFGTHTSNTHNQQNGGVNLQHAIKGSVMITIGCFSCACFMILQAITIEAYPAELSLTAWICLLGTVEGGVVALVMERKNLSAWSLQWDTKLLAAVYSVGSLLLQ

SEQ ID NO: 149426 - protein, 77 aa, Glycine max
  Coding DNA Sequence Number=SeqID_32648
  Homolog annotation: Hit_ID=Q1SU89; Match level="QueryCoverage=77%, HitCoverage=13%, E-value=9e-07, Identity=52%"; Hit description =Inositol polyphosphate related phosphatase
WHQLGNYLCLVCVLWTQNLGTVSMQLCALVSSKSCSSAWTLAVQQVDDNEEFVNGFKGQHLGIVAVEGAIFLLFMST

SEQ ID NO: 149427 - protein, 339 aa, Glycine max
  Coding DNA Sequence Number=SeqID_32649
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=97%, HitCoverage=64%, E-value=1e-129, Identity=69%"; Hit description =Inositol polyphosphate related phosphatase
  Pfam annotation: Domain name=Exo_endo_phos; Domain location=57-329; Score=63.9; E_value=5.4e-16; Accession=PF03372.13; Description =EndonucleaseExonucleasephosphatase family
MWDSAAIAKERRRSCSDRDRYVVVPDDLSEGWVMDSTSGMKKKSAPGPGTGGPDLRMFVGTWNVGGKSPNEGFNLRNWLTCPSPADIYIIGFQEIVPLNAGNVLGPEDSGPAAKWLGLIREALNSNEELDNTGQNSPKSSPRYCLAASKQMVGIFLSVWVRADLCNHVTNLKVSCVGRGIMGYLGNKGSTSISMTLYNTTFCFVCTHLTSGEKFGDELRRNLDVSEILKKTKFYHSFKSLAHPLPPESILEHDNIIWLGDLNYRLASGYDDTHELLKKNNWQALLEKDQLRIEQKAGRVFKGWNEGNIYFAPTYKYLTNSDHYVAQSSKSKIKRRTPAW

SEQ ID NO: 149428 - protein, 48 aa, Glycine max
  Coding DNA Sequence Number=SeqID_32650
MEMARAKDVTVVVKVIEPLISPYTYQLGAVLHPTARGNFILGKVFVSN

SEQ ID NO: 149429 - protein, 75 aa, Glycine max
  Coding DNA Sequence Number=SeqID_32651
  Homolog annotation: Hit_ID=Q6YZC6; Match level="QueryCoverage=84%, HitCoverage=42%, E-value=4e-07, Identity=57%"; Hit description =Cation exchanger-like protein
LFYCCSSDSLDRPASSTEDKAHELAETDHTSPIKLDATAHAHIEKHRYLFLQRRLLSIAWQAPVVPTCEQRQLLG

SEQ ID NO: 149430 - protein, 106 aa, Glycine max
  Coding DNA Sequence Number=SeqID_32652
MAKEGGGGGCFVVVRLVRRRSCDCCEEGEVMGEEVAMAGVVCTKRKVLGSEKDSLVFSSKMRGVRYTYESAPFKSVIHLLSIQAHKKKQFSFSDSDSGCVLILDLN

SEQ ID NO: 149431 - protein, 112 aa, Glycine max
  Coding DNA Sequence Number=SeqID_32653
  Gene Ontology: Mol. function=oxidoreductase activity; Biological process=electron transport
  Homolog annotation: Hit_ID=Q8LE44; Match level="QueryCoverage=60%, HitCoverage=14%, E-value=2e-15, Identity=57%"; Hit description =Putative amine oxidase
MESRFKSNPQLRRACVSENCLFSEVLILFLLKLTRFPSSTFLVGLCCANDDKQQERSPSVIVIGGGMAGIAAARALQDASFQVILLESRERPGGRIHTDYSFGFPVDLGASW

SEQ ID NO: 149432 - protein, 98 aa, Glycine max
  Coding DNA Sequence Number=SeqID_32654
MVLPPPLRWSTFAVNGNTRRRAREGRRTIYDGAFAFGGFGGHRKRRWFSDVAHGGDEDEVPTKTEVAWDAARNGGCSVVRRYLAFSFCEGFQTGSCLA

SEQ ID NO: 149433 - protein, 1353 aa, Glycine max
  Coding DNA Sequence Number=SeqID_32655
  Homolog annotation: Hit_ID=UPI0000DB7211; Match level="QueryCoverage =26%, HitCoverage=22%, E-value=4e-18, Identity=26%"; Hit description =PREDICTED: similar to Stretchin-Mlck CG18255-PA, isoform A
  Pfam annotation: Domain name=CRA_rpt; Domain location=130-164; Score =2.9; E_value=0.57; Accession=PF07046.2; Description=Cytoplasmic repetitive antigen (CRA)
  Pfam annotation: Domain name=CRA_rpt; Domain location=221-256; Score =0.9; E_value=1; Accession=PF07046.2; Description=Cytoplasmic repetitive antigen (CRA)
  Pfam annotation: Domain name=CRA_rpt; Domain location=53-108; Score =7.5; E_value=0.15; Accession=PF07046.2; Description=Cytoplasmic repetitive antigen (CRA)
  Pfam annotation: Domain name=M; Domain location=215-235; Score=4.2; E_ value=36; Accession=PF02370.7; Description=M protein repeat
  Pfam annotation: Domain name=M; Domain location=285-305; Score=7.7; E_ value=12; Accession=PF02370.7; Description=M protein repeat
  Pfam annotation: Domain name=M; Domain location=310-330; Score=4.7; E_ value=30; Accession=PF02370.7; Description=M protein repeat
  Pfam module annotation: Pfam domain module=CRA_rpt::CRA_rpt::CRA _rpt::M::M::M; Domain location=130-164::221-256::53-108::215-235::285- 305::310-330
SETFRLRSLRIVTPITNQGRGGDGNENRTLQSDWEKEIGRLKELIEVEKGRADSERKNATEACKLLENEKNKVVEKEKEIGGLKRLIEAEKRRADSESKKAAEACKMVGDEKNKVVEKEKEIVGLKRLIEAEKRRADSESKKASEACKLVGDEKNKAAEKEEGIRRLKGIMEVEKRKNDSERKEDTEACKLLGEEKKKVAEKEKEIGRLKGCIEEKKRRVDSERKKATEACKLLEEEKNKAAVKGEIARIEAEKAVKYSFQIGQLEKQVNEAKTKLVSEISTFREATKKFEAENHKLLAEKRNAESGMAKANERLEVEKQKVNEEKRRADAEMVKLEKQKALAKDNWNKFMKEKCLADQMSQQLEEDKKTIEDLKRKIHELSSLTKPVEMAADSKVNADSTEVKLLKNKLKLEKLRAKHTRQKYKLETSRYSILRHDLGRLKMDFIQFLQRLDILDASFSPVAGSMHGQTKFENILDMQNSNVTRQICNLNLSETCRQFENELLEPCCTTIYASDPLRKNIQNTQLLTPGGNYSEKSITGIGSKLEPLVRGSDRTKLQSSAVNSSTESFSDGQLMGSQDAAIFPVTASAKLTQDCKPPDKSVDVHHRKRKRMQDTIEYNANLSPEKLSDLHGLIYRKVGKCLEGGKEVLHNLNNLQEENKRAHKKRKKSRREKVDMIPLVNRDEQKGAEEAETEVYDDANVCRHTSCLAPHTLETSEACGDRICDAANNFDSMVNFDTVPDGNYMKLLELEDATSEECYRKAMDFPISPSLPEIEFCDTFEEGNLTNTSLEKALQDDMLSSRTDLFTSPYLNVINVEINSNEQKCDDCGVSCNLHMRITEKPRTAFSVEDVIGSLNNQLPEFCVVFSNIEDNSIISRILVATKNCIARCNLASQTGWGVANILTALKMEEKLSQKEKVSVLLTLMMFNFAMTATKTFGKLWDGNLFHCLQSYSEHICTETRVLFVENYSLHELLSLIEDFLIEGKVIVNNRVYAETLSCDLRVNDFLDCVNQVSSDVASSEQLAAASIILASVCAATDYVGFICDASYHILQSCKWDSLMVLTILHIFAYLGGEKFFNMDNFGLMVTVLKSLVMFLEDESPSVASACLPSINQLHAELCMNVKCPFLEGVESIDAVACLLLEEIKRINLSDSRLMSDNYDAELWYNQDAIQCTISKNCDVPCLRKFSIFATQPDALRNVNFCRLNDVLSLVELVSNKMSWHWADIKLVPQLLNILDSCVEENFAVRIIVLLGQLGRTGVDFGGYEDKGVGNLRCYLFTYFCRTSSMKAGLSLQVAAATALFGLLPLDFETLFHTKINLSAYSKSVSDNAESLRKWFSGLDKDQQKLLSDVFNM

SEQ ID NO: 149434 - protein, 45 aa, Glycine max
  Coding DNA Sequence Number=SeqID_32656
MYTSGERKLGGWFHCWLRAFAYVARSSCSELEHFLVGVDKKSQGW

SEQ ID NO: 149435 - protein, 86 aa, Glycine max
  Coding DNA Sequence Number=SeqID_32657
GATSVVLRLLLLWGLGFTPLPSSPTLLPSLISEAICYSFIALRTTWHSQRIEIRLPNLTPRTPAVNSGRRSTRRPKNRGMLCDKPS

SEQ ID NO: 149436 - protein, 602 aa, Glycine max
  Coding DNA Sequence Number=SeqID_32658
  Gene Ontology: Mol. function=helicase activity; Cellular component =mitochondrion; Biological process=embryonic development ending in seed dormancy
  Homolog annotation: Hit_ID=Q8S5M5; Match level="QueryCoverage=92%, HitCoverage=70%, E-value=1e-135, Identity=38%"; Hit description =Putative PPR-repeat protein
  Pfam annotation: Domain name=PPR; Domain location=100-134; Score=9.2; E_value=0.6; Accession=PF01535.11; Description=PPR repeat
  Pfam annotation: Domain name=PPR; Domain location=171-205; Score =20.4; E_value=0.0065; Accession=PF01535.11; Description=PPR repeat
  Pfam annotation: Domain name=PPR; Domain location=206-240; Score =32.8; E_value=1.2e-06; Accession=PF01535.11; Description=PPR repeat
  Pfam annotation: Domain name=PPR; Domain location=241-275; Score =38.6; E_value=2.1e-08; Accession=PF01535.11; Description=PPR repeat
  Pfam annotation: Domain name=PPR; Domain location=276-310; Score =34.0; E_value=5.2e-07; Accession=PF01535.11; Description=PPR repeat
  Pfam annotation: Domain name=PPR; Domain location=311-345; Score =18.0; E_value=0.035; Accession=PF01535.11; Description=PPR repeat
  Pfam annotation: Domain name=PPR; Domain location=378-412; Score =47.1; E_value=5.9e-11; Accession=PF01535.11; Description=PPR repeat
  Pfam annotation: Domain name=PPR; Domain location=413-447; Score =44.6; E_value=3.4e-10; Accession=PF01535.11; Description=PPR repeat
  Pfam annotation: Domain name=PPR; Domain location=448-482; Score =51.7; E_value=2.5e-12; Accession=PF01535.11; Description=PPR repeat
  Pfam annotation: Domain name=PPR; Domain location=483-517; Score =44.6; E_value=3.4e-10; Accession=PF01535.11; Description=PPR repeat
  Pfam annotation: Domain name=PPR; Domain location=518-552; Score =33.7; E_value=6.5e-07; Accession=PF01535.11; Description=PPR repeat
  Pfam annotation: Domain name=PPR; Domain location=553-587; Score =43.2; E_value=9.1e-10; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=100-134::171 -205::206-240::241-275::276-310::311-345::378-412::413-447::448 -482::483-517::518-552::553-587
MLLCFKIPSFPLCTSAPETNFNDHNEAESSSSSSSSSDNETEWERLLKPFDLKQLRRSLSLTPISPFQLCKLLELPLDIPTSMELFQRAGAQKGYSHTFDACYLLIDKLGAVGDFKVIEKLLKQMKDEGLLFKESLFILIMKHYGKAGLPGQATRLLLDMWGVYSCDPTFKSYNVVLDILVDGDCPRVAPNVFYDMLSRGVSPTVYTFGVVMKALCMVSEVDSACSLLRDMAKHGCVPNSVIYQTLIHALCENNRVSEALQLLEDMFLMCCEPDVQTFNDVIHGLCRAGRIHEAAKLLDRMLLRGFSTDALTYGYLMHGLCRMGQVDEARALLNKIPNPNTVLYNTLISGYVASGRFEEAKDLLYNNMVIAGYEPDAYTFNIMIDGLVKKGYLVSALELLNEMVAKRFEPNVITYTILINGFCKQGRLEEAAEIVNSMSAKGLSLNTVGYNCLICALCKDGNIEEALQLFGEMSGKGCKPDIYTFNSLINGLCKNHKMEEALSLYHDMFLEGVIANTVTYNTLVHAFLMRDSIQQAFKLVDEMLFRGCPLDNITYNGLIKALCKTGAVEKGLGLFEEMLGKGIFPTIISCNILISGLCRTGK

SEQ ID NO: 149437 - protein, 589 aa, Glycine max
  Coding DNA Sequence Number=SeqID_32659
  Gene Ontology: Mol. function=protein dimerization activity; Cellular component=nucleus; Biological process=regulation of transcription, DNA-dependent
  Homolog annotation: Hit_ID=Q9ZTX8; Match level="QueryCoverage=52%, HitCoverage=33%, E-value=1e-160, Identity=89%"; Hit description =Auxin response factor 6
  Pfam annotation: Domain name=Auxin_resp; Domain location=532-589; Score=76.2; E_value=1e-19; Accession=PF06507.4; Description=Auxin response factor
  Pfam annotation: Domain name=B3; Domain location=405-510; Score =114.2; E_value=3.8e-31; Accession=PF02362.12; Description=B3 DNA binding domain
  Pfam module annotation: Pfam domain module=Auxin_resp::B3; Domain location=532-589::405-510
MIMVPVARYSVLWLVSPEVVIGVDGPIFGGPKVVISVLGGPAFGCPEVVIGVGGLTPTFGGLEVVIGVGGPAFGGFEVVISGIAFDSLELVIGVGGPKVAIDVDGPAFGGPEVVISVGSLTFGSPEAVIGVGGSAFGGPEIVIGVGGPEVVIRAFGGLAFGGPELVIGVGVGDSTFSGLEVVIGALDDPIFGGPKIVIGVGNLPFGVPEVVFGDGGPKVVIGGPEIIISAFGGPKEQGGSGVALEVALDDGVLWVASIFGVGVFAKFGTSPIVIAPSMKLSSSGFNPPAEEEGEKKCLNSELWHACAGPLVSLPPVGSRVVYFPQGHSEQVAASTNREVDAHIPNYPNLPPQLICQLHNVTMHADAETDEVYAQMTLQPLSPQEQKEVYLLPAELGTPSKQPTNYFCKTLTASDTSTHGGFSVPRRAAEKVFPPLDYSQQPPAQELIARDLHDNEWKFRHIFRGQPKRHLLTTGWSVFVSAKRLVAGDSVLFIWNEKNQLLLGIRRANRPQTIMPSSVLSSDSMHIGLLAAAAHAAATNSRFTIFYNPRASPSEFAIPLAKYVKAVYHTRVSVGMRFRMLFETEESSVR

SEQ ID NO: 149438 - protein, 235 aa, Glycine max
  Coding DNA Sequence Number=SeqID_32660
  Gene Ontology: Mol. function=hydrolase activity, acting on glycosyl bonds; Cellular component=integral to membrane; Biological process =carbohydrate metabolic process
  Homolog annotation: Hit_ID=Q9SUP5; Match level="QueryCoverage=98%, HitCoverage=53%, E-value=1e-100, Identity=74%"; Hit description =Putative polygalacturonase
  Pfam annotation: Domain name=Glyco_hydro_28; Domain location=2-235; Score=-106.7; E_value=0.00075; Accession=PF00295.8; Description =Glycosyl hydrolases family 28
MNSSPGFVKLAFDCTIAILWKRKGTACRKVYEFYPWRWSLGCGENGTIDGQGDEWWNKWKQRTLQFTRPNLVEFVNSRDIIISNVIFKSSPFWNIHPYSNVVVRYVTILAPRDSPNTDGIDPHSSSNVCIEDSYISTGDDLVAEKSGWDEYGIVYGRPSSDITIRRVTGSSPFAGIAIGSETSGGVENVLSEHINLYNMGIGIHIKTNTGRAGYIKNITMSHVYMEEARKGIRIS

SEQ ID NO: 149439 - protein, 168 aa, Glycine max
  Coding DNA Sequence Number=SeqID_32661
MDIVYLDTCLASLYRQETTHPGLIPELLPEEREGQAMSTTVLGAGTSALGATMCVGVVSANVGGEFIGTGDGGELTRTGVGGELTGITTGGVAAGGVAVGGVATGGVVAGAGATALNEGDAIMEDETGRVAIAALGDEDGGDEVREAAGAIDFGLEGVVAGNAINTFF

SEQ ID NO: 149440 - protein, 71 aa, Glycine max
  Coding DNA Sequence Number=SeqID_32662
MFFFNRQVKVKVDLLQNLELIRIDLLRVWKEVKVVNVMNEKKFGTNSVHVWCEIRWGVRCRARCSAVRDVV

SEQ ID NO: 149441 - protein, 90 aa, Glycine max
  Coding DNA Sequence Number=SeqID_32663
MKDMWLKLEVLGVSEKIIKGPDLGCKEDPAAAAGEDRESWSEVFVLTREAEAEVEARVEFHFPLHKQSTTQAHAIVMFLPESLFLSALSL

SEQ ID NO: 149442 - protein, 932 aa, Glycine max
  Coding DNA Sequence Number=SeqID_32664
  Gene Ontology: Mol. function=protein serine/threonine kinase activity; Cellular component=integral to membrane; Biological process=protein amino acid phosphorylation
  Homolog annotation: Hit_ID=O65440; Match level="QueryCoverage=97%, HitCoverage=92%, E-value=0.0, Identity=61%"; Hit description=CLV1 receptor kinase like protein
  Pfam annotation: Domain name=LRRNT_2; Domain location=31-74; Score =14.2; E_value=0.028; Accession=PF08263.3; Description=Leucine rich repeat N-terminal domain
  Pfam annotation: Domain name=LRR_1; Domain location=103-125; Score =10.2; E_value=3.5; Accession=PF00560.23; Description=Leucine Rich Repeat
  Pfam annotation: Domain name=LRR_1; Domain location=127-149; Score =12.2; E_value=1.5; Accession=PF00560.23; Description=Leucine Rich Repeat
  Pfam annotation: Domain name=LRR_1; Domain location=151-173; Score =6.4; E_value=18; Accession=PF00560.23; Description=Leucine Rich Repeat
  Pfam annotation: Domain name=LRR_1; Domain location=175-197; Score =9.2; E_value=5.5; Accession=PF00560.23; Description=Leucine Rich Repeat
  Pfam annotation: Domain name=LRR_1; Domain location=199-221; Score =11.1; E_value=2.4; Accession=PF00560.23; Description=Leucine Rich Repeat
  Pfam annotation: Domain name=LRR_1; Domain location=223-246; Score =1.4; E_value=1.6e+02; Accession=PF00560.23; Description=Leucine Rich Repeat
  Pfam annotation: Domain name=LRR_1; Domain location=248-270; Score =20.1; E_value=0.0077; Accession=PF00560.23; Description=Leucine Rich Repeat
  Pfam annotation: Domain name=LRR_1; Domain location=272-294; Score =13.4; E_value=0.8; Accession=PF00560.23; Description=Leucine Rich Repeat
  Pfam annotation: Domain name=LRR_1; Domain location=296-318; Score =19.2; E_value=0.015; Accession=PF00560.23; Description=Leucine Rich Repeat
  Pfam annotation: Domain name=LRR_1; Domain location=320-342; Score =6.8; E_value=15; Accession=PF00560.23; Description=Leucine Rich Repeat
  Pfam annotation: Domain name=LRR_1; Domain location=344-366; Score =12.4; E_value=1.4; Accession=PF00560.23; Description=Leucine Rich Repeat
  Pfam annotation: Domain name=LRR_1; Domain location=368-387; Score =10.2; E_value=3.6; Accession=PF00560.23; Description=Leucine Rich Repeat
  Pfam annotation: Domain name=LRR_1; Domain location=392-414; Score =8.2; E_value=8.3; Accession=PF00560.23; Description=Leucine Rich Repeat
  Pfam annotation: Domain name=LRR_1; Domain location=416-438; Score =12.2; E_value=1.5; Accession=PF00560.23; Description=Leucine Rich Repeat
  Pfam annotation: Domain name=LRR_1; Domain location=440-462; Score =2.7; E_value=89; Accession=PF00560.23; Description=Leucine Rich Repeat
  Pfam annotation: Domain name=LRR_1; Domain location=465-487; Score =12.9; E_value=1.1; Accession=PF00560.23; Description=Leucine Rich Repeat
  Pfam annotation: Domain name=LRR_1; Domain location=489-511; Score =17.5; E_value=0.049; Accession=PF00560.23; Description=Leucine Rich Repeat
  Pfam annotation: Domain name=LRR_1; Domain location=513-535; Score =11.7; E_value=1.8; Accession=PF00560.23; Description=Leucine Rich Repeat
  Pfam annotation: Domain name=LRR_1; Domain location=537-559; Score =11.4; E_value=2.1; Accession=PF00560.23; Description=Leucine Rich Repeat
  Pfam annotation: Domain name=LRR_1; Domain location=561-583; Score =1.9; E_value=1.3e+02; Accession=PF00560.23; Description=Leucine Rich Repeat
  Pfam annotation: Domain name=LRR_1; Domain location=585-607; Score =4.6; E_value=40; Accession=PF00560.23; Description=Leucine Rich Repeat
  Pfam annotation: Domain name=LRR_1; Domain location=79-101; Score =5.8; E_value=23; Accession=PF00560.23; Description=Leucine Rich Repeat
  Pfam annotation: Domain name=Pkinase; Domain location=704-932; Score =117.0; E_value=5.4e-32; Accession=PF00069.15; Description=Protein kinase domain
  Pfam annotation: Domain name=Pkinase_Tyr; Domain location=704-923; Score=71.4; E_value=2.9e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=31-74::103-125::127-149::151-173::175-197::199-221::223 -246::248-270::272-294::296-318::320-342::344-366::368-387::392 -414::416-438::440-462::...
  Pfam module annotation: Domain location=465-487::489-511::513 -535::537-559::561-583::585-607::79-101::704-932::704-923
  Subcellular localization annotation: CTP_CleavageSite=38; ConfidenceScore=5.43e-01
MGTPTLGLVLVLLLSFLTWPASVSSSLPMSLRRQASILVSLKQDFEANTDSLRTWNMSNYMSLCSGTWEGIQCDEKNRSVVSLDISNFNLSGTLSPSITGLRSLVSVSLAGNGFSGVFPSDIHKLGGLRFLNISGNAFSGDMRWEFSQLNELEVLDAYDNEFNCSLPLGVTQLHKLNSLNFGGNYFFGEIPPSYGDMVQLNFLSLAGNDLRGLIPPELGNLTNLTQLFLGYYNQFDGGIPPEFGELVSLTHLDLANCGLTGPIPPELGNLIKLDTLFLQTNQLSGSIPPQLGNMSGLKCLDLSNNELTGDIPNEFSGLHELTLLNLFINRLHGEIPPFIAELPNLEVLKLWQNNFTGAIPSRLGQNGKLAELDLSTNKLTGLVPKSLCLGRRLRILILLNNFLFGSLPADLGQCYTLQRVRLGQNYLTGSIPNGFLYLPELALLELQNNYLSGWLPQETGTAPSKLGQLNLSNNRLSGSLPTSIRNFPNLQILLLHGNRLSGEIPPDIGKLKNILKLDMSVNNFSGSIPPEIGNCLLLTYLDLSQNQLAGPIPVQLSQIHIMNYLNVSWNHLSQSLPEELGAMKGLTSADFSHNDFSGSIPEEGQFSVFNSTSFVGNPQLCGYELNPCKHSSNAVLESQDSGSARPGVPGKYKLLFAVALLACSLAFATLAFIKSRKQRRHSNSWKLTTFQNLEFGSEDIIGCIKESNVIGRGGAGVVYHGTMPNGEQVAVKKLLGINKGCSHDNGLSAEIRTLGRIRHRYIVRLLAFCSNRETNLLVYEYMPNGSLGEILHGKRGEFLKWDTRLKIATEAAKGLCYLHHDCSPLIIHRDVKSNNILLNSEFEAHVADFGLAKFLQDTGTSECMSSIAGSYGYIAPEYAYTLKVDEKSDVYSFGVVLLELLTGRRPVGNFGEEGLDIVQWTKLQTNWSNDKV

SEQ ID NO: 149443 - protein, 150 aa, Glycine max
  Coding DNA Sequence Number=SeqID_32665
MEIEEIFGGWDNLLCASLHTAPGYYFSYCMSKDTMKQNIMCLNESIIVITKAHTYSKGGLVYEYHCIEITLGVVMWGGDHEIVVRDNDSRTNTISVNRSEFPKQFVIITQVQQWCGFERVNIFLVEDIGDEVQIPCMRRRINYVTNLEML

SEQ ID NO: 149444 - protein, 73 aa, Glycine max
  Coding DNA Sequence Number=SeqID_32666
MNHIDQGVERNSSGNLVQTEGTATSNDAQVNNRARSSSNKDSPETESPAANIKRREGRKEKGQKNRLMFEESR

SEQ ID NO: 149445 - protein, 448 aa, Glycine max
  Coding DNA Sequence Number=SeqID_32667
  Gene Ontology: Mol. function=DNA-directed RNA polymerase activity; Cellular component=chromatin; Biological process=chromatin assembly or disassembly
  Homolog annotation: Hit_ID=Q1SJG5; Match level="QueryCoverage=86%, HitCoverage=29%, E-value=1e-70, Identity=43%"; Hit description=SNF2 -related; Chromo; DEAD/DEAH box helicase, N-terminal; DNA-directed RNA polymerase, subunit beta-prime
MAFFRNFSNDTVSHGVMEDKSQGQNANRVHRSVGNDCTDATSSEKEFDMNMEAQYDSDGEPDGSSRLQTEATADDGDAVKESNLQTTGSKTAMVGRWGSTFWKDCGQMDPQNGSESGQESKSGSDYRNADGSEDNSLDGRAGRLDSDDDDGQKEAGKGPRGHSDVPAEEMLSDEYYEQDGEEQSDSLHYGGIKKPTGSNSWPQRMSTSANRTLHRNLRFSDDVEDNDGEDEDDDDGDNDNDGDDADYEEEDEADEDDPDDADFEPATSGHAANKDKDWEGEGSDEDDDSDANIVVSDDDEPFYAKRPKGRQRGKIGQNIKSTRERKVYAASGRQRRVKSSFEDNESTTEDSDSDGDEDFKSTKKRSVHVRKNNGRSSAATGFSSRNSEVRTSSRTVRKVSYVESEESEEADEAKKKKSQKKEEREVTTPLKQPLDLSSLKWSQKVNPK

SEQ ID NO: 149446 - protein, 203 aa, Glycine max
  Coding DNA Sequence Number=SeqID_32668
  Gene Ontology: Mol. function=DNA-directed RNA polymerase activity; Cellular component=chromatin; Biological process=chromatin assembly or disassembly
  Homolog annotation: Hit_ID=Q1SJG5; Match level="QueryCoverage=80%, HitCoverage=13%, E-value=1e-80, Identity=87%"; Hit description=SNF2 -related; Chromo; DEAD/DEAH box helicase, N-terminal; DNA-directed RNA polymerase, subunit beta-prime
  Pfam annotation: Domain name=Chromo; Domain location=150-203; Score =48.3; E_value=2.7e-11; Accession=PF00385.14; Description='chromo' (CHRromatin Organisation MOdifier
  Pfam annotation: Domain name=Chromo; Domain location=59-116; Score =5.8; E_value=0.2; Accession=PF00385.14; Description='chromo' (CHRromatin Organisation MOdifier
  Pfam module annotation: Pfam domain module=Chromo::Chromo; Domain location=150-203::59-116
ISGMRFADCLAEFKLNMQDGNFSCIGFDEEIEEDDGDSIEKVLWHQPKGMAEDAQRNNRSTEPVLMSHLFDSEIDWNEIEFLIKWKGQSHLHCQWKSFAELQNLSGFKKVLNYTKKIMEDIRYRRTISREEIEVNDVSKEMDLDIIKQNSQVERIIADRISNDNSGNVIPEYLVKWQGLSYAEATWEKDIDIAFAQHAIDEYK

SEQ ID NO: 149447 - protein, 335 aa, Glycine max
  Coding DNA Sequence Number=SeqID_32669
  Gene Ontology: Mol. function=DNA-directed RNA polymerase activity; Cellular component=chromatin; Biological process=chromatin assembly or disassembly
  Homolog annotation: Hit_ID=Q1SJG5; Match level="QueryCoverage=91%, HitCoverage=25%, E-value=1e-162, Identity=91%"; Hit description=SNF2- related; Chromo; DEAD/DEAH box helicase, N-terminal; DNA-directed RNA polymerase, subunit beta-prime
  Pfam annotation: Domain name=DEAD; Domain location=40-213; Score= -7.3; E_value=2.3e-05; Accession=PF00270.19; Description=DEADDEAH box helicase
  Pfam annotation: Domain name=ResIII; Domain location=36-207; Score =1.0; E_value=3.8e-05; Accession=PF04851.6; Description=Type III restriction enzyme, res subunit
  Pfam annotation: Domain name=SNF2_N; Domain location=42-327; Score =353.3; E_value=3.9e-103; Accession=PF00176.13; Description=SNF2 family N-terminal domain
  Pfam module annotation: Pfam domain module=DEAD::ResIII::SNF2_N; Domain location=40-213::36-207::42-327
AREAAMAVQGKMVDSQRKKSKASLRKLEKQPEWLKGGELRDYQLEGLNFLVNSWRNDTNVILADEMGLGKTVQSVSMLGFLQNAQQIHGPFLVVVPLSTLSNWAKEFRKWLPDMNIIIYVGTRASREVCQQYEFYNEKKPGKPIKFNALLTTYEVVLKDKAVLSKIKWNYLMVDEAHRLKNSEAQLYTTLSEFSTKNKLLITGTPLQNSVEELWALLHFLDPDKFRSKDEFVQNYKNLSSFNENELANLHMELRPHILRRVIKDVEKSLPPKIERILRVEMSPLQKQYYKWILERNFHNLNKGVRGNQEMPILDAWFLSTMQTSLIVKSSKLELV

SEQ ID NO: 149448 - protein, 696 aa, Glycine max
  Coding DNA Sequence Number=SeqID_32670
  Gene Ontology: Mol. function=nucleic acid binding; Cellular component= chromatin; Biological process=chromatin assembly or disassembly
  Homolog annotation: Hit_ID=Q1SJG7; Match level="QueryCoverage=90%, HitCoverage=70%, E-value=0.0, Identity=67%"; Hit description =Helicase, C-terminal; Homeodomain-like
MDIDEILERAEKVEEKETDGEQGNELLGAFKARYVDSTVANFCNDEDDGSFWSRWIKPDAVFQAEEALAPRSARNIKSYAEVDPSERSNKRKKKEPEPPEQVPKRRKAEYSAHAVPMIEGASVQYGVIYSLPGSKISSLLLLLDRVNCCTALWVSQWVLKYGNESQIDLIAAEVGGAVGAAPPGAQIELFNALVDGCTEAVELGNLDAKGPLLDFFGVPVKANDLLTRVQQLQLLAKRIGRYEDPVAQFRVLSYLKPSNWSKGCGWNQIDDARLLLGIHYHGFGNWEKIRLDERLGLMKKIAPVELQHHETFLPRAPNLKDRANALLEQELAVLGVKNANSRVGRKPSKKERENMINLSLLRGQEKKKKSSSVNVQMRKDRFQKPQKVESIVKEEGEMSDNEEVYEQFKEVKWMEWCQDVMVEEMKTLKRLHRLQQTSANLPKEKVLSKIRNYLQLLGRRIDQIVLEHEQEPYKQDRMTVRLWKYVSTFSHLSGERLHQIYSKLRQEQDEAEVGPSHTNGSVSVSFSRNGNPFRFHMERQRGLKNMATYQMPEPVDNTGKSEAWKRRRRTESDNHFQGQPPPQRTVSNGVRIADPNSLGILGAGPSDKRFASEKPYRTQPGGFPSRQGFSSEADYKSVGFHSAFIQLQLLYILWNFFLPPMRIRPCGIPFGCVLADMRNIPTLGFASLKMAEAKKI

SEQ ID NO: 149449 - protein, 252 aa, Glycine max
  Coding DNA Sequence Number=SeqID_32671
  Gene Ontology: Mol. function=protein binding; Cellular component =integral to membrane
  Homolog annotation: Hit_ID=Q5N7I7; Match level="QueryCoverage=93%, HitCoverage=65%, E-value=1e-75, Identity=60%"; Hit description =Putative NTS2 protein
  Pfam annotation: Domain name=DUF6; Domain location=19-125; Score =11.7; E_value=0.014; Accession=PF00892.11; Description=Integral membrane protein DUF6
  Pfam annotation: Domain name=DUF803; Domain location=3-252; Score =410.0; E_value=3.4e-120; Accession=PF05653.4; Description=Protein of unknown function (DUF803)
  Pfam module annotation: Pfam domain module=DUF6::DUF803; Domain location=19-125::3-252
MGLSKENLKGLILALVSSGFIGASFIIKKQGLRRAAAVSGVRAGVGGYYYLLEPLWWVGMITMIVGEVANFVAYAFAPAVLVTPLGALSIIVSAVLADIILKEKLHNLGILGCIMCIAGSIIIVIHAPKEQPITSVLEIWNMATQPAFLAYVGSVIVLVFILVFHFAPRCGHTNVLVFTGICSLMGSLSVMSVKALGTSLKLTFEGKNQLIYPETWFFMLVVAICVIMQMNYLNKELLFVLSLLGGGEKDLL

SEQ ID NO: 149450 - protein, 110 aa, Glycine max
  Coding DNA Sequence Number=SeqID_32672
  Homolog annotation: Hit_ID=Q5N731; Match level="QueryCoverage=36%, HitCoverage=11%, E-value=4e-07, Identity=56%"; Hit description =Putative NTS2 protein
MFKDWDGQSGGTIVSEICGFIIVLSGTIMLHATKDFERSSSFRGVVVILYRLRYLPDFLPEMVTHYLSKMRKMDLPRVICAQEGKNWGRRSLSLENLNEMPIRLYYTMKL

SEQ ID NO: 149451 - protein, 134 aa, Glycine max
  Coding DNA Sequence Number=SeqID_32673
MSYWTDYNLELLPFFGLFGSAGSLTQTHYCGITKKLEIQSNEGIMQQYRERNEKRGSIIHIGGIHLFYYKTKEAVGYTWTAISSFRTNSTSSFCHARGDGGESHDNGEEGGELHCIEWSNQSENWDIGNSTGSG

SEQ ID NO: 149452 - protein, 45 aa, Glycine max
  Coding DNA Sequence Number=SeqID_32674
MERKMHNPTSSTVLTILLLGVLSQNLVVPVTCTPTSSPTPFTGTS

SEQ ID NO: 149453 - protein, 429 aa, Glycine max
  Coding DNA Sequence Number=SeqID_32675
  Gene Ontology: Mol. function=GTP binding; Cellular component =intracellular; Biological process=small GTPase mediated signal transduction
  Homolog annotation: Hit_ID=Q6ATJ0; Match level="QueryCoverage=49%, HitCoverage=51%, E-value=3e-58, Identity=60%"; Hit description =Putative GTP-binding protein
  Pfam annotation: Domain name=MMR_HSR1; Domain location=129-254; Score= 116.6; E_value=7.3e-32; Accession=PF01926.13; Description=GTPase of unknown function
MAWGKPVLDRVGLIIEIFNAHAFTKEAKLQAELAALSYKKTRLVRIRGPDGRNTFGASGEAEVVSARGRGSGGQGFMSGAGETELQLQRRRILERRNYLLSQIEEVRRTRALQRAGRKRRGGSSGEGLATVAVVGYTNAGKSTLVSRLSDSDLYSDCRLFATVDPRVRSAVLPSGKKVLFSDTVGFISDLPVQLVEAFQATLEEVVEADLLVHVVDSSAPNLDEHRSTVFQVLQQIGVSEEKLQNMIEVWNKIDMEEECMDVDEYLDDEDKDGDADENSSFSGEDDVKSEVLPEREKDRAGSISGAENEGIKEVDCEGMEEKEDYSDGWLYDDDLVDEDEFCSPSTVADQQNESYKKDNSVVKDGSIGQSGPHVKTSAVTGVGLQELLELIDKKLSVQNKKGARVVERSIYDRKWRPSHNQESGIAVEQ

SEQ ID NO: 149454 - protein, 82 aa, Glycine max
  Coding DNA Sequence Number=SeqID_32676
MRRRNCSRVLRSSDWHRREVIGCGGRCDRGSGGDAPRIPVIERSASSRRRGGAAEEEKIAARKYDLENQLQRRERNGARERK

SEQ ID NO: 149455 - protein, 267 aa, Glycine max
  Coding DNA Sequence Number=SeqID_32677
  Gene Ontology: Mol. function=ATP-dependent helicase activity; Cellular component=integral to membrane; Biological process=transport
  Homolog annotation: Hit_ID=Q6YZD2; Match level="QueryCoverage=82%, HitCoverage=91%, E-value=2e-85, Identity=70%"; Hit description =Coated vesicle membrane protein-like
  Pfam annotation: Domain name=EMP24_GP25L; Domain location=84-147; Score=53.8; E_value=5.7e-13; Accession=PF01105.14; Description =emp24gp25Lp24 family
MRKAEGRATTPFPVSAKHTVEIKKHNLMRLSLRHALVFVLIGALWNLQRAEGIRFVIDRDECFSHDVKYEGDTVHVSFVVIKADSPWHYGDEGVDLVVKGPSGEQIQDFRDKTSEKFDFVAHKSGVHKFCFTNKSPYHETVDFDVHVGHFSYFEQHAKDEHFTPLLEQIGKLEEALYNIQFEQHWLEAQTDRQAIATIPKETTLLRTLLPISLTMFTVENIDSVNDAMSRRAVHKAIFESAALIGASALQVYLLQRLFERKLGTSRV

SEQ ID NO: 149456 - protein, 71 aa, Glycine max
  Coding DNA Sequence Number=SeqID_32678
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XH47; Match level="QueryCoverage=90%, HitCoverage=92%, E-value=2e-23, Identity=67%"; Hit description=Small zinc finger-like protein
  Pfam annotation: Domain name=zf-Tim10_DDP; Domain location=14-67; Score=16.6; E_value=0.00011; Accession=PF02953.6; Description =Tim10DDP family zinc finger
MASNISPSAFDKEQIFGMAEKEMEYRVELFNKYKESELNMGENSCIDRCVSKYWHVTNLIGQLLGSGRPPM

SEQ ID NO: 149457 - protein, 45 aa, Glycine max
  Coding DNA Sequence Number=SeqID_32679
MEDYFNFHAFKLIVGTHNMDCLCYAVVMVGIAPRSSIWGIWGLKK

SEQ ID NO: 149458 - protein, 255 aa, Glycine max
  Coding DNA Sequence Number=SeqID_32680
  Gene Ontology: Mol. function=transferase activity; Cellular component= intracellular; Biological process=translation
  Homolog annotation: Hit_ID=Q8S5U6; Match level="QueryCoverage=61%, HitCoverage=72%, E-value=1e-19, Identity=31%"; Hit description =Putative indole-3-acetate beta-glucosyltransferase
  Pfam annotation: Domain name=PPR; Domain location=104-138; Score=4.4; E_value=2.2; Accession=PF01535.11; Description=PPR repeat
  Pfam annotation: Domain name=PPR; Domain location=11-45; Score=45.8; E_value=1.5e-10; Accession=PF01535.11; Description=PPR repeat
  Pfam annotation: Domain name=PPR; Domain location=69-103; Score=51.2; E_value=3.5e-12; Accession=PF01535.11; Description=PPR repeat
  Pfam module annotation: Pfam domain module=PPR::PPR::PPR; Domain location=104-138::11-45::69-103
MKGAGLVADTVIYTILIDGYCRNGNVAEALNVRKEMVERGVFADYYTLTTLFMGRALGLFETLTQRSLVTYNTLMDGFCKIGEMEKAKELWCDMVSRGILPSYVSFSILMNGFCSLGLMGLVVDYANAITGSVYHRKHNPGGCLRSPDIIVEPSCLGGAWIEVIAIMKCSMGDWKLKHSFFLLSSSMRMVTSHHLSSGSKPFTMSPSCKQVVLVAMMASLCLTGASAYPTHMGAGRGCGLFSVVEYWDPNSRYGT

SEQ ID NO: 149459 - protein, 56 aa, Glycine max
  Coding DNA Sequence Number=SeqID_32681
MVMEEDVEEFITNAEKVEDEILSMVRKDWTVMRLLLTFLDFTFDVTHTSHHHASLR

SEQ ID NO: 149460 - protein, 410 aa, Glycine max
  Coding DNA Sequence Number=SeqID_32682
  Homolog annotation: Hit_ID=Q38848; Match level="QueryCoverage=61%, HitCoverage=77%, E-value=2e-61, Identity=50%"; Hit description=LRP1
  Pfam annotation: Domain name=DUF702; Domain location=186-352; Score =304.9; E_value=1.5e-88; Accession=PF05142.3; Description=Domain of unknown function (DUF702)
  Subcellular localization annotation: CTP_CleavageSite=20; ConfidenceScore=5.08e-01
VATTRRLPSDSGAFADWAATASSGAGGGGGRAVPVDELSLGFNAGPAAATGPTAGMWSTPTRSINYPEMGMFVVAPASSFHPNLHHHHHHHHQPSPNDPAVMVDSLNPATALGVGVIPLLAPTPCHESDNNILGNRTRGGGIQFWQDQQQHNQGNYTKKPQQGLLDHNSNTSSGNLVQNSGGVTASGTSSGGTTCQDCGNQAKKDCTNRRCRTCCKSRGFDCPTHVKSTWVPAARRRERQLMTSATVAPVAGSSGSTSGTKKPRLIASQTTTTSHTSTSNTTPPRSFDTSSSHQDAGFKESLPGQVRAPAVFKCVRVTAVEDGQDEYAYQAVVKIGGHEFKGFLYDQGAENRDVYPNLSELHLGGGNGGSGGAGRNGVSSSSPMMDPNDVYAASGGGLLGGSSAYGNPMN

SEQ ID NO: 149461 - protein, 465 aa, Glycine max
  Coding DNA Sequence Number=SeqID_32683
  Homolog annotation: Hit_ID=Q1SS74; Match level="QueryCoverage=99%, HitCoverage=94%, E-value=2e-66, Identity=35%"; Hit description=C2
  Pfam annotation: Domain name=C2; Domain location=35-122; Score=34.9; E_value=2.9e-07; Accession=PF00168.20; Description=C2 domain
MDSFNQSVQNSSFRYNPNLNTRTHADEEAEFSGILDIFVHHARNIHNICIYDNQDVYAKFSLTYNPDETLSTRIINGGGKNPTFNENLRLKITQMNAVLKCEVWMFSRSRIHMEDQLLGFALVPISQVVGKGKLTEDYSLSSTDLFHSPAGTVQLTLSLDPSLAINSSVNLIPESAKNSSISSEVILLDRKISEVMLDPVEYARIEFPDISVVKENQQMVSEYFNLASQDTNSAPSRSNIGGSLPFLHLGASPQLDDYEMTMMSSPDENHIGPISPNESIQNSCFPGSTITTLSSDDINSADSVEKKNHLSTGDSSNSITVSITVEGTQNCGAGPDTPTSKKEEGEARGNKDANFSSKEKESKKINNNNTEASKFGQVYSAPLGNINLEAEQAAMQKQIVDMYMRSMKQFTESLAKMKLPMDLDKPEKVDHGDVDVIQNLDNSKLEIDKKKKDGSRVFYGSRAFF

SEQ ID NO: 149462 - protein, 136 aa, Glycine max
  Coding DNA Sequence Number=SeqID_32684
  Subcellular localization annotation: CTP_CleavageSite=57; ConfidenceScore=5.31e-01
MISLTGFYTNNNLSASSPPNNIPYPSFAIQFTRGSPPKLFGGRIGGKLIGVEPVHVMASIVKKHEYHKPNVQPVIKSTRGANHYVDITNNTDNNHLGFSNIGPSSSSPINIQTTTTPYAPTDANMHALSEQPHQSG

SEQ ID NO: 149463 - protein, 247 aa, Glycine max
  Coding DNA Sequence Number=SeqID_32685
  Gene Ontology: Mol. function=DNA binding
  Homolog annotation: Hit_ID=Q1SZ33; Match level="QueryCoverage=59%, HitCoverage=45%, E-value=1e-10, Identity=31%"; Hit description=HMG-I and HMG-Y, DNA-binding
  Pfam annotation: Domain name=DUF296; Domain location=66-189; Score =10.1; E_value=7.2e-05; Accession=PF03479.5; Description=Domain of unknown function (DUF296)
  Subcellular localization annotation: CTP_CleavageSite=18; ConfidenceScore=5.25e-01
MANNFCAPSLSPPPPSPLSSTLSSPIFVIPSESDVPPPDVVAIAKRLKRKPSGSENKPKPVIEEFPKPMFLMVPAGIDIINAIITFARNQHASILVHHASGTISQVNLCNPVYPFDDLSFQGNMYMFSFSGFYTKSLSPLPPKNIPFSFFNIRLSKGTTPQHLGGLIRGKLIAAEPVHVMASLLKEHEYQEIGTHGNRYASIMNNAINGITNNNTANHHPGMNAQPLASPTDLNMLYLNNPTNQGDN

SEQ ID NO: 149464 - protein, 138 aa, Glycine max
  Coding DNA Sequence Number=SeqID_32686
  Homolog annotation: Hit_ID=Q00TN0; Match level="QueryCoverage=48%, HitCoverage=7%, E-value=2e-10, Identity=52%"; Hit description =Homology to unknown gene
MGRAKSLLLLLMVLLFSFATYNLVAMIMDHKADGLESLNRKMMVSGKTNSKFHVAVTATDAAYNQWQCRIMYYWYKKVKDMPGSDMGKFTRILHSGRSDQLMDEIPTFVVDPLPEGLDKNKPIPFTTLGCGGEVEGFV

SEQ ID NO: 149465 - protein, 225 aa, Glycine max
  Coding DNA Sequence Number=SeqID_32687
  Gene Ontology: Mol. function=methyltransferase activity; Biological process=metabolic process
  Homolog annotation: Hit_ID=Q00TN0; Match level="QueryCoverage=87%, HitCoverage=20%, E-value=2e-51, Identity=46%"; Hit description =Homology to unknown gene
GYIVLNRPWAFVQWLEKADIEEEYILMAEPDHIFVKPLPNLAQGTLPAAFPFFYIKPDQNEKIIRKFYPEENGPVTDVDPIGNSPVIIKKSLMEEIASTWVNVSLRMKDDQETDKAFGWVLEMYAYAVASALHGVKHNLRKDFMLQPPWDLNVENKFIIHYTYGCDYNMKVFTPYYFIQGELTYGKIGEWRFDKRSYLLGPPPKNLPLPPPGVPESVLASLEKAR

SEQ ID NO: 149466 - protein, 699 aa, Glycine max
  Coding DNA Sequence Number=SeqID_32688
  Homolog annotation: Hit_ID=Q8W417; Match level="QueryCoverage=99%, HitCoverage=82%, E-value=1e-147, Identity=44%"; Hit description=Cig3
MNRQSYSQLSGDVKALEVNGRGKGEAKLVNRDTGVDTCLRKGGASNIQDTYKSFCTRLVRLNGILFTRTSLEILTEVLSLVSAGLRELLSSGQDEELNFGTDTLENKLAIVRIVSIIIFTVHNVNKESEGQTYAEIVQRAVLLQNAFTAAFELMSLVVERCMQLWDPSCSYLLPGILVFVEWLACYPYLAAGNDVDENQATVRSKFWNHCISFLNKLLSVWPMSIEDDEEETCFNNMSRYEEGETENRLALWEDFELRGFGPLLPAQTILDFSRKNNLGSDSEKERKARVKRILAAGKALANVVRIDQKMIYFDSKGKTFVIGVQPQISDDFVISSYSGMPNAEDLLKDNTVVDKTKVGIGHPDHQQYIEGEEDDEVIVFKPIVAERRADVVVASSQAPHEGLESVPKASIGDIKFNVNSTSNPLNDANHQISLPASVSPMMPQHLQPVQPHSSRWLEEEISLANSLKGLRFLENGHVMKPDLPFKAAVAISDHAALAVPTQQSVSASTNMFYAHDLSKAEDFAISSKIDAIASSGTFTDNSVVKTSSTLQAGLKKSLVSRPSRHLGPPPGFSHVPPKQGSPTVSDSISGNPIMDDYSWLDGYQLPASTNDLGPDGPLTYSQSNPHQIGLSGTASFPFPGKQIPSTLQVEKQNGWRDFQTLELLKAHHNQQLQSQLAPNGNQHFTPLPEQFQGQSIWTG

SEQ ID NO: 149467 - protein, 260 aa, Glycine max
  Coding DNA Sequence Number=SeqID_32689
  Homolog annotation: Hit_ID=Q8W417; Match level="QueryCoverage=35%, HitCoverage=11%, E-value=3e-26, Identity=63%"; Hit description=Cig3
MDKVSSSRERAQRLYEKVASGNWHTALHWLNLELENKRRRSAQAQVPSDPNAWQQIRENYEAIILEDHAFSEQHNIEYALWQLHYKRIEELRAYFNAAHASVSSKSSQGGKGPVRPDRITKIRLQFKTFLSEATGFYHDLIMKIRAKYGLPLGYFDDSQNNVVTEKDGKKSSEMKKGLISCHRCLIYLGDLARYKGLYGEGDSIKREFAAASSYYLQAASICPTSGNPHHQVFGIPVSAVFCFWLFTFLVDHSLRLLYSI

SEQ ID NO: 149468 - protein, 323 aa, Glycine max
  Coding DNA Sequence Number=SeqID_32690
  Gene Ontology: Mol. function=GTPase activator activity; Cellular component=intracellular; Biological process=signal transduction
  Homolog annotation: Hit_ID=Q69RJ1; Match level="QueryCoverage=93%, HitCoverage=32%, E-value=2e-73, Identity=57%"; Hit description =Pleckstrin homology (PH) domain-containing protein-like
PRKTPSVESVDSSGEEELAIQRLEIAKNDLQHRIAKEARGNAILQASLERRKQALHERRLALEQDVSRLQEQLQAERDLRAALEVGLSMSSGQLSSSRGMDSKVYTFCKKSAIVQTKAELEEIALAEADVARLKQKVAELHHQLNQQRQHHYGSLTDVGDRYQHAQNHPQQRFLQQDFDSTLAFVNHERKQRTEESLLGTDWRNIKGQVLASGNGTRQPSRKQFLESSPSDSKSTEASTSMSVDDLGAIDSASVPSTSRVADVGEYARHPPVASSTLVELTTRLDFFKERRSQLMEQLHNLDLNYGSTTSQDFVYKPSSPSWS

SEQ ID NO: 149469 - protein, 151 aa, Glycine max
  Coding DNA Sequence Number=SeqID_32691
  Gene Ontology: Cellular component=integral to membrane; Biological process=vesicle-mediated transport
  Homolog annotation: Hit_ID=Q1S712; Match level="QueryCoverage=98%, HitCoverage=68%, E-value=3e-65, Identity=80%"; Hit description =Longin-like
MGILYALVGRGSVVLAEFSGTTTNASAIARQILEKIPGNNDTHVSYSQDRYIFHVKRTDGLTVLCMADDTAGRRIPFAFLEDIHQKFVRTYGRAVHSAQPYGMNEEFSRVLSQQMEYYSSDPNADRINRLKGEMSQLFKHCLSSMNKIIVP

SEQ ID NO: 149470 - protein, 431 aa, Glycine max
  Coding DNA Sequence Number=SeqID_32692
  Gene Ontology: Mol. function=GTPase activator activity; Cellular component=intracellular; Biological process=signal transduction
  Homolog annotation: Hit_ID=Q10L77; Match level="QueryCoverage=81%, HitCoverage=45%, E-value=1e-127, Identity=63%"; Hit description =Pleckstriny domain-containing protein, putative, expressed
  Pfam annotation: Domain name=RhoGAP; Domain location=143-249; Score= -3.9; E_value=1.8e-05; Accession=PF00620.17; Description=RhoGAP domain
MSAPLAAFERPRPGASNTSALPQRGGEVNLTLGGIDLNNSGSVVVREDKKLLTVLFPDGRDGRAFTLKAETSEDLLEWKTALEQALTQAPSAALVMGHNGIFRSDASDSIEGSFHQWRDKRPIKSLVVGRPILLALEDIDGGPSFLEKALRFLEKYGTKVEGILRQSADVEEVDRRVQEYEQGTNSYLKRPSTLHAFEESQLLVLGKTEFGPEEDAHVVGDCVKENRMTPSAVAACMAPLLLRPLLAGECELEDEFDASGDSSAQLLAAANAANNAQAIITTLLEEYESIFDEENIQRCSMSADSRVENSGSEDSTDDDNIDVKENGYHDAENEVDQETDDDADRVQSGKLSESSGYAGSDLYDYKAFGGDDSDVGSSSSNHAKTENANLNAVPDTPGSEDQNKQRKASETQLMKMMLRICCLHLNLIDPW

SEQ ID NO: 149471 - protein, 243 aa, Glycine max
  Coding DNA Sequence Number=SeqID_32693
  Homolog annotation: Hit_ID=Q1S708; Match level="QueryCoverage=30%, HitCoverage=31%, E-value=3e-25, Identity=77%"; Hit description=PpiC -type peptidyl-prolyl cis-trans isomerase; Rhodanese-like
  Pfam annotation: Domain name=Rotamase; Domain location=152-224; Score= 22.8; E_value=9.8e-06; Accession=PF00639.11; Description=PPIC-type PPIASE domain
MGHPLSQLPNYLKDGAACFLDVGTLTSGTANITPGSKGIKEQKQDQEVQKQDQQVQIAEKPKRKVLALEASFNSAPNMLPPLFQQALWLGPSSSFWAYSFMLVPLQMVPRANINSNSSNVNVEISLSVKASYGTGASAAAEGDRPREILVQHLLVKEDDQKLLLDIQQRISSGEDLSDLAVEYSLCPSKEEGGMLGWVRKGQMAVLPLSDGKDTVTVNFLWEEEADEVPEFEEAAFTAPLNKV

SEQ ID NO: 149472 - protein, 80 aa, Glycine max
  Coding DNA Sequence Number=SeqID_32694
MVFGMVIDRYVIVYFAILYIRHHAGIVTDEMLDTPKAPFIVVGLLEALAAATGMAAGVSTMLILSVLTMYSINNDADAGG

SEQ ID NO: 149473 - protein, 79 aa, Glycine max
  Coding DNA Sequence Number=SeqID_32695
  Gene Ontology: Mol. function=catalytic activity; Biological process =metabolic process
MGDRDTTAYTTTPDNIQSIAQDVTQTLRCVMDSNACSPDWRVQFYVFPYAYTRSMLHKFRRCFLHMRIIDVRETSRIQE

SEQ ID NO: 149474 - protein, 66 aa, Glycine max
  Coding DNA Sequence Number=SeqID_32696
  Gene Ontology: Cellular component=integral to membrane; Biological process=vesicle-mediated transport
  Homolog annotation: Hit_ID=Q1S712; Match level="QueryCoverage=98%, HitCoverage=30%, E-value=9e-25, Identity=86%"; Hit description =Longin-like
  Pfam annotation: Domain name=Synaptobrevin; Domain location=1-66; Score=58.3; E_value=2.4e-14; Accession=PF00957.11; Description =Synaptobrevin
VRNVMIENIDKVLDRGDRLELLVDKTANMQGNTFRFRKQARRFRSTVWWRNVKLTYILDLNLSLIS

SEQ ID NO: 149475 - protein, 135 aa, Glycine max
  Coding DNA Sequence Number=SeqID_32697
  Homolog annotation: Hit_ID=Q1S708; Match level="QueryCoverage=29%, HitCoverage=17%, E-value=1e-14, Identity=90%"; Hit description=PpiC -type peptidyl-prolyl cis-trans isomerase; Rhodanese-like
MACGHYKLPSGCSHRVLGKYTIFLGESMPMLSRLIHQFPHIDLQCSPLLVLFLSLNMRARFCGMSMLPLGIGILLVRTCIYFGLRVRGYISSARFFVKLALAVRWFMIFSAISILWLSIPGWNHSWVKGSLIEYL

SEQ ID NO: 149476 - protein, 465 aa, Glycine max
  Coding DNA Sequence Number=SeqID_32698
  Gene Ontology: Mol. function=protein serine/threonine kinase activity; Cellular component=cytoplasm; Biological process=protein amino acid phosphorylation
  Homolog annotation: Hit_ID=Q1S707; Match level="QueryCoverage=97%, HitCoverage=88%, E-value=0.0, Identity=88%"; Hit description=EPS15 homology (EH); Protein kinase
  Pfam annotation: Domain name=Pkinase; Domain location=8-266; Score =346.1; E_value=5.7e-101; Accession=PF00069.15; Description=Protein kinase domain
  Pfam annotation: Domain name=Pkinase_Tyr; Domain location=8-264; Score=-21.1; E_value=3.6e-11; Accession=PF07714.7; Description =Protein tyrosine kinase
  Pfam annotation: Domain name=efhand; Domain location=305-333; Score =35.1; E_value=2.5e-07; Accession=PF00036.22; Description=EF hand
  Pfam annotation: Domain name=efhand; Domain location=341-369; Score =35.2; E_value=2.3e-07; Accession=PF00036.22; Description=EF hand
  Pfam annotation: Domain name=efhand; Domain location=377-405; Score =32.2; E_value=1.8e-06; Accession=PF00036.22; Description=EF hand
  Pfam annotation: Domain name=efhand; Domain location=412-440; Score =37.6; E_value=4.2e-08; Accession=PF00036.22; Description=EF hand
  Pfam module annotation: Pfam domain module=Pkinase::Pkinase _Tyr::efhand::efhand::efhand::efhand; Domain location=8-266::8 -264::305-333::341-369::377-405::412-440
MEDVKSTYSMGKELGRGQFGVTHLCTHKSTGKQYACKTIAKRKLVNKEDIEDVKREVQIMHHLSGQANIVELVNVYEDKQSVHLVMELCAGGELFDRIIAKGHYTERAAASLLRTIVQIVHTCHSMGVIHRDLKPENFLLLNKDENAPLKATDFGLSVFYKQGEMFKDIVGSAYYIAPEVLKRKYGPEVDIWSIGVMLYILLCGVPPFWAESENGIFNAILRGHVDFTSDPWPSISPAAKDLVRKMLHSDPRQRMTAYEVLNHPWIKEDGEAPDTPLDNAVLNRLKQFRAMNEFKKVALREEIMGLKQMFRGMDTDNSGTITIEELKQGLAKQGTKLTEQEVKQLMEAADADGNGTIDYDEFITATMHMNRMNKEDHLYTAFQYFDKDNSGYITIEELEQALVEFNMHDGRDMKEIISEVDSDNDGRINYDEFAAMMNKGTLEVGTKKRRDSTMMMSEISRSVQH

SEQ ID NO: 149477 - protein, 626 aa, Glycine max
  Coding DNA Sequence Number=SeqID_32699
  Homolog annotation: Hit_ID=Q1S6Z6; Match level="QueryCoverage=95%, HitCoverage=95%, E-value=1e-161, Identity=50%"; Hit description=Las1- like
  Pfam annotation: Domain name=Las1; Domain location=32-223; Score =171.9; E_value=1.6e-48; Accession=PF04031.4; Description=Las1-like
MEPALLLGLEEEAKVVVTESSSLSSSSSAHRLVPWLNWDEWLFVKHALFSDSPHSVSSALKRISAWRSRGSLPVLIEVTASIIEIQLKDPFFRESFAAHSGPTRFKQDCLQWERIPVDESNDASLSEEMLAMLYCMAIMRLVNGVVEKTRKKEVTSIAVAADAIGIPRMLIDIRHGEQSALLFVLLIAVIAEGSHRELPSLKIVRSASVKALDWLKSYYWEPQSKAIPFHGEGIANVKKEIKSKIRELAICLKVNGSAQSSSSLLKAKQIVSVLLEYLLKALSSSELEENADGASIGLTTQNVLADWKLIILKLCNKEPELLLNLLKEILDMIETQEDMKYKEDNPNMGVSHSRTEFRLSSLFAWLVGILSKDPSATAIMPKRVLHELLRRCLLVSQLCNKQLLDSALQLAELMNDSYLMEKVQKFSLISLSNLESADDESPLLTSKNIFQFEESMLEAAKKLELVKQQIMKNKKLMAMDCDTKKSQTWTLAKSWNPCPIGMLPRAVGSSGCLPVLNIVDGEKQNQVSPCCLPVVDIIDDEKQNRVSEKEENWKLTPHGAKRDATLDLLQLDNSTVKKMRETKEFGELNNELPLQGEKGCLVVGGVWKKLTEEELLVIESSVRILV

SEQ ID NO: 149478 - protein, 273 aa, Glycine max
  Coding DNA Sequence Number=SeqID_32700
  Gene Ontology: Mol. function=sequence-specific DNA binding; Cellular component=nucleus; Biological process=regulation of transcription, DNA-dependent
  Homolog annotation: Hit_ID=Q1ST32; Match level="QueryCoverage=94%, HitCoverage=99%, E-value=1e-100, Identity=72%"; Hit description =HSF/ETS, DNA-binding
  Pfam annotation: Domain name=HSF_DNA-bind; Domain location=23-213; Score=164.1; E_value=3.6e-46; Accession=PF00447.8; Description=HSF -type DNA-binding
MAFTLDRCEDSMVFTMESHKSVPAPFLTKTYQLVDDPHTDHIVSWGDDETTFVVRRPPEFARDLLPNYFKHNNFSSFVRQLNTYGFKKVAADRWEFANEYFRKGAKHLLCEIHRRKTPHHYQQHYHMHDQPPQLLQPDENMCWIDAPPLPSPKPGTDILAALSEDNQRLRRKNFMLLSELTHMKNLYNDIIYFIQNHVSPAASYDEQRSRSAILKMVELDSSPNVIRPTKSRIMEKSLVTNSSDEPNNSSVKLFGVPLCGKKRLHPGNLVQQE

SEQ ID NO: 149479 - protein, 333 aa, Glycine max
  Coding DNA Sequence Number=SeqID_32701
  Pfam annotation: Domain name=DUF1645; Domain location=106-310; Score=- 49.3; E_value=0.032; Accession=PF07816.2; Description=Protein of unknown function (DUF1645)
  Subcellular localization annotation: CTP_CleavageSite=54; ConfidenceScore=5.47e-01
MVDMMDISFSNEFCYMSTACSFSQDMCFYSAPTSPSRLKVRTSFGSQTGPTTPRATTHEDDANSNVNEFEFETSRRFNVSVGDLDTETNQKDESPFGDSLQTMAFADELFCDGKVLPLMPPLKLPPRMHQNGDGSIMSTHSSTLTSPRSPGSVLRVRFSRQCLWNDDFDPFMAALEKVREEKRGKPSARHGLRRTRSLSPFRSFNNKCERNVGISKSSQLESHCCDTAQLVCELKKEPLKHVSGRINVLSEPKGLVFARQVRLVGVSNDTTTLERTSVSKVSKETKKDERKRGGFWRRNTKRENIKKFLFGISNMWKANAHHKLEDKMAAQEK

SEQ ID NO: 149480 - protein, 403 aa, Glycine max
  Coding DNA Sequence Number=SeqID_32702
  Gene Ontology: Mol. function=actin binding; Cellular component =cytoskeleton; Biological process=establishment and/or maintenance of cell polarity (sensu Fungi)
  Homolog annotation: Hit_ID=Q9FKI0; Match level="QueryCoverage=96%, HitCoverage=57%, E-value=1e-175, Identity=79%"; Hit description =Fimbrin-like protein 2
  Pfam annotation: Domain name=CH; Domain location=135-239; Score=51.5; E_value=2.9e-12; Accession=PF00307.21; Description=Calponin homology (CH) domain
  Pfam annotation: Domain name=CH; Domain location=243-350; Score=78.6; E_value=1.9e-20; Accession=PF00307.21; Description=Calponin homology (CH) domain
  Pfam annotation: Domain name=CH; Domain location=9-111; Score=104.8; E_value=2.5e-28; Accession=PF00307.21; Description=Calponin homology (CH) domain
  Pfam module annotation: Pfam domain module=CH::CH::CH; Domain location=135-239::243-350::9-111
DVEELISLAPDKLLLKWMNFHLKKAGYEKQVTNFSSDLKDGEAYAYLLNALAPEVAGPSALNTSDPTERANMVLEQAERLDCKRYLTPKDIVEGSPNLNLAFVAQIFQHRNGLTTVDSQKMSFAEMMTDDAETSREERCFRLWINSLGISTYVNNVFEDVRNGWVLLEVLDKVSAGSVNWKLATKPPIKMPFRKVENCNQVIKIGKELNFSLVNVAAFLWQLMRFTMLQLLRNLRSHSQGKEITDADILNWANNKVKRAGRTSQMDSFKDKNLSSGIFFLELLSAVEPRVVNWSLVTKGETGEDKKLNATYIISVARKLGCSIFLLPEDIIEVNQKMILILAASIMYWSLKKPEENITPEASPKASVDGESETDLVDEVSHLAIDEVSNLAIDETTSENASSS

SEQ ID NO: 149481 - protein, 239 aa, Glycine max
  Coding DNA Sequence Number=SeqID_32703
  Gene Ontology: Mol. function=Rab GTPase activator activity; Cellular component=intracellular; Biological process=regulation of Rab GTPase activity
  Homolog annotation: Hit_ID=Q6Z973; Match level="QueryCoverage=96%, HitCoverage=55%, E-value=1e-107, Identity=81%"; Hit description =GTPase activator protein-like
  Pfam annotation: Domain name=TBC; Domain location=1-170; Score=101.7; E_value=2.2e-27; Accession=PF00566.9; Description=TBC domain
MCTLWDLPRTFPGHPWLDTPEGHAALRRVLVAYSFRDSDVGYCQGLNYVAALLLLVMKTEEDAFWMLAVLLENVLVNDCYTNNLSGCHVEQRVFKDLLSKKCPRIATHLEALEFDVSLVTTEWFLCLFSKSLPSETALRVWDVIFYEGAKVIFNVALAIFKMKENELVLTHHVGEVINILQMTTHHLFDPDDLLTVAFDKIGSMTTNTISKQRKKQEPEVMKELDQRIRRLNSLRMEDK

SEQ ID NO: 149482 - protein, 62 aa, Glycine max
  Coding DNA Sequence Number=SeqID_32704
MPLRSKYVLSRSRLKLAFWIFLRDLNRYCFRGSLKRWRYCCRDNGVVSCGVVVDYGLESPWH

SEQ ID NO: 149483 - protein, 81 aa, Glycine max
  Coding DNA Sequence Number=SeqID_32705
MRLMSLACFSILLLILFLFKISSSSAADGYAKSQSFRTEPVSNLGPFKGKSRQNTGEGGGEAFLGDEKRIIYTGPNPLHNR

SEQ ID NO: 149484 - protein, 433 aa, Glycine max
  Coding DNA Sequence Number=SeqID_32706
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=99%, HitCoverage=100%, E-value=0.0, Identity=77%"; Hit description =Putative hydroxymethylglutaryl-CoA lyase
  Pfam annotation: Domain name=HMGL-like; Domain location=140-411; Score=280.6; E_value=3e-81; Accession=PF00682.9; Description=HMGL -like
MSSLEEPLGLDKLPSMNTIDRIQRFSSGSCRPRVDNLGMGNCWIEGRSCSTSNSCNEDDEEYTAETFPWKRQTRDLSPDDSFSQKTLIKGRKSMKFGMIDDSFSDCQTSPKCHTKDLQGLAYKYLNSIPKFVKIVEVGPRDGLQNEKNIVPTAVKIELIHRLASTGLSVIEATSFVSPKWVPQLADAKDVMQAVHNLRGIRLPVLTPNLKGFEAAIAAGAREVAIFASASESFSKSNINCSIEESLIRFQAVTHAAKQLSIPVRGYVSCVAGCPVEGPIPPSKVAYVAKELYDMGCFEISLGDTIGVGTPGTVVPMLLAVMAVVPIDKIAVHFHDTYGQSLPNILVSLQMGISTVDSSVAGLGGCPYAKGASGNVATEDVVYMLNGLGIKTDVDLGKLILAGEFISNHLGRPSTSKTAIALNRVTSNASKISH

SEQ ID NO: 149485 - protein, 106 aa, Glycine max
  Coding DNA Sequence Number=SeqID_32707
MKCCSRFHLGIKSEALVGGGRWEQTFISMERSWDKVVFNSWILPGSLLMAEATSSRQIASGSAQNEVLKEWQDAWDERDKDFEKQGINQQDSFWSKLKSEAARKVF

SEQ ID NO: 149486 - protein, 108 aa, Glycine max
  Coding DNA Sequence Number=SeqID_32708
  Gene Ontology: Cellular component=nucleus; Biological process =regulation of progression through cell cycle
  Homolog annotation: Hit_ID=Q39880; Match level="QueryCoverage=49%, HitCoverage=12%, E-value=5e-20, Identity=87%"; Hit description =Mitotic cyclin b1-type
MGLKNDWSMVYLRFKNRIKSLSWPPDWNNSNNSPSMVKQKNMGDEGRNRRVFQDIGNLVGLQGHGNGINLSKPVTRNFRAQLLANAQEKNKVVMGSVIVWQLPWTASS

SEQ ID NO: 149487 - protein, 84 aa, Glycine max
  Coding DNA Sequence Number=SeqID_32709
MEAGLLSLDVSFSVTKNTTLHKHNKNCPASECVLEVMNLAMDVPSVGTINEGFKNELLHQYEIEKNKGAKSILRKCANILQDWK

SEQ ID NO: 149488 - protein, 549 aa, Glycine max
  Coding DNA Sequence Number=SeqID_32710
  Gene Ontology: Mol. function=protein binding; Cellular component =nucleus; Biological process=regulation of progression through cell cycle
  Homolog annotation: Hit_ID=Q39880; Match level="QueryCoverage=83%, HitCoverage=98%, E-value=0.0, Identity=82%"; Hit description=Mitotic cyclin b1-type
  Pfam annotation: Domain name=Cyclin_C; Domain location=422-545; Score= 197.4; E_value=3.4e-56; Accession=PF02984.9; Description=Cyclin, C -terminal domain
  Pfam annotation: Domain name=Cyclin_N; Domain location=296-420; Score= 221.3; E_value=2.2e-63; Accession=PF00134.13; Description=Cyclin, N -terminal domain
  Pfam module annotation: Pfam domain module=Cyclin_C::Cyclin_N; Domain location=422-545::296-420
MREKNPTVKIEYRIDRWRPENQRKREREKEKVATNKQSAVATTDVSGGGETRNGGLQGFLSSLFSTLGGVFGSTFQEPHQTVVMAARLEQQQQQQQPINVGEVKQKNMGGEGRNNRRVLQDIGNLVGKQGHGNGINLSKPVTRNFRAQLLANAQEKNKKSSTEANNGAVVATDGDGVGNFVPARKVEAAKKTKEEPEVIVISSDDESEEKPAAKGKKEREKSARKNAKAFSSVLSARSKVVPFFLHFLECGLGLGVEAACGLPRDLLVSIDATDMDNELAAAEYIDDIYKFYKETEMYLILMKQEEGCVHDYMGSQPDINAKMRSILVDWLIEVHRKFELMPETLYLTLNIVDRFLSVKAVPRRELQLVGISSMLIASKYEEIWAPEVNDFECISDNAYVSQQVLMMEKTILRKLEWYLTVPTPYHFLVRYIKASTPSDKEMENMVFFLAELGLMHYPTAILYRPSLIAAAAVFAARCTLGRSPFWTSTLKHYTGYSEEQLRDCAKIMVNLHAAAPGSKLRAVYKKFCNSDLSAVALLSPAKENCLEQA

SEQ ID NO: 149489 - protein, 233 aa, Glycine max
  Coding DNA Sequence Number=SeqID_32711
  Gene Ontology: Mol. function=Rho GDP-dissociation inhibitor activity; Cellular component=cytoplasm; Biological process=negative regulation of cell adhesion
  Homolog annotation: Hit_ID=Q9SFC6; Match level="QueryCoverage=99%, HitCoverage=95%, E-value=7e-92, Identity=71%"; Hit description=Rho GDP-dissociation inhibitor 1
  Pfam annotation: Domain name=Rho_GDI; Domain location=31-232; Score =57.5; E_value=4.5e-14; Accession=PF02115.7; Description=RHO protein GDP dissociation inhibitor
MGFDENKETGEKSGATDHANEEHYKSDGEPLRRHVSDESSIHATEDDHEEDEVGSKLQLGPQCTLKEHLEKDKDDESLRRWKEQLLGSVDVNNVAEILDPEVTITCLTIISPDRDDIVLPIPENGTPKGLWFTLKEGSHYRLKFTFHVSNNIVSGLKYTNTVWKTAVKVDSSKEMLGTFSPQAEPYTHEMPEETTPSGLFARGSYSARSKFLDDDNKCYLEINYTFDIRKEWA

SEQ ID NO: 149490 - protein, 211 aa, Glycine max
  Coding DNA Sequence Number=SeqID_32712
  Homolog annotation: Hit_ID=Q10KN0; Match level="QueryCoverage=66%, HitCoverage=20%, E-value=3e-32, Identity=50%"; Hit description =Expressed protein
MEVIKHRKPRKITQYWIRYTCGAVGLSVCSIWLLRHSRLVGSSDLDNWVQEARNSTYSFFRNHVEEPIFSIRDELFDTFKKRHQGIMDVEEVQLTSNSLHSCVDSLPWLELKLILMLLAFSEQTKGQKFPVNASDQEMMEIVMDRDLGIMGCLCPTSSSLDAWWRSGLVPTPRFKRVLLVLGCLSVGIKAGCRCLEKGYLWGFRLSRAVLS

SEQ ID NO: 149491 - protein, 198 aa, Glycine max
  Coding DNA Sequence Number=SeqID_32713
  Homolog annotation: Hit_ID=Q10KN0; Match level="QueryCoverage=50%, HitCoverage=16%, E-value=1e-18, Identity=44%"; Hit description =Expressed protein
MAVPPSETESVENRTFLSQFYSHYLGNRIHALYPYFSTNFLSTFVLRFRSTQRRECLPLPLPSSSLDAPLFMTKRSRVHDVLEDILERVLINLHSVQKNLQFWQSRAKRSDSEKARFMIFERGPRAFIDETVKLLRGLTAQGSSTQNLSQSASDYIDERVGFLSSLRYSLATFLAQGIPLMGLLRDYEDRFNRIVQSA

SEQ ID NO: 149492 - protein, 62 aa, Glycine max
  Coding DNA Sequence Number=SeqID_32714
MFQLQQLTYEGNFKEEVKHKFESVCKAAWCSHQPNLAKPETCPNTSVSPLGSQADVTQLDML

SEQ ID NO: 149493 - protein, 269 aa, Glycine max
  Coding DNA Sequence Number=SeqID_32715
  Gene Ontology: Mol. function=sequence-specific DNA binding; Cellular component=intracellular
  Homolog annotation: Hit_ID=Q1SNM1; Match level="QueryCoverage=95%, HitCoverage=92%, E-value=1e-52, Identity=46%"; Hit description =Histone-fold/TFIID-TAF/NF-Y
  Pfam annotation: Domain name=CBFD_NFYB_HMF; Domain location=1-61; Score=68.1; E_value=2.8e-17; Accession=PF00808.13; Description =Histone-like transcription factor (CBFNF-Y) and archaeal histone
MARIKKIMQADEDVGKIAMAVPLLVSKALELFLQDLCDRTYDITLRRGAKTMNAFHLKQCVQTFNVFDFLKDIVSKVPDLGGSVATGDDHAVTKRRKVAGDDDNDSDEELKRNKKPEPGHSSGRGRGRGRGRGLGGGIRTVDQEMSSHAKCEDDSDVLKQNDNHTQSNESMENVLEPEEVKQSFPVSELAEVSVRNFDLNLDPDENMDSLDTPTSVPTSSSAKSVSEEKHEEYPGWSLSEMEKMIIDPIQLANLNGRIDEDEEDYDEEM

SEQ ID NO: 149494 - protein, 200 aa, Glycine max
  Coding DNA Sequence Number=SeqID_32716
  Homolog annotation: Hit_ID=UPI000016344C; Match level="QueryCoverage =74%, HitCoverage=24%, E-value=2e-11, Identity=32%"; Hit description =protein binding
MEDCTVWFSLVKSGNLDALKRLIGNNSEVLMTIKDSDGMSLLHKAALCRQRSIVSYIQGFTSREDNLVLGGVDNKGNNVLHLAAAKQQSSSHLLRNAKVEMQNDLAWFKEIEKKFHEFSYNTMVNDKGKTPEEVFYDQHEDLSDKIKDDSKEIANSGMIVAILVATVAFAAALTVPGFSTTACGLDIIVCPNLKNLMFPL

SEQ ID NO: 149495 - protein, 46 aa, Glycine max
  Coding DNA Sequence Number=SeqID_32717
  Subcellular localization annotation: CTP_CleavageSite=11; ConfidenceScore=5.15e-01
MAFALKQEVVSVATASNRKKNGALRRRRTTRYRTKPRPRQISDLKS

SEQ ID NO: 149496 - protein, 177 aa, Glycine max
  Coding DNA Sequence Number=SeqID_32718
  Gene Ontology: Mol. function=nucleotidyltransferase activity; Cellular component=cytosol; Biological process=biosynthetic process
  Homolog annotation: Hit_ID=Q1RVE8; Match level="QueryCoverage=87%, HitCoverage=60%, E-value=3e-36, Identity=59%"; Hit description =Cytidylyltransferase
EIDKGAQIIYFAELIQPIEERINNVKTFIKGQIIDILYICLTATCLFTSSIVYIGEVVWFCLLVLCGGDTNYNSVKPELEVQAVPITDPFGPSITDENLEAVIVSKETLPGGLAINRRRAERGLSQLKILEIILVDLMQIEVVDLVSGESGEIKLSSSMLRKIEAEKAKQQNTISET

SEQ ID NO: 149497 - protein, 650 aa, Glycine max
  Coding DNA Sequence Number=SeqID_32719
  Homolog annotation: Hit_ID=Q9FMQ0; Match level="QueryCoverage=99%, HitCoverage=100%, E-value=1e-104, Identity=38%"; Hit description =Genomic DNA, chromosome 5, P1 clone:MXC9
  Pfam annotation: Domain name=UBA; Domain location=158-197; Score =31.4; E_value=3.1e-06; Accession=PF00627.21; Description=UBATS-N domain
  Pfam annotation: Domain name=UBA; Domain location=217-260; Score=0.2; E_value=4.1; Accession=PF00627.21; Description=UBATS-N domain
  Pfam module annotation: Pfam domain module=UBA::UBA; Domain location =158-197::217-260
  Subcellular localization annotation: CTP_CleavageSite=36; ConfidenceScore=5.50e-01
MSPASRSKSKDRKANKDAQKASAKPTGSSNAVAGVPASAYNPLLGTFHTLDMSPAPTSPIHSNGRFRNIDETDEHPVNSLVAGVEYDSVSNNGSWSGESEEHKDKSSNVPVRPESVPGADNDKREKIRQKNERKHQRQKERRAQELHERCTGYLMSRKLEVLSQQLVAMGFSHERATMALILNEGRVEESVAWLFEGGEDADGNKDTNIGRGNLKIDISDELARIADMVTRYDCSKQEVERVIVSYEGDLDRAAETLRELKLDPPSAPPKPEETGDPPIINNVKQSGVASQSSRPQTKPIPLPNQPKKDDKDFNYTKAALTIGVSSDSSNKNMQPLKRIQSEWTKPQQATVPADKRWPSAGSNPSVSYSLASPLQMSPPPAKSETQYMPAGGDFKNLQSGVAREQLIMMQRPQTVNAKQVPATSMSSSPPGIAASWYPTNSSDAVRSNNGFISHAPSTRSLSPNYLNSNQMYHQLQYQPQQYQFVGGSSSNSVDHQGNSIWNRTGATPPLAAATSLGLFSGLGSAGPSGASSPVDWSTGGTMQFDYTNIDWSLDRSLASPRSNGLWLGFSPFLRSNSAPMYDANTSGVVAQSSMRPVPSNGSMNAPMPGLQDGGVASAETSTAGSREWSSPFEGKDLFSLPRQFVSSPSL

SEQ ID NO: 149498 - protein, 259 aa, Glycine max
  Coding DNA Sequence Number=SeqID_32720
  Gene Ontology: Mol. function=nucleic acid binding; Cellular component= nuclear pore; Biological process=DNA integration
  Homolog annotation: Hit_ID=Q1T4S3; Match level="QueryCoverage=88%, HitCoverage=14%, E-value=8e-68, Identity=55%"; Hit description=Zinc finger, CCHC-type
MEEAMADQTGDKIQIILGIRTIDHNVKFVDPTHYRSIVRALQYIIITRPEISFSINKVCQFMHRPQEHHWSAVKRILRYLQGSITYGLHIKPSQQLLIMGFCDLDWGSDPDDRKSTICYCVYLVPNLVSWSSRKQVVVSRSSTGAEYRGLAAVAADILWLQNLLRELCVPVALPRIYCDNLGVVHLAANPIMHSRTKHFELDLHFVRDKVLSRELVVVHLPAEFQVVDILTKVYSNPQFTIFRSKLKVSSTSTMSLKGV

SEQ ID NO: 149499 - protein, 334 aa, Glycine max
  Coding DNA Sequence Number=SeqID_32721
  Homolog annotation: Hit_ID=Q9LIC9; Match level="QueryCoverage=46%, HitCoverage=21%, E-value=6e-08, Identity=28%"; Hit description =Similarity to Serine/Threonine protein kinase
MEGQSVVVIHDASREINVKIFEWSLHGLLLVPGDMLTLIAVMHQVITPMGYKSSVDSRLMFGANQKMIEAQAARKKEEYLNNPELAQISELYKSEKVGFKIETITGSSLKTVALKSAMKLKANWLILDRKMKNDEEYFLRKLSCGILRVRRFNKILRLREPLHLPQETQPGSTHETYTDSIPLPDTSTEHDLYVFSAETSPNTSKKMIGQGGDNQMNQEQGHTLKSLHDEEGFLTPDQLNMEEKDNSIKHMESQTQRSQHWQDEQKENRNNGNERDPKPKQKLEEKNCDITCSGSKRETEQKIFCTKVYQKGGERCSSFGGARNFYLGGAEEYT

SEQ ID NO: 149500 - protein, 102 aa, Glycine max
  Coding DNA Sequence Number=SeqID_32722
  Gene Ontology: Mol. function=translation elongation factor activity; Cellular component=eukaryotic translation elongation factor 1 complex; Biological process=translational elongation
  Homolog annotation: Hit_ID=Q84WM9; Match level="QueryCoverage=77%, HitCoverage=35%, E-value=3e-28, Identity=72%"; Hit description =Elongation factor 1-beta 1
MAVTFSDLHTEEGIKSLDQFLSGKTYISGDQLTKDDIKVYAAVVEKPGDTFPNAAKWYDAVSSQLAPSFPGHAQGVRFSGAAAPAEAAPAKAETNSKSLILS

SEQ ID NO: 149501 - protein, 258 aa, Glycine max
  Coding DNA Sequence Number=SeqID_32723
  Gene Ontology: Mol. function=nickel ion binding; Biological process =nitrogen compound metabolic process
  Homolog annotation: Hit_ID=Q8H1P4; Match level="QueryCoverage=88%, HitCoverage=95%, E-value=1e-109, Identity=88%"; Hit description =Urease accessory protein UreF
  Pfam annotation: Domain name=UreF; Domain location=47-185; Score= -58.6; E_value=0.086; Accession=PF01730.7; Description=UreF
MQVNEEHNKPCSDPFLQWSQWQLLDSLLPTGGFAHSFGLEAAVQCHLVSDSNDLKTFVIHILENTGSLLLPFVYSASMLPNLETWHKLDKILDATLTNEVGRKASISQGSALMRVASAVFSEVPSLKTMRDTSLGLGTVSFHHAPVFGLICGALGFDKTSSQRAYMFITMRDVISAATRLNLIGPLGAALLQHQVAPNAEVILEKWMNRAVDEACQTMPLLDTVQGCHETDSETSIVFEGTGTHGNDLLKFYCAVIPI

SEQ ID NO: 149502 - protein, 638 aa, Glycine max
  Coding DNA Sequence Number=SeqID_32724
  Gene Ontology: Mol. function=binding; Cellular component =mitochondrion; Biological process=translation
  Homolog annotation: Hit_ID=Q6Z2L7; Match level="QueryCoverage=99%, HitCoverage=73%, E-value=1e-105, Identity=35%"; Hit description =Putative pentatricopeptide (PPR) repeat-containing protein
  Pfam annotation: Domain name=PPR; Domain location=115-148; Score =14.0; E_value=0.16; Accession=PF01535.11; Description=PPR repeat
  Pfam annotation: Domain name=PPR; Domain location=162-196; Score =17.8; E_value=0.04; Accession=PF01535.11; Description=PPR repeat
  Pfam annotation: Domain name=PPR; Domain location=197-231; Score=0.2; E_value=7.1; Accession=PF01535.11; Description=PPR repeat
  Pfam annotation: Domain name=PPR; Domain location=232-266; Score =20.6; E_value=0.0057; Accession=PF01535.11; Description=PPR repeat
  Pfam annotation: Domain name=PPR; Domain location=299-333; Score =23.8; E_value=0.00061; Accession=PF01535.11; Description=PPR repeat
  Pfam annotation: Domain name=PPR; Domain location=368-402; Score =27.4; E_value=5.2e-05; Accession=PF01535.11; Description=PPR repeat
  Pfam annotation: Domain name=PPR; Domain location=403-436; Score=8.7; E_value=0.69; Accession=PF01535.11; Description=PPR repeat
  Pfam annotation: Domain name=PPR; Domain location=437-471; Score =25.2; E_value=0.00023; Accession=PF01535.11; Description=PPR repeat
  Pfam annotation: Domain name=PPR; Domain location=472-506; Score=2.2; E_value=4.1; Accession=PF01535.11; Description=PPR repeat
  Pfam annotation: Domain name=PPR; Domain location=576-609; Score =19.2; E_value=0.015; Accession=PF01535.11; Description=PPR repeat
  Pfam module annotation: Pfam domain module=PPR::PPR::PPR::PPR::PPR::PP R::PPR::PPR::PPR::PPR; Domain location=115-148::162-196::197-231::232- 266::299-333::368-402::403-436::437-471::472-506::576-609
MRFVGLDLDSFAYHVLLDALVEKNYLNAFDIIVRQIRSRGYENHMTNVIVVKHLCKERRLEEAEGFLNGLMCRGEELKGPEVSFLVGALCESYRFERAFELVKQFGSSGLVPLDHAYGVWIKGLVRGGRVDEALELLRENRLREVYDLLVDMSESCIPPDAVTMNAVLCFFCKVGMADVALELYNSRSDLELSPNHLACKYLILTLCWDGGAKEAFNVLRSTVDRSYFPDGQTFCTLASALCRERKIDEMKELLYLAVGRNIVPPTSMYDKYISALCRAGRVEDGYLVHGELKSVAAKTSYVKMIKGFVKSGRGDTAARLLVEMNGKGHTPIPRLCRYVICSLLEMDNSRGRFFNLLEMLTRCQHSCQTYNFFLDGAGHAMKPELAREVFELMQRNGITPNMCSLILMMNGYLISGRISDALNFFNDVQRRGLATKKLYVALITGLCKSNKVDISREYFFRMLRVGLNPSLECYELLVQKLCSLQRYSEAMHIINVSQKMGRPVSSFIGNVLLYHSLISPQLYDTCVNLRGVEEGVFSGNSTLCLMIGAFSGRLRVSHYITDLERLIEKCFPPNIFTYNLLLKQVARSDMDKARLLFARMCQRGYQPNSWTYDIMVRGFSIHGRNDEARRWLKEMFRN

SEQ ID NO: 149503 - protein, 138 aa, Glycine max
  Coding DNA Sequence Number=SeqID_32725
  Homolog annotation: Hit_ID=Q9LUN0; Match level="QueryCoverage=71%, HitCoverage=73%, E-value=1e-33, Identity=62%"; Hit description =Arabidopsis thaliana genomic DNA, chromosome 3, P1 clone: MKP6
  Pfam annotation: Domain name=DnaJ_CXXCXGXG; Domain location=49-123; Score=-31.1; E_value=0.011; Accession=PF00684.9; Description=DnaJ central domain (4 repeats)
  Subcellular localization annotation: CTP_CleavageSite=63; ConfidenceScore=5.47e-01
MGFGTLSLSVVVRFEATNFNGLPPSRSSNSLPHLSFTKPSWVVRTESNVRKKRRKKPDPHCVVCEGSGRVDCHQCHGKGRTNQVHLEMLPKGEWPKWCRTCGGSGLSYCSRCLGTGEYRDDGIWFKVLENVLVQQLYL

SEQ ID NO: 149504 - protein, 117 aa, Glycine max
  Coding DNA Sequence Number=SeqID_32726
VAKVNQRKLKMWRVLAAVTRNLQSTRKSSKVADESMFESGNGVELFGHERGRRSQHGWGLVCSILQAPISILSCVSHPQVNNNGSDGIWVTTGEFSSQVSEMNHLMVSDSMRYAILM

SEQ ID NO: 149505 - protein, 189 aa, Glycine max
  Coding DNA Sequence Number=SeqID_32727
  Homolog annotation: Hit_ID=Q6Z2L7; Match level="QueryCoverage=37%, HitCoverage=8%, E-value=7e-07, Identity=39%"; Hit description =Putative pentatricopeptide (PPR) repeat-containing protein
MEGVLGLSGNGVADDQDVVEADAVVEDAPAEGVEEVEDEGLEVGAGEDLENGNEGGAGVVEVGLVAGPVEELEAGEDGGESGGEVLFAGGGGKDLVDAVQEGVEGELLELEAEEEDVDWEGDDDAREVYAAWSEEHGLRTVEMKDLDLRRCLVTCLSGSIMDWNGPMELECSSRSLRVPLHSKCLCLCP

SEQ ID NO: 149506 - protein, 131 aa, Glycine max
  Coding DNA Sequence Number=SeqID_32728
  Homolog annotation: Hit_ID=Q9C9V9; Match level="QueryCoverage=41%, HitCoverage=6%, E-value=7e-09, Identity=56%"; Hit description =Putative golgi transport complex protein; 67058-70172
MEWMKIPLTSPNPHLSILPIRAVLGWTDKRQKMSSVCHLCSELSNFNEYDLADIDAINEELSWVKETGDLLHNEAMKVLKCGMEGLNQAKIGIELKVSRLFPHPMQLHFLPLHPFDSDAKVGAIPAARERL

SEQ ID NO: 149507 - protein, 219 aa, Glycine max
  Coding DNA Sequence Number=SeqID_32729
  Gene Ontology: Mol. function=RNA-directed DNA polymerase activity; Biological process=RNA-dependent DNA replication
  Homolog annotation: Hit_ID=Q1T5Q8; Match level="QueryCoverage=65%, HitCoverage=20%, E-value=2e-27, Identity=45%"; Hit description=RNA -directed DNA polymerase
VATIEKELNRLESEGEDRQLSGQELLVRKKLQEELWAAAQAQESLMRQKAKARWIKEGDSNSKFFHRVVNSNRKSNTLRGVLVNGVWRRKHGCLKSASISVLINGSPSSEFTPQRGIRQGDPLALLLFNVVAEGLNGLMREVLKKNLFQGFLVGRKEVEVNIPQYADDTLFFGKASMENVEAIKVILRSFKLASGLRINFSKNCFGKIGMSESWKEDAA

SEQ ID NO: 149508 - protein, 53 aa, Glycine max
  Coding DNA Sequence Number=SeqID_32730
MEMIQKSTSSDNSQGWFHVTSLASRDIILLDNNIVAVPCVHGATNISNYECNR

SEQ ID NO: 149509 - protein, 62 aa, Glycine max
  Coding DNA Sequence Number=SeqID_32731
MTKANVSLKRIIKWDEVTLPEKWVMEKATPSDPRPAPIIEKIKQDNSGKKGYRLPMDARHHR

SEQ ID NO: 149510 - protein, 391 aa, Glycine max
  Coding DNA Sequence Number=SeqID_32732
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=99%, HitCoverage=98%, E-value=1e-161, Identity=69%"; Hit description =Polygalacturonase precursor
  Pfam annotation: Domain name=Glyco_hydro_28; Domain location=52-391; Score=446.3; E_value=3.9e-131; Accession=PF00295.8; Description =Glycosyl hydrolases family 28
MDMKLNIPPIVLYLVLTISGTAQSVGIDIKKFGGIPDADITQAFTDAWKVACASTSASKILIPNGTYKMKAVDVKGPCMAPIEIQIDGTIQAPADPNALDGAKQWVKIGYANFITLSGKGIFDGQGAIAWKQNDCRTNTNCKIPSMNFGFNFVNHSMVRGITSKDSKSFHVILFGCYNFTFDGFHISAPETSINTDGIHIGKSTDVKILNTNIATGDDCVSLGDGSIHVTVQNVNCGPGHGISVGSLGKYTNEEPVKDLLVKNCTLTNTENGVRIKTWPNSSQTYLVTDMHFEDITMVDVLNPVIIDQEYCPWNHCPKQSPSKIKIRKVSFSDIKGTSKSKEGVIFICSKAVPCEDVELNNVALTFKGDPIVAKCANVRPKFAGKAPPCTA

SEQ ID NO: 149511 - protein, 179 aa, Glycine max
  Coding DNA Sequence Number=SeqID_32733
  Gene Ontology: Mol. function=protein binding; Cellular component=cell division site; Biological process=embryonic development via the syncytial blastoderm
  Homolog annotation: Hit_ID=Q2A9P5; Match level="QueryCoverage=98%, HitCoverage=50%, E-value=2e-43, Identity=50%"; Hit description=Mo25 family protein
  Pfam annotation: Domain name=Mo25; Domain location=2-179; Score= -126.4; E_value=0.0012; Accession=PF08569.1; Description=Mo25 protein family
MKKALFKPKPKTPVELVRHARELIIFLDSNACTRESKREEKLSDLSKMILEIRTVLYGNGESEPNADACSQITREFFKDDTFRLFILYLSNLKLGARQDATHVIANLQRQRVNSQLIASQYLEKNLDLVDMLIGGSSVLDKWLMKVYLISYEKEGDIALTYGAVARECIRHQSVARYAI

SEQ ID NO: 149512 - protein, 536 aa, Glycine max
  Coding DNA Sequence Number=SeqID_32734
  Gene Ontology: Mol. function=nucleic acid binding; Cellular component= ribonucleoprotein complex
  Homolog annotation: Hit_ID=Q2R0P4; Match level="QueryCoverage=61%, HitCoverage=71%, E-value=1e-129, Identity=68%"; Hit description=RNA -binding protein, putative, expressed
  Pfam annotation: Domain name=RRM_1; Domain location=149-219; Score =81.3; E_value=3e-21; Accession=PF00076.12; Description=RNA recognition motif. (a.k.a. RRM, R
  Pfam annotation: Domain name=RRM_1; Domain location=49-118; Score =72.3; E_value=1.6e-18; Accession=PF00076.12; Description=RNA recognition motif. (a.k.a. RRM, R
  Pfam module annotation: Pfam domain module=RRM_1::RRM_1; Domain location=149-219::49-118
MCKELDWIRQEHAFFLYPMVRCLRRLALSISIDAAATCIYKMQSDNGKLFIGGISWDTNEERLREYFCTYGEVVEAVIMKDRTTGRARGFGFVVFSDPAVAEIVIKEKHNIDGRMVEAKKAVPRDDQNILSRNSGSIHGSPGPGRTRKIFVGGLASTVTESDFKKYFDQFGTITDVVVMYDHNTQRPRGFGFITYDSEEAVDKVLLKTFHELNGKMVEVKRAVPKELSPGPSRTPLGGYNYGLTRVNSFLNGFTQGYTPSTVGGYGLRADGRFSPVAGGRSGFAPFGSGYGMSMNFEPGLNAGFGGNANFNSNLSYDRGVNPYFIGSSNRFGSPVGYESGNGGNNSFFSSVTRNLWGNGGLSSANSNAYIGSGSGSVGGNTFGNTGVNWGSSAISGQQGGGNNMSQSSGNLGYGGGDNSYGLGTGGYGRSTGAAFAPTSSYSASNGGVDGAFADFYNNSSVYGDPTWRSSNSERDGSGPFGYGFGGVASDVSAKSSPGYVGGYTVNKRQPNRGKSYNNLDECPFLDARHFEEMLSD

SEQ ID NO: 149513 - protein, 670 aa, Glycine max
  Coding DNA Sequence Number=SeqID_32735
  Gene Ontology: Mol. function=signal transducer activity; Cellular component=membrane; Biological process=response to light stimulus
  Homolog annotation: Hit_ID=Q9LUB9; Match level="QueryCoverage=99%, HitCoverage=99%, E-value=0.0, Identity=52%"; Hit description =Similarity to bZIP transcription factor
  Pfam annotation: Domain name=BTB; Domain location=30-133; Score=6.4; E_value=0.0011; Accession=PF00651.21; Description=BTBPOZ domain
  Pfam annotation: Domain name=NPH3; Domain location=216-467; Score =107.9; E_value=3e-29; Accession=PF03000.5; Description=NPH3 family
  Pfam module annotation: Pfam domain module=BTB::NPH3; Domain location= 30-133::216-467
  Subcellular localization annotation: CTP_CleavageSite=58; ConfidenceScore=5.18e-01
MEVVSPKDYSVASSPFSSPNIGALLKIKVITWSQQTGLPVSVSVRVKDKTFKLHKQFPLTSKSGYFKKRLNDTSEVELPETFPGGPETFEMIAMFVYGSSTLIDPFNVVPLRCAAEFLEMTEDHCSGNLCERFDLYLNQVVLQSWDDTLIALQRCQMLLPWSEDLLIVSRCIESLAFMACMEVLDPERRRDTPVVKVEELASKDWSCEIVKDVVSLDLWMRDLIALPFDFFKRVIGSLRKQGMKEKYVSPIIAFYANKWVLSKKTRQFLESSCDKVGEGGMNSKASVILQGVVDLLPVGDKARKVIPVGFYFALLSRSLELGLRIESKAKLQDQITSLLHFSQVEDFLLPESGAESMSSSMEFVTMESIISAYVASSSRVSHTPEASRYRVAELWDAYLFNVAADPDMGPKRFMELIERVPPSYRQNHYPLYKTINSFVKTHSGISQDDKGAVCKYLDCQRLSQEACIEAVQDELMPLRLIVQALFVQQLNTHKAFKECSDSFRYAHCGDMSGSLSSSRCPYSASQNLGESPYTDGPDLSSRPLSFLLQKDNVMQNFKFSTTDYESTSFRIQNLEQELVSLKRSLQLHNIVTKAEPNLIKSQKMKPCGLETRSQSKRRNPIGQATSCISSVNFASQRRNASRLLQVFRRITLFGSRKLKRKPGTPSQLSK

SEQ ID NO: 149514 - protein, 297 aa, Glycine max
  Coding DNA Sequence Number=SeqID_32736
  Gene Ontology: Mol. function=protein kinase activity; Cellular component=cytoplasm; Biological process=protein amino acid phosphorylation
  Homolog annotation: Hit_ID=Q1SS77; Match level="QueryCoverage=97%, HitCoverage=95%, E-value=1e-134, Identity=76%"; Hit description =Protein kinase
  Pfam annotation: Domain name=Pkinase; Domain location=26-284; Score =171.2; E_value=2.5e-48; Accession=PF00069.15; Description=Protein kinase domain
  Pfam annotation: Domain name=Pkinase_Tyr; Domain location=27-282; Score=34.0; E_value=1.5e-14; Accession=PF07714.7; Description =Protein tyrosine kinase
  Pfam module annotation: Pfam domain module=Pkinase::Pkinase_Tyr; Domain location=26-284::27-282
MPAEKSNSFDNEVEAFVEVDPTGRFGRYSDLLGCGAVKKVYRAFDQEEGIEVAWNQVRLRNFSEDPVLINRLHSEVDLLRTLSNKYIIVCYSVWKDEERHNINFITEVCTSGNLRDYRKKHRHVSIKAFKKWSKQVLEGLEYLHTHDPCIIHRDLNCSNIFVNGNIGQVKIGDLGLAAIVGRNHAAHSILGTPEYMAPELYEEDYTEMVDIYSFGMCLLEMVTTEIPYSECDSVAKIYKKVTMGIKPEALSKVTDPEVKEFIEKCIAQPRARPSATDLLKDPFFYELNNDEESTPIN

SEQ ID NO: 149515 - protein, 521 aa, Glycine max
  Coding DNA Sequence Number=SeqID_32737
  Gene Ontology: Mol. function=molecular_function; Cellular component =nucleus; Biological process=nervous system development
  Homolog annotation: Hit_ID=Q656K0; Match level="QueryCoverage=87%, HitCoverage=88%, E-value=1e-149, Identity=60%"; Hit description =Putative ES2 protein
  Subcellular localization annotation: CTP_CleavageSite=23; ConfidenceScore=5.16e-01
MLQSPGHSPLHISSPSPSISQVSAQNPNDPPSSSCAKHPAVLDEDTYVEALEKIIERDYFPDISKLRDRLDWLEAIKTGDPVVIREAQLKILERRAGTTKVTNPNDASRTTSHTPGSTFVRNFTPFDEFDGKPSQTPRAPVPEAKEGENNDGGVDTSLGLDQFMRRYTSEDNHSFSKILEKVNKKRKERFGFLNEDVQGIEDVKRDRITDGYGTSYQPPSTLEGWNYTAKNLLMYHPADRGEVPLTEEERANRIKAATKEINRGNTRFHGKMMDSRPKDDGTVEVLYTPVAGATPGPMSLREGDKLKKYDLEDLRKTPNPFYLESGKKAENGYSFVKTPSPAPGVDESPFITWGEIEGTPLRLDLEDIQLDIGGSADGPHYRIPSAPTRDSKAHSLSREAARKIRERSKMFHKPPLASPVRGGSASPSMRTLSPAAQKFVRNAFAKSSSSVDETLRASYRGSTPALATPTSVSRSVSRFARDGSLASRDKKATEAIDCERGPRRVPIDQVSNLFVVVVAEN

SEQ ID NO: 149516 - protein, 66 aa, Glycine max
  Coding DNA Sequence Number=SeqID_32738
MEFWMFFALRQDFRPSIDFLKLTWTKLDNYCMTGCYLFVMSEFYGLLGDEFYDSISTPISTGSLHV

SEQ ID NO: 149517 - protein, 66 aa, Glycine max
  Coding DNA Sequence Number=SeqID_32739
MTNANCPQESLHSVSNGNLRFDTAQTLVSRFFQDEGESPVESDETKVQTWSSQHYRNEPVVVVAAP

SEQ ID NO: 149518 - protein, 72 aa, Glycine max
  Coding DNA Sequence Number=SeqID_32740
MPQLGLLAFKGNRNKVVDILVGHVQCIGWCIVGSQIRLNNGAGGCNCGRIVLHHGGHLVMQSSLGKDQLPEP

SEQ ID NO: 149519 - protein, 106 aa, Glycine max
  Coding DNA Sequence Number=SeqID_32741
MSNRALGFQALVTSLCRSYRVPVPPPARSCHHDIGIMPARHPVDPKKGPGVSSSDYGPLSVLRSARRPNKVIRPPLPIELSSRSTAPPGRCRAKHQSSIGMAGSGQ

SEQ ID NO: 149520 - protein, 109 aa, Glycine max
  Coding DNA Sequence Number=SeqID_32742
  Subcellular localization annotation: CTP_CleavageSite=27; ConfidenceScore=5.04e-01
MLLSSNVIYICVRVVMLVRMIGTRLFAAARVKSCPGMHSSSVIASLSGCARTAGPPPISAGQRTLNSLKVWMWSTLKMRTRSPLKVRACSPLKARMCSPLEVRACSPLK

SEQ ID NO: 149521 - protein, 49 aa, Glycine max
  Coding DNA Sequence Number=SeqID_32743
MTLFCTRLPIESKIKRGVGYRQSRTTLNGNLKGRDTKNGSSFAGSSLPC

SEQ ID NO: 149522 - protein, 202 aa, Glycine max
  Coding DNA Sequence Number=SeqID_32744
MMKQELKKSLKVELSHIASHLSAPIEALEIQALLARVSTKGSCTGPEGSELLKELLNGDDDLMGLFVVVGQNTMLAGLGKVFENSSTIHNVRYENDVVKVQVVRTYMPHAEVPIPTSEVHYLEQAVGTFVAWPTHLVREVTNEVVVGPDKPPSKSVGEPNRLTYVATDDPLGELVKKSYVVYTKPMELAWDGAKFGLPNATN

SEQ ID NO: 149523 - protein, 260 aa, Glycine max
  Coding DNA Sequence Number=SeqID_32745
  Gene Ontology: Mol. function=endonuclease activity; Cellular component=intracellular; Biological process=DNA repair
  Homolog annotation: Hit_ID=Q7VSN5; Match level="QueryCoverage=75%, HitCoverage=75%, E-value=1e-100, Identity=85%"; Hit description =Putative endonuclease
MPSSRQERHGRFIGECTRQRGQSPIFAGRISCDVSLIILCARSCARRWNGRPTAWLLQRGVVVDRQRRVVGKAFVFIDRDAAGAGGDAGRGDLVIDTPPDVLGPGLAAVAPPGVLVRPLVDGAEHVDEAALVEHVGQPGAFLGQETGILQVALPVLQVDFLVGDVPVAADDEFAAGLLVLVHQFVDPRTEAVQEAVLGLLAFVAAGARGQVGADDRQVLPVGADDAALGIEFFAAQADADALGRITQIDADAAVSILTAW

SEQ ID NO: 149524 - protein, 122 aa, Glycine max
  Coding DNA Sequence Number=SeqID_32746
  Subcellular localization annotation: CTP_CleavageSite=77; ConfidenceScore=5.14e-01
MSSVIACFQKLTMTLIYISKNFNVFMLSRVLLLRLSLVVGWMLTWASKLLQDEVISSPGRATFSPNASFCYKEEERRENKAKCFRIAFVIDSYTVHHSFFGRSLLFFIVLHSSSGLCLLLRI

SEQ ID NO: 149525 - protein, 215 aa, Glycine max
  Coding DNA Sequence Number=SeqID_32747
  Gene Ontology: Mol. function=sequence-specific DNA binding; Cellular component=intracellular; Biological process=regulation of transcription, DNA-dependent
  Homolog annotation: Hit_ID=Q6DB01; Match level="QueryCoverage=50%, HitCoverage=27%, E-value=8e-49, Identity=85%"; Hit description =Xylose operon regulatory protein
RLSGINVARTKLAVFAINGVMVAIAGLILSSRLGAGSPSAGNIAELDAIAACVIGGTSLAGGVGSVAGAVMGAFIMASLDNGMSMMDVPTFWQYIVKGAILLLARATMHEKRYRITLLFNANKVYDRQVVEGVGEYLQASQTDWDIFIEEDFRCRIDNIREWLGDGVIADYDDSSIESLLSNVPVPIVGVGGSYHRQQDYPPVHYIATDNAALVE

SEQ ID NO: 149526 - protein, 208 aa, Glycine max
  Coding DNA Sequence Number=SeqID_32748
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=94%, HitCoverage=20%, E-value=7e-63, Identity=62%"; Hit description =Protein kinase
  Pfam annotation: Domain name=Pkinase; Domain location=1-208; Score= -0.9; E_value=1.7e-08; Accession=PF00069.15; Description=Protein kinase domain
  Pfam annotation: Domain name=Pkinase_Tyr; Domain location=1-208; Score=-85.0; E_value=2.9e-07; Accession=PF07714.7; Description =Protein tyrosine kinase
  Pfam module annotation: Pfam domain module=Pkinase::Pkinase_Tyr; Domain location=1-208::1-208
MIEQNIIGSHGYGIVYRIDVGSGYVAVKKVWNNRKLEKKLEKSFRAEVRKLSNIRHTNILRLMCCISNEDSMLLVYEYLENHNLDRWLHKKVKSGSVSKVVLDWPWLKIAIAFVQGLSYMHHDCSPHMVHRDIKTSNIILDTQFNAKVGGFGLAKMLIKPGELNTMSVVIGSFGYIAPEKSVYFNIDVPCYLLEVGTGPYLFSYVHAF

SEQ ID NO: 149527 - protein, 99 aa, Glycine max
  Coding DNA Sequence Number=SeqID_32749
CPSPPARSCNRDIGHPVDPKKSNRVLGFPALITGLCHFYGVPVTLGKVIRFPTNRAFIKKYCAPGRRKAKHHNSLGIASNRQQMHRRHLQSPSAHPQKG

SEQ ID NO: 149528 - protein, 54 aa, Glycine max
  Coding DNA Sequence Number=SeqID_32750
MESVGWWGRGNWTTSKKIRACLVEGKEWEGANRMMHQLFLISILTWDVVSIFYH

SEQ ID NO: 149529 - protein, 81 aa, Glycine max
  Coding DNA Sequence Number=SeqID_32751
  Gene Ontology: Mol. function=catalytic activity; Biological process =cellular metabolic process
  Homolog annotation: Hit_ID=Q9SDZ2; Match level="QueryCoverage=85%, HitCoverage=26%, E-value=1e-14, Identity=50%"; Hit description=2' -hydroxy isoflavone/dihydroflavonol reductase homolog
MAKTKPLMHIFLLEHPNPKGRYNFSECMFSSHSSSKQIEGIRLLDLSSKKLIDAGFMYKYELNEMLHGSIKCCKEKGFPVR

SEQ ID NO: 149530 - protein, 755 aa, Glycine max
  Coding DNA Sequence Number=SeqID_32752
  Gene Ontology: Mol. function=identical protein binding; Cellular component=cytoplasm; Biological process=negative regulation of enzyme activity
  Homolog annotation: Hit_ID=Q1SED0; Match level="QueryCoverage=99%, HitCoverage=99%, E-value=0.0, Identity=83%"; Hit description =Orn/DAP/Arg decarboxylase 2; Protease-associated PA; Proteinase inhibitor I9, subtilisin propeptide
  Pfam annotation: Domain name=PA; Domain location=360-460; Score =105.6; E_value=1.4e-28; Accession=PF02225.12; Description=PA domain
  Pfam annotation: Domain name=Peptidase_S8; Domain location=116-601; Score=60.8; E_value=4.6e-15; Accession=PF00082.12; Description =Subtilase family
  Pfam annotation: Domain name=Subtilisin_N; Domain location=29-105; Score=71.1; E_value=3.6e-18; Accession=PF05922.7; Description =Subtilisin N-terminal Region
  Pfam module annotation: Pfam domain module=PA::Peptidase _S8::Subtilisin_N; Domain location=360-460::116-601::29-105
MSSFRKPFVAILWVVLFLGLHEAAEPEKSTYIVHVAKSEMPESFEHHALWYESSLKTVSDSAEIMYTYDNAIHGYATRLTAEEARLLETQAGILAVLPETRYELHTTRTPMFLGLDKSADMFPESSSGSDVIIGVLDTGVWPESKSFDDTGLGPVPSTWKGACETGTNFTASNCNRKLIGARFFSKGVEAILGPINETEESRSARDDDGHGTHTASTAAGSVVSDASLFGYASGTARGMATRARVAAYKVCWKGGCFSSDILAAIERAILDNVNVLSLSLGGGMSDYYRDSVAIGAFSAMENGILVSCSAGNAGPSPYSLSNVAPWITTVGAGTLDRDFPAYVALGNGLNFSGVSLYRGNAVPDSPLPFVYAGNVSNGAMNGNLCITGTLSPEKVAGKIVLCDRGLTARVQKGSVVKSAGALGMVLSNTAANGEELVADAHLLPATAVGQKAGDAIKKYLFSDAKPTVKILFEGTKLGIQPSPVVAAFSSRGPNSITPQILKPDLIAPGVNILAGWSKAVGPTGLPVDNRRVDFNIISGTSMSCPHVSGLAALIKSAHPDWSPAAVRSALMTTAYTVYKTGEKLQDSATGKPSTPFDHGSGHVDPVAALNPGLVYDLTVDDYLGFLCALNYSASEINTLAKRKFQCDAGKQYSVTDLNYPSFAVLFESGGVVKHTRTLTNVGPAGTYKASVTSDMASVKISVEPQVLSFKENEKKSFTVTFSSSGSPQQRVNAFGRVEWSDGKHVVGTPISINWG

SEQ ID NO: 149531 - protein, 189 aa, Glycine max
  Coding DNA Sequence Number=SeqID_32753
  Pfam annotation: Domain name=DUF1723; Domain location=36-79; Score =8.0; E_value=0.057; Accession=PF08330.1; Description=Protein of unknown function (DUF1723)
MTAPSQLNTSTDQDASANSERSIPILILIVTMTTSNKGLDLITMLSLHALELPCCPITLTLMDIAAITGLKPLAQALHFEEDICLSEFLLASIYKDTIKKSKELTFFQESKKATKTKSDDRVKFPPRSPKFQQPLKSTSSQPSKSKVSKGLDDYDEDMPTNSSFKLTSFAKTKRKDDKIMDLSSSQDPS

SEQ ID NO: 149532 - protein, 61 aa, Glycine max
  Coding DNA Sequence Number=SeqID_32754
MGAKLRWWWSPSLDKKWEAAQTRRQRRSGHRRMLGQRDYHADQIVEVEGCSFFRIFVDLRC

SEQ ID NO: 149533 - protein, 357 aa, Glycine max
  Coding DNA Sequence Number=SeqID_32755
  Gene Ontology: Mol. function=peptide deformylase activity; Cellular component=integral to membrane; Biological process=translation
  Homolog annotation: Hit_ID=Q6DAY2; Match level="QueryCoverage=81%, HitCoverage=66%, E-value=1e-104, Identity=67%"; Hit description =Putative membrane protein
  Pfam annotation: Domain name=UPF0118; Domain location=7-291; Score =86.6; E_value=7.4e-23; Accession=PF01594.7; Description=Domain of unknown function DUF20
MGDRNGLASFVTLLIICLIVFTPLAIITSSLVVEINTVYTKLQTNSAQFPTVFASLLQHLPEWAQTWLADHDLNNAAQIQQKLSGFALKGGQYMAGSVFLIGKGTFTFTVGFGVMLYLLFFLLKDGAWLVGLILEALPLSTYVKHHLLMKFAAVSRATVKGTVVVAVVQGVLGGFAFWITDIDGSLLWGALMAFLSLIPAVGSAIVWVPAAIFFFATGALWKGLFLVGFFVIVVGLVDNILRPLLVGKDTKMPDYLILIATLGGMEVYGINGFVIGPLIAALFIACWNLLSGRDNRENVEEIDEEFIEEVQQLKTCCRAATAHWQAHPERRVKAPLVFSARPPGCHARNAVSTFSDL

SEQ ID NO: 149534 - protein, 343 aa, Glycine max
  Coding DNA Sequence Number=SeqID_32756
MRLLSLSNRNHNIQNDQYDVENIEDDDNVEVRKSRKNNYSPFTILGYEWVSREVNFYASRFQIWESIVVLKKEIPLMLMGVSKPYGGGGFVNDDVAVSDDVAVSVGRLVQNEGIIDLVMPSSATSNLPPSLSQDSNQSASPLAMMQRELGVGKRVDLPHIRSARTIANADERIKVMKTQLKSMKIKVEKTKTLKKDLANSKEFVAKLQTDFDKHVASLSAKSKENNTLNILVVALDKSVADVKAKFADFSSQFAAEQTKSKTAEEEKKIAKDKLTSANEEAQCQVIVLLPDFDYKKLDASCNVLDGEIVRESQLCYDEEEEEEKNEVESNAVGFNVDVTNTTY

SEQ ID NO: 149535 - protein, 76 aa, Glycine max
  Coding DNA Sequence Number=SeqID_32757
MAQMEDIRRENAEVKWESTKGETAVEQPRGFNPFHDRRVEHEDPDKHSHPKDIAIKCGLPNNSIVRFDGFSHAFVT

SEQ ID NO: 149536 - protein, 313 aa, Glycine max
  Coding DNA Sequence Number=SeqID_32758
MTNIFSQVTCHIEAKESMARKLAMEKKESGSTSGSGSGIKPYRKEFLKPRGNWNKRERQVIKEGSTPSTANLRDYIGTSSPIGKLNKRDVLGHFVGLKVPKDLMMPYPGVLVNFVGAEIEVKFPLDDGSVGVISVNQEIASKCYQESLRSMKGLYELTKQYEEVKEVEIVEGKKVNINTILSPLLEDNMLKVLMRNLNTFEWSSSDMPRIDPDFLCHKLALNPSAKSIIQKRRKFGEEKIKAITEEIDKLIFANHLKASISSPRIAEVDGRFAHHSIFLSVRECYWLGPSASGGRTTSDILCELGLARRRVTI

SEQ ID NO: 149537 - protein, 293 aa, Glycine max
  Coding DNA Sequence Number=SeqID_32759
MEKFDQAVVAIVTTTKNAGDAIGRSTPLIIASLNIMAANPGDASSIGACRPRIFFINGFLCFLEDELQRNGERKRERRFHFKEKMSLEEAHHHRRPWIRAWRKKEMNEGRGREEHQILIDGQWPIEEMEDNLNPMDFGNPQNESSLFWDVVFRTSIHNHMHNIPKVTHIDMEKLNFVNYVKGPHVEANRVCTILCAVEDRGKDLLNKKMLENDKARLTVEVEKLRKQMVDAEENRVDKVKFDLTMVDTKLAQQIVEGFKDAIVQVKIVVEDVDFDVVDPSKEVVNYEIVEVVE

SEQ ID NO: 149538 - protein, 266 aa, Glycine max
  Coding DNA Sequence Number=SeqID_32760
MAFEELVGILKFHEQKLAQDKRTKKRKSLAIKVQRLKCNSASKEYSFKAFVANDAFEEESDDDDFDDELSLIRFNGSFKRSFHKKEKSLIICYECKKLTLQDLDDSSSDEDNKEEANLCLMVDVPTSKVEPTLDMSSENEDSQLEDTVNSDGEEHDDLKKAHQIHIVDFVLETNLPGSVQDASVCDVVKVLMDKKEERVKSLTIALEDTEEGRKEMLEQKLLLQKECTLANDELDKIKRKNSNLWTKCQHYKKMSSKLNYMPKGCE

SEQ ID NO: 149539 - protein, 303 aa, Glycine max
  Coding DNA Sequence Number=SeqID_32761
  Homolog annotation: Hit_ID=Q1STZ2; Match level="QueryCoverage=54%, HitCoverage=35%, E-value=1e-11, Identity=30%"; Hit description=IMP dehydrogenase/GMP reductase
LAAIEAFVAYHHSKESPVVAILADLFDTFDRSAINWFPRWKEGKGGVLFSCGDYPNIPLIGTRGCINYNPTLAIRQLGYPMRGAPTEESLSPFLVRNLGAQSLKAIQRVHKAWRSPLTKDKELRGIRNGVIGGYHGWLRIHTLAKEKFKSAATHIQKECTELQEENMATAKALEQETKRAHKEEYGREKFRGALWGSNNELKKEFGSKRREIGHGSLAQHLEATEQSILAIIGQYKEELNQSMAHEQKLVEDFAQVYAKKKARGRVIDALHQEATMWMDRFALTLNGSQDLSRLLAKAKAMTE

SEQ ID NO: 149540 - protein, 200 aa, Glycine max
  Coding DNA Sequence Number=SeqID_32762
  Gene Ontology: Mol. function=RNA-directed DNA polymerase activity; Cellular component=chromatin; Biological process=RNA-dependent DNA replication
MKKSNGKWRMCIDHTNLNKACPKDAYLLPNIERLVDGACKYQKLSFLDAYSRYNQIKMYLPNEDKISFNTEDANFYYKVMSFRLKNVGMTYQRGIGTNPDKCEAVIIMRIPHNLKEPLDHSKLQPSPQTSHEKTQAYYEALIARLKLAIEVSVKKIKCRNDSKLITEQVNEVFQARETQMQNIIVWSRNYWNTLTTMNSL

SEQ ID NO: 149541 - protein, 141 aa, Glycine max
  Coding DNA Sequence Number=SeqID_32763
MELKSEVIKGYGYKSLRTLVTDDQVDLLLDLEKQKKRKRVKNSSKIELGGVSKPLGGSDFVGDEVVVGVNTGIAPIKPSFTTIKETIASTDEKFKVMFEQLKTMKVESEENKALSTRVVTLEKDVIDVGAKLEELSFDLVF

SEQ ID NO: 149542 - protein, 165 aa, Glycine max
  Coding DNA Sequence Number=SeqID_32764
MWMPSTASRRRKAVQTLQRCLLGPRERRLTDGDRLHLRRLGVAELELERCFNIAEEEEAPQPWSILLHQRLLLFRGNPSLESYGILNVKIYWWMQVDRSSLQILDWQRTCQECNMLCCEESTGRHLGHGAMDSLREFKEYKGCYLEAQESIVKNLNAFGANTLRE

SEQ ID NO: 149543 - protein, 138 aa, Glycine max
  Coding DNA Sequence Number=SeqID_32765
MEDSSLKKVTKNSSNNSESNILHPWLSTLRCMDRPKQPSKKLFWRSAKVDVSLSELNALSECHPLIEASTRLADKRNLEGNLSRRHTLSTSSARSTSHLSPSRLSASLALSDYSLTHAKRDNGAKRDVEVNEPFLSLE

SEQ ID NO: 149544 - protein, 109 aa, Glycine max
  Coding DNA Sequence Number=SeqID_32766
MLNWKEIIVNEQVSKVKLRQGSDTTFKELFEENLSKVRIRPLESCLKKLEQGSYTTFGESLEKVLGMNFLARSLSFLIRSPGYYLFVWMQNLPASAPGRQAQVLNTDVS

SEQ ID NO: 149545 - protein, 139 aa, Glycine max
  Coding DNA Sequence Number=SeqID_32767
MAERGHGMYYMPQTFAQYPTQMYQYPFQGHHTDTSASQHSFGGVAETQAHFSWPTMTPSQQYQGPIPTPNAPLGTQWNVQGPIPNMGDLLGIDLRHEFSAEADEEEAGRHRGRRNPDRQARRWDRPCGTSTRHHGHQNE

SEQ ID NO: 149546 - protein, 207 aa, Glycine max
  Coding DNA Sequence Number=SeqID_32768
MEPMMSMKKITKVNAGAAAVTSTVAEVDLTPLSGLNQINHPTSNMVGWGGKELGSVGGPHFVQVQNEHPFSPYGLPPNYMPPNVAHTPGENINNSNPILVESQQPQSNHAHVSQPMGETHEIPHHDLVDFKSRLGYATEGQAVGGVPDFDKYNETTCPKNHLKLYCQKMGAYAKDDCLCISSKKALLGQPSPGILTWNLPESVLGRT

SEQ ID NO: 149547 - protein, 214 aa, Glycine max
  Coding DNA Sequence Number=SeqID_32769
  Gene Ontology: Biological process=multicellular organismal development
  Homolog annotation: Hit_ID=Q9XGW1; Match level="QueryCoverage=64%, HitCoverage=15%, E-value=8e-35, Identity=51%"; Hit description =Protein PINHEAD
  Subcellular localization annotation: CTP_CleavageSite=61; ConfidenceScore=5.09e-01
MSKNLTEYAVIGVKQLNSTGKNPNELPQNQTSPHARNNRRRRSRGGGRKFDQGDILMEPIVTSGVENGNTMCGEKEMSYLTLSKSLSFAPRPSYGQVRRKCIVKANHFFPKLLDKDLNQYDVSITPEVSSKAMNKSIIVELVRLYKESDLGMRLPAYDGTKSLYIARTLPFSRRNFKIKVVDDKDGVNGSNIQIKLNFQLTLAPFSKGKENIEW

SEQ ID NO: 149548 - protein, 140 aa, Glycine max
  Coding DNA Sequence Number=SeqID_32770
  Homolog annotation: Hit_ID=Q9XGW1; Match level="QueryCoverage=66%, HitCoverage=9%, E-value=8e-34, Identity=74%"; Hit description =Protein PINHEAD
  Subcellular localization annotation: CTP_CleavageSite=54; ConfidenceScore=5.20e-01
MDLVMIPLQSDNKSSSLLTLMSSFHAFITNILFTKMHAMMSTLMDLMGGRNIVLVDAISCRIPLVSDISSIIFGADATHPRNGEDSNPSLLDVVASQHWPELKKCVGLVCAQAHRQELIQDSYKMWHNLVHALVSGGMIQ

SEQ ID NO: 149549 - protein, 165 aa, Glycine max
  Coding DNA Sequence Number=SeqID_32771
  Pfam annotation: Domain name=zf-CCHC; Domain location=39-56; Score =22.8; E_value=0.00017; Accession=PF00098.13; Description=Zinc knuckle
KDQGQGILGVTPSMPKDEEGKAIEKQAPKASMQEKTSSIKCFKCLGRGHITSQCPTTKTMIMRGQDIYSSQDEATTSPSSSESEEAKGEESSEEIYPQEDGQPLVVKEKCKETLASIATPLGLEFIPQVKKLLDEGVEEKSPKFQEPRDLRSNPFQGGGNDAILP

SEQ ID NO: 149550 - protein, 187 aa, Glycine max
  Coding DNA Sequence Number=SeqID_32772
FDYSNLDANRMVYNDQADMTDRLFAGSLTFDCRIMHYIIVRILLPRSSNLAQASEEDLIFMWAFLIGRPIDWAHLIRYRMHKALRTVTSFGYRKDMDGKWLKKDMQPPQDECTRSPPPQRDDSSTLMHEVLSVLRGLHTYVGEHFDSLDGRINAIDARFVGMDTRIPQLEEDISYVHQCFDLPPPSS

SEQ ID NO: 149551 - protein, 139 aa, Glycine max
  Coding DNA Sequence Number=SeqID_32773
MSFVNVRFLQDVWKKAQAIQKQNTAPHLLSRGGYEYLEQKLMVEKTKKKLEEVAQFGSTEAVIDPPSPITRHVKWKMARTKKTGQMTSKATKEIVEKILSHFQLRIALQGSFVPHKRQDLLTTAIGRPEHPGRVRAAGA

SEQ ID NO: 149552 - protein, 97 aa, Glycine max
  Coding DNA Sequence Number=SeqID_32774
  Homolog annotation: Hit_ID=Q1SWQ8; Match level="QueryCoverage=70%, HitCoverage=24%, E-value=2e-10, Identity=44%"; Hit description =Nucleic acid-binding, OB-fold; TonB box, N-terminal
MDVMLFLCCSGEILSCTLWENYCTQFLSYLNERGDDGPMVIILTHARIKDAQGSYPASVSNSFKASKLLINDPILEIQEFKERYFAYHLCSVVVKFV

SEQ ID NO: 149553 - protein, 90 aa, Glycine max
  Coding DNA Sequence Number=SeqID_32775
MGYVAKTQRNRGAMGKKWELRKSSNICIYIKYGQNTSSSMANKNISSNETYPPTLIPKTIPKLQNSLRVGKNHGFSLKACNELQNKERGT

SEQ ID NO: 149554 - protein, 240 aa, Glycine max
  Coding DNA Sequence Number=SeqID_32776
  Gene Ontology: Mol. function=sulfate-transporting ATPase activity; Cellular component=outer membrane-bounded periplasmic space; Biological process=sulfate transport
  Homolog annotation: Hit_ID=Q7CJH2; Match level="QueryCoverage=81%, HitCoverage=56%, E-value=3e-93, Identity=85%"; Hit description =Thiosulfate binding periplasmic protein of sulfate/thiosulfate ABC transporter
MAFLVRKDNPKGIHTWNDLVRDDVKLVFPNPKTSGNGRYTYLAAWGAASQADGNDAAKTRAFMTRFLKNVLVFDTGGRGATTTFVERGLGDVLISFESEVNNIRKQYGEDKYEVIVPPVDILAEFPVAWVDKNVERNGTEQAAKAYLNYLYSPAAQQVITSFYYRVYDQKAMAAAKGQFPDTQLFRVEDQFGGWPQPRQQPVLYLFDPAVAAHRAGDAAGTDEPGAILGSDFQPAGGGGV

SEQ ID NO: 149555 - protein, 73 aa, Glycine max
  Coding DNA Sequence Number=SeqID_32777
MGAKHLTRTKEWSHVIEQRSPDEIRFSPNRFPPTRSGRKTTIDTSKPYTGAMRGTVHEPQVNIGADQKFSPID

SEQ ID NO: 149556 - protein, 189 aa, Glycine max
  Coding DNA Sequence Number=SeqID_32778
MKRDFGQFSKLLHEASQIQRAINVALVKEFYANLYSSEGPSPKQPRVKGHLVKIDVDSLNTFLEILIVLEEGETLPIYSRYCRLPTDHREIEVALCIPGRGFILNAEGHLRRILKKDLTTLAQVWSVLSYSNLAPTSHTLDLTMDKARLIFGLVSHMDMNIGALILGQMTSIAQSNSFRLGFPALITAL

SEQ ID NO: 149557 - protein, 495 aa, Glycine max
  Coding DNA Sequence Number=SeqID_32779
  Gene Ontology: Mol. function=methylated-DNA-[protein]-cysteine S -methyltransferase activity; Cellular component=intracellular; Biological process=regulation of transcription, DNA-dependent
  Homolog annotation: Hit_ID=Q3P8D9; Match level="QueryCoverage=66%, HitCoverage=93%, E-value=1e-105, Identity=58%"; Hit description =Methylated-DNA-[protein]-cysteine S-methyltransferase
  Pfam annotation: Domain name=Ada_Zn_binding; Domain location=145-210; Score=143.8; E_value=4.5e-40; Accession=PF02805.6; Description=Metal binding domain of Ada
  Pfam annotation: Domain name=DNA_binding_1; Domain location=404-489; Score=119.9; E_value=7.2e-33; Accession=PF01035.11; Description=6-O -methylguanine DNA methyltransfera
  Pfam annotation: Domain name=HTH_AraC; Domain location=224-269; Score= 32.8; E_value=1.2e-06; Accession=PF00165.13; Description=Bacterial regulatory helix-turn-helix proteins, araC family
  Pfam annotation: Domain name=HTH_AraC; Domain location=272-318; Score= 14.8; E_value=0.052; Accession=PF00165.13; Description=Bacterial regulatory helix-turn-helix proteins, araC family
  Pfam annotation: Domain name=TetR_N; Domain location=221-266; Score =8.5; E_value=0.025; Accession=PF00440.13; Description=Bacterial regulatory proteins, tetR family
  Pfam module annotation: Pfam domain module=Ada_Zn_binding::DNA _binding_1::HTH_AraC::HTH_AraC::TetR_N; Domain location=145-210::404 -489::224-269::272-318::221-266
MTCQVRPGDHARRHCSRAAQAPKLARRRHHARLLRSGWHDRRCDGQASYRARGDRRRTGEIFQPRTPDVDHPAPPLRGRRYRLAYPRLVICRRRSGRDGGEHGRHSHRHRPPGRRRLLALSDRQSVRRRPPGCRLMTGAADNADDARWARIAARDPTADGAFWRGVTTTGIYCRPTCGTRRPKRENVRFFDQQEEAEAAGFRPCRRCRPDEGTPATRNVELVAEACRLIEADVGVPSVSALAHALGVSEGHLHRLFRARTGLTPRAYGQEKRAQRMRSSLALGRRITETIYETGYGSSGRFYAVTRKSLGMTPTHYQAGGAGETLRFAVGQTSLGAIVVASSDAGVAAILLGDDPETLLRDLQERFVHATLIGGDQSYEALVAQVVGLVEEPATAEPLPLDVRGTAFQRRVWRVLQAVPPGSVISYDEIARRVGRPRAIGAVASACASNPLAVAIPCHRVVKSDGGYWSYTWGLDRKRALLLREGAETQSASVAG

SEQ ID NO: 149558 - protein, 106 aa, Glycine max
  Coding DNA Sequence Number=SeqID_32780
MHEQRLAINSWGYGLDGGGCMNDNQFMGLRIRFDGGRCTNSARQLFRGAPDSMRLAINSWGYGLDGGGCMNDNQFMGLRIRFDGGRCTNSARQLFRGAPDSIVEDA

SEQ ID NO: 149559 - protein, 299 aa, Glycine max
  Coding DNA Sequence Number=SeqID_32781
  Gene Ontology: Mol. function=nucleoside-triphosphatase activity; Cellular component=membrane; Biological process=DNA metabolic process
  Homolog annotation: Hit_ID=Q4US48; Match level="QueryCoverage=84%, HitCoverage=54%, E-value=1e-133, Identity=94%"; Hit description=DNA repair protein
RADARLLFALDSVEPCSAAVRPPVDHGSTLQKAAGRGLGSTVLASRRVDGLGQALHRDHFHAFHRTALRRIGLGHDGALEAMGGRLTQAVFAIGHRPDLAGQADFAEGNGLLRQRPILQRGQHRQQHRQVGRGLLHANATDHIDEHILIADQHTAVAMQHRQQHGQPVLLQADRDTTRVRQRRRIDQRLHLHQQRPGALAGDHHTAARLMGAATGQEDRRRIGDFLQALVAHREHAQLVDCTEAVLEGAQQAEAAAALAFEIQHRIDHVLEHARAGDAALLGHVTDQEHGGSGLLGKAH

SEQ ID NO: 149560 - protein, 66 aa, Glycine max
  Coding DNA Sequence Number=SeqID_32782
MARTCSPLKAKTCSPPKVRTCSPLKVRTCSPLKIDCPFEKGDNSCDLILSFANLSGNSLRVYVLFD

SEQ ID NO: 149561 - protein, 68 aa, Glycine max
  Coding DNA Sequence Number=SeqID_32783
MEHLLVGDEQKHKTESKNAKKDDPRAANSSIPWGWLAQASPVRPGELTCTFFFVFEGNINHVPSLLMD

SEQ ID NO: 149562 - protein, 281 aa, Glycine max
  Coding DNA Sequence Number=SeqID_32784
  Gene Ontology: Mol. function=pyridoxal phosphate binding; Cellular component=cytoplasm; Biological process=cysteine biosynthetic process from serine
  Homolog annotation: Hit_ID=Q7WGV1; Match level="QueryCoverage=83%, HitCoverage=77%, E-value=1e-117, Identity=90%"; Hit description =Cysteine synthase B
MRHSAAVEDLGQVGLGPLADAGNRRTLGRLRAHHLHRRVARLQVGGHAHDGAGRAHGADEVRDAAFGLRPDFRTGGLDMRARIVGVGKLVQHHAAAVRLHFGGQIAGVFHAALVGRRQDQLGAIGRHGRAPFHRQVVGHDQDHAVATHGGRHGQRDAGVAAGRLDQRVARLDVAALLGMPDHGQRRPILDRTGGVIAFQLGQDDVASGRTGGSGNALQAHQRRIADGLLDSGIGSSHAADHNPARRRAPPKAALVPGVHATGRPPPAPRPANAGRPPRAYP

SEQ ID NO: 149563 - protein, 217 aa, Glycine max
  Coding DNA Sequence Number=SeqID_32785
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=7e-30, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=59; ConfidenceScore=5.13e-01
MSLPSEDYTSSPSEGRTPSPSEDYTSSTSKDYTSSSSKGTCTFTFVGLHAPTFRGLHVLAFKGLHVLPFRGLHVLAIRGLHVLPFRGLHVLHFRGLHVLPFRGLHALAFRGLDALAFRGLHVLAFRGLHALVFRGLHVLNFRGLHALAFRGLHILPFRGLHAPTFRGLYAFAFRGLHVLPFRGLHIIPFRGLHVLHFKGVHVLPFRGLHILAIKGLH

SEQ ID NO: 149564 - protein, 57 aa, Glycine max
  Coding DNA Sequence Number=SeqID_32786
MAFGGPAAHPGKLRLSHEAIGSPRRARDWCRTTQKMSISIHYKKNDLSLRTPFCYRH

SEQ ID NO: 149565 - protein, 144 aa, Glycine max
  Coding DNA Sequence Number=SeqID_32787
  Subcellular localization annotation: CTP_CleavageSite=54; ConfidenceScore=5.31e-01
MALGSKRVLNPLMMKATYQLKIVPLFFESFWTSSMVFRLLLVTSLMPWNCKSTCGSMPWNQGSPKSKKMSPSSVLALIHHHYLHHPLSLFVIIMTKDCHHQKGGDCRQRIKLNVLMMPKDHMFLKALFKTKKLKIFKMDDQDSL

SEQ ID NO: 149566 - protein, 98 aa, Glycine max
  Coding DNA Sequence Number=SeqID_32788
MVIPKFKVPNFDKYKGTTCPKNHLKMYCRKMGPYEKDGKLLIHFFQESLTGAAVTCISTILIWLRIGCNYRAYARGGTDLSKNTPKGGGIWQPKWFPQ

SEQ ID NO: 149567 - protein, 64 aa, Glycine max
  Coding DNA Sequence Number=SeqID_32789
MHRSPTGNLVPLDLEIEATLQRNRAERRRKLLQDRIVASILEDKPAPEHNVWLQVMEGDQEVLK

SEQ ID NO: 149568 - protein, 326 aa, Glycine max
  Coding DNA Sequence Number=SeqID_32790
  Homolog annotation: Hit_ID=Q4VWY7; Match level="QueryCoverage=22%, HitCoverage=18%, E-value=2e-26, Identity=85%"; Hit description =Monoglyceride lipase isoform 2-like
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSVSRDPAALLAKYSDPLVYTGPIRVRTGHEILRISSYLMRNFNSVTVPFFVLHGTADKVTDPLASQDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149569 - protein, 245 aa, Glycine max
  Coding DNA Sequence Number=SeqID_32791
  Pfam annotation: Domain name=DUF313; Domain location=120-230; Score =16.5; E_value=4.2e-06; Accession=PF03754.4; Description=Domain of unknown function (DUF313)
MSCKPFKPSILHLAISQDAPHLYSEEQLIQLKKLSKLLPSAESKPNTNTTDKRVTKKRQIEERPKEERVMPATIKKPRKIILEQNGPSPYLSRRIILGHSGPSPDLPPRRIILEHSGPSPDLPMQFKNRIAELSGHDLKYLMHKRLFLSDVKPNNNRLSMPINEIMCEFLTQAEIEKLDERNGRNGKGRLVGLELTVLDPCLREFTLPLKKWSMQRTDTYNLGLQEVLDSTAVAVPSFLVDKKAC

SEQ ID NO: 149570 - protein, 483 aa, Glycine max
  Coding DNA Sequence Number=SeqID_32792
  Gene Ontology: Mol. function=protein kinase activity; Cellular component=integral to membrane; Biological process=protein amino acid phosphorylation
  Homolog annotation: Hit_ID=Q1S8D8; Match level="QueryCoverage=99%, HitCoverage=100%, E-value=0.0, Identity=91%"; Hit description =Protein kinase domain, putative
  Pfam annotation: Domain name=Pkinase; Domain location=64-314; Score =25.1; E_value=4.7e-10; Accession=PF00069.15; Description=Protein kinase domain
  Pfam annotation: Domain name=Pkinase_Tyr; Domain location=76-314; Score=-22.4; E_value=4.3e-11; Accession=PF07714.7; Description =Protein tyrosine kinase
  Pfam module annotation: Pfam domain module=Pkinase::Pkinase_Tyr; Domain location=64-314::76-314
MGCLHSKTAHLHSPEDPPTALPDSKKPDPGNGGDDVDQECQVPAFKEYGLIELRRATNEFSTDYIVSESGEKAPNVVYRGKLENNRLVAVKRFSKLSWPDAQQFMAEAAGVGKVRHKRLVNLIGCCAEGDERLLVAEYMPNDTLSKHLFHWDKQPLPWEMRVRVAYHVAQALDHCSLENRKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPEIKFLLTAVAPLQKQKEVTSHVLMGLTKNTAVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQALALSKLGMETDAHDMLNDGAAFEAKRSNSWRG

SEQ ID NO: 149571 - protein, 280 aa, Glycine max
  Coding DNA Sequence Number=SeqID_32793
  Pfam annotation: Domain name=DUF313; Domain location=125-235; Score =11.2; E_value=1.3e-05; Accession=PF03754.4; Description=Domain of unknown function (DUF313)
MRDLKTLKELVASVTDWKSLEKMSCKPFKPSILHLAISQDAPHLYSEEQLIQLKKLSKLLSAESKPNTNKTDKRVTKKRQIEERPKEERVMPATIKKPRKIILEQNGPSPDLSRRIILGHSGPSPDLPMQFKNRIAELSGHDLKYLMHKTLFWSDVKPNNNRLSMPINEIMCECLTEAEIKKLDERNGSNGKGRLVGLELTVLDPCLREFTLPLKKWSMQRTDTYNLGLQEVLDSTAVAFPFYFYQKFTHVRRRKLERNQIGIIYVQLAVVMPIFKCTGL

SEQ ID NO: 149572 - protein, 73 aa, Glycine max
  Coding DNA Sequence Number=SeqID_32794
MLASPERVQMTTLAFAHRSHLGSLNDEVRITVRCPPQATSSWVMTTKGGVVDKSEALAPTYPPMRNSDLRSSG

SEQ ID NO: 149573 - protein, 365 aa, Glycine max
  Coding DNA Sequence Number=SeqID_32795
  Gene Ontology: Mol. function=translation elongation factor activity; Cellular component=intracellular; Biological process=translational initiation
  Homolog annotation: Hit_ID=Q9FF87; Match level="QueryCoverage=94%, HitCoverage=87%, E-value=3e-25, Identity=26%"; Hit description =Arabidopsis thaliana genomic DNA, chromosome 5, P1 clone:MRO11
  Pfam annotation: Domain name=mTERF; Domain location=98-365; Score =69.8; E_value=9e-18; Accession=PF02536.5; Description=mTERF
MDEWRRKNTGFGSKEIHQSSDTSNAVLSLLKTYGCSESQFSVLPRGTSFDSESDGNHHKSGTFTVSYLINSCGVSPKLARELSNRVNLKNPDGPNAVLDLLKNYGFCKTKLAKLVGRHPLVLVADAENTLLPKLKFFRFIGVSDAGMPKILIANSSILKRNLEKCLIPRYEILKSVLCDDREVVRALRNSPLGFIYGDLVNALVPNIKILKQCGVAQASISLLITIALSAAYVKHSRFVEAVKTVKEIGFSPLKNNFVVAISVLVTMRKSVWDSRFEVYQRWGWNHEMSLRAFRKFPGFMIFSGETFTKKMSFLVKDMGWPSEAIAEYPQVVAYSLEKRIIPRFSVIKILKSKGVLTCTLVPLFA

SEQ ID NO: 149574 - protein, 141 aa, Glycine max
  Coding DNA Sequence Number=SeqID_32796
  Homolog annotation: Hit_ID=Q9AVH2; Match level="QueryCoverage=95%, HitCoverage=53%, E-value=5e-35, Identity=60%"; Hit description =Putative senescence-associated protein
SNSEWTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 149575 - protein, 125 aa, Glycine max
  Coding DNA Sequence Number=SeqID_32797
VCGIAPARHPVDPKKSNRVLGFPALITGLCQFYGVPVTPSKFIRPPINRAFIKKYCAPRQAQGETPQQPRDGRQRATNALPPPLEFTTTHPQKGERGSALLVLRNHLKLVRKIVSVKKIQAEELL

SEQ ID NO: 149576 - protein, 436 aa, Glycine max
  Coding DNA Sequence Number=SeqID_32798
  Gene Ontology: Mol. function=translation elongation factor activity; Cellular component=intracellular; Biological process=translational initiation
  Homolog annotation: Hit_ID=Q67UI0; Match level="QueryCoverage=74%, HitCoverage=82%, E-value=5e-32, Identity=28%"; Hit description =Mitochondrial transcription termination factor-like
  Pfam annotation: Domain name=mTERF; Domain location=53-328; Score =84.3; E_value=3.7e-22; Accession=PF02536.5; Description=mTERF
EPLLILNQIYNHQKGGTFTVSYLINSCGVSPTLARKLSNKVNLKTPHGPNAVLDLLNNYGFDKIQVAKLVEKHPLVLLADAENTLLPKLKFLRSIGVSNTDMPKILIANHSLKRSLKKFFIPRYEILRRVLGDDQEVVRAITSSRFGINYGDAMNLVPNIEVLRQSGVPQASISFMMIHCGTVAYWKHSRFVEAVNTAKEIGFNPLRTNFIVAIEMLLISSKAVWESRFKVYERWGWNREMALQAFRKFPNVMRLSEEAFSKKMNFLVNDMGWPSEEIAEYPQVVAYNLEKRIIPRFSVIKILKSKGLLENNVSFSSIICITEEKFLENFVISLQKDLPVLPDLYRGISSDAESDDENHHKGDTFTVSYLINSWGLSPKLASELSNRVNLKNPDGPNAVINLLNKYGFEKTHLAKLAEIKPSVIAANAEIPFCRNS

SEQ ID NO: 149577 - protein, 223 aa, Glycine max
  Coding DNA Sequence Number=SeqID_32799
  Homolog annotation: Hit_ID=Q1SKD7; Match level="QueryCoverage=58%, HitCoverage=34%, E-value=4e-13, Identity=33%"; Hit description =Ankyrin
MAPKKLSTKRSRRDAAAEGFSATPEFDSHHFQSAEHQQRFEAIKGWSFHRERHVQLMEDEYTNFQEEIARRRWTSLVTPMAKFDLEIVLEFYANAWPTEEGVRDMRSWVRGQWIPFDVDALSQFLGDPLVLEEGQQYEFSQRRNRADGFDEEDFTRTAAGRWVRIMCTSMTTLTQTWMTLLLNNVLPSDHNSDLPLPKCHLVYAILTRISVHVAQVCHPPGTL

SEQ ID NO: 149578 - protein, 463 aa, Glycine max
  Coding DNA Sequence Number=SeqID_32800
  Gene Ontology: Mol. function=transferase activity; Cellular component= chloroplast; Biological process=biosynthetic process
  Homolog annotation: Hit_ID=Q2LDA3; Match level="QueryCoverage=90%, HitCoverage=88%, E-value=1e-147, Identity=63%"; Hit description =Phytoene synthase
  Pfam annotation: Domain name=SQS_PSY; Domain location=109-450; Score =394.4; E_value=1.6e-115; Accession=PF00494.10; Description =Squalenephytoene synthase
  Subcellular localization annotation: CTP_CleavageSite=53; ConfidenceScore=5.15e-01
MSGVLLWVSCGPKENPISIVGLGGRGGRSQRRFGLCNGISFASFSPAVADPSRSSEERVYEVVLKQAALVKEQDKGTKRALNLDKPTIEGDLTNGDLLSDAYDRCGEVCAEYAKTFYLGTQLMTQERRKAIWAIYVWCRRTDELVDGPNASHITPKALDRWEQRLSDVFEGRPYDMYDAALSDTVSKYPVDIQPNFKMVSKIVVDLILSHPQLFKNLPCSFPKMSNSKCEEVVLDNLFRLSWPRSNSRTRKMVVLKATKHPFKDMIEGMRLDLRKSRYNSFDELYLYCYYVAGTVGLMSVPVMGIAPESKATTESVYNAALALGIANQLTNILRDVGEDARRGRVYLPQDELAQAGLTDDDIFRGKVTDKWRNFMKGQIQRARMFFDEAEKGVSELNSASRWPVWASLLLYGQILDSIEANDYNNFTKRAYVGKVKKLLSLPAAYGRALLGPQKLTKMVTRSM

SEQ ID NO: 149579 - protein, 321 aa, Glycine max
  Coding DNA Sequence Number=SeqID_32801
  Gene Ontology: Mol. function=oxidoreductase activity; Cellular component=integral to membrane; Biological process=potassium ion transport
  Homolog annotation: Hit_ID=Q13J96; Match level="QueryCoverage=98%, HitCoverage=93%, E-value=2e-83, Identity=46%"; Hit description =Putative Norsolorinic acid reductase
  Pfam annotation: Domain name=Aldo_ket_red; Domain location=8-305; Score=169.2; E_value=1.1e-47; Accession=PF00248.11; Description =Aldoketo reductase family
MKYKLFGAKTGLHASEIILGAANFGTRKGYGADPEESKKILTAYAEAGGNFIDISDVYQFGEAEEIVGNYLQGQRSNFIICSKYTRSSDPQPAISNFGNNRKSMRQAVEQSLKRLKTDYIDIYMPHYDDGVTPLEEIALGLQDLVSEGKIVYAGLSNFPAWKASAIASATKLTGLQIEYNLLQRTADRELIPMATEFGLGLMMYSPLAGGLLTAKYRKGEAGRISHSSEAAYAENEKTKLIIDELVAIAEKQEATPGQIAFAWNLSKEAFPLLGARNINQFEQSLKAAEINLTADELTKLDALSSISLGYPHDLLNSVGIL

SEQ ID NO: 149580 - protein, 91 aa, Glycine max
  Coding DNA Sequence Number=SeqID_32802
MCNQLQQGRLSVIDYQKDRSFLIGADVVASFGYRKKRDGSWVKKGAQPNDDEGHLLVEGDSSLLQSNLDRFDGLQTCVGERFDSLESQVNT

SEQ ID NO: 149581 - protein, 334 aa, Glycine max
  Coding DNA Sequence Number=SeqID_32803
  Gene Ontology: Mol. function=transferase activity
  Homolog annotation: Hit_ID=Q9MAP9; Match level="QueryCoverage=88%, HitCoverage=62%, E-value=1e-70, Identity=46%"; Hit description =Highly similar to YUP8H12R.39
  Pfam annotation: Domain name=Transferase; Domain location=1-324; Score=-40.5; E_value=5.4e-09; Accession=PF02458.6; Description =Transferase family
MATSLKCGGIIVACTFDHRVADAYSTNMFLVSWADMAQPTKPNNTLVVTVAPTASRHPCFRRSLLSPRRPGSIHPSLHHMYTPISELPPPPSIASAALLSRIYYVTAEQLHLMQVFAATRTKLECFSAFLWKMVARAASKEKNGKRVVAKMGIVVDGRKRLGNGDKESEAMMESYFGNVLSIPFGGKPVEELVEEPLGFLAEAVHEFLAAATTEEHFLGLIDWVEAHRPVPGITKIYCNNADDGPAFVVSSGQRFPEDKVDFGWGKVVFASYHFPWGGETGYVMPMPSPLRNGDWIHYYKKPFLRHALYVGCIRNRFNKWCGGIFEIIGLQMAF

SEQ ID NO: 149582 - protein, 70 aa, Glycine max
  Coding DNA Sequence Number=SeqID_32804
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=85%, HitCoverage=100%, E-value=3e-10, Identity=53%"; Hit description=ATP synthase C chain
  Pfam annotation: Domain name=ATP-synt_C; Domain location=17-66; Score= 38.8; E_value=1.8e-08; Accession=PF00137.12; Description=ATP synthase subunit C
MYVGYEEIIMNPIISAASVIAAGLAVGLASIGPGVGQGTAAGQAVEGIARQPEAEGKIRALALLFANPFV

SEQ ID NO: 149583 - protein, 70 aa, Glycine max
  Coding DNA Sequence Number=SeqID_32805
MKMRTRSPLKARACSPLQARMCSPLMARTYSPLKIDCPFEKGDNSCNLILSFANLSGNSLRVYILFDLVT

SEQ ID NO: 149584 - protein, 121 aa, Glycine max
  Coding DNA Sequence Number=SeqID_32806
MATNCASTTRGGGYRAATVHTNEDRAHKTPSGPGGVQQGPRVSSSSYGPLDRAHKTPSGPGEVQQGPGVSSSSYGPLDRARKTPSGLEESQQGPGVSSSDYGPLSVLRSACRPQQGPQAPY

SEQ ID NO: 149585 - protein, 67 aa, Glycine max
  Coding DNA Sequence Number=SeqID_32807
MSLKITKEVKKQFDAGLLAVDRYPEWVANIVLVLKKDGKVRMLQSNKDGTKGYGKDHVHHPLGNVLL

SEQ ID NO: 149586 - protein, 100 aa, Glycine max
  Coding DNA Sequence Number=SeqID_32808
MVVIYMLFFLTSAIKTITNSFQGMSNQGAPRWVEPKSNVQSGGFECGYYVMHWMWCIVTASLKDDWHKWFFDGSPLDVEAITTVRQKWATYFLTFRKSSC

SEQ ID NO: 149587 - protein, 311 aa, Glycine max
  Coding DNA Sequence Number=SeqID_32809
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=1e-35, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTARPRLQRAARPHLQRAHALAFRGLHVLVLKGMHALTIRGLHVITFRGLHVLTIKGLHALSFRGLDVLTGRGLDVLTFRGLEVITIRGLHALTSRGLHVLIFRGMHVLVFRGSHALTFKGLDVLAIRGWHAFTLRGLHILAIRGLYALTFRGLHVLTFRGLHVLTFKGLHVLAIRGLHALTFRGLHVLAFRGLHVLAIRGRHTLTFRGLHAFAFRGLDVLVIRGLEVLAIRGLEVHAIRGLHALTFGRLHVLVFRGLHVLAFSGRHALTLKGLHAFAIRGLHALTFRGLHILAFRELHVLVFRGLHVLVI

SEQ ID NO: 149588 - protein, 80 aa, Glycine max
  Coding DNA Sequence Number=SeqID_32810
MSNEELKLQDPRCRIQCPDILPENTGVAVQCKIKIFQKKIDLLQHQGVAAQKRKLLYNHGGCTSSVPSPGLKSYFVSFGT

SEQ ID NO: 149589 - protein, 48 aa, Glycine max
  Coding DNA Sequence Number=SeqID_32811
MVKYCAKSKTGMNQGTWGRARMDARPMINISMSRVQLWTSEKRYWEAA

SEQ ID NO: 149590 - protein, 174 aa, Glycine max
  Coding DNA Sequence Number=SeqID_32812
  Homolog annotation: Hit_ID=Q9SIV6; Match level="QueryCoverage=49%, HitCoverage=37%, E-value=2e-29, Identity=76%"; Hit description =Expressed protein
  Pfam annotation: Domain name=DUF1640; Domain location=54-171; Score= -3.6; E_value=9.6e-05; Accession=PF07798.2; Description=Protein of unknown function (DUF1640)
  Subcellular localization annotation: CTP_CleavageSite=76; ConfidenceScore=5.26e-01
MAAVRRRVWQLSSIPGFGASKLEVSSSFQRAILDPFPVSGTRHFSQVVKSNGKHSFQRAILDSFPVSGTRHFSQVVKSNGKHLFLVDTLALVRRLEGEGVPSKQAEAITAAITEVLNDSLENVSQSLVSNGEMQKIEMMQESNLSKFKAEVQSSQGLVLVVNMLGLNERFVCCL

SEQ ID NO: 149591 - protein, 104 aa, Glycine max
  Coding DNA Sequence Number=SeqID_32813
MGNQRILKQGSRFLFLTKSLLTKEICDVPTKLAHLSGKAPRDNQRIVESVNYQLRVYFQPKVMPTPLVSPFNGSNIATNNSATRVFHGVSHITLLEAASRQCKG

SEQ ID NO: 149592 - protein, 129 aa, Glycine max
  Coding DNA Sequence Number=SeqID_32814
  Gene Ontology: Mol. function=glutamyl-tRNA(Gln) amidotransferase activity; Cellular component=integral to membrane; Biological process=regulation of translational fidelity
  Homolog annotation: Hit_ID=Q10SS1; Match level="QueryCoverage=89%, HitCoverage=16%, E-value=1e-40, Identity=71%"; Hit description =Expressed protein
SNKAGKLLAEVLLRGYQGNRPETLIGYSLGARVIFKCLQYLAKTENGAELVEKVVLLGAPIPIKDENGEAARKMVAGRFVNAYSRNDWMLGVAFRASRLLTKGLAGIQPVDIPGIQNAIRLIRGPHKRS

SEQ ID NO: 149593 - protein, 159 aa, Glycine max
  Coding DNA Sequence Number=SeqID_32815
  Subcellular localization annotation: CTP_CleavageSite=31; ConfidenceScore=5.09e-01
MSFPSPVTFQALPPATVRAQVTSLADKPTIRSTHKQSTQCHRWHHHRTPGAPSRGYPRLTKQYQRQKFYQHVRPTPTPKVRGHFMFIWRFSFVFLFRAALLRDRHTSLLFLCLKVSPMDLSAFSWVNRAYHHCRRPPRRPCAQPTQNTAASDPTQGPSA

SEQ ID NO: 149594 - protein, 127 aa, Glycine max
  Coding DNA Sequence Number=SeqID_32816
  Gene Ontology: Mol. function=peroxidase activity; Cellular component =mitochondrion
  Homolog annotation: Hit_ID=Q9SIV6; Match level="QueryCoverage=88%, HitCoverage=45%, E-value=2e-43, Identity=80%"; Hit description =Expressed protein
  Pfam annotation: Domain name=DUF1640; Domain location=1-126; Score =86.7; E_value=7.3e-23; Accession=PF07798.2; Description=Protein of unknown function (DUF1640)
MVGCLGETIAILKGHHFSLLQHETEKLRNDIEKMRSELRHEIDKVTAGQRLDLNLERGRIREELSNQNAETNNLTNKLDRVSNYGSVWEIHSLRAQLEAAKYDVIKYCIGTLVSISAVGLAVLRILM

SEQ ID NO: 149595 - protein, 165 aa, Glycine max
  Coding DNA Sequence Number=SeqID_32817
DQRSLGSLQEAGFASWLITGHKRPTSFGFIARSGYNFLVVITGHKGPTSLGFIARTGHNFLVVITGHKGGDSFVVHCFDSSISNGSIPQDFPLVALIRFPNVREKEKRLKLSFHCLRAMSISSSPYIILQISTVKVLGLCGKGEGYDAKEISITSDICLQFPTAR

SEQ ID NO: 149596 - protein, 108 aa, Glycine max
  Coding DNA Sequence Number=SeqID_32818
  Gene Ontology: Cellular component=nucleus; Biological process =regulation of progression through cell cycle
  Homolog annotation: Hit_ID=Q9AS36; Match level="QueryCoverage=74%, HitCoverage=29%, E-value=7e-26, Identity=69%"; Hit description =Putative ania-6a type cyclin
MTKTVPSYVRVKAKGMIYTTIDMFYLTDEQLANSPSKKDGIDEATETTLRMPQAVMATGQVLFHRFYCKKSFARFNVKDGMQEGEFSHGAFRLVFQGQKLLILTFLCL

SEQ ID NO: 149597 - protein, 156 aa, Glycine max
  Coding DNA Sequence Number=SeqID_32819
  Homolog annotation: Hit_ID=Q1SDG1; Match level="QueryCoverage=35%, HitCoverage=4%, E-value=8e-09, Identity=49%"; Hit description =Integrase, catalytic region; Zinc finger, CCHC-type
MEEGFSTNKPPMFRGIKYDYWKERMIAHFESIHIDLWYVVENGDYIPYDGHLSSEYDVVAVRSLRKRIHKVTMLRALKNLDSMSLEEPVSTLKVHEQEIQRDEGLQREKSLALGSQKNKKTSSSREHALRSSSKVLKVEMIHLKKTQMKMSSPLSL

SEQ ID NO: 149598 - protein, 412 aa, Glycine max
  Coding DNA Sequence Number=SeqID_32820
  Gene Ontology: Mol. function=protein binding; Cellular component =integral to membrane; Biological process=defense response to fungus
  Homolog annotation: Hit_ID=Q1SWI7; Match level="QueryCoverage=92%, HitCoverage=88%, E-value=1e-80, Identity=34%"; Hit description =Leucine-rich repeat
  Pfam annotation: Domain name=LRR_1; Domain location=113-135; Score =2.2; E_value=1.1e+02; Accession=PF00560.23; Description=Leucine Rich Repeat
  Pfam annotation: Domain name=LRR_1; Domain location=142-164; Score =4.9; E_value=35; Accession=PF00560.23; Description=Leucine Rich Repeat
  Pfam annotation: Domain name=LRR_1; Domain location=166-188; Score =12.2; E_value=1.5; Accession=PF00560.23; Description=Leucine Rich Repeat
  Pfam annotation: Domain name=LRR_1; Domain location=17-39; Score=7.1; E_value=13; Accession=PF00560.23; Description=Leucine Rich Repeat
  Pfam annotation: Domain name=LRR_1; Domain location=190-212; Score =9.4; E_value=4.9; Accession=PF00560.23; Description=Leucine Rich Repeat
  Pfam annotation: Domain name=LRR_1; Domain location=214-237; Score =6.1; E_value=20; Accession=PF00560.23; Description=Leucine Rich Repeat
  Pfam annotation: Domain name=LRR_1; Domain location=239-262; Score =6.2; E_value=20; Accession=PF00560.23; Description=Leucine Rich Repeat
  Pfam annotation: Domain name=LRR_1; Domain location=287-310; Score =7.4; E_value=12; Accession=PF00560.23; Description=Leucine Rich Repeat
  Pfam annotation: Domain name=LRR_1; Domain location=312-334; Score =8.1; E_value=8.7; Accession=PF00560.23; Description=Leucine Rich Repeat
  Pfam annotation: Domain name=LRR_1; Domain location=336-355; Score =5.8; E_value=24; Accession=PF00560.23; Description=Leucine Rich Repeat
  Pfam annotation: Domain name=LRR_1; Domain location=357-378; Score =4.5; E_value=42; Accession=PF00560.23; Description=Leucine Rich Repeat
  Pfam annotation: Domain name=LRR_1; Domain location=385-406; Score =12.2; E_value=1.5; Accession=PF00560.23; Description=Leucine Rich Repeat
  Pfam annotation: Domain name=LRR_1; Domain location=41-63; Score =12.8; E_value=1.1; Accession=PF00560.23; Description=Leucine Rich Repeat
  Pfam annotation: Domain name=LRR_1; Domain location=65-87; Score =14.4; E_value=0.42; Accession=PF00560.23; Description=Leucine Rich Repeat
  Pfam annotation: Domain name=LRR_1; Domain location=89-111; Score =17.9; E_value=0.037; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=113-135::142-164::166-188::17 -39::190-212::214-237::...
  Pfam module annotation: Domain location=239-262::287-310::312 -334::336-355::357-378::385-406::41-63::65-87::89-111
GNEIQGPIPGGIRNLSLLLILDLSFNSFSSSIPDCLYGLHRLKSLDLSSSNLHGTISDALGNLTSLVELDLSINQLEGNIPTCLGNLTSLVELHLSRNQLEGNIPTSLGNLCNLRVIDLSYLKLNQQVNELLEILAPCISHGLTTLVVQSSRLSGNLTDHIGAFKNIDLLDFSNNSIGGALPRSFGKLSSLRYLDLSMNKFSGNPFESLRSLSKLLSLHIDGNLFHGVVKEDDLANLTSLTEFVASGNNFTLKVGPNWIPNFQLTYLEVTSWQLGPSFPLWIQSQNQLQYVGLSNTGIFGSIPTQMWEALSQVSYLNLSRNHIHGEIGTTLKNPISIHVIDLSSNHLCGKLPYLSRDVIWLDLSSNSFSESMNDFLCNDQDEPMQLELLNLASNNLSGEIPDCWMNWTSLGD

SEQ ID NO: 149599 - protein, 139 aa, Glycine max
  Coding DNA Sequence Number=SeqID_32821
  Gene Ontology: Mol. function=protein binding; Cellular component =integral to membrane; Biological process=xylan catabolic process
  Homolog annotation: Hit_ID=Q1SWI7; Match level="QueryCoverage=82%, HitCoverage=18%, E-value=6e-43, Identity=69%"; Hit description =Leucine-rich repeat
  Pfam annotation: Domain name=LRR_1; Domain location=27-48; Score=8.5; E_value=7.5; Accession=PF00560.23; Description=Leucine Rich Repeat
  Pfam annotation: Domain name=LRR_1; Domain location=3-25; Score=18.0; E_value=0.035; Accession=PF00560.23; Description=Leucine Rich Repeat
  Pfam module annotation: Pfam domain module=LRR_1::LRR_1; Domain location=27-48::3-25
MRSLQSIDFSRNQLSGEIPPSIANLSFLSMLDLSYNHLKGNIPTGTQLETFDASSFIGNNLCGPPLPINCSSNGKTHSYEGSDGHGVNWFFVSMTIGFIVGFWIVIAPLLICRSWRGRVAERKEGKDRRCGEMELRITK

SEQ ID NO: 149600 - protein, 66 aa, Glycine max
  Coding DNA Sequence Number=SeqID_32822
MLGKRKGKSCVCLSRSGTCDYEVGGAVDGKGRVGDAHGSNCHGRRGNRWWRWEKGEGKSAVRTHAT

SEQ ID NO: 149601 - protein, 171 aa, Glycine max
  Coding DNA Sequence Number=SeqID_32823
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=34%, E-value=4e-61, Identity=85%"; Hit description=NADH -plastoquinone oxidoreductase subunit 2
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAPFKIKQFHRIKYDCMCDSI

SEQ ID NO: 149602 - protein, 199 aa, Glycine max
  Coding DNA Sequence Number=SeqID_32824
  Gene Ontology: Mol. function=chitin binding; Cellular component =extracellular region; Biological process=chitin metabolic process
  Homolog annotation: Hit_ID=UPI00006A17C9; Match level="QueryCoverage =79%, HitCoverage=98%, E-value=4e-17, Identity=32%"; Hit description =UPI00006A17C9 related cluster
MSKSCGFGMTGPLDESISCFLIRVDLGGLHVLALRGLHVLTIRGLHALTSRGLHVFALRGLHALTLGTSYPHRQRTTRPRLERTTRPHHQRAARPYLQRTTCPRLERATRPHLGGLHALTSRGLHVFALRGLHALTLGTSYPHRQRTTRPRLERTTRPHHQRAARPYLQRTTCPRLERATRPHLGYYLPSPSEDYTSSP

SEQ ID NO: 149603 - protein, 353 aa, Glycine max
  Coding DNA Sequence Number=SeqID_32825
  Gene Ontology: Mol. function=citrate transporter activity; Cellular component=integral to membrane; Biological process=potassium ion transport
  Homolog annotation: Hit_ID=Q8P630; Match level="QueryCoverage=98%, HitCoverage=56%, E-value=1e-166, Identity=83%"; Hit description =Sulfur deprivation response regulator
MADHQRERRGQQRQRHLQHPHRDAGRQLVDGMAGHPCRRTTGIHCPAEWNQPGHHEHRLPVDRGIGLVHAQHAGQQHAGHAGHQRQRHRQLAGQRDQDGQREDRHRDLELVRALLAGRVVGHHHEVTAARGLRQIGPDAVEDQHVAGAQLHVAHVLADHLLVAVDRQQADAALLAQAQVRGALADHVRGRRHHRLGNTGTARVEQVTQVLQARRHAQELVLREIVDLLARAHRTEHAADPDAHFRRRRQAGVVAGFQGQQQRGIVQVLGLAQGHAHQRAFGTDHQLEHIAFDAVGLGEVALGACGRDPVVDQVLFLDQLAVAVVAEIQQRGDQQGHADRQRCEHAQRLDGGIL

SEQ ID NO: 149604 - protein, 149 aa, Glycine max
  Coding DNA Sequence Number=SeqID_32826
MAPPKEIPTLIYHSGHIVDDPVQGSTYQCTTPIFFYASRSITFTQFIRKINNHLPTRATEQVSQLLFRVPISIHLGQTRFISAQLFDNDDLRGAMETIIQNPQLNSAEFYAVTELISQPQLSSPQPSCPQLQLPHPQQLPYNNIDLNNP

SEQ ID NO: 149605 - protein, 465 aa, Glycine max
  Coding DNA Sequence Number=SeqID_32827
  Gene Ontology: Mol. function=DNA (cytosine-5-)-methyltransferase activity; Cellular component=intracellular; Biological process=DNA restriction-modification system
  Homolog annotation: Hit_ID=P0AED9; Match level="QueryCoverage=94%, HitCoverage=93%, E-value=1e-153, Identity=62%"; Hit description=DNA -cytosine methyltransferase
  Pfam annotation: Domain name=DNA_methylase; Domain location=91-455; Score=276.2; E_value=6.4e-80; Accession=PF00145.8; Description=C-5 cytosine-specific DNA methylase
MLALDPAATASPSPHSADDDATALLLQVLDIYAARDLVVILSEAGGRDWSITQLNRIRAGKSAAPALSAAEVARLQALLPSRPAHYDNPRFQFIDLFAGIGGIRRGFEQIGGQCVFTSEWNKEAVRTYKANHYSDPALHQFNSDIRLITQPAGLPDEQAIYQHIDKTIPDHQVLLAGFPCQPFSLAGVSKKNALGRAHGFECEAQGTLFFDVARILAAKKPPFFVLENVKNLKSHDKGRTFAIIMATLDELGYDVADAADDSSPDAKVVDARHFLPQHRERIVLVGIRRDTGLSEGFSLRALAALYPPEVPPLHSLLEPEPAAKYTLSPTLWHYLYQYAKKHKAKGNGFGFGLNDPRNPHCCVRTLSARYYKDGSEILIDRGWDHALGEQDFQQAANMARRPRRLTPRECARLMGFEAPGEARFRIPVSDTQAYKQFGNSVVVPVFAAVAKLLLPLIEQHARQRR

SEQ ID NO: 149606 - protein, 260 aa, Glycine max
  Coding DNA Sequence Number=SeqID_32828
  Homolog annotation: Hit_ID=Q1T493; Match level="QueryCoverage=78%, HitCoverage=44%, E-value=2e-10, Identity=21%"; Hit description =Nucleic acid-binding, OB-fold, subgroup
MVLMICVVVMSRKENLISELHTRKGTWKIAVRITDLWQARKQNSKQTIEMNLRIVDNQSEYRVSPTPYLVYFLKTTSVKEIHRPEIPSNVYLITPFTDIISGLAPRHTLVDIVGVIVNLIDVKTVNPPHKMTIRLRDNSNCDILIIVWEDYAIQLHDAIDKNLLLQEPLVVMLTLGKIKDATDKYPLSVQNIKFGSKLYVNTDITEIHEFCQSLSVPFYSGGMINDKDGSQSQSSQSNVVEKFLQNAQVVSIGQINNLRQ

SEQ ID NO: 149607 - protein, 189 aa, Glycine max
  Coding DNA Sequence Number=SeqID_32829
  Gene Ontology: Mol. function=phosphoinositide phospholipase C activity; Biological process=intracellular signaling cascade
  Homolog annotation: Hit_ID=Q69L69; Match level="QueryCoverage=71%, HitCoverage=19%, E-value=1e-14, Identity=42%"; Hit description =Calcineurin-like phosphoesterase-like protein
MRCGECTITLQDVFVLLGHRVDGAPLIGPTNLDWADLYKELLGVRPQEGELQGSVVKLSWLAQHFSQLNNPDGDVQQLQRFTCAWILRFIGDVLFVDKSSSKVSLSAARMHRDLPCLLFYIERCAAPPITKLNQSEERCTTLVPKRTPPVIENKPLGHRWLRRGNQHISNDDLIVFHRKLDIMKRHEFL

SEQ ID NO: 149608 - protein, 227 aa, Glycine max
  Coding DNA Sequence Number=SeqID_32830
  Gene Ontology: Mol. function=oxidoreductase activity, acting on single donors with incorporation of molecular oxygen, incorporation of two atoms of oxygen; Biological process=L-phenylalanine catabolic process
  Homolog annotation: Hit_ID=Q5VRH4; Match level="QueryCoverage=92%, HitCoverage=51%, E-value=1e-102, Identity=75%"; Hit description =Homogentisate 1,2-dioxygenase
  Pfam annotation: Domain name=HgmA; Domain location=1-227; Score =266.2; E_value=6.4e-77; Accession=PF04209.4; Description =homogentisate 1,2-dioxygenase
MDNCAFCNADGDFLIVPQQGRLLITTECGRLKVSPGEIAIIPHGFRFSVNLPDGPSRGYVAEIFGTHFQLPDLGPIGANGLASPRDFLVPSAWFEDKSYPGYTIVQKFGGELFDAVQDFSPFNVVAWHVLTAPTDKPGVALLDFVIFPPRWLVAEHTFLPPYYHRNCMSEFMGLIHGGYEANADGFLPGGASLHNCMTPHGPDTKSYETSKKFLQYHIPRFTPKCKI

SEQ ID NO: 149609 - protein, 165 aa, Glycine max
  Coding DNA Sequence Number=SeqID_32831
  Gene Ontology: Mol. function=transition metal ion binding; Cellular component=chromatin; Biological process=proteolysis
MGGKGSRGLHVITPSLEELQHAHLYILNSSNGVMPYIVHLEALVKENTIFGDDNASKTLRKLADGPKRNVITWPGYDINKVSLSVESQHFATVHDDNPRLASIPYFGVIEEIWELNYVKFIVCVFKCKWVDSNIGVRTDNFGFTLVDLKKLAYRNEPFIMVEQAK

SEQ ID NO: 149610 - protein, 34 aa, Glycine max; identical to SEQ ID NO: 136953
  Coding DNA Sequence Number=SeqID_32832

SEQ ID NO: 149611 - protein, 109 aa, Glycine max
  Coding DNA Sequence Number=SeqID_32833
MTRCIALRNLVLKDIKTQRSDRMWHWDYSVVYKSKGERKDIELVEEEHARIGVDPSSETSNKSENYKEEARKKTQKHKPKRVESVIADAEAFGDDWKILIALCIVKLKH

SEQ ID NO: 149612 - protein, 139 aa, Glycine max
  Coding DNA Sequence Number=SeqID_32834
  Homolog annotation: Hit_ID=Q9FGN7; Match level="QueryCoverage=50%, HitCoverage=16%, E-value=1e-14, Identity=41%"; Hit description =Arabidopsis thaliana genomic DNA, chromosome 5, P1 clone:MFG13
MEAVAEGLWGLAEYHGKRGEIGKAVKCLEAICQSDVSFFPEVYSLLSECYHLVGAILPQNQVLHKGLELTASVGERSIVARLALYVLKKIRLARQTKQCRRSAHQEGCYVCIVTGYVKMETWDFGLAKTLKADDLASSM

SEQ ID NO: 149613 - protein, 149 aa, Glycine max
  Coding DNA Sequence Number=SeqID_32835
  Homolog annotation: Hit_ID=Q9M9W1; Match level="QueryCoverage=29%, HitCoverage=35%, E-value=4e-10, Identity=72%"; Hit description=60S ribosomal protein L22-2
  Pfam annotation: Domain name=Ribosomal_L22e; Domain location=57-132; Score=-31.2; E_value=0.0099; Accession=PF01776.7; Description =Ribosomal L22e protein family
MTYIVRRFYETALECTRGNDNDDEFICKNVVVFGPCVIGVLKDKNPSLVLITIARGERERCENERSEGEEEGREEEEGFSLEKFLQERIKVDDKAGALGNSISITKDKSNNTVTSDSNFSKRYSLRHAPLGQPIPCVQESLQLKRPSVP

SEQ ID NO: 149614 - protein, 326 aa, Glycine max
  Coding DNA Sequence Number=SeqID_32836
MVESSKKRKGSSSTTTVAGHRHDQRLWYNSQFSSRIILDPKYLDTYFFNDETFDCYQVFQNSRLIDFMSLKLPYYLELVKVFYSNLKIQDGIISSEVHGISMIIDQSLFFSLTKLPSQGAPFEGTIVDDWKFNYSSHDVRRMVCNDLAEMTDRLLARSLTFDCRIMNYIIVRILLPRSSNLAQASEEDLILMWAFLTGRQIDWAHLLYHLVLITTHFGFLMLPKGERNGVELNCHHQKGGDCRSKDFAFEVLMMPYVCDILMPYENALLKFNSRQKSKNTRYNIKKISSVLGREFQIETVKGLTKKFKQKCLIQEIYSLVIDYQRM

SEQ ID NO: 149615 - protein, 72 aa, Glycine max
  Coding DNA Sequence Number=SeqID_32837
MRILFMGQGCRFRVKLPYYFHEACATMMIWKQRAKLVMHTARWVPKHPAYGIMILRLGFYASRLLVLSFTKL

SEQ ID NO: 149616 - protein, 184 aa, Glycine max
  Coding DNA Sequence Number=SeqID_32838
  Gene Ontology: Mol. function=ribonuclease H activity; Cellular component=membrane; Biological process=DNA integration
MNGAVEATNKNIKKIIKKMTVSYKDWHEMLPFALHGYRTSVCTSTRATLFALVYGMEAMLPFEVEVPSLTILAESGLKESEWAPTRFNQLNLIEGKRLAAMSHGRLYQRWVKNAFDKKVHPCKFNEGDLVLKKVSQAQKDNRGKWAPNYEGSFVVKKTFLGGALVLASMDDEEFPSPMNSDVVK

SEQ ID NO: 149617 - protein, 138 aa, Glycine max
  Coding DNA Sequence Number=SeqID_32839
MINYNNNLSGWWRWKVEAISDVSNVAFNLCDPRIHLSESNVYLTLQGVKSLSNIGLKTIKPIHDTLHKRRILSSGRATLSIMWLNILLYLRAIMLFAITEGGEHCGPNGKGLLDLNRRFKIKRYLEMVKKKRNKMRIG

SEQ ID NO: 149618 - protein, 190 aa, Glycine max
  Coding DNA Sequence Number=SeqID_32840
  Homolog annotation: Hit_ID=UPI0000503967; Match level="QueryCoverage =90%, HitCoverage=80%, E-value=7e-07, Identity=27%"; Hit description =UPI0000503967 related cluster
MHERQSIHGAPNKSGEWRIALGNHFAWLQTHWWRMHERQSMHGAPNISGEWRIALGNHFAWLQTHWWKMHERQSIHGAPNKSGEWTIALGNHFAWLQTHWWTMHEQQSIHGAPNISGEWRIALGNHFAWLQTHWWKMHERQSIHGAPNKSGEWTIALGNHYAWLQTYWWRMHEQQSIHGVPNKTGEWRLH

SEQ ID NO: 149619 - protein, 168 aa, Glycine max
  Coding DNA Sequence Number=SeqID_32841
  Pfam annotation: Domain name=zf-CCHC; Domain location=97-114; Score =24.6; E_value=8.6e-05; Accession=PF00098.13; Description=Zinc knuckle
MWDTLQLTHEGTTDVKRNMRWNCNALIKIKKMTKKKRSIALKASSSVQEEKKEEDSDDEEYFSFFVKKFQKFIKKRRIDRRQNFNNGRKSQEDSQVLRCYKCNQIGHIKANFPSNEDWPEKSEKKRNDERRTKKAYIAWDDNDSSDGSKKEINLLTKDYESDENISQE

SEQ ID NO: 149620 - protein, 125 aa, Glycine max
  Coding DNA Sequence Number=SeqID_32842
MAKFDPEIVLEFYANAWPIEEGVRDMRSWVRGQWIPFDADALNQFLGDPLVLEAGQQCEFSQRRNRADGFDEEAIAQQLCTPRNVLPSDHNSDLPLPKCQLVYAILTRMSGHVAQVITNAIYLFA

SEQ ID NO: 149621 - protein, 124 aa, Glycine max
  Coding DNA Sequence Number=SeqID_32843
MEEQASQDSMEEQASQDSFVAHGQHPGRVRAAGANVTIKQYFGPTPRTSHTSSSIAPKDMEQLTQKIRDQLEESITEKVTRQVLALPPEPVDGRSATHVSTKENVVIWFCSLHNRLDFLKGIII

SEQ ID NO: 149622 - protein, 244 aa, Glycine max
  Coding DNA Sequence Number=SeqID_32844
  Homolog annotation: Hit_ID=Q1SP02; Match level="QueryCoverage=76%, HitCoverage=41%, E-value=3e-19, Identity=32%"; Hit description=IMP dehydrogenase/GMP reductase
CWIYEHFPSVHQCATDDTYQEASPRASWWLTSKAHMKGITGAPYRARCDALTVMDVSWLPYTEHRGVRAFELISSFQGQLRWGPMVVTARPERVVRQFGYIQSIPPPPVSARLSYDDIDDRWMHFAEHVLPMGELCLVPGQVSADYIEWFFRISHPFMIPTQAGDQPRDAPAADPEEYIQLPSPQDDYDGYEAIAQRLERVLNLRMVTAGIELYDIMQDCLTIARGGASADGSVRARQRRCKEH

SEQ ID NO: 149623 - protein, 104 aa, Glycine max
  Coding DNA Sequence Number=SeqID_32845
IAWMSGKLGRIDGDPVLRETRIWATWEYVSSVGGGQQGMVVVPGDMSRGSGDLGDVRRAPGNQQMKGTKTTKQGGLCGGWPAMNLETKMVSGNRLPGGVINYQA

SEQ ID NO: 149624 - protein, 136 aa, Glycine max
  Coding DNA Sequence Number=SeqID_32846
MSSRKRKSIGARPTAQYDTRRFHSFEAWTIYTDNVLGRHILAERKVEIYHMELDEFKAELERCNFHKRFTNLADSSIDLALVKEFYANLHSPEGPSPKQVRIRGHLIKIDADSLNTFLETLVVLAKGESLPAYSRY

SEQ ID NO: 149625 - protein, 103 aa, Glycine max
  Coding DNA Sequence Number=SeqID_32847
MVSQPTLRREGDARLAGCVFHERNTRGVATNVYLRKTSDNHSGISARQHDSKVSMTDLASAEDDVNLHVSTGLSAAINEGCRMTTLAAACHRARRLWMTKGCG

SEQ ID NO: 149626 - protein, 55 aa, Glycine max
  Coding DNA Sequence Number=SeqID_32848
MVYNNASPHQLDFGPYTSGPYNAQWNAPGLLHDKHMSRSSHIHRKMEVEEPWLGL

SEQ ID NO: 149627 - protein, 33 aa, Glycine max
  Coding DNA Sequence Number=SeqID_32849
MAYVGFHWWSVLPSFIRKDLFRNRCGFPFYSFR

SEQ ID NO: 149628 - protein, 105 aa, Glycine max
  Coding DNA Sequence Number=SeqID_32850
MVKFGGCQTHERQHKGFFLPMLIRKNQEKLHKRQHRNSMTKVVQLKFSFIFQTFIKSNQLNLGKIICVKDNFGSCIILWEFSGLGIFIHDHDIDAAELSGLASGT

SEQ ID NO: 149629 - protein, 845 aa, Glycine max
  Coding DNA Sequence Number=SeqID_32851
  Gene Ontology: Mol. function=RNA-directed DNA polymerase activity; Cellular component=chromatin; Biological process=chromatin assembly or disassembly
  Pfam annotation: Domain name=RVP_2; Domain location=73-203; Score= -34.9; E_value=0.00053; Accession=PF08284.2; Description=Retroviral aspartyl protease
  Pfam annotation: Domain name=zf-H2C2; Domain location=754-795; Score =21.0; E_value=0.00059; Accession=PF09337.1; Description=His(2) -Cys(2) zinc finger
  Pfam module annotation: Pfam domain module=RVP_2::RVT_1::zf-H2C2; Domain location=73-203::329-498::754-795
MKRLTPDEIASQRERGLCFTCDEKYHRGHKCASRVFLFLAEGDEPSETNISLPDPQPEPPDPPSPHTPSVLNDPVQAQISFNSLAGHVAPETLRFVGTLADRQVVLLVDGGSTHNFIQAELVSQLGLPCQPTLPLRVMVGNGQTLECNSLCSDVTVIIQSAQFVVDLHVLPISGANIVLGVQWLKSLSPVLTDYTTLTMQFFQHDRMVELKGDTDAHLWLLSSPQFRRLYRRQGDGVCFQITMLPPESDSVDTTSLPRELQSLLLKYEALFQHQQALPPRRDTDHHIHLLPQSSPVNVRPYRYPHFQKREIELQVDTMLQKGLIQPSSSPFSSPVLLVRKHDGSWRFCVDYRALNAVTVKDRFSIPTIDELLDELGGTCYFSKLDLLQGYHQIRMNEADIPKTAFRTHHGHYEFRVMPFGLCNAPSSFQSTMNTLFGPFLRRFVIVFFDDILVYSASFQDHLQHLEQTFQVLLQNQFVLKLSKCSFAQTQVEYLGHIVSNRGVEPVASKISVIQQWPPPRTTKALRSFLGLAGFYRRFIRGYATIAAPLVKATTSDPLQWTSITQNAFDQLKEALSTAPVLSLLDFTKPFTLETDASGVGMGAVLSQQGHPLAFFSKPFTPKLLRSSTYVRELCAITTAVKKWRQYLLGHHFTIIIDHRSLKEFLGQATNALSRLPDHNSSLTLLLSVPCLSFLEELRAQLNHSDEYNDFRRNILLYPHQYSEYSVTQDLVLYKARIWLPRDLPIIQTLLQEFHSTPTGGHAGVAKTTARILNNFYWPKLREDVTRFVALCRDCQVTKYESKKATGLLCPLPTPHRPWDDLSMDFIVGLPAYKGNTMINDTSSRG

SEQ ID NO: 149630 - protein, 106 aa, Glycine max
  Coding DNA Sequence Number=SeqID_32852
MEDCCWVRRRRASSSLSEGFEEFDINESTNLLEGKNKDADFEGSNLQLKGKKRITKGKCVSNSAPATRNPLGVEEKSPEFQEPRDLRSNPFQGGGNDAILPRKGIG

SEQ ID NO: 149631 - protein, 242 aa, Glycine max
  Coding DNA Sequence Number=SeqID_32853
  Gene Ontology: Mol. function=RNA-directed DNA polymerase activity; Cellular component=chromatin; Biological process=chromatin assembly or disassembly
MSNSSNPSDKLEDALLRLTQQQSSMTAKIDELLMRLPPLFHHTPSSTTSSQPSPSPASVHKMKLDVPRFDGSDPSGWIFKINQFFEYHDTPAHERLTIALFYMEGRALAWFQWMTSNGQLTSWPVFLQALQTRFAPSQYKDPTGALFKLTQKSTVNAYLAEFEDLANHVVGLPAPFLLRCFISGLSLEIRRDVQAMQPLTLSQAAGFARLQEDKLLDVHPSLRPRPPYPPSPTPSRNPPSLQ

SEQ ID NO: 149632 - protein, 53 aa, Glycine max
  Coding DNA Sequence Number=SeqID_32854
  Subcellular localization annotation: CTP_CleavageSite=30; ConfidenceScore=5.15e-01
MRSDFSSKAMRSESSPSGVSNHHTLKKVCMSSTPQSQPIGKMRSLLKPVRKQV

SEQ ID NO: 149633 - protein, 104 aa, Glycine max
  Coding DNA Sequence Number=SeqID_32855
MANLCYDAPLPSLNRQSIGHFPPELYAKLSKFNLITMTLVEITFQNLMAISQNCQNSNTNGNDADVAPEFSPLKIVQFGNPSQDTVDPRDGDFGGRLWRWKWEK

SEQ ID NO: 149634 - protein, 97 aa, Glycine max
  Coding DNA Sequence Number=SeqID_32856
METLEEDYGDGNGKNESRQFIEGFYHSSHNEASLITVLHLLQALKWLTSLLQLGKACMRGHVNTFNDNYEKSATGSRVYYGVHSLGFSLFLLYSCTF

SEQ ID NO: 149635 - protein, 243 aa, Glycine max
  Coding DNA Sequence Number=SeqID_32857
  Pfam annotation: Domain name=NC; Domain location=85-156; Score=27.0; E_value=4.8e-05; Accession=PF04970.4; Description=NC domain
MVSHVANAVSQSMVFCIYVSDDKVIHFTRRGQEVGTGTALDLLLISSGPAKSRESCPTCMAPQEEHGVISSCLNCFLAGGVLYRFEYAVTPALFLAKARGGTCTLAVSDSDDIVIHRAKYLLENGFGCYNVFKKNCEDFAIYCKTGLLEIGQSGQAVSIIGGPLAAALSSPLRMVTTNVYGMAATAVGVYCASRYMADIGMRPNAVKVPVEQLTTRLATGLLQVVEPQIPTNISRQSPQLVTQ

SEQ ID NO: 149636 - protein, 443 aa, Glycine max
  Coding DNA Sequence Number=SeqID_32858
  Gene Ontology: Mol. function=DNA binding; Biological process=DNA integration
  Homolog annotation: Hit_ID=Q1SLU3; Match level="QueryCoverage=95%, HitCoverage=58%, E-value=2e-39, Identity=37%"; Hit description =Integrase, catalytic region
  Pfam annotation: Domain name=zf-CCHC; Domain location=119-136; Score =15.7; E_value=0.0025; Accession=PF00098.13; Description=Zinc knuckle
  Pfam annotation: Domain name=zf-CCHC; Domain location=157-174; Score =14.7; E_value=0.0036; Accession=PF00098.13; Description=Zinc knuckle
  Pfam module annotation: Pfam domain module=RVT_2::zf-CCHC::zf-CCHC; Domain location=368-443::119-136::157-174
MTKWWNYVNYVIYVRGRGCHRDELENFRPDPICSCNTRCTCLALNIVAQRKLEDRAIQFLRGLNEQYGNVRSHVLLMDPLPEISRIFSYVAEQERQIGSNLIAANNIDMKGSLINAVKLACNYCGKTGHTENVCYKKHGVPSNNSERNKSSSHMSGKVCTYCGKMGHTIDVCYKKHGFPPGYRFSNPRSSANSLVAGDDAVTNDQTQLLEFKEIRFSPEQYKALLVLIQQSTNGNSTNMSSNLKQIASCSVDTTPAHGCDHSSKDCLPTSSEHTDNNSATPLHRSTQDRRPPTYLHDYHAFLTSAANINSASVSHPLDYSASVRHPLNFVLSYSRLSSSHRHFILSISTSIEPKTYAEASQHGCWLKAMQAELQALQTNNTWTLTDLPANKKAIRCRWVYKIKYHANGSVERYKAQLVAKGYTQMEGLDFLDTFSPVAKLTTV

SEQ ID NO: 149637 - protein, 52 aa, Glycine max
  Coding DNA Sequence Number=SeqID_32859
MGELKLECEMFNLLRELFIEERLQASAPSPPQTPPAREDNEEEATVVHETTH

SEQ ID NO: 149638 - protein, 89 aa, Glycine max
  Coding DNA Sequence Number=SeqID_32860
MDQTSSGCGVRQFKSYLLHKQEKCKHNGEYYSLIGCFHWLAIADSRLIIIYWIQKHKSNVIEGTSSISNFLSNENGNFLSFYGEVEAKD

SEQ ID NO: 149639 - protein, 136 aa, Glycine max
  Coding DNA Sequence Number=SeqID_32861
GSKGSLNCKHHEPHDEGSSIKSMLYKLLVNLRSGVFMLQIDAFTKISTAAYLRHKFCSICNMWVEKGWEWKFKWRRHLFDRELEMADCFRNDVAGSCIQIHKKDEWIWKIDPTGQYSIIKGETTNKDKFEEEKGGN

SEQ ID NO: 149640 - protein, 122 aa, Glycine max
  Coding DNA Sequence Number=SeqID_32862
  Gene Ontology: Mol. function=DNA binding; Cellular component =mitochondrion; Biological process=DNA integration
MRYRLVEKVAFALVNTTFHLCQYFQCPKITTRTNCHIAKILHKPKLLGQMMGWSIKLSKYEIAYELRGTIRAHVLADFNNELHPLLPQFKHEWWTMHVDGSSNWHGSGTSVILEGPNDVTMA

SEQ ID NO: 149641 - protein, 103 aa, Glycine max
  Coding DNA Sequence Number=SeqID_32863
MHSHNWVKVSDIHPNLFEMFHEASYFSLVKFFQLEGRFTSMMLGTKRFLNYNNCLPNVLRDRGIVFRHTLLLVALGKPIVVELTSPPSNKLASGCRDPWASRR

SEQ ID NO: 149642 - protein, 85 aa, Glycine max
  Coding DNA Sequence Number=SeqID_32864
MAPRNLYAKRSRRDAAAEGTCAAPEFASHCFRSTEQQQRFKAIKGWSFHRERCVQLRDDEYTEFQEEIARRRWTSLVTPMAKFDP

SEQ ID NO: 149643 - protein, 82 aa, Glycine max
  Coding DNA Sequence Number=SeqID_32865
MPPTRHPLDPDKSNRALGFPALITGLCQSFGVPVTPTKMIQPPITQAFIEKYCTPRQAQGDAVSTTLGSPTGGQPPGAGVDT

SEQ ID NO: 149644 - protein, 85 aa, Glycine max
  Coding DNA Sequence Number=SeqID_32866
MDAHPCQDGIHQLTLRQRKVGVMIIGQDIAEQQHHPHLGQGGHAGAHDPHPSPGSSSGKILTRPSSNTSGSPRNWLRASVSKGIH

SEQ ID NO: 149645 - protein, 114 aa, Glycine max
  Coding DNA Sequence Number=SeqID_32867
FHPSKVAAKSITLSIRQQFGQPWPTWGAIPKDHQELFFQHFKRKLVWRPEEENKIKKAFNSKASHRLFEMFKDARNENKRPYWIGDRVWNDLLSHWNALEYRSKCAQAKKKLSI

SEQ ID NO: 149646 - protein, 41 aa, Glycine max
  Coding DNA Sequence Number=SeqID_32868
MPPPPLYRIMGCLVATFSACPTPGRDDYRSVVTLSSICVRS

SEQ ID NO: 149647 - protein, 211 aa, Glycine max
  Coding DNA Sequence Number=SeqID_32869
  Homolog annotation: Hit_ID=Q9AVH2; Match level="QueryCoverage=22%, HitCoverage=16%, E-value=7e-20, Identity=97%"; Hit description =Putative senescence-associated protein
MTEGCGEGFCLANLPGDAFSLWGNFFEAKKQMMADAKVGGAGLWPRAKFRIGWPPPPPRDQFCCQDFANFWLAPRWLSLCLGGGSSWEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 149648 - protein, 130 aa, Glycine max
  Coding DNA Sequence Number=SeqID_32870
  Homolog annotation: Hit_ID=Q1STZ2; Match level="QueryCoverage=54%, HitCoverage=18%, E-value=2e-08, Identity=42%"; Hit description=IMP dehydrogenase/GMP reductase
MEGGENRDSYFVWEISKCSLDGDAGLHQLQSRPHYKTTWLPYERGAIRGRPHTFHYTRVHKAWGMSEKKDKELRGSSNGPIGGYRRWLKAYAQDLDWFPSLSTTWGMEIETLEEDEEVQALKIELEKAQT

SEQ ID NO: 149649 - protein, 303 aa, Glycine max
  Coding DNA Sequence Number=SeqID_32871
  Gene Ontology: Mol. function=transcription factor activity; Biological process=regulation of transcription, DNA-dependent
  Homolog annotation: Hit_ID=Q83R08; Match level="QueryCoverage=90%, HitCoverage=83%, E-value=6e-81, Identity=52%"; Hit description =Putative LYSR-type transcriptional regulator
  Pfam annotation: Domain name=HTH_1; Domain location=5-64; Score=68.7; E_value=1.8e-17; Accession=PF00126.17; Description=Bacterial regulatory helix-turn-helix protein, lysR family
  Pfam annotation: Domain name=LysR_substrate; Domain location=88-294; Score=87.2; E_value=4.9e-23; Accession=PF03466.10; Description=LysR substrate binding domain
  Pfam module annotation: Pfam domain module=HTH_1::LysR_substrate; Domain location=5-64::88-294
MRLNLEALLILDALDRHGSFAAAAAALFKTPSALSYMVQKLENDLDITLLDRSGHRAKFTDTGKLMLEKGRVLLRAAQDLEQQARYVENGWESEITLGIDASFPFARLLPLIDEFYRQHHHTRLRFSHEVLAGSWESLVYGCADIIIGAICEPPSRVGYAFSRLGQLDYVFAVAPQHPLAALPEPLPKDEIRQHRAVVVRDTSRVNAPQSLNLLEEQDTLTVFGFDAKLQAQLAGLGCGYLPRSLAEPYLNSGELVAKRVESERCSDVAYFGWRESASGLAAKWWRERLQRYADDGEAYPAAQ

SEQ ID NO: 149650 - protein, 182 aa, Glycine max
  Coding DNA Sequence Number=SeqID_32872
  Gene Ontology: Mol. function=hydrolase activity; Cellular component =membrane fraction; Biological process=metabolic process
  Homolog annotation: Hit_ID=Q4KDV0; Match level="QueryCoverage=100%, HitCoverage=85%, E-value=5e-79, Identity=78%"; Hit description =Hydrolase, isochorismatase family
  Pfam annotation: Domain name=Isochorismatase; Domain location=2-147; Score=-2.3; E_value=4.8e-06; Accession=PF00857.11; Description =Isochorismatase family
MAFGVANIDRQQLKNNVVGLAKAGKIFNVPTLFTSVETESFSGYIWPELLAVHPEITPIERTSMNSWEDAAFVKAVEATGRKKLVISALWTEVCLTFPALMALEAGYEVYVVTDTSGGTSVDAHERSIDRMVQAGAVPVTWQQVLLEYQRDWARKDTYDAVMALVREHSGAYGMGVDYAYTM

SEQ ID NO: 149651 - protein, 120 aa, Glycine max
  Coding DNA Sequence Number=SeqID_32873
  Gene Ontology: Mol. function=carboxypeptidase activity; Biological process=cytoskeleton organization and biogenesis
  Homolog annotation: Hit_ID=Q04219; Match level="QueryCoverage=94%, HitCoverage=15%, E-value=4e-41, Identity=62%"; Hit description=TNP2
  Pfam annotation: Domain name=Transposase_21; Domain location=1-120; Score=93.6; E_value=5.9e-25; Accession=PF02992.5; Description =Transposase family tnp2
MRWHKDRKIKDGQLRHSADSITWKTLDSKYPSFVADPRNVRLGLASDGFNPFGIMSPSNSIWSVVLVPYNLPPWMCMKDPFFMMSLLIPSLTTPRNDTDVYLQPSIEELKELWGERCSDI

SEQ ID NO: 149652 - protein, 104 aa, Glycine max
  Coding DNA Sequence Number=SeqID_32874
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=16%, E-value=3e-14, Identity=54%"; Hit description =Integrase, catalytic region
  Pfam annotation: Domain name=Chromo; Domain location=32-80; Score =21.1; E_value=0.0032; Accession=PF00385.14; Description='chromo' (CHRromatin Organisation MOdifier
MWNKGMKRNFCSDLKIIPLPLPGKDFDNRPLITPLIILKTRWVDTDNGPRLQVLVQWVGLPIDDTSWEDWASLKEEYHLEDNVIFEGTGSDRLVNMHEAQHERP

SEQ ID NO: 149653 - protein, 99 aa, Glycine max
  Coding DNA Sequence Number=SeqID_32875
MVKDQGQPIIPLIRNGMPLESQAWEKMPCLRGSTFSCFPNVVSGNPQLEFFSTNLDQGCVRPTSARVVFGRSQLGLYSIDLSRGDFRPSSSMINVANLG

SEQ ID NO: 149654 - protein, 81 aa, Glycine max
  Coding DNA Sequence Number=SeqID_32876
  Homolog annotation: Hit_ID=Q2RBL5; Match level="QueryCoverage=87%, HitCoverage=59%, E-value=9e-17, Identity=55%"; Hit description =Macrophage migration inhibitory factor family protein, expressed
MDGIFEFVMVILKGSVPISFEGNKEPAAYAEIVSMGGINPEVKRKLINTIGTILQSNLSIPRTRFFLKVFDTTLFRTKSKM

SEQ ID NO: 149655 - protein, 48 aa, Glycine max; identical to SEQ ID NO: 127988
  Coding DNA Sequence Number=SeqID_32877
  Homolog annotation: Hit_ID=Q9SCU2; Match level="QueryCoverage=79%, HitCoverage=29%, E-value=3e-08, Identity=58%"; Hit description=LS1 -like protein

SEQ ID NO: 149656 - protein, 180 aa, Glycine max
  Coding DNA Sequence Number=SeqID_32878
MNFTDCATMLYCDFRHTTELHEFPNDGCQVPRSVRYRMHKALRLHAPFPYPHLVTLFLQHFNIPLDSEPYLPIKRSFLIGAVVIESFGYRKEHDGSWVKKGAQPIDEEGHLPVGEDSSLLQKILDRFDGLQTFVGERFDALELQVDMRFDEMDSRITKVEGDVSYIHTSFDLPPPPPPSS

SEQ ID NO: 149657 - protein, 156 aa, Glycine max
  Coding DNA Sequence Number=SeqID_32879
  Subcellular localization annotation: CTP_CleavageSite=45; ConfidenceScore=5.63e-01
MNSLPSAVHVSSTFESGAPRIHCLAKFANSPFSTFIRSPMNLLPSAVHVSSTFESGAPRIDCLALFANSPFSTFIRSPMNLLPSAFHVSSTFESGAARIDCLALFANSPFSTFIRSPMNSLPSAFHASSTYESGGPRIDYQALSPVLHSPLLFGAP

SEQ ID NO: 149658 - protein, 151 aa, Glycine max
  Coding DNA Sequence Number=SeqID_32880
MKDIELVEEEQARIGADPSSGTSNKSENYKEEAWKKTQKHKPKRVESVNADAEAFAEAVEHTNKRDTGHQNLALDNKTGDSTMLKMGDSAKVVIKQDMKGREHKYGFNNNEREKPEKKRVVDDETGNKHQLDEVLRRQIETKNRCLNKRKM

SEQ ID NO: 149659 - protein, 191 aa, Glycine max
  Coding DNA Sequence Number=SeqID_32881
  Gene Ontology: Mol. function=transporter activity; Cellular component= integral to membrane; Biological process=transport
  Homolog annotation: Hit_ID=P33915; Match level="QueryCoverage=30%, HitCoverage=17%, E-value=1e-24, Identity=94%"; Hit description=Inner membrane ABC transporter permease protein yejE
MPTLFLIILLSSVVQPNFWWLLGITVLFGWMALVGVVRAEFLRTRNFDYIRAAQALGLHHHPHLTGFSRFRVTVGFPIAWRTAAAGQEQPAGAVVRHRRLSFRGRAAVAADFYWRSRRDAHRGQRPDAADPARQERFGALHPAAAAFSASELPARGYSLSRPFAAARRRTDPARHSRQQNRDDLPGADGVA

SEQ ID NO: 149660 - protein, 46 aa, Glycine max
  Coding DNA Sequence Number=SeqID_32882
MSTIILGSFRNNWEAYFNDPRPLDPERLKALQIQWAQYYLRVRDQT

SEQ ID NO: 149661 - protein, 76 aa, Glycine max
  Coding DNA Sequence Number=SeqID_32883
  Subcellular localization annotation: CTP_CleavageSite=34; ConfidenceScore=5.28e-01
MDRSVRISGFWLSVCFSRSANGLMRSSFFQILPRAQLRSVALNGWLAKSEDWLSERMKISTSQTFLINLKLRGNGY

SEQ ID NO: 149662 - protein, 64 aa, Glycine max
  Coding DNA Sequence Number=SeqID_32884
MASRGPFWTRSLAVILTSLKPGGNYPDLSFNIAHIIGDNEDDDGRKILREGPQLDKINGGQQGQ

SEQ ID NO: 149663 - protein, 115 aa, Glycine max
  Coding DNA Sequence Number=SeqID_32885
  Subcellular localization annotation: CTP_CleavageSite=51; ConfidenceScore=5.68e-01
MGFIPRPVVANMSYMPVNVSNTFVATFGGASVKTLCRNLPFGRRATRGLTSASCKKGKCAESPPTFIQGKRRKNRKRRGLRTLSVKGSGVVFMHEEGCFPCSYVFLNCDKEIRPT

SEQ ID NO: 149664 - protein, 121 aa, Glycine max
  Coding DNA Sequence Number=SeqID_32886
MTSFDLRVLLILSCKDFPFSWQRIRGPHLMQSYPPRALDRRLQEDWARDAIEGPRVLMSLRLHLQSPFLLLHSTAIDLQEVKDSIDEEDPRPTSSTWSYITIFALNDTLIFVEGDTISTVA

SEQ ID NO: 149665 - protein, 128 aa, Glycine max
  Coding DNA Sequence Number=SeqID_32887
MRARARVISEIEEVQEQMKADMEAMKEQMTTMMEAMMRMKRMMKVNAATVIAASIATEVVLTHPSDLNQVNPTVADMVGQGGEVLRRETHELPRHTVANFEPHLGYATEGQAFGGILFEPDKCTRWRK

SEQ ID NO: 149666 - protein, 66 aa, Glycine max
  Coding DNA Sequence Number=SeqID_32888
MNIRVSVIALVKALAREGMNDELSRLLQNILRSCKLNDAKVAKVLVEVNFKEGNMDVVLNVLTKMA

SEQ ID NO: 149667 - protein, 155 aa, Glycine max
  Coding DNA Sequence Number=SeqID_32889
  Gene Ontology: Mol. function=nucleic acid binding
  Homolog annotation: Hit_ID=Q1RSN0; Match level="QueryCoverage=99%, HitCoverage=26%, E-value=2e-10, Identity=28%"; Hit description=Zinc finger, CCHC-type
MIYGENVHKYYEDFKMSKHNLWVKCKEHKRSVKLLNDKLLKNQEFNGQPQDVVKLHHEIGTLKTTLSKFVSGTNNLNKLLGYCGSSSDKFGNRYDGKLSQKDPKRFVYLRKRLFLLQMSLIVRSIRRSWYLDSGCSWHMIGERCMFKCLTPYLGG

SEQ ID NO: 149668 - protein, 283 aa, Glycine max
  Coding DNA Sequence Number=SeqID_32890
  Gene Ontology: Mol. function=protein serine/threonine kinase activity; Cellular component=integral to membrane; Biological process=protein amino acid phosphorylation
  Homolog annotation: Hit_ID=Q2HSI2; Match level="QueryCoverage=91%, HitCoverage=27%, E-value=5e-62, Identity=47%"; Hit description =Protein kinase
  Pfam annotation: Domain name=LRRNT_2; Domain location=23-64; Score =23.1; E_value=0.001; Accession=PF08263.3; Description=Leucine rich repeat N-terminal domain
  Pfam annotation: Domain name=LRR_1; Domain location=114-136; Score =15.3; E_value=0.23; Accession=PF00560.23; Description=Leucine Rich Repeat
  Pfam annotation: Domain name=LRR_1; Domain location=138-166; Score =0.4; E_value=2.4e+02; Accession=PF00560.23; Description=Leucine Rich Repeat
  Pfam annotation: Domain name=LRR_1; Domain location=168-190; Score =6.1; E_value=21; Accession=PF00560.23; Description=Leucine Rich Repeat
  Pfam annotation: Domain name=LRR_1; Domain location=192-214; Score =14.0; E_value=0.55; Accession=PF00560.23; Description=Leucine Rich Repeat
  Pfam annotation: Domain name=LRR_1; Domain location=242-264; Score =12.9; E_value=1.1; Accession=PF00560.23; Description=Leucine Rich Repeat
  Pfam annotation: Domain name=LRR_1; Domain location=266-280; Score =4.3; E_value=45; Accession=PF00560.23; Description=Leucine Rich Repeat
  Pfam annotation: Domain name=LRR_1; Domain location=91-112; Score =12.6; E_value=1.3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=23-64::114-136::138 -166::168-190::192-214::242-264::266-280::91-112
MMMKNLVLFLCLCFFTLVVSETDSNDVKILNSFKRGLNNSELLPWPEEGGDPCGSPPWKYIFCNGNRVAQIQTKNLGLVGPLPPNLNELTMLENLGLQNNNLNGPLPSFKGLTNLKYIFLGHNDFDSIPVDFFEGLKSLEVLALDYNEKLNASNGGWNFPATLEDSAQLRNLSCMSCNLVGPIPGFFGDMASLSVLLLSGNNLTGEIPATLNAVPALQVLWLNNQRGEGLGGKIDVLASMVSLTSLLLRGNSFEGSVPMNIGDLVSLKDLDLNGNEFVGLIGS

SEQ ID NO: 149669 - protein, 70 aa, Glycine max
  Coding DNA Sequence Number=SeqID_32891
MGKGGSRRSLPEEHFPEEHFFRKTPEKPLPESFRKKWFIRKNSRRRALPEELSNFRKTFPKEPLLPEVIL

SEQ ID NO: 149670 - protein, 657 aa, Glycine max
  Coding DNA Sequence Number=SeqID_32892
  Gene Ontology: Mol. function=protein serine/threonine kinase activity; Cellular component=integral to membrane; Biological process=protein amino acid phosphorylation
  Homolog annotation: Hit_ID=Q2HSI2; Match level="QueryCoverage=99%, HitCoverage=68%, E-value=1e-158, Identity=61%"; Hit description =Protein kinase
  Pfam annotation: Domain name=LRRNT_2; Domain location=28-68; Score =12.4; E_value=0.043; Accession=PF08263.3; Description=Leucine rich repeat N-terminal domain
  Pfam annotation: Domain name=LRR_1; Domain location=120-142; Score =15.3; E_value=0.22; Accession=PF00560.23; Description=Leucine Rich Repeat
  Pfam annotation: Domain name=LRR_1; Domain location=96-118; Score =13.0; E_value=1; Accession=PF00560.23; Description=Leucine Rich Repeat
  Pfam annotation: Domain name=Pkinase; Domain location=311-587; Score =146.4; E_value=7.6e-41; Accession=PF00069.15; Description=Protein kinase domain
  Pfam annotation: Domain name=Pkinase_Tyr; Domain location=311-587; Score=137.7; E_value=3.2e-38; Accession=PF07714.7; Description =Protein tyrosine kinase
  Pfam module annotation: Pfam domain module=LRRNT_2::LRR_1::LRR _1::Pkinase::Pkinase_Tyr; Domain location=28-68::120-142::96-118::311- 587::311-587
MGPIPEFAASKVSYENNEFCEAKAGVMCAFEVMVLLEFLGGLGYPWILVDSWSGNDPCHGPWLGIRCNGDGKVDMIILEKFNLSGTLSPSVAKLDSLVEIRLGGNDISGTIPSNWTSLKSLTLLDLSGNNISRPLPSFGKGLKLVIDGDPHGSAPEGSLSLPGTGSSSTKGESPSTDKHNPNPSEDSSPNPKSSSSFESNNSSNGKKIVPIVVPIAGVAAAAFVLIPLYVYCFRKKKGVSEGPGSLVIHPRDASDPDNVLKIVVANNSSRSVSTVTGSGSGTMTRSGESRVIEAGNLVISVQVLRNVTKNFARENEVGRGGFGVVYKGELEDGTKIAVKRMESGVITSKALDEFQSEIAVLSKVRHRHLVSLLGYSVEGKERILVYEYMPQGALSMHLFHWKSLQLEPLSWKRRLNIALDVARGMEYLHSLAHQIFIHRDLKSSNILLGDDFRAKVSDFGLVKLAPDGKKSVVTRLAGTFGYLAPEYAVTGKVTTKADVFSFGVVLMELLTGLMALDEDRPEETQYLASWFRHIKSDKEKLMAAIDPALDIKEEMFDVVSIVAELAGHCTTREPNQRPDMSHAVNVLSPLVQKWKPLDDDTEEYAGVDYSLPLNQMVKEWQETEGKDLSYVDLQDSKSSIPERPTGLAESFTSIDGR

SEQ ID NO: 149671 - protein, 264 aa, Glycine max
  Coding DNA Sequence Number=SeqID_32893
  Gene Ontology: Mol. function=protein dimerization activity; Cellular component=nucleus; Biological process=regulation of transcription, DNA-dependent
  Homolog annotation: Hit_ID=Q1S6L7; Match level="QueryCoverage=97%, HitCoverage=55%, E-value=1e-45, Identity=46%"; Hit description=CAMP response element binding (CREB) protein
  Subcellular localization annotation: CTP_CleavageSite=49; ConfidenceScore=5.17e-01
KTVDEVWSEIHKGQQSQQQQQQQQNNNTNNNCGGGSNNNNVQNTESAPRQPTFGEMTLEDFLVKAGVVREQGGMAAMPAMPAQASAHQHMQQYGMYANNNPTMGASFVGRPVMGMAGGVDVGGGGGGNVVAPPYQAVPQGGVGGAIGDSSGYAGNGKRDVGYPPAAVPPPGVCFGGRVLNGGGGYAAVSNMGMVAPVSPVSPEGIGTGENSGGQFGMDISVLRGRKRVLDGPVEKVVERRQRRMIKNRESAARSRARKQVDIPC

SEQ ID NO: 149672 - protein, 148 aa, Glycine max
  Coding DNA Sequence Number=SeqID_32894
MKLIANLAKYKKRGEGCVKDSKYFSGGQRTKVVLSEIYQRKRRKGDGDASCNEDKEEVGTMFGELCQRSLWSFMDRDLISKEEGNDSFMSSQREGISKRHKCNYSRSFSIIMRSKQKQKRLALWQSVNVSVVGVACLAPLQNTSKVLW

SEQ ID NO: 149673 - protein, 250 aa, Glycine max
  Coding DNA Sequence Number=SeqID_32895
  Homolog annotation: Hit_ID=UPI00005F7B7A; Match level="QueryCoverage =66%, HitCoverage=88%, E-value=7e-55, Identity=64%"; Hit description =COG3009: Uncharacterized protein conserved in bacteria
  Pfam annotation: Domain name=DUF330; Domain location=51-227; Score =226.3; E_value=6.6e-65; Accession=PF03886.4; Description=Protein of unknown function (DUF330)
MKGLQPGSPAYNKLVGDMQRLDQVLRELQPVLKTLNSKSNALGETVKKGLIIGAVLLLAGCSSTIDTTYYQLPAGSNMARVSSDASASQPMIWVEQVSVPDYLAGNGLVYQTSDVKYVIAANNLWASPLDQQLQQTLVSNLGQALPGRLVASQPLGDTHDTLSVHVTGFHGRYDGKVVVSGEWLLQHQGRLIKHGFNLTLPQTEDGYDALVRTLALGWQQTAQQIANSVPDMAVALRDLCRFHGKLMTLA

SEQ ID NO: 149674 - protein, 97 aa, Glycine max
  Coding DNA Sequence Number=SeqID_32896
  Subcellular localization annotation: CTP_CleavageSite=54; ConfidenceScore=5.18e-01
MTKDVIHDHNSIASRLHFPFYFSLPVFLTLSLCLWMCFPSSFAWLFIEKSQKVQANSPKRSKLTQVNFLLSAEGTNSPRKVVACPGELNYLCLKKLD

SEQ ID NO: 149675 - protein, 232 aa, Glycine max
  Coding DNA Sequence Number=SeqID_32897
  Gene Ontology: Mol. function=RNA-directed DNA polymerase activity; Biological process=RNA-dependent DNA replication
  Homolog annotation: Hit_ID=Q1SYT5; Match level="QueryCoverage=46%, HitCoverage=76%, E-value=1e-14, Identity=40%"; Hit description=RNA -directed DNA polymerase (EC 2.7.7.49) (Clone AmLi2)-garden snapdragon-related
MESNNFFQEHFSQPEELRLGLEGVRFDSLNEENNNHLIAPFIEDEIKEEVDIVRVVMEKFPLHGRFWKSVNASFISLIPKKKVVHKVIDESQSVFVEGRNMLDSVLMANEIINDVKECLESLMIYMLVNGSMTKEFKAKRLRQGDLFAPFLFLVVAEGLEGLVRVEGDLVARFTRLLNCATMVLPFTFLSILVGADPRMDATWILILENLRKKLTPLKMPRCVDTSIKNLQR

SEQ ID NO: 149676 - protein, 141 aa, Glycine max
  Coding DNA Sequence Number=SeqID_32898
VGGEVVMENDVGKKGIVDKSALSFVWLREGGQDNGWFNEGLKRVVEGGGWGRHFVLEGGLARGGDLGMEVQLEKNIFGMGETDDGVIHESYSIGSTKEGIHTIPREQVRKLWVIIHLATILSLWLHGNEVVFKDQQPCGHE

SEQ ID NO: 149677 - protein, 153 aa, Glycine max
  Coding DNA Sequence Number=SeqID_32899
  Gene Ontology: Mol. function=transferase activity; Biological process= metabolic process
  Homolog annotation: Hit_ID=Q1SYJ0; Match level="QueryCoverage=95%, HitCoverage=56%, E-value=3e-17, Identity=33%"; Hit description =Terpenoid cylases/protein prenyltransferase alpha-alpha toroid
MKLVTLVDKHVEERFQMRRYLFLRIVDALGNHHEYFQTRFNAAGRMGFSPLQKCIVALRVWAYKSPADSVVDYVQIGANNGINVLNRSDLLNDVLQGEVSTMQYTVNGTKYNLGYHLADGKKDNYSPNNKNPLERMLSRLLECSNLDLQLYVV

SEQ ID NO: 149678 - protein, 69 aa, Glycine max
  Coding DNA Sequence Number=SeqID_32900
MEQQYSFSTLIVEETQAIVELDYCGTTEGDDVEAVAGALGAEGEKGKEGVGKDGAFEESLVLEGVGGCE

SEQ ID NO: 149679 - protein, 149 aa, Glycine max
  Coding DNA Sequence Number=SeqID_32901
  Gene Ontology: Mol. function=RNA-directed DNA polymerase activity; Cellular component=chromatin; Biological process=chromatin assembly or disassembly
MVGNGHELECYQWFREVLLRVQGQELWVNFHVLSLCGTNLVLYVEWLKSLGLLKGDRDNGTGSITADQLRCLVKTDEASDFFHLRIEPPSTQILQSMPHTPKIRALIRKFEHLFQAPTSLPSFQTTNHAINLRSNSKPVNVRPYCYPYF

SEQ ID NO: 149680 - protein, 225 aa, Glycine max
  Coding DNA Sequence Number=SeqID_32902
  Gene Ontology: Mol. function=transporter activity; Cellular component= intracellular; Biological process=transport
  Homolog annotation: Hit_ID=Q94FN1; Match level="QueryCoverage=48%, HitCoverage=22%, E-value=4e-36, Identity=59%"; Hit description =Phosphatidylinositol transfer-like protein III
  Pfam annotation: Domain name=CRAL_TRIO_N; Domain location=84-188; Score=29.2; E_value=1.5e-05; Accession=PF03765.5; Description =CRALTRIO, N-terminus
LAATKIDGSNYESNSSSVGNDGELGKGGEATNDGVEPIGERYDLVKVAGSQAVVRGTKATSLSMPPRLDPQARRVSRAYQRYNGSIHEDLNDEKKENRSDFENFEDERRTRIGSLKKKALNTSSKFKHSLEKKSSRRKSDGCVSSVSIEDVRNFKEQFLKVRKFDIERAKHMWNDMLQWRKEFGTDTIMEEAPEEFDQTIFVVQKNKSIGPIEGLALNFVKDQQR

SEQ ID NO: 149681 - protein, 158 aa, Glycine max
  Coding DNA Sequence Number=SeqID_32903
MYKAHPGATREPNPTNQRDLKTDRIAVMLLGDSLDHTSKEQPVGDHEPGTDQGVGLGSGREPVARPRPRRWRDRRRHRTRARCQGSRTGRRARCWGSQLRMPWTWNFAVNSAPVLVSRDLTLRDVTWKHGKWGVRAIHKKTQRERSWRSSLRGRGGLG

SEQ ID NO: 149682 - protein, 77 aa, Glycine max
  Coding DNA Sequence Number=SeqID_32904
  Homolog annotation: Hit_ID=Q1SAV4; Match level="QueryCoverage=94%, HitCoverage=18%, E-value=5e-07, Identity=41%"; Hit description =Integrase, catalytic region
MGRSFPRLQCRPSTLSAVDDILSDREVVFASLKKKLLKFQEHMKALADPHKRDVNFEPGEWVMVKLRPQSPLSNFGN

SEQ ID NO: 149683 - protein, 207 aa, Glycine max
  Coding DNA Sequence Number=SeqID_32905
MEIQHLNKVQFAMVRQEMESLKEMMNEILEKRSAEQTKISFPVYDGNVCQQWRAKCEQYFMLEEENRSADEVSRGKRRIIVAEKKHITIARTTRIIFSPSPKRCEVEHWNPGEENGSFSEIMSPVLYNKMGKRKENRKLQNKNPYFVLLVVAERMKPLPYRSWIRQNSDEGGKIPSLVDRPKAMDLEDTRGRPKRRTIPPIHLKDYV

SEQ ID NO: 149684 - protein, 73 aa, Glycine max
  Coding DNA Sequence Number=SeqID_32906
  Gene Ontology: Mol. function=nucleotide binding; Cellular component =protein complex; Biological process=protein polymerization
  Homolog annotation: Hit_ID=Q9M436; Match level="QueryCoverage=90%, HitCoverage=14%, E-value=2e-19, Identity=74%"; Hit description =Chloroplast FtsZ-like protein
MKFGFIQVSITLIATGFKRQEESQGRPLQVSQLTQADTTYGTNRRSSSFADGGLFEIPEFLKKKGGGSRYPRA

SEQ ID NO: 149685 - protein, 161 aa, Glycine max
  Coding DNA Sequence Number=SeqID_32907
MEARDTHPFTYHGVKALQIMHVRELKLTWLLSILHTPLPKEPTIHQLQRKCRAYIIELCWASLEVGRVMGGYAILLQSWVWYRMPFIAPSVSQHETTYPLAKRGFEEHLPKHAYRDKEIWSTCIAIICFPFVEWHQTNQVKLQFGLHQDILVDPMNLDRLH

SEQ ID NO: 149686 - protein, 96 aa, Glycine max
  Coding DNA Sequence Number=SeqID_32908
MTKSKGKDPLEGLGGPMTRARARKAKEADENHETSQIHFSLSSLLNQSQTYQGNPCGVYPDLSSFTGSGVIQTSVACIKRSTPTQVHIIWYQSFGS

SEQ ID NO: 149687 - protein, 129 aa, Glycine max
  Coding DNA Sequence Number=SeqID_32909
MLDLKCHPIPEASNEDDLDDVPVAGHEEDVGGGEKGINVDIGGGEERDVGRGEEKDVGGDEEENVGNPDDGDDNDEDKWFTDFSCMRKEVEVEYEIDGYHSEELKNHISSDYEDEDVHKVYPQQNDKGL

SEQ ID NO: 149688 - protein, 166 aa, Glycine max
  Coding DNA Sequence Number=SeqID_32910
MVTQNNESENFLLWDRECAELIGQTADGVNRVKIEDDDLDLNASPQALDKLLGHVLAFKVRIQSRFKNLVVLKYSKDLDLINAVLEMLPDSETCFKIDPSNVDCNDATHAECQFLSATADHDPVAGLPLTPKRRMSSDEANDELGSSQISPAQILSNKLTRHSHRS

SEQ ID NO: 149689 - protein, 123 aa, Glycine max
  Coding DNA Sequence Number=SeqID_32911
MKMKANKTRNGLKVSNWNTYRLKNEERMKNDEEQRKIYIDLLTETSRKHYGSTSTHFFFTEMCFLPKIAEMHSLGVMNIFLKQPPSPIYREKGRRLPPRGFLRKISKRTPITKFTPLFVLYGK

SEQ ID NO: 149690 - protein, 107 aa, Glycine max
  Coding DNA Sequence Number=SeqID_32912
MIESFQQQQQMSVLELYVEKDVAGGSMFHVANSVTSCGCNVSHHESELPRNISNLHVGEDDDDDDYLASNSYVEEFFDDDDSDDGISDTEDEVTDIVELVSVVHPSE

SEQ ID NO: 149691 - protein, 149 aa, Glycine max
  Coding DNA Sequence Number=SeqID_32913
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=97%, HitCoverage=12%, E-value=2e-38, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKEGLNIIEKNQTWELVSLPHDKKLIVLKGICKVKVNPNGEVIKHKARLVVKGFLQKLGVDYGEVYAHAAKTKISASLNGPLDEEVYAIQVSGFEIFDQEEKVLRLKKALYGLKQAPRAWNKRFDNFLSQIGFVECTSEHGMCLKVLKM

SEQ ID NO: 149692 - protein, 268 aa, Glycine max
  Coding DNA Sequence Number=SeqID_32914
  Gene Ontology: Mol. function=DNA binding; Biological process=DNA integration
MSDQESIVDYFSQVQMLVNSMKACKEEMIDQQVVDKVEELQKILEAHDGCKKKGKGKWKEGKSNESTNGQDHGKGGKGKLNDEANPTHDDRLDSNPLLLMVTTSKRDWFVRLDESTKNKVIFFMIAHKGMKSNLLSLGQLLEKGFVMKIEDNVLKVYASKKRLVLKAHLSKNRTFKVRIDVMEHECLATVVRKTSSIVAYILNRSPTKWLSGKTPEEAWVGTKPNATHFRVFGSICFRHVHNQLKRKLNDKDEQMVLVGYHFTGGYKL

SEQ ID NO: 149693 - protein, 173 aa, Glycine max
  Coding DNA Sequence Number=SeqID_32915
MGSFLKYLQHGVLFYVGMIACKTQTAIVNGEFGIKAIGNRQSNWRVPIDESAAGLVCHGSAVQHAGARRQGQIAITIGDLPCPRITNMAGGLLQNIGSSIIKAELRECTATLPSFLCFHCFAIVLHKFLSAFLLFCCCLLFLGCDLFHSLYVVCLVFSSSYYVTSLYLWYIMI

SEQ ID NO: 149694 - protein, 146 aa, Glycine max
  Coding DNA Sequence Number=SeqID_32916
MGQEKEDESQYLEGLVLDSRYGEELVLDCQSGKYSGKDNNTHGQTPSASKVHNKVEITLDYNATTEGTSVEGEDSGRERLKRHRVEVAGRVWIPDIWGQEELLKDWIDCTAFDAPLVPSRIVMARTALVEEGRRATSGGLRIENRC

SEQ ID NO: 149695 - protein, 117 aa, Glycine max
  Coding DNA Sequence Number=SeqID_32917
MADEGSSSSRTRKTQNHDPLSELSDGTRTTVQSLMLLKLGGKYNGDDVSGKRKRVASLGEQEVDQILPNNDITSVKKSKKIYDNDIEVVVNGPRMKKHRSLANIYKATKPIIHPAKE

SEQ ID NO: 149696 - protein, 50 aa, Glycine max
  Coding DNA Sequence Number=SeqID_32918
MIACKTQTAIANGEFGVNPKSPVLMAICSSIGNRQSDWRVPWYMPTSQAS

SEQ ID NO: 149697 - protein, 72 aa, Glycine max
  Coding DNA Sequence Number=SeqID_32919
MDASYMCGLYVDDNLPFLIALGKVYEGSTIVHHIPLGIDMVKDKQVPKGPTKPVDRPKPDGNPTYQMTLMIL

SEQ ID NO: 149698 - protein, 46 aa, Glycine max
  Coding DNA Sequence Number=SeqID_32920
MTIEAEAAREEPMVRRGCSGDGGTYMCGDRFYLPRAIALPAVAGHD

SEQ ID NO: 149699 - protein, 165 aa, Glycine max
  Coding DNA Sequence Number=SeqID_32921
  Gene Ontology: Mol. function=uroporphyrinogen-III synthase activity; Biological process=tetrapyrrole biosynthetic process
MRPNRCWMLQRKNRFGLVTKEFKNGIDGFIQVVARDPTIVDASGRIPCPCAKCRNRYREKSFWVEKHLYDHKFVDGYINWTLHDHVKEHRNPYVDIVMDVAYDVLNPKAEEIEEDPNPSTSKFYNLLSDVDEPLWDGCKKHMKLSGVTQLLNLKFEFNMSVSCYD

SEQ ID NO: 149700 - protein, 87 aa, Glycine max
  Coding DNA Sequence Number=SeqID_32922
MENSWPPQHLSRTDVLSQVNQLNEITLGLKSCKQKQLGHGQDNAKAREDLKVICKHLELIVKNKKFKKPKATYVLNPSKKRWGVRVE

SEQ ID NO: 149701 - protein, 198 aa, Glycine max
  Coding DNA Sequence Number=SeqID_32923
  Gene Ontology: Mol. function=kinase activity; Cellular component =cytoplasm; Biological process=carbohydrate metabolic process
  Homolog annotation: Hit_ID=Q1SU04; Match level="QueryCoverage=99%, HitCoverage=39%, E-value=8e-82, Identity=73%"; Hit description =Carbohydrate kinase, FGGY
MPELSLPQDSYFLGFDSSTQSLKATVLDSNLNIVASELVRFDSDLPHYKTKDGVYRDPSGNGRIVSPTLMWLEALDLMLQKLSKPNFDFAKCVLDPKRPLLDQLENAFSIKESPIWMDSSTTAECRAIEKAFGGALELVHVTGSHAYERFTGPQIKKIFDTRPEIYSSTERISLVSSFMARLFSLALMLPLIILMVQA

SEQ ID NO: 149702 - protein, 78 aa, Glycine max
  Coding DNA Sequence Number=SeqID_32924
METQKITKGEWKKFPTMTTEELKKLTIRKGEELKIATTTEGKEMKVKLCCGISNTHYLLLMTEHLEHEVCKTRHLQMV

SEQ ID NO: 149703 - protein, 159 aa, Glycine max
  Coding DNA Sequence Number=SeqID_32925
  Homolog annotation: Hit_ID=Q2QX94; Match level="QueryCoverage=60%, HitCoverage=11%, E-value=1e-35, Identity=70%"; Hit description=ZW18 protein, putative, expressed
MEKETKSSMTNAKDHQRRIKECSAATEEELKKLTIKKEKNAATTEGKEVKLKVNGKENARTRMDGYVPYHSARIESCQAASRDTSKKGKLFLEMLNACLDQIRANSMQRGVFMRCDVNFDASTQGKNLDSIIGRAAHIEFLDSDIFARFIMWSFPDLFR

SEQ ID NO: 149704 - protein, 300 aa, Glycine max
  Coding DNA Sequence Number=SeqID_32926
  Homolog annotation: Hit_ID=Q9SLU9; Match level="QueryCoverage=85%, HitCoverage=30%, E-value=1e-61, Identity=50%"; Hit description=ZW18 protein
MGFGGVTSLDMKNVLLVKALLTSRDILLEELQKTSKAINESLDISEFVSIMSNTKLLNFVLRANQFAINVEVVGQGKPQNGLKAGNEALDFLDVEKLHSLSQNELLDCFHSLGDQLLYLWKIFLKFHRDNKTKILGFLCDSWAKDRKAEWSIWMLYSKVEMPHHYINSKSEESSHRGVHRRVSSLWKLPDDPLQTATTRAELHRRSIEQMRINNRSVQDMQIFGDLLHTPIVIVEHVMNVPRHCPSANSLLKHIGSIDSDGLPIGLSSDTIGKKFAPQTVWICHRIQMKVVEFYTELKVL

SEQ ID NO: 149705 - protein, 231 aa, Glycine max
  Coding DNA Sequence Number=SeqID_32927
  Homolog annotation: Hit_ID=Q9SLU9; Match level="QueryCoverage=81%, HitCoverage=15%, E-value=3e-23, Identity=62%"; Hit description=ZW18 protein
MDPSSIYGVWRIDDTDNSFSTQSFRIKYARQDVHLYMMIVFNLSCSEFVGILWESNCILGSRQHLSHNPRHIYYELVLLDFGNGPNSTLQSRLGNEYGTNWLGLEYQIEDLATTAVILKFELRYAPATEVGADMQASPDDSPAAIHEFRIPPKALIGLHSYCPVHFDALHAVLVDVSIHVTLLKAASYSSALELPRKHGFRYELCYDIGLIHEHNKFLKFIGHDMDEIQHI

SEQ ID NO: 149706 - protein, 676 aa, Glycine max
  Coding DNA Sequence Number=SeqID_32928
  Gene Ontology: Mol. function=RNA binding
  Homolog annotation: Hit_ID=Q1SU11; Match level="QueryCoverage=94%, HitCoverage=95%, E-value=0.0, Identity=62%"; Hit description=KH, type 1
  Pfam annotation: Domain name=KH_1; Domain location=178-245; Score =61.9; E_value=2.1e-15; Accession=PF00013.19; Description=KH domain
  Pfam annotation: Domain name=KH_1; Domain location=326-384; Score =47.1; E_value=5.8e-11; Accession=PF00013.19; Description=KH domain
  Pfam annotation: Domain name=KH_1; Domain location=35-97; Score=58.1; E_value=2.9e-14; Accession=PF00013.19; Description=KH domain
  Pfam annotation: Domain name=KH_1; Domain location=411-478; Score =68.0; E_value=3.1e-17; Accession=PF00013.19; Description=KH domain
  Pfam annotation: Domain name=KH_1; Domain location=603-665; Score =45.7; E_value=1.5e-10; Accession=PF00013.19; Description=KH domain
  Pfam annotation: Domain name=KH_2; Domain location=178-222; Score =9.2; E_value=0.0096; Accession=PF07650.7; Description=KH domain
  Pfam annotation: Domain name=KH_2; Domain location=326-372; Score =0.1; E_value=0.12; Accession=PF07650.7; Description=KH domain
  Pfam annotation: Domain name=KH_2; Domain location=35-82; Score=3.9; E_value=0.04; Accession=PF07650.7; Description=KH domain
  Pfam module annotation: Pfam domain module=KH_1::KH_1::KH_1::KH_1::KH_ 1::KH_2::KH_2::KH_2; Domain location=178-245::326-384::35-97::411 -478::603-665::178-222::326-372::35-82
  Subcellular localization annotation: CTP_CleavageSite=41; ConfidenceScore=5.30e-01
MTSSKRPNAGPNGRGKRRRSSGGFSSLGVSPGSVVFRLLCHASRIGGVIGKGGSIISQIRQETGVKLRIEEAVPGCDERVITISGSEKETEEDNTEQGKEVNDNDDGGSEGKDREEKDDGDGNEDKREKDAVPVEDSKSEKGNSAIWKAISLVFERMVEGVEETTEGDEESNKPSSFFLRLLILTAQVGCVLGKGGSVIKRMAAESGAQIRILPKDKLPACASASDEIVQISGSVEVVRKALQSVSQQLLENPPRDHDSLSAKSTGPSSHSFGQFPPHNRSFSAQGEPFASGPHDISAFHSAAPLIPKFHEAAIHGRMRPLQEMLTFRLLCPAERVGNIIGKGGAIIKTVQQETASEIKVLEAPPDSEDCVIVISGPAHPEDRISPVQEAVFRVQTRIAKPIPDAKDHIMLARFLVSSTQIGCLLGKGGSIITEMRKKSGAHIRILGKDKVPKCASEDEEVIQVNGEIEAVHDALLQITTRLKHHCFRDSYPSVNYPSNSPFLDQLPPFPPYLGRRGLSPPRMYSDLGHPHPHAGFPLDDRPPFLNSIHRPGLPPHISERKPWGPQGILEGGIPIGLPDFPGGPPRRISGFAGGSQPIITSTTVEVVVPRAVVPVIYGEDGECLKQILQISDANITITDPKPGTVETKIIISGTPEQTHAAQSLIQAFVMSERESV

SEQ ID NO: 149707 - protein, 90 aa, Glycine max
  Coding DNA Sequence Number=SeqID_32929
  Homolog annotation: Hit_ID=Q9SLU9; Match level="QueryCoverage=68%, HitCoverage=7%, E-value=6e-18, Identity=64%"; Hit description=ZW18 protein
MPRSAKVKSVATLETVREIGVYIQRFHNLDLFKQGWYRIKITVRWEDSENMSFGIPASVVQYEGNLSKLCSGGVVRVNSVGYMLYPTQDS

SEQ ID NO: 149708 - protein, 117 aa, Glycine max
  Coding DNA Sequence Number=SeqID_32930
  Gene Ontology: Mol. function=protein transporter activity; Cellular component=nuclear pore; Biological process=protein import into nucleus, docking
  Homolog annotation: Hit_ID=Q9ZWR4; Match level="QueryCoverage=71%, HitCoverage=13%, E-value=2e-23, Identity=69%"; Hit description =Importin-beta2
MAAAGNYKIGAAHFQSLYWVQVVPNIMGAGHLLSQWVWLVMYVEASRRKYWFIVMGLLPNCMWNCPAINSIELAADIYAADDNMTEYTNCLTNGILEAYSGILEGFKGSPKTQFLMS

SEQ ID NO: 149709 - protein, 159 aa, Glycine max
  Coding DNA Sequence Number=SeqID_32931
MARKPRQDFSIQKVKFFSLLVAEYESHQEKKWAPFCSTQNGTSGKKIQKLFSSPTLLFFSLSHPPLLPIKAPNFAHHFYSKLQKEAIFGVVKRTSTLWDFKFQVWVDFFSHAKLDIKLVEMMGRVNLGLNVRMVVMTCGKAWVEQMRKMRDKGESKSHF

SEQ ID NO: 149710 - protein, 169 aa, Glycine max
  Coding DNA Sequence Number=SeqID_32932
  Gene Ontology: Mol. function=kinase activity
  Homolog annotation: Hit_ID=Q9SUG3; Match level="QueryCoverage=38%, HitCoverage=18%, E-value=3e-25, Identity=81%"; Hit description =Inositol-tetrakisphosphate 1-kinase 2 (EC 2.7.1.134) (Inositol- triphosphate 5/6-kinase ...
  Homolog annotation: Hit description=2) (EC 2.7.1.159) (Inositol 1,3,4- trisphosphate 5/6-kinase 2) (Ins(1,3,4)P(3) 5/6-kinase 2)
  Pfam annotation: Domain name=Ins134_P3_kin; Domain location=41-169; Score=-138.8; E_value=0.0011; Accession=PF05770.2; Description =Inositol 1, 3, 4-trisphosphate 56-kinase
MRLREEVACKNDDVCEKEEVVIENDVTVAQNHWCPVVNAGFSSPKRVVVVGYALTTKKIKSFLQPKLEGLARNKGILFVAIDHNRPLSDQGPFDIVLHKLSGKEWRQVLELRSRPQGSCKFISPGCKDTRIEFWLVKRESMTFHLSVLFLTPYIPILYAVVFAVLVNGI

SEQ ID NO: 149711 - protein, 56 aa, Glycine max
  Coding DNA Sequence Number=SeqID_32933
MLTVWVEIALMVATWIGQNQKIRLMVVEINLRGDGAERLRERGRAKAPENCYNPDK

SEQ ID NO: 149712 - protein, 107 aa, Glycine max
  Coding DNA Sequence Number=SeqID_32934
  Subcellular localization annotation: CTP_CleavageSite=29; ConfidenceScore=5.33e-01
MAVDLNFSLTAQACSSFAFRACTSSLSFGASASSSLTGEPIQPLCPDSQLLMIAADDPITASPKIFVLPLHRIPCLVDSLKYHRIGVTKTPCDERRDAFPNDAPLMG

SEQ ID NO: 149713 - protein, 122 aa, Glycine max
  Coding DNA Sequence Number=SeqID_32935
  Gene Ontology: Mol. function=RNA binding; Cellular component =ribonucleoprotein complex
  Homolog annotation: Hit_ID=Q1SU12; Match level="QueryCoverage=69%, HitCoverage=87%, E-value=1e-20, Identity=61%"; Hit description=50s ribosomal protein cl25, chloroplast
MSLVSSMFGCGVVMAASQAMGIGRRSDGGLTIVCSSRPQKKATAHHMKTRPRKTQAWDRNRKPTVYDPLPPLPPDWTLVIPADASSAPQLFFHVFISNQTFIICFGSINVSEFSLFRTVRMR

SEQ ID NO: 149714 - protein, 279 aa, Glycine max
  Coding DNA Sequence Number=SeqID_32936
  Gene Ontology: Mol. function=inositol tetrakisphosphate 1-kinase activity; Biological process=inositol and derivative phosphorylation
  Homolog annotation: Hit_ID=Q9SUG3; Match level="QueryCoverage=94%, HitCoverage=70%, E-value=1e-101, Identity=71%"; Hit description =Inositol-tetrakisphosphate 1-kinase 2 (EC 2.7.1.134) (Inositol- triphosphate 5/6-kinase ...
  Homolog annotation: Hit description=2) (EC 2.7.1.159) (Inositol 1,3,4- trisphosphate 5/6-kinase 2) (Ins(1,3,4)P(3) 5/6-kinase 2)
  Pfam annotation: Domain name=Ins134_P3_kin; Domain location=1-270; Score=428.1; E_value=1.2e-125; Accession=PF05770.2; Description =Inositol 1, 3, 4-trisphosphate 56-kinase
MRVESRCPLCSMTWRFIADYRLSHPEVTVLDPPDAIQHLRNRQYMLQAVADMNLSDSYGIVGVPRQLVIKRDALAIPELVNKAGLTLPLVAKPLVADGSAKSHELSLAYEHFSLQNLEPPLVLQEFVNHEAHHGKVNNKCYFIFGVGGVLFKVYIVGDAIKVVRRFSLPDVSKWELSKDAGIYRFPRVSCAAASADDADLDPTVAELPPRPLLEKLAKELRWRLGLRLFNLDIIREYGTRNHFYVIDINYFPGYGKMPEYEHIFTDFLLSLGQGKYKKK

SEQ ID NO: 149715 - protein, 106 aa, Glycine max
  Coding DNA Sequence Number=SeqID_32937
  Subcellular localization annotation: CTP_CleavageSite=29; ConfidenceScore=5.33e-01
MAVDLNFSLTAQACSSFAFRACTSSLSFGASASSSLTGEPIQPLCPDSQLLMIAADDPITASPKIFVLPLHRIPCLVDSLKYHRIGVTKTPCDERRDAFPNDAPLM

SEQ ID NO: 149716 - protein, 102 aa, Glycine max
  Coding DNA Sequence Number=SeqID_32938
  Gene Ontology: Mol. function=double-stranded RNA binding; Cellular component=intracellular
  Homolog annotation: Hit_ID=Q5YDB5; Match level="QueryCoverage=70%, HitCoverage=12%, E-value=9e-12, Identity=41%"; Hit description=C -terminal domain phosphatase-like 2
MAKTMKSFEDRIEALRGWLLPEIDPIDTVVDNEKVYKVQMEEALPLSNSHEKLVWPVVRLQERNIVLTRINPEGLSLGFWELVKFDERRSLGVLGIGEICLE

SEQ ID NO: 149717 - protein, 78 aa, Glycine max
  Coding DNA Sequence Number=SeqID_32939
  Homolog annotation: Hit_ID=Q1RYP3; Match level="QueryCoverage=53%, HitCoverage=5%, E-value=1e-11, Identity=83%"; Hit description=Cyclic nucleotide-binding; Ion transport protein
MDKDYKVFVWLNNVKTYLDKLLYLIYPLSSEIVKANRVMMEKAWAGAAYNLMLYMLASHYLGSDPRSSGNEQRSTKSS

SEQ ID NO: 149718 - protein, 39 aa, Glycine max
  Coding DNA Sequence Number=SeqID_32940
MTAAEKTNYSKCTQLDLNARAVCLSTDHESKPAAELIIR

SEQ ID NO: 149719 - protein, 92 aa, Glycine max
  Coding DNA Sequence Number=SeqID_32941
  Gene Ontology: Mol. function=voltage-gated potassium channel activity; Cellular component=membrane; Biological process=potassium ion transport
  Homolog annotation: Hit_ID=Q1RYP3; Match level="QueryCoverage=98%, HitCoverage=12%, E-value=4e-22, Identity=59%"; Hit description =Cyclic nucleotide-binding; Ion transport protein
MVSNRSKSVRFQDELETNKLMDNKESHLPMVSFDGVSDKQKGGKDAIGKSSDGRELSRVFTEDYDAAEISVLDPMGNRVNTWNKIFLAACLL

SEQ ID NO: 149720 - protein, 57 aa, Glycine max
  Coding DNA Sequence Number=SeqID_32942
MSHHQRKLCLENRVDDHGDDKEGGTSAMGASDGLWHRWPATIVVEDIPFCFFDDSAI

SEQ ID NO: 149721 - protein, 367 aa, Glycine max
  Coding DNA Sequence Number=SeqID_32943
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=8e-60, Identity=32%"; Hit description= UPI00006A17C9 related cluster
GLPVLTFRGLHALAIRGLHVFIFRGLHVFPFRGLHALAFVGLHVLTFRGLHALTIRGLHALNFRGLHVLTLRGLHAFAIGGLHVLPFKGLHVFAFRGLHVVAFRGLDVLAFRGLHALAFRGLHVLTFTFRGVQVLTFIGLHALAFRELHTLTFKGLHVLAFRGLHVLTLRGLHAFAFRGLHVLPFKGLHVLAFRGLHVLAFRGLHVLAFRGLHALAIRGLHVLTFTFRGVQVLTFIGLHAFAFRGLHILRFKGLHVLVFRGLHVLAFTGLHALAFRGLHVLTFTFRGVQDLTFIGLHAFAFRGLHVLPFKGLHVLVFRGLHVVSFRGLHALAFRGLHSLAFRGLHVLAFTFRGVQVLTFIGLHALAF

SEQ ID NO: 149722 - protein, 93 aa, Glycine max
  Coding DNA Sequence Number=SeqID_32944
MGFHPTKLNFVPSDADEAPLDVSICLHAFGIVGCGSFSGVSLANVRVLTIGSCVAYLPNGIRVASQTHSIQASLLGTLEDFKVPHVNHVSRPS

SEQ ID NO: 149723 - protein, 123 aa, Glycine max
  Coding DNA Sequence Number=SeqID_32945
MEDCLEGPHLGNHETQLQTRKWRTHEQRKAITFMGLRKRGRMEDCLEGSHLGNHETQLQTRKWRTHERKRNSWSSEKGGEWRIALRVCTQAIMKHSSKLESGGHMNQNAIHGAPEKGENGGLP

SEQ ID NO: 149724 - protein, 196 aa, Glycine max
  Coding DNA Sequence Number=SeqID_32946
  Homolog annotation: Hit_ID=Q8H6Q8; Match level="QueryCoverage=95%, HitCoverage=7%, E-value=2e-30, Identity=33%"; Hit description=CTV.20
MEPKFWDKNPFKATAKVFPPRFHFKPTAINKTRTFYKFILIDTNSMSIKHFKDPNDQSLNTHSTIQILKVLQPRHFGQNLNEVKKFSVPFDPRGYTYWDYIDAWNKVFWHQNSKFKHSWLIYFKTNTVYNFQNWFLQWWDFFGPIPEIFPKQVQQGFASFNKMYSKTEGNKQFPSLQRYAFVKWWNQFDSSKTEPD

SEQ ID NO: 149725 - protein, 273 aa, Glycine max
  Coding DNA Sequence Number=SeqID_32947
RIQGTNRLRILCPNTLEGTSFGVQVEGTSTWVVLLRTTEGTSLVDQFKWRVHPFGCSKRTKEGTSLVDLWLVKDFTRLKEISRTGGCLGTGCRHREIKDVPEVMLGKGHLVLDSYNQILTSSPRVCPRLPILDMGRKKNFKAYGPTEMHRMDKVQMIKNLFKLDTLFNNKGKLTRMYHFSNMCASFIIDPTYDHFRARHKRLPFITNNTIYDLYKLDEDTFEDRVRLTHESQVIEAIALETGAVEEVALKQAKEEVALKQLNWMPTMPKSIKF

SEQ ID NO: 149726 - protein, 72 aa, Glycine max
  Coding DNA Sequence Number=SeqID_32948
MTAHTAKSISTKVAAGVSLSEAYALSESHALSEVLSPLSELGEFGGESEKHMRAQLAQRGVVSSCSKRAQLA

SEQ ID NO: 149727 - protein, 87 aa, Glycine max
  Coding DNA Sequence Number=SeqID_32949
MVEGYYHLYAIGYTNGEEFPAPYRGRDITLVKGDSAKGLYNKTFPYFHVLGHAFGKDLATWENDEDLIIIVEGMDKEDDTNDVEVDT

SEQ ID NO: 149728 - protein, 235 aa, Glycine max
  Coding DNA Sequence Number=SeqID_32950
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=40%, HitCoverage=8%, E-value=4e-18, Identity=52%"; Hit description=Chromo
  Pfam annotation: Domain name=Tryp_alpha_amyl; Domain location=164 -234; Score=16.6; E_value=0.0019; Accession=PF00234.12; Description =Protease inhibitorseed storageLTP f
GLVKNAMGCPCCISTATIVITHASVSKTNDKIILPQKRSELRSNRSVSLNKFVIEAGETKESTYVLLGGGNRPIYNSLDLGLFGFNSFAGNDVPQDFLSTGQHGKNPMASKGYPLHGLQTKLIEKAQALISDNNPTSSSINTTIAKSQLPTKYLFSFNSDNLPCPPKSTIPPSSSPQKCPKDTLKFGLADLEAALCLCTAIKANVLGAVKVKVHVAVSLLVNACGKKVPSGFVCA

SEQ ID NO: 149729 - protein, 102 aa, Glycine max
  Coding DNA Sequence Number=SeqID_32951
MPFTGLKSARKRTAFSAFSGKRDELAKRVHQYSLCIKAFSEELAKRTYHAKRVHPLRMNTHPLAELLVPLRSLAHILAADVQLNGCCPAKPILQNLNFCNFR

SEQ ID NO: 149730 - protein, 236 aa, Glycine max
  Coding DNA Sequence Number=SeqID_32952
  Gene Ontology: Cellular component=cellulose and pectin-containing cell wall
  Homolog annotation: Hit_ID=Q9SJ54; Match level="QueryCoverage=70%, HitCoverage=79%, E-value=2e-60, Identity=62%"; Hit description =Putative harpin-induced protein
VLEDVLLTFLLWRLSLDTNGAPLDYLELDGVFSDDDSIAAGAKGDEGRAADVEVVATGDEGADLPTNPSVGSDGDEDITVTLVLAEAEEIERRDGDVGTINKRRPNIDLIVALVGRRDGGSVRDLLAPVDYVDFEAVVVNTDVVVRVARDERDLKIRSEEVRYGGVEGVDRDVLEGEGGFGGSKDCPYQKNCEQHEEEEHHYAPEHLPEDLPLLPLVVLALRHGIGRFGVVDASEK

SEQ ID NO: 149731 - protein, 320 aa, Glycine max
  Coding DNA Sequence Number=SeqID_32953
  Homolog annotation: Hit_ID=Q69UJ1; Match level="QueryCoverage=30%, HitCoverage=56%, E-value=9e-47, Identity=74%"; Hit description =Putative RNA-binding protein RBP37
  Pfam annotation: Domain name=RRM_1; Domain location=34-103; Score =42.8; E_value=1.1e-09; Accession=PF00076.12; Description=RNA recognition motif. (a.k.a. RRM, R
MLLGFTDLIAAFFEYSWVWQKKEEGRREEKAIYICIEELHLARVTEEQLAALFLNCGQVVDCRVCGDPNSILRFAFIEFTDEEGARAALNLSGTMLGYYPLRVLPSKTAIVPVNPTFLPRSEDEREMCSRTIYCTNIDKKGLRNQIWLPHRFGDVLEPTTCICPSPTTWIQGPKSLGLHTLYDWRACTIYDAMFYGNWIKCVDLGKVFGQNRHRVEGKKLVNTKGMLRAASMVSIWLKDIYWLHVMCLIKCQDDIFGYEGRCGLPTNFDSIYCYALGYGAAAFLQSGKTEEWTVGGTALTSLMDVERRHGIQCSGYFKKG

SEQ ID NO: 149732 - protein, 51 aa, Glycine max
  Coding DNA Sequence Number=SeqID_32954
YINNTLTMQQGRCTSTKEAWPLTPPGAGPDCTRLPQGHNDESGGTTRPCRS

SEQ ID NO: 149733 - protein, 190 aa, Glycine max
  Coding DNA Sequence Number=SeqID_32955
  Gene Ontology: Mol. function=hydrolase activity, acting on ester bonds; Biological process=nucleobase, nucleoside, nucleotide and nucleic acid metabolic process
  Homolog annotation: Hit_ID=Q1GZH0; Match level="QueryCoverage=69%, HitCoverage=91%, E-value=8e-46, Identity=68%"; Hit description =Putative Holliday junction resolvase
  Pfam annotation: Domain name=UPF0081; Domain location=52-185; Score =188.3; E_value=1.8e-53; Accession=PF03652.6; Description =Uncharacterised protein family (UPF0081)
MTSSPGPCNSWAWISPPCPRWLVMPDAVKHGKQPLNQSHLPITQRRYPEISGSVLAFDFGEKRIGVAIGDTLLKLAHPLLTIEAEENAAKFAQIEALLNEWQPALLIVGLPMSLEGEAHAMTALAQKFAQRLEGRFNLPVMMVDERLSSAEAAQSLREAGIKGRAQKPLLDQVAAQTILQSYFDAYHGRV

SEQ ID NO: 149734 - protein, 417 aa, Glycine max
  Coding DNA Sequence Number=SeqID_32956
  Gene Ontology: Mol. function=dihydroorotase activity; Cellular component=cytoplasm; Biological process=pyrimidine nucleotide biosynthetic process
  Homolog annotation: Hit_ID=Q1GZG7; Match level="QueryCoverage=98%, HitCoverage=96%, E-value=1e-135, Identity=58%"; Hit description =Dihydroorotase, multifunctional complex type
  Pfam annotation: Domain name=Amidohydro_1; Domain location=42-371; Score=11.7; E_value=1.3e-05; Accession=PF01979.10; Description =Amidohydrolase family
  Pfam annotation: Domain name=Amidohydro_3; Domain location=42-369; Score=-88.8; E_value=0.048; Accession=PF07969.2; Description =Amidohydrolase family
  Pfam module annotation: Pfam domain module=Amidohydro_1::Amidohydro _3; Domain location=42-371::42-369
MDASQSLDQVKDLYISAGKIVAIGEAPAGFKADQTLDASGKWVLPGLVDLCARLREPGSEYKATLLSELRAAMAGGVTSLACPPDTDPVLDEPGLVEMLKHRAKSQALAHVYPLGAVTRQLEGQLLTEMYALTAAGCVGFSQADTAIVDTQVLWRAFEYAASFGYTLFMRAEDPYLAKNGVAHDGEVASRLGLKGIPSAAESIALQTMLRIAQATGVRLHIARVSTAESVELIRQAKQSGMQVTADVSIQHLHLTDMDIGFFDGMVNLKPPVRTQRDRDALRAGLMDGTLDAVCSDHTPVDDDAKALPFAEAHPGASALELLLPLTLKWAAQAKLAPVQALQKITQTPADILGIKAGNLQLNSTADVVIYDPEMEWRVDGRVLVSQGKNTPFVHHALTGKVTATLTQGNLSSGDPLE

SEQ ID NO: 149735 - protein, 60 aa, Glycine max
  Coding DNA Sequence Number=SeqID_32957
  Gene Ontology: Cellular component=integral to membrane
  Homolog annotation: Hit_ID=Q2QLQ4; Match level="QueryCoverage=60%, HitCoverage=26%, E-value=1e-10, Identity=78%"; Hit description=Erg28 like protein, expressed
  Pfam annotation: Domain name=Erg28; Domain location=1-54; Score= -30.7; E_value=0.036; Accession=PF03694.4; Description=Erg28 like protein
  Subcellular localization annotation: CTP_CleavageSite=30; ConfidenceScore=5.16e-01
MKALGWWLIAVGTLRLASVWFGFFDIWALRLAVFSNTTTFTRKCRCSSFCVSQAIRMFPE

SEQ ID NO: 149736 - protein, 254 aa, Glycine max
  Coding DNA Sequence Number=SeqID_32958
NHVEAIIQQKSEDKRLQGKTRIYNIYFDHCWDMWVLYQLRQYSLDEERSAKRFENLKAGLETKKLGRKGLQPWTNYKPYELMDDTEENEHERDDVVVIHDGDKVEEEKSEEVEDLIDEQDKEKEEQNEDEEGRMSLLEDEGEEDTHATREKHNKENGASRVLMRVTKSLGSEFEFGGLRKVKEEEVGNSKRVGTEKQKKKILEPSNSSHHKVVDDVTDEHGSFPNVSFTKGIDDVLDFGAGSNSDSLLKTHEFD

SEQ ID NO: 149737 - protein, 317 aa, Glycine max
  Coding DNA Sequence Number=SeqID_32959
MGEIEEEQERMKAYIEAMKEQMATMMEAMMSMKKIMEVNATIVAATSAVAEGGKELGITGGPHCVQIQNKHAFLPYDLPPNYTPPNVVPTPDENVNNSTPILIKCQQPQFDHAHISQPMGETHEIPHHNLADFEPHLEYATMGQVVGGVPLPNTLEGPQFRPQPLPLHFAVGRVPPTMVEREKLDHIKERLRVIEGGGDHAFADIAELYLVPDIIIPLKFKVSDFDKFKGTTCPKNHLKLYCRKMGAYAKDEKLLMHFFQESLTRAAVTWIEVGLKRGKFDYPALINEKPGENREDEKEEGTHVVTAIPTWPNFPPA

SEQ ID NO: 149738 - protein, 856 aa, Glycine max
  Coding DNA Sequence Number=SeqID_32960
  Homolog annotation: Hit_ID=Q1SPJ4; Match level="QueryCoverage=94%, HitCoverage=50%, E-value=0.0, Identity=65%"; Hit description=Thiolase
MARFRFRRLRFLAIFVVAVVVFASDESESERELSVTDLDWNLFHQDYSPPAPPPPPPHPPSVSCVDDLGGVGTLDTTCKIVNDVNLTRDVYIAGKGNFNILPGVRFHCEIPGCMVTVNVTGNFSLGSNSSIVTGAFEFEAENAVFGNESVVNTTGMAGDPPPQTSGTPQGVEGGGGGHGGRGASCLVDTTKLPEDVWGGDAYSWASLQKPYSFGSRGGSTSKESDYGGLGGGLVRMVVHQIVEMNATVLADGADGGTKGGGGSGGSIYIKAYRMFFVSNCLCLSMLLHLGCGCLCIIITMNEMSRTGNGIISACGGNGFAGGGGGRVSVDVFSRHDEPKIYVHGGKSLGCPENAGAAGTLYDAVPRSLIVDNYNMTTDTETLLLEFPNQPLWTNVYVRNKARATVPLLWSRVQVLVFYVVMIVLAKVASLKESQVQGQISILQGGVLSFGLRHYATSEFELLAEELLMSDSVMKVYGALRMSVKMFLMWNSKMLIDGGEDVTVATSLLEASNLIVLRGASVIHSNANLGVHGQGLLNLSGPGDWIEAQRLVLSLFYSIHVGPGSVLRGPLENATTDDVTPKLYCNNEDCPYELLHPPEDCNVNSSLSFTLQICRVEDILVEGLIKGSVVHFHRARTISVESSGTISASGMGCTGGLGRGNTLTNGIGSGGGHGGTGGDAFYNDNHVEGGRSYGNATLPCELGSGSGIGNSTGSTAGGGIIVVGSLEHPLSSLSIQGSVNADGGNFEPQIRNEKFAIFDNFTGGPGGGSGGTILMFLHMLNIGQSAVLSSMGGYSSSNGSGGGGGGRIHFHWSDIPTGDVYLPIASVEGDIQICMIKEISSSGTRIGILRSWKRFKN

SEQ ID NO: 149739 - protein, 336 aa, Glycine max
  Coding DNA Sequence Number=SeqID_32961
  Gene Ontology: Mol. function=DNA binding; Cellular component =intracellular; Biological process=base-excision repair
  Homolog annotation: Hit_ID=Q1S746; Match level="QueryCoverage=89%, HitCoverage=93%, E-value=1e-130, Identity=72%"; Hit description =Putative serine esterase (DUF676), putative
  Pfam annotation: Domain name=DUF676; Domain location=70-330; Score =230.0; E_value=5.1e-66; Accession=PF05057.5; Description=Protein of unknown function (DUF676)
MDSERALTQVQEIEQEGGVGGGTNKKMEVKNETNKKKRSSYFPKFGCFRIEHDASGRGFDIEVADESGQRPTPTHLIIMVNGLVGSAQNWKFAAKQFLKRYPKDTIVHCSERNSSMLTFDGVDVMGDRLAEEVISVIKRHPSVQKISFVGHSLGGLVARYAIAKLYGRDISMELSQGNGHCESQVSDQECHDRKYEGKIAGLEPINFITSATPHLGSRGHKQVPMFCGFYSLEKAVSRVAGVFGKTGKHLFLTDSDNGKPPLLLQMVRDSEDIKFLTSSIRRRKELPKRRHLSRHEKYPHIVNVETEKSTSVVADEVHDESRVSSGSSKLDFEADK

SEQ ID NO: 149740 - protein, 695 aa, Glycine max
  Coding DNA Sequence Number=SeqID_32962
  Homolog annotation: Hit_ID=Q1SPJ4; Match level="QueryCoverage=97%, HitCoverage=46%, E-value=0.0, Identity=69%"; Hit description=Thiolase
  Pfam annotation: Domain name=GCC2_GCC3; Domain location=53-104; Score= 1.3; E_value=0.079; Accession=PF07699.3; Description=GCC2 and GCC3
GGKGKGQGGSGANGTITGKACPKGLYGTFCEVMHYFFPASIWWLAYEVRHVDYFSDSDVLECPAGTYKNVTGSDKSLCHSCPVNELPHRAVYISVRGGITETPCPYQCASDRYLMPDCYTALEELIYTFGGPWLFGLFLIGLLILLALVLSVARMKFVGVDELPGPAPTQHGSQIDHSFPFLESLNEVLETNRVEESQSHVHRMYFMGPNTFSEPWHLPHTPSEQIKDVVYESEFNTFVDEINAIAAYQWWEGAIHSVLSVLAYPLAWSWQQWRRRLKLQRLREFVRSEYDHACLRSCRSRALYEGIKVNATSDLMLAYVDFFLGGDEKRIDLPPRLHERFPMSLPFGGDGSYMAPFTLHNDNILTSLMSQSVQPTTWYRLVAGLNAQLRLVRRGRLRVTFRPVLGWLETHANPALSVHGVRIDLAWFHATSSGYCHYGLMVYALEEGYPATGGSTDGALRTEERSRVQSVNKEHLGLAISRAHLSPDGRIEDNYMRRQMHGAALDVNNLQMLDKKRDIFYLLSFILQNTKPVGHQDLVGLVISMLLLGDFSLVLLTLLQLYSISLVDVFLVLFILPFGILLPFPVGINALFSHGPRRSAGLARLYALWNLTSFMNVVVAFLCGYIHYNSQSSSSKRHPSIQPWSIMDESEWWIFPAGLVLCKLFQSQLINWHVANLEIQDRSLYSNDFELFWQS

SEQ ID NO: 149741 - protein, 1683 aa, Glycine max
  Coding DNA Sequence Number=SeqID_32963
  Gene Ontology: Mol. function=binding
  Homolog annotation: Hit_ID=Q1SPJ5; Match level="QueryCoverage=99%, HitCoverage=85%, E-value=0.0, Identity=75%"; Hit description=TPR repeat
MDPQKAFSSPDIRLSIILPNSSEAVMDTVEMKGSNGENSVSGDGNIQQLSAFKEKEANIQEEQLHERRSSRLERLRSRKPGKEESNSSCGKDPTKVVIQYLEPFISGGLGGQDTIDRDRTTVSCLGNSEYYNVSAFLRETSNNYGAYHMGHLLLEEVTRQGLTYQDAFVKFLELEKLTRHWGKERTAECNIFLAELYYDFGSCSSTGSQQLEFISETSYHLCKIIESVALDYPFHLTHALNENCFSIDSIQETSGKTINTSTESNSNLDISLLMKNSPLWSRFFWLSGRLSIVDGNRAKACEEYCIALTLLAKRENEDSLCSVPRPHCKVVKELNFDRVLDEINILKVNFLMEKSVIKMMEQEKFLECVSLLSPLLFSTQDVYPNSFSLSKTDKSDEKITSTELMAVDVLMEACQKANPMDVEMYFNCHYRKLKILMTKMGLNTCITSFKSSDQAPILSASPNFDIDSKESSSKNCSHLVADEVKALSDCISQVKKIIDQRGDSDGLFVPTRSICQMQSLLLLIMSHVANILALNKASAQVISDQAESSCFVDAAIVFCKLQHLCPTTPIKTQVDLIVATHDLLAEYGLCCLGEGGKGEEGTFLRFAIKHLLALDTKLKSSFNHKESMQCEEVSKNSLVNVSVEESKSDTLDIQMDCTKIDEINSEKKDVYEGIISKGISSCRVHDKDCKEVECENHGGAGTGSKLIKGESSINQLIECEDELSEDEWEELESKIDCALDQCFFCLYGLHLRSDSSYEDDLVVHKNTSRGDYQTKEQCADVFKYVLPYAKASSRTGLVKLRRVLRAIRKHFLQPPEDLLAGNPIDKFLDDPNLCEDKLSEEAGSDGFLESITKRMFPDVGGLAQYNATLLRRSEPYLEVYCNLYYFLALSEEMSATDKWPGFVLTKEGEEFVEQNAKLFKYDLMYNPLRFESWQRLGNIYDEEVDLLLNDGSKHVNVVGWRKNATLSERVETSRRRSRRCLLMSLALAKTSAQQCEIHELLALVYYDSLQNVVPFYDQRSALPLKDAAWMMFCENSMKHFKKAFTLKQDWLHAFYLGKLSEKLGYSHEIALSYYNKAIAWNTSAVDPVYRMHASRLKLLFKCGKQNLEILKVLSANSFNQSVKEAVTSILIGIDSSFLNTKERCIDANFVETKHEELLKLDTVWSMLFNDCLSALETCVEGDLKHFHKARYMLAQGLYKRGESGDIERAKDHLSFCFKSSRSSFTINMWEIDSTVKKGRRKTPGTAGNKKSLEVNLPESSRKFITCIRKYLLFYLKLLEETGDRCILERSYVALRADKRFSLCIEDLIPVAIGRYLKALIATMCHYQTTASGSVSSSDNVLERMFALFMEQGSLWPEICSLPEIEGSDMSESIIYGYLHEHIVLLEKNGKLETLEAINEKIRKRSKNPKFSDSNYAKVRKHASVAWCRSLVYNLAQITPLSCEFSNGIQVLNLTDGGMDNSQLLCIDLQPNELWSTAFEDPTHLEKIETKWSTILSKVKDIIIKKASDENLETANTLLRACYNFYRESSSVVLTSGLNFYLIPSQLVTQTPFNPSTAGIEALDLSIPRKLLLWAYVLSHGRCANISIVVKHCEEMSKSKMKRGSGMSPALSNTSPAPSFPGSGRNGSNSAGSIDVDSAHATTVGSVSLDIQKNLFASPQLHQCTSNDAERSNLIAHEGDPEGD

SEQ ID NO: 149742 - protein, 171 aa, Glycine max
  Coding DNA Sequence Number=SeqID_32964
  Gene Ontology: Mol. function=binding
  Homolog annotation: Hit_ID=Q1SPJ5; Match level="QueryCoverage=75%, HitCoverage=6%, E-value=1e-60, Identity=89%"; Hit description=TPR repeat
  Pfam annotation: Domain name=TPR_1; Domain location=124-157; Score =2.4; E_value=2.7; Accession=PF00515.18; Description=Tetratricopeptide repeat
  Pfam annotation: Domain name=TPR_1; Domain location=88-123; Score =15.5; E_value=0.075; Accession=PF00515.18; Description =Tetratricopeptide repeat
  Pfam module annotation: Pfam domain module=TPR_1::TPR_1; Domain location=124-157::88-123
MCDFKAEDEGSSLRGKEMSQVDWGRIYGEEFHLSQTYHEGLLKLQTKEYEMARELLESVLKDPLIANAQVDSSASDGHLLQLRRFYRFLALKNLATVFLQQDSTHYENALRCYLQAVEIDSKDSVVWNRLGTLSCSMGSLSISRWAFEQGLLCSPNNCKHLILLDLNKSFF

SEQ ID NO: 149743 - protein, 67 aa, Glycine max
  Coding DNA Sequence Number=SeqID_32965
MSRWIWTVRVYDRGDGRSRLNLFVEFELCVREENDASGIQRTRFNQDAVFTENRWARFYRILLDLKC

SEQ ID NO: 149744 - protein, 537 aa, Glycine max
  Coding DNA Sequence Number=SeqID_32966
  Gene Ontology: Mol. function=6-phosphofructokinase activity; Cellular component=6-phosphofructokinase complex; Biological process=glycolysis
  Homolog annotation: Hit_ID=Q1S726; Match level="QueryCoverage=98%, HitCoverage=97%, E-value=0.0, Identity=83%"; Hit description =Phosphofructokinase, putative
  Pfam annotation: Domain name=PFK; Domain location=97-376; Score= -24.4; E_value=1.8e-11; Accession=PF00365.10; Description =Phosphofructokinase
MASNDSDSQMKIVHGDAGYILEDVPHFADYIPNLPTYPNPLRSNPAYSVVKQYFVHMDDTVPQKVVVHKDSPRGVHFRRAGPRQKVYFKSDEVHACIVTCGGLCPGLNTVIREIVCGLSYMYGVNKVLGIDDLGKKAGIALMCFSVPDFFGGYRGFYSKNTITLTPKVVNDIHKRGGTILGTSRGGHDTGKIVDSIQDRGINQVYIIGGDGTQRGATVIYEYYLLQLGSSLMEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIEKRLKENGHMVIVIAEGAGQDLLTESMQAMDQKDASGNKLLQDVGLWISHKIKDHFARKDKMPINLKYIDPTYMIRAIPSNASDNVYCTLLAQSAVHGAMAGYTGFTVGLVNGRQTYIPFIRINERQNKVVITDRMWARLLSSTNQPSFLSPKDLEEAKKAESPTQLLEENNCNDVGDAEKEQPPKDEQESGNHTDNGIKTQN

SEQ ID NO: 149745 - protein, 245 aa, Glycine max
  Coding DNA Sequence Number=SeqID_32967
  Homolog annotation: Hit_ID=UPI0000612705; Match level="QueryCoverage =36%, HitCoverage=92%, E-value=5e-11, Identity=34%"; Hit description =UPI0000612705 related cluster
GLHALTFRGLHVLAFRGLHVLAFRGLHVLAFRGPHALAFRRLPILAFKGLHVLAIRGLHTLAFRGLHTHAFRGMHALAFRGVHILTFRGLHICALREFKFPFISSVPGPPPNPGGGPTMRAQLEEEAVVQPLCILGQDFTRAVTKKRVRIMGRAHKTPSGPGEVQQGPRVSSSGYGPLSVLQGARPPQQGIAPARHPVDPEKFNRVLGFLAAGTGRDTTTAWGWLTAGNRHTATTSRVHLSSSIK

SEQ ID NO: 149746 - protein, 1021 aa, Glycine max
  Coding DNA Sequence Number=SeqID_32968
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=97%, HitCoverage=98%, E-value=0.0, Identity=45%"; Hit description=Protein kinase
  Pfam annotation: Domain name=LRRNT_2; Domain location=32-71; Score =34.1; E_value=4.9e-07; Accession=PF08263.3; Description=Leucine rich repeat N-terminal domain
  Pfam annotation: Domain name=LRR_1; Domain location=101-123; Score =11.8; E_value=1.8; Accession=PF00560.23; Description=Leucine Rich Repeat
  Pfam annotation: Domain name=LRR_1; Domain location=125-147; Score =16.1; E_value=0.13; Accession=PF00560.23; Description=Leucine Rich Repeat
  Pfam annotation: Domain name=LRR_1; Domain location=149-171; Score =13.7; E_value=0.69; Accession=PF00560.23; Description=Leucine Rich Repeat
  Pfam annotation: Domain name=LRR_1; Domain location=173-195; Score =8.7; E_value=6.7; Accession=PF00560.23; Description=Leucine Rich Repeat
  Pfam annotation: Domain name=LRR_1; Domain location=197-221; Score =9.1; E_value=5.6; Accession=PF00560.23; Description=Leucine Rich Repeat
  Pfam annotation: Domain name=LRR_1; Domain location=223-245; Score =4.9; E_value=35; Accession=PF00560.23; Description=Leucine Rich Repeat
  Pfam annotation: Domain name=LRR_1; Domain location=248-270; Score =20.8; E_value=0.0048; Accession=PF00560.23; Description=Leucine Rich Repeat
  Pfam annotation: Domain name=LRR_1; Domain location=272-295; Score =13.1; E_value=1; Accession=PF00560.23; Description=Leucine Rich Repeat
  Pfam annotation: Domain name=LRR_1; Domain location=296-318; Score =20.3; E_value=0.007; Accession=PF00560.23; Description=Leucine Rich Repeat
  Pfam annotation: Domain name=LRR_1; Domain location=320-342; Score =13.4; E_value=0.8; Accession=PF00560.23; Description=Leucine Rich Repeat
  Pfam annotation: Domain name=LRR_1; Domain location=344-366; Score =9.7; E_value=4.5; Accession=PF00560.23; Description=Leucine Rich Repeat
  Pfam annotation: Domain name=LRR_1; Domain location=368-390; Score =5.6; E_value=26; Accession=PF00560.23; Description=Leucine Rich Repeat
  Pfam annotation: Domain name=LRR_1; Domain location=416-438; Score =6.6; E_value=16; Accession=PF00560.23; Description=Leucine Rich Repeat
  Pfam annotation: Domain name=LRR_1; Domain location=440-460; Score =9.8; E_value=4.1; Accession=PF00560.23; Description=Leucine Rich Repeat
  Pfam annotation: Domain name=LRR_1; Domain location=462-484; Score =3.9; E_value=53; Accession=PF00560.23; Description=Leucine Rich Repeat
  Pfam annotation: Domain name=LRR_1; Domain location=486-508; Score =13.5; E_value=0.79; Accession=PF00560.23; Description=Leucine Rich Repeat
  Pfam annotation: Domain name=LRR_1; Domain location=510-532; Score =9.7; E_value=4.4; Accession=PF00560.23; Description=Leucine Rich Repeat
  Pfam annotation: Domain name=LRR_1; Domain location=534-556; Score =8.9; E_value=6.1; Accession=PF00560.23; Description=Leucine Rich Repeat
  Pfam annotation: Domain name=LRR_1; Domain location=558-580; Score =17.7; E_value=0.041; Accession=PF00560.23; Description=Leucine Rich Repeat
  Pfam annotation: Domain name=LRR_1; Domain location=581-603; Score =7.1; E_value=14; Accession=PF00560.23; Description=Leucine Rich Repeat
  Pfam annotation: Domain name=Pkinase; Domain location=701-1000; Score= 159.0; E_value=1.2e-44; Accession=PF00069.15; Description=Protein kinase domain
  Pfam annotation: Domain name=Pkinase_Tyr; Domain location=701-977; Score=93.5; E_value=6.2e-25; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=32-71::101- 123::125-147::149-171::173-195::197-221::223-245::248-270::272 -295::296-318::320-342::344-366::368-390::416-438::440-460::462 -484::486-508::510-532::...
  Pfam module annotation: =534-556::558-580::581-603::701-1000::701-977
MSKLPLFMLKFPFHFLLLLSVIVPFQVFSQSENTEQTVLLSLKRELGDPPSLRSWEPSPSAPCDWAEIRCDNGSVTRLLLSRKNITTNTKNLSSTICNLKHLFKLDLSSNFISGEFPTTLYNCSDLRHLDLSDNYLAGQIPADVDRLKTLTHLNLGSNYFSGEIMPSIGNLPELQTLLLYKNNFNGTIRGEIGNLSNLEILGLAYNPKLKGAKIPLEFAKLRKLRIMWMTQCNLIGEIPEYFGNILTNLERLDLSRNNLTGSIPRSLFSLKKLKFLYLYYNSLSGVIPSPTMQGLNLTELDFSKNNLTGSIPGELGNLKSLVTLHLYSNYLSGEIPTSLSLLPSLEYFRVFNNGLSGTLPPDLGLHSRIVAVEVSENHLSGELPQHLCASGALIGFVAFSNNFSGVLPQWIGNCPSLDTIQVFNNNFSGEVPLGLWTSRNISSLVLSNNSFSGPLPSKVFWNTKRIEIANNKFSGRISIGITSAANLVYFDARNNMLSGEIPRELTHLSQLSTLMLDGNQLSGALPSEIISWKSLSTMTLSRNKLSGKIPIAMTALPSLAYLDLSQNDISGEIPPQFDRLRFVFLNLSSNQIYGKISDEFNNHAFENSFLNNPHLCAYNPNVNLPNCLTKTMPHSSNSSSKSLALILVVIIVVLLTIASLVFYMLKTQWGKRHCKHNKIETWRVTSFQRLDLTEINFLSSLTDNNLIGSGGFGKVYRIASNRPGEYFAVKKIWNRKDMDGKLEKEFMAEVEILGNIRHSNIVKLLCCYASEDSKLLVYEYMENQSLDKWLHGKKKTSPSRLSWPTRLNIAIGTAQGLCYMHHDCSPPVIHRDVKSSNILLDSEFRAKIADFGLAKMLAKLGEPHTMSALAGSFGYIPPEYAYSTKINEKVDVYSFGVVLLELVTGRNPNKAGDHACSLVEWAWEHFSEGKSITDAFDEDIKDPCYAEQMTSVFKLALLCTSSLPSTRPSTKEILQVLHRCCHSGSTRRRVGNEFNITPLLGDTRYIYSYKESNAASNNSSW

SEQ ID NO: 149747 - protein, 499 aa, Glycine max
  Coding DNA Sequence Number=SeqID_32969
  Gene Ontology: Mol. function=pectinesterase activity; Cellular component=cell wall; Biological process=cell wall modification
  Homolog annotation: Hit_ID=Q9FKF3; Match level="QueryCoverage=64%, HitCoverage=94%, E-value=1e-108, Identity=55%"; Hit description =Pectin methylesterase-like protein
  Pfam annotation: Domain name=DUF1565; Domain location=228-444; Score=- 105.6; E_value=0.039; Accession=PF07602.2; Description=Protein of unknown function (DUF1565)
  Pfam annotation: Domain name=Pectinesterase; Domain location=224-489; Score=141.1; E_value=3.1e-39; Accession=PF01095.10; Description =Pectinesterase
  Pfam module annotation: Pfam domain module=DUF1565::Pectinesterase; Domain location=228-444::224-489
MSKKKSTIDFGINDTRLSTSAHRIDIWSDVIIEVLDSGIWPKSKSFNDKGFSPPPSKGKGTYQTSKNFTCNSKIIGAKIYKAGGFFSDDDPKSVRDIDGHGTHGTPRGATTKARIVVYKVCWFDGCSDADILAAFDDAIADGVDIITVSLGGFSDENFFRDVIAIGAFHAMKNGVLTVVLSDDTVPIPANKAQLGEWYNTNVGPLDQRKSTVDPALVTAEEGAKVVKVMQDGSGEFKTITDAIKSIPSGNTKRVIIYIGAGNYNEKIKIEKTKPFVTLYGVPEKMPNLTFGGTAQQYGTVDSATLIVESDYFVAANIMISNTAPRPDPKTPGGQAVALRISGDKAAFYNCKMYGFQDTICDDRNRHFFKDCLIQGTMDYIFGSGKSLYVSTELRTLGDNGITVIVAQARKSETEDNAYSFVHCDVTGTGTGTFLGRAWMSHPRVVFAYSNMSDINSGPGADPKGRATITKQLSETEVKPYITLAMIEGSKWLLPPPTPK

SEQ ID NO: 149748 - protein, 754 aa, Glycine max
  Coding DNA Sequence Number=SeqID_32970
  Gene Ontology: Mol. function=amino acid transporter activity; Cellular component=1-2nm peptidoglycan-based cell wall; Biological process=amino acid transport
  Homolog annotation: Hit_ID=P37902; Match level="QueryCoverage=34%, HitCoverage=86%, E-value=1e-119, Identity=80%"; Hit description =Glutamate/aspartate periplasmic-binding protein precursor
  Pfam annotation: Domain name=BPD_transp_1; Domain location=345-559; Score=121.0; E_value=3.4e-33; Accession=PF00528.12; Description =Binding-protein-dependent transport s
  Pfam annotation: Domain name=NMT1; Domain location=62-255; Score= -84.3; E_value=0.09; Accession=PF09084.1; Description=NMT1THI5 like
  Pfam annotation: Domain name=SBP_bac_3; Domain location=38-268; Score= 196.7; E_value=5.4e-56; Accession=PF00497.10; Description=Bacterial extracellular solute-binding proteins, family 3
  Pfam module annotation: Pfam domain module=BPD_transp_1::NMT1::SBP _bac_3; Domain location=345-559::62-255::38-268
MQIRKVALSLLLLGAAAGAAQAEDLTGTLKKINDSGVIVVGHRESSVPFSYYDNQQKVVGYSQDYSNAIVAAIKAKLNKPDLQVKMLPITSQNRIPLLQNGTYDFECGSTTNNVERQQQAAFSDTIFIIGTRLLVKKGGDIKDFADLKGKTVVVTSGTTSEILLRKLNDEKKMDMRIISAKDHGDSFRTLETGRAVAFMMDDALLAGERAKAKKPDNWEITGTPQSKEAYGCMLRKDDAPFKQLMDDTIAKAQTSGEATKWFDTWFKQPIPPKNLNLNFELSSDRQALQTVTGRSPETGHKTPLNNLMGSLATLFLPELVMGIDWNWGIFLQQAPFGNTTYLGWLWSGFQVTVAVSCCAWIIAFLVGSFFGILRTVPNRWLSTIGTCYVELFRNIPLIVQFFFWYLVAPELVGEKLGMWFKAELDPNIQFFLSSTICLGLFTAARVCEQVRAAIQSLPRGQKNAGLAMGLTLPQTYRYVLLPNAYRVIVPPMTSEMLNLVKNSAIASTIGLVDLAAQAGKLLDYSAHAYESFTAITLAYVGINLFDSAQPALSAERHDHYAENHGGGGGVWHYLGHHSGGDALVRVRPGPLVRQTVREPVPLGAAGDGAAVVLSGGPQLPAAGAWAVAKNRYPPDLRHGGVCAHLARPIFRRAGAGHDPLAIHAAGDPAAGVPRHGAAAADPGHRAVPGYLAGLRIEPGRLLPHRPRRLGAGKLFEEKDCLMISLKNVSKWYGHFQVLTDCTTEVKKGEVVVVC

SEQ ID NO: 149749 - protein, 423 aa, Glycine max
  Coding DNA Sequence Number=SeqID_32971
  Gene Ontology: Mol. function=nucleotide binding; Cellular component =membrane; Biological process=cellular response to phosphate starvation
  Homolog annotation: Hit_ID=P0A9K3; Match level="QueryCoverage=64%, HitCoverage=75%, E-value=1e-142, Identity=93%"; Hit description=PhoH- like protein
  Pfam annotation: Domain name=DEAD; Domain location=57-209; Score= -33.0; E_value=0.0034; Accession=PF00270.19; Description=DEADDEAH box helicase
  Pfam annotation: Domain name=PhoH; Domain location=52-256; Score =522.6; E_value=4.2e-154; Accession=PF02562.7; Description=PhoH-like protein
  Pfam annotation: Domain name=UPF0054; Domain location=312-403; Score =189.1; E_value=1.1e-53; Accession=PF02130.7; Description =Uncharacterized protein family UPF0054
  Pfam module annotation: Pfam domain module=DEAD::PhoH::UPF0054; Domain location=57-209::52-256::312-403
LYVDTAPVRGQIPDIEPDQIHLAIKESRVLEQTADSVPEYGKAVNIKTKRGVIKPRTPNQAQYIANILDHDITFGIGPAGTGKTYLAVAAAVDALERQEIRRILLTRPAVEAGEKLGFLPGDLSQKVDPYLRPLYDALFEMLGFERVEKLMERNVIEVAPLAYMRGRTLNDAFVILDESQNTTIEQMKMFLTRIGFNSKAVITGDVTQIDLPRSTKSGLRHAIEVLANVEEISFNFFHSEDVVRHPVVARIVNAYEAWEEADQKRRDKLAEEHLQLACADENGLPAAAAFQRWLEAAVTPFQPESEVTIRLVDEAESHELNLTYRGKDKPTNVLSFPFEAPPGIELPLLGDLIICRQVVEQEAAEQGKSPEAHWAHMVVHGTLHLLGYDHIEDEEAEEMEALETEIMLALGYPDPYISEKEDV

SEQ ID NO: 149750 - protein, 78 aa, Glycine max
  Coding DNA Sequence Number=SeqID_32972
  Gene Ontology: Mol. function=hydrolase activity, acting on carbon -nitrogen (but not peptide) bonds; Cellular component=integral to membrane; Biological process=nitrogen compound metabolic process
  Homolog annotation: Hit_ID=P23930; Match level="QueryCoverage=96%, HitCoverage=14%, E-value=7e-12, Identity=48%"; Hit description =Apolipoprotein N-acyltransferase
  Subcellular localization annotation: CTP_CleavageSite=68; ConfidenceScore=5.52e-01
MPPNVAMLTYTQLMPLPNRPKPQAKPMPAACALRRSSNSSCKPARESRAAGQKSYGEKERVPAAPRINASSRRTRCCE

SEQ ID NO: 149751 - protein, 435 aa, Glycine max
  Coding DNA Sequence Number=SeqID_32973
  Gene Ontology: Mol. function=iron-sulfur cluster binding; Cellular component=cellular_component; Biological process=metabolic process
  Homolog annotation: Hit_ID=Q7MB63; Match level="QueryCoverage=54%, HitCoverage=49%, E-value=1e-120, Identity=87%"; Hit description=TRNA- methylthiotransferase MiaB protein
EADQLRRITINVDDVVGELNRMAGGETNPVNSVNCGHQTQQFGKGTNLVVKGRAAIGVDVLPQQIHFTHALRCELGNFQQDVIAGTAHFLAARIRHHAESAIFIAAFHDRDKSSRTFSTRLRQAIKLFDFRERDVNNRTLAAAHLINHLRQTVQRLRAKNDVHALRALANFIALLRSHTAAHANNQLRILRLQLLPASQQVKHFFLRLLTDGAGIQQQYVCVFGFLRQGIAVRAVQARIVMLWRGCDQHARHTSHARHVGCARLLRSLTDVSSRDDPCLPPSWRTNYLGHDARLYFARLSRLKHKDSQFDVVVVGGGMVGAALACGLAQQQFRVAVIERAEPAAFDASLAPDIRISAIGDAQRALPQAGNLGMAKRTRHLRRGCTGHSGAGLYGGKQRAAARAVGADATGWRNAAVSGFTAGAAGAQRRLAATAG

SEQ ID NO: 149752 - protein, 156 aa, Glycine max
  Coding DNA Sequence Number=SeqID_32974
  Homolog annotation: Hit_ID=Q1RZH8; Match level="QueryCoverage=33%, HitCoverage=5%, E-value=9e-15, Identity=71%"; Hit description =Adaptin, N-terminal
MWGDSRGTPVDHEPPHKEADVRFHLTLVTQHISPSSVSLPLERKSLSSTSIVILATCGTCTVAPSPGHVAPPSYLSEPRLNNLGSGGIVEAEAVEHDDLVTELGRQGKIHPGILNNQLTENPDHTGHNLRIRTFKILNQMLEANPNRARMRIIEEV

SEQ ID NO: 149753 - protein, 302 aa, Glycine max
  Coding DNA Sequence Number=SeqID_32975
  Gene Ontology: Cellular component=cellulose and pectin-containing cell wall
  Homolog annotation: Hit_ID=Q1SCB9; Match level="QueryCoverage=79%, HitCoverage=96%, E-value=5e-57, Identity=47%"; Hit description =Harpin-induced 1
  Pfam annotation: Domain name=Hin1; Domain location=127-265; Score =175.7; E_value=1.2e-49; Accession=PF07320.4; Description=Harpin -induced protein 1 (Hin1)
GTNLILKPLPKVVSFLFELRGQHHHHAFTHSRYTLSLTTLTHHVPHCTQQTNFKSVRTMSHLNGAYYGPSVPPPKSYHRPSRGGRDGCCCGCLSCFCGCIFDCILGLICKILTTILIIVAILGFLFWFIVRPNVLKFHVTDASLTRFDYTTNNTLHYDLALNVSIRNPNRRVGVYYDHIEAHALYQDVLFGNQTLGPFFQHHKNTTFVNPLFKGQRVTPLAGNQVEVFDKEKGSGVYTIDLKLFMVVRFKFLLFKSASVKPKIRCALHVPLKSRNATTTISPDAAFQPTECGWDYGKKWWIH

SEQ ID NO: 149754 - protein, 77 aa, Glycine max
  Coding DNA Sequence Number=SeqID_32976
  Subcellular localization annotation: CTP_CleavageSite=52; ConfidenceScore=5.23e-01
MKAKCNQRGCSPRQANLPFFFYAVMSMALYRPAFSYSNPLKDTRRPCSGIFRLSRVGKGRRFVGRDPSLYLHPSLST

SEQ ID NO: 149755 - protein, 364 aa, Glycine max
  Coding DNA Sequence Number=SeqID_32977
  Gene Ontology: Cellular component=integral to membrane; Biological process=peroxisome organization and biogenesis
  Homolog annotation: Hit_ID=Q8GZV4; Match level="QueryCoverage=97%, HitCoverage=76%, E-value=1e-109, Identity=53%"; Hit description =Amino acid transporter
  Pfam annotation: Domain name=Aa_trans; Domain location=1-352; Score =163.2; E_value=6.8e-46; Accession=PF01490.8; Description =Transmembrane amino acid transporter protein
MHVFCGLIQYGKLAGLTVGYTITSSTSLVAIKKAICFHKRGHQAYCRFSNNPFMLGFGMLQILLSQIPNFHKLTCLSTVAAITSFCYALIGSGLSLAVVVSGKGETTRVFGNKVGPGLSEADKMWRVFSALGNIALACSYATVVYDIMDTLKSYPPECKQMKKANVLGITTMTILFLLCGSLGYAAFGDDTPGNILTGFGFYEPFWLVALGNVCIVIHMIGAYQVLAQPLFRIIEMGANMAWPGSDFINKEYPTKIGSLTFSFNLFRLIWRTIYVAVVTIIAMVMPFFNEFLALLGAIGFWPLIVFFPIQMHIAQKQIKRLSFKWCLLQLLSFVCFLVSVVAAVGSIRGISKNIKKYKLFMYKQ

SEQ ID NO: 149756 - protein, 65 aa, Glycine max
  Coding DNA Sequence Number=SeqID_32978
MSPNVVREKKADDVHANRKWLPHPALLLLLLLLLLLIVARDKLDVTYENWKQVPAAQKDLIWEDI

SEQ ID NO: 149757 - protein, 305 aa, Glycine max
  Coding DNA Sequence Number=SeqID_32979
  Gene Ontology: Mol. function=protein serine/threonine kinase activity; Cellular component=integral to membrane; Biological process=multicellular organismal development
  Homolog annotation: Hit_ID=Q9FGL5; Match level="QueryCoverage=100%, HitCoverage=53%, E-value=5e-84, Identity=35%"; Hit description =Receptor protein kinase
  Pfam annotation: Domain name=LRR_1; Domain location=108-130; Score =14.6; E_value=0.36; Accession=PF00560.23; Description=Leucine Rich Repeat
  Pfam annotation: Domain name=LRR_1; Domain location=132-156; Score =4.8; E_value=36; Accession=PF00560.23; Description=Leucine Rich Repeat
  Pfam annotation: Domain name=LRR_1; Domain location=158-180; Score =0.0; E_value=2.8e+02; Accession=PF00560.23; Description=Leucine Rich Repeat
  Pfam annotation: Domain name=LRR_1; Domain location=182-204; Score =15.5; E_value=0.19; Accession=PF00560.23; Description=Leucine Rich Repeat
  Pfam annotation: Domain name=LRR_1; Domain location=206-229; Score =14.2; E_value=0.49; Accession=PF00560.23; Description=Leucine Rich Repeat
  Pfam annotation: Domain name=LRR_1; Domain location=231-253; Score =8.9; E_value=6.2; Accession=PF00560.23; Description=Leucine Rich Repeat
  Pfam annotation: Domain name=LRR_1; Domain location=255-277; Score =15.5; E_value=0.19; Accession=PF00560.23; Description=Leucine Rich Repeat
  Pfam annotation: Domain name=LRR_1; Domain location=279-301; Score =6.1; E_value=21; Accession=PF00560.23; Description=Leucine Rich Repeat
  Pfam annotation: Domain name=LRR_1; Domain location=35-59; Score=6.0; E_value=21; Accession=PF00560.23; Description=Leucine Rich Repeat
  Pfam annotation: Domain name=LRR_1; Domain location=61-82; Score=6.1; E_value=20; Accession=PF00560.23; Description=Leucine Rich Repeat
  Pfam annotation: Domain name=LRR_1; Domain location=84-105; Score =15.0; E_value=0.28; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =108-130::132-156::158-180::182-204::206-229::231-253::255-277::279 -301::35-59::61-82::84-105
MKDSLSGKYPTNWDAAGEVVPICGFTGVTCNTKGEVINLDLSGLSSLSGKFPPDICSYLPQLRVLRLGHTRLKFPIDTILNCSHLEELNMNHMSLTGTLPDFSSLKKSIRILDLSYNSFTGQFPMSVFNLTNLEELNFNENGGFNLWQLPTDIDRLKKLKFMVLTTCMVHGQIPASIGNITSLIDLELSGNFLTGQIPKELGQLKNLQQLELYYNYHLVGNIPEELGNLTELVDLDMSVNKFTGSIPASVCKLPKLQVLQLYNNSLTGEIPGEIENSTAMRMLSLYDNFLVGHVPAKLGQFSGMV

SEQ ID NO: 149758 - protein, 89 aa, Glycine max
  Coding DNA Sequence Number=SeqID_32980
  Gene Ontology: Mol. function=tryptophan synthase activity; Biological process=tryptophan metabolic process
  Homolog annotation: Hit_ID=Q06H27; Match level="QueryCoverage=65%, HitCoverage=22%, E-value=3e-12, Identity=59%"; Hit description =Tryptophan synthase alpha chain
MLWDGITLILGSEVVFVDVDGLGWVVILMFMGLALKSSCFLQLKKPQAGFNVCFSSKKVIISMKQHTLVAAIRTMEVAGLFATFTKLKK

SEQ ID NO: 149759 - protein, 580 aa, Glycine max
  Coding DNA Sequence Number=SeqID_32981
  Gene Ontology: Mol. function=protein serine/threonine kinase activity; Cellular component=integral to membrane; Biological process=multicellular organismal development
  Homolog annotation: Hit_ID=Q9FGL5; Match level="QueryCoverage=95%, HitCoverage=74%, E-value=0.0, Identity=52%"; Hit description =Receptor protein kinase
  Pfam annotation: Domain name=LRR_1; Domain location=122-144; Score =17.2; E_value=0.058; Accession=PF00560.23; Description=Leucine Rich Repeat
  Pfam annotation: Domain name=LRR_1; Domain location=145-164; Score =2.4; E_value=1e+02; Accession=PF00560.23; Description=Leucine Rich Repeat
  Pfam annotation: Domain name=LRR_1; Domain location=2-24; Score=8.0; E_value=9.2; Accession=PF00560.23; Description=Leucine Rich Repeat
  Pfam annotation: Domain name=LRR_1; Domain location=26-47; Score=9.4; E_value=5; Accession=PF00560.23; Description=Leucine Rich Repeat
  Pfam annotation: Domain name=LRR_1; Domain location=50-72; Score=8.8; E_value=6.4; Accession=PF00560.23; Description=Leucine Rich Repeat
  Pfam annotation: Domain name=LRR_1; Domain location=74-96; Score =15.0; E_value=0.28; Accession=PF00560.23; Description=Leucine Rich Repeat
  Pfam annotation: Domain name=LRR_1; Domain location=98-120; Score =10.7; E_value=2.8; Accession=PF00560.23; Description=Leucine Rich Repeat
  Pfam annotation: Domain name=Pkinase; Domain location=270-550; Score =186.0; E_value=8.9e-53; Accession=PF00069.15; Description=Protein kinase domain
  Pfam annotation: Domain name=Pkinase_Tyr; Domain location=270-550; Score=71.1; E_value=3.5e-18; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=122 -144::145-164::2-24::26-47::50-72::74-96::98-120::270-550::270-550
MVLLRFRVSNNRLEGSIPAGLLGLPHVSIIDLSSNNFTGPVPEINGNSRNLSELFLQRNKISGVINPTISKAINLVKIDFSYNLLSGPIPAEIGNLRKLNLLMLQGNKLSSSIPGSLSSLESLNLLDLSNNLLTGSIPESLSVLLPNSINFSHNLLSGPIPPKLIKGGLVESFAGNPGLCVLPVYANSSDQKFPMCASAHYKSKKINTIWIAGVSVVLIFIGSALFLKRWCSKDTAAVEHEDTLSSSYFYYDVKSFHKISFDQREIIESLVDKNIMGHGGSGTVYKIELKSGDIVAVKRLWSHSSKDSAPEDRLFVDKALKAEVETLGSVRHKNIVKLYCCFSSYDFSLLVYEYMPNGNLWDSLHKGWILLDWPTRYRIALGIAQGLAYLHHDLLLPIIHRDIKSTNILLDVDYQPKVADFGIAKVLQARGGKDSTTTVIAGTYGYLAPEFAYSSRATTKCDVYSFGVILMELLTGKKPVEAEFGENRNIVFWVSNKVEGKEGARPSEVLDPKLSCSFKEDMVKVLRIAIRCTYKAPTSRPTMKEVVQLLIEAEPRGSDSCKLSTKDVSNVTVIKKPYEL

SEQ ID NO: 149760 - protein, 76 aa, Glycine max
  Coding DNA Sequence Number=SeqID_32982
MGAKYLEAVKQRLHAIKQWSPDEIRESTKLPTSRELHDHKMPLLEGSNPINKRSYSPVVLVGQKDGSWRLLDKWPQ

SEQ ID NO: 149761 - protein, 57 aa, Glycine max
  Coding DNA Sequence Number=SeqID_32983
MWSKNVREHLKGAMSMLLPFGSVVYEHNNMLMKSAMQELMKKNHLTTVFWPTPCERN

SEQ ID NO: 149762 - protein, 206 aa, Glycine max
  Coding DNA Sequence Number=SeqID_32984
  Gene Ontology: Mol. function=structural molecule activity; Cellular component=protein complex; Biological process=microtubule-based movement
  Homolog annotation: Hit_ID=Q53M52; Match level="QueryCoverage=85%, HitCoverage=39%, E-value=3e-87, Identity=89%"; Hit description =Tubulin alpha-2 chain
  Pfam annotation: Domain name=Tubulin; Domain location=79-206; Score =108.4; E_value=2.1e-29; Accession=PF00091.15; Description =TubulinFtsZ family, GTPase domain
MAFKAGIQSGKVGHKRSDPSCQTRVKQTLKMRECISIHIGQAGIQVGNACWELYCLEHGIQPDGQMPSDKTVGGGDDAFNTFFSETGAGKHVPRAVFVDLEPTVIDEVRTGAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQ

SEQ ID NO: 149763 - protein, 102 aa, Glycine max
  Coding DNA Sequence Number=SeqID_32985
MTEVLSELRGLCTYVGERFDSLDGRFEGMDTRITQLEEDVTYLRRKDFAFDVLMMPYDHDVLMPYENALLKFNSRQKSKNTRYNIKKISSVLGREFQTETAK

SEQ ID NO: 149764 - protein, 639 aa, Glycine max
  Coding DNA Sequence Number=SeqID_32986
  Homolog annotation: Hit_ID=Q54455; Match level="QueryCoverage=99%, HitCoverage=63%, E-value=0.0, Identity=70%"; Hit description=Surface layer protein
MAIINDLRSSVATDSATVTQQHGFEYDIGTSLLYKTAASLTATAAGGNATGTVNTGASHQISNAETAVLTDVQLNANAASIVNLKFADHLANLTINGTSAATVNLSDNGVNPGVDITVNNGNVILNASSGNDDVIVTSTANIATGTGDFNLGNGNDSLKWAGNAATGAANTVGAGISANGGAGTDSISANFITKTVVTNQNALGVRTSTVTSNAHNFSNFEQIDLTGYIGKSVGTLITTPLIGSPTTTSVTTPNNTFDFGLTNGTSTVEGTTGGTVTQNAAATNLGTQGFVVSGLANVNVINAAGGNAAQLAVKGDATAASTLNFTFVQNATNHFDINFDAVSSANVNAGAITLNSSSSLIGGTALSTVNVASGGTGSFDNILSLAGTNAQVQTINVTGDHALDLTVGSGFSNVRDINASTNTAGLNLDSSHGGTGDGIIIQLLNILPLSVVTTNLLAPVLTALGLNGYQMTVEGSSAADTLGVIGNTTLTGGAGANTYDIKASNTQAGVTIKDFNSLKDSIVDVNHGGLTISDDASGTAVANYGTRSADTLDALLGTLVGGLTNGVIGLLGGILGLDSSNSLTSKVGVASVVFSGGGNTASSYVIIDNNDNHSLDLNDTVVYLTGQNHQQLVDTLHYA

SEQ ID NO: 149765 - protein, 162 aa, Glycine max
  Coding DNA Sequence Number=SeqID_32987
  Gene Ontology: Mol. function=RNA-directed DNA polymerase activity; Cellular component=chromatin; Biological process=RNA-dependent DNA replication
MDKQKVKAIEEWGVPVTELRSVLGLLNSSGKCQRAFEDLKRAVTEEPVLRLPDYTVPFEVHTEASDYAIGRVLVQEGHPVAYESRKLNETERRGNLKEKIPQLIVQLAEASRELELERKKKELADETVRRDEMIKSASRLATRIKNAVERKKERTGAILEDC

SEQ ID NO: 149766 - protein, 48 aa, Glycine max
  Coding DNA Sequence Number=SeqID_32988
  Gene Ontology: Mol. function=nucleoside-triphosphatase activity; Cellular component=membrane
  Homolog annotation: Hit_ID=Q9C7G2; Match level="QueryCoverage=97%, HitCoverage=10%, E-value=5e-13, Identity=59%"; Hit description=ATP -dependent RNA helicase, putative
MTGQDDIEKLVSKLEDKVCVFSPPPPNCRRIIVATNIAETSLTVDGVV

SEQ ID NO: 149767 - protein, 65 aa, Glycine max
  Coding DNA Sequence Number=SeqID_32989
MALTAESLPYSSRSRDVSEFNLREWAHCKQVQAITVGNAYLQNGLALNSKWNESERYVCNPLSGE

SEQ ID NO: 149768 - protein, 259 aa, Glycine max
  Coding DNA Sequence Number=SeqID_32990
  Gene Ontology: Cellular component=mitochondrion
  Homolog annotation: Hit_ID=Q10G00; Match level="QueryCoverage=72%, HitCoverage=24%, E-value=8e-34, Identity=46%"; Hit description =Expressed protein
MCVPSSPYSVVALAINKDEFTTLKAGLRRVKFFADYVSTGRAKKASSKDEGSDGRSSNRSEDFENRYTSNVDSLDNDAAIKSEVNEEDSCVRHSLSYETLASGNYVGGSPYSGSTINGKDECWIYYSSQKSDYGGAHVENYNTCDQVEHQNSKHRILSWRKRKLHFRSSKVKGELLLKKHGEEGGHDIDYDRRLLSSSDDYTSGKILGKASGGGVIPVSAVLADKDVMICIQPGQHGSPLFVRSCEDTELSFLLEPGIL

SEQ ID NO: 149769 - protein, 83 aa, Glycine max
  Coding DNA Sequence Number=SeqID_32991
  Subcellular localization annotation: CTP_CleavageSite=35; ConfidenceScore=5.16e-01
MLAEALFMEHDLNFHRGGKPTTAATVSSGRRSKVSSEGVQAFPRGVTRVVERGGECIDKEEGKLRGKRSYVTRVVERGVELIH

SEQ ID NO: 149770 - protein, 85 aa, Glycine max
  Coding DNA Sequence Number=SeqID_32992
  Gene Ontology: Mol. function=ATP-dependent helicase activity; Cellular component=cytoplasm; Biological process=regulation of translation
  Homolog annotation: Hit_ID=Q53RP3; Match level="QueryCoverage=55%, HitCoverage=9%, E-value=9e-15, Identity=77%"; Hit description =DEAD/DEAH box helicase, putative
MHDTFTLFCMAPCLVGLPSEIFYADKLMSPEFQPSIEQLIHFLPTTRQILMFSATFPVTVKDFKDRNFLKPVEGMGFEDLSKYGS

SEQ ID NO: 149771 - protein, 312 aa, Glycine max
  Coding DNA Sequence Number=SeqID_32993
  Gene Ontology: Mol. function=zinc ion binding; Biological process =cell redox homeostasis
  Homolog annotation: Hit_ID=O22197; Match level="QueryCoverage=91%, HitCoverage=92%, E-value=5e-83, Identity=55%"; Hit description =Expressed protein
  Pfam annotation: Domain name=zf-C3HC4; Domain location=189-229; Score= 41.2; E_value=3.5e-09; Accession=PF00097.15; Description=Zinc finger, C3HC4 type (RING finger)
  Pfam annotation: Domain name=zf-MIZ; Domain location=185-232; Score= -13.8; E_value=0.08; Accession=PF02891.10; Description=MIZ zinc finger
  Pfam module annotation: Pfam domain module=zf-C3HC4::zf-MIZ; Domain location=189-229::185-232
MELFLLVLCPSSLLLRLRPVRLGRRDVVCPSCNLGFVHELNDIVHVNPFDLFGMDNNEERDQRLGLMETFSAFMRHQMADRGRSHDIRVRTDSNPEHSASFAPLLIFGGHIPFRLSRHGGFEALFNGAPGIGLTQGNTGDYFIGPGLEELFEQLSANNRQGPLPASRSSIDAMPTIKIVQRHLRSDSHCPVCKDKFELGSKARQMPCNHLYHSDCIVPWLVQHNSCPVCRQELPPQGLSSSNGGANGRSRSARVSSSGRESHGRRNPFSFLWPFRSSHSSSNDEATGSSTPTPTIPENSHHHHAGYSGWPFE

SEQ ID NO: 149772 - protein, 64 aa, Glycine max
  Coding DNA Sequence Number=SeqID_32994
MVDAFHRRFYSVARKVTYMELAATKHMRGKPFETYLARTESLRDIGGKTTGRLVCRPAINAFLS

SEQ ID NO: 149773 - protein, 142 aa, Glycine max
  Coding DNA Sequence Number=SeqID_32995
  Gene Ontology: Mol. function=acid phosphatase activity; Cellular component=extracellular region; Biological process=chitin metabolic process
  Homolog annotation: Hit_ID=UPI000044A8F0; Match level="QueryCoverage =97%, HitCoverage=99%, E-value=9e-17, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=62; ConfidenceScore=5.41e-01
MWSPLKVRTRSPLKARACSPLKSRKCHLLKARACSPRKVRACSPLKARACSPLKAKMCNPLTARAFSPLKVRACSPQKVRTCSPLKVRKSSPPKVRTCSPLKVKACSSLKARVCSPLKARACSPLKVRKCSPLKARACSPLK

SEQ ID NO: 149774 - protein, 71 aa, Glycine max
  Coding DNA Sequence Number=SeqID_32996
  Homolog annotation: Hit_ID=Q8H885; Match level="QueryCoverage=94%, HitCoverage=7%, E-value=4e-28, Identity=88%"; Hit description =Putative mitotic control protein dis3
MLTNKYCGSLEPMPMPAGSGGIAHALFVSKDCRIPNIRIQTRQLENLLDKRIIVAVESWDRQSRYPSGHYV

SEQ ID NO: 149775 - protein, 64 aa, Glycine max
  Coding DNA Sequence Number=SeqID_32997
LHTLQSHTSSSLYFSNSDHAIGIGLIAFSIEMTNKVKGKGKEVAGKGYAGKRKGAFDDDKTGGG

SEQ ID NO: 149776 - protein, 70 aa, Glycine max
  Coding DNA Sequence Number=SeqID_32998
MEKIIIMFVLKAEVTITKLNEERRRNTQEKDLLLRQEELNNLLFRISQISPLGVHSWLLEDAISNKYLLI

SEQ ID NO: 149777 - protein, 99 aa, Glycine max
  Coding DNA Sequence Number=SeqID_32999
MDKFDVAWPGAQPSPSRGGGASAAQEPEPEEPAAAVEGEVELTPPKPFYFDAGVHMAQEEETATTLILEPSPAPIPDDAIPSAPAPELEQPISQIHQLL

SEQ ID NO: 149778 - protein, 120 aa, Glycine max
  Coding DNA Sequence Number=SeqID_33000
MVNEECKEVSVSSKRLPKKESHFAIKTNIKETSLLRQPPHLLLCKRKLVSTTIPLELEVNSQVKELLDKGLVHKSLNCCALLVPKIVIKGVPRIQENKGVEGRRPEFQEYLDLRSNPLQG

SEQ ID NO: 149779 - protein, 209 aa, Glycine max
  Coding DNA Sequence Number=SeqID_33001
  Homolog annotation: Hit_ID=Q2HTK5; Match level="QueryCoverage=64%, HitCoverage=65%, E-value=8e-11, Identity=29%"; Hit description=H+ -transporting two-sector ATPase, alpha/beta subunit, central region
MLGKYPRLYSISEQQHHEVQQMGSAAEGVWEWSFRRRRNLLKSELEMASNFMQVGNIQPKVHMVCQVGRVRFMEDESAQQGSALCMETGSGQEDASHIFFQCPKVLPMWWECLSWVQIKSFFPADPAHHFLQHPDCHLPGLIQNRWHTLWASLTWCIWYQRNKLGFSGEAFDGQRVLEQALFFCWLWLKNFERNFNIPFHYWSSNIKTG

SEQ ID NO: 149780 - protein, 416 aa, Glycine max
  Coding DNA Sequence Number=SeqID_33002
  Gene Ontology: Mol. function=transferase activity, transferring phosphorus-containing groups; Cellular component=membrane; Biological process=two-component signal transduction system (phosphorelay)
  Homolog annotation: Hit_ID=Q9C5U2; Match level="QueryCoverage=93%, HitCoverage=32%, E-value=1e-129, Identity=62%"; Hit description =Histidine kinase
  Pfam annotation: Domain name=HATPase_c; Domain location=3-84; Score =61.2; E_value=3.4e-15; Accession=PF02518.16; Description=Histidine kinase-, DNA gyrase B-, and HSP90-like ATPase
  Pfam annotation: Domain name=Response_reg; Domain location=257-392; Score=102.5; E_value=1.2e-27; Accession=PF00072.14; Description =Response regulator receiver domain
  Pfam module annotation: Pfam domain module=HATPase_c::Response_reg; Domain location=3-84::257-392
GTNEPEIIQLLVIVEDTGIGIPTDAQSRIFTPFMQADSSTSRTYGGTGIGLSISRCLVDLMGGEIGFVSEPGIGSTFSFTGTFRKGESTSLDAMRQNNHFGSEFQELRTLVVDRRKIRAEVTKYHLQRLGMSVDVTYSLNSACSCLSNVCNMSMLAMILIDKDAWDKEYHILYTIKKRRQNGIKGDPLNLPKIFLLATHLSSNEQDELKSVGVIDDILMKPLWFSSLIQCYRESLGTENKRVNRKKVSKLGNLLIDKQILVVDDNAVNRRVAKGVLQKYGAKVTAVESGRAALKMLELPHNFDACFMDLQMPEMDGFEATRKIRCLESEVNEKIACGQASAEMFGNISYWHIPILAMTADSTQSSNEECIKCGMNDYVSKPFEEEQLYMAMARFFKPETMSVFQPIESKTNPAHDT

SEQ ID NO: 149781 - protein, 143 aa, Glycine max
  Coding DNA Sequence Number=SeqID_33003
  Gene Ontology: Mol. function=hydrolase activity, hydrolyzing O -glycosyl compounds; Cellular component=membrane; Biological process =carbohydrate metabolic process
  Homolog annotation: Hit_ID=Q9FKH4; Match level="QueryCoverage=75%, HitCoverage=91%, E-value=1e-36, Identity=63%"; Hit description =Similarity to beta-1
  Pfam annotation: Domain name=X8; Domain location=29-109; Score=154.9; E_value=2e-43; Accession=PF07983.3; Description=X8 domain
MATFMLKLVLPLLFLSMIPPKTAYAEFEQWCVADEQTTDSELQAALDWACGKGGADCSKIQVNQPCYLPNTLKGHASYAFNSYYQKFKHSGGSCYFRGASITTEVDPSSMVVLLVPDQANLGGRTQINLVPLPQVVLDTFWSN

SEQ ID NO: 149782 - protein, 615 aa, Glycine max
  Coding DNA Sequence Number=SeqID_33004
  Gene Ontology: Mol. function=transferase activity, transferring phosphorus-containing groups; Cellular component=membrane; Biological process=two-component signal transduction system (phosphorelay)
  Homolog annotation: Hit_ID=Q8L8I6; Match level="QueryCoverage=79%, HitCoverage=48%, E-value=0.0, Identity=74%"; Hit description =Cytokinin receptor
  Pfam annotation: Domain name=CHASE; Domain location=248-472; Score =295.6; E_value=9.4e-86; Accession=PF03924.4; Description=CHASE domain
  Pfam annotation: Domain name=HisKA; Domain location=533-598; Score =84.8; E_value=2.7e-22; Accession=PF00512.15; Description=His Kinase A (phosphoacceptor) domain
  Pfam module annotation: Pfam domain module=CHASE::HisKA; Domain location=248-472::533-598
MNSNKVVLFVLCLTKFIMQILSNCIDERRLQMLLGSGMVSTPQLMCPENQELQKEHTCVVDTVEPIEQCPILDDYVQTRLELSFPLKNYVSLALRSALSTDLNTVQSWELRVSAIRYHVSSSNLIKGCWWVIGIIMSYFCLLWRSQKQKLVQGHPGAQQKQLKHFPRGPSRGTGRWRKKLLVIFVSLGIIGSFWLFWHLNTGIMQRREETLANMCDERARMLQDQFNVSMNHVHALAILVSTFHHGKHPSAIDQKIFGEYTESTAFERPLTSGVAYALKVLHSDRMHFEKQHGWTIKKMETENEALVQDCIPEKLDPAPIQDEYAPVIFAQETVSHIVSIDMMSGKEDHENILRARASGKGVLTSPFKLLKSNHLGVVLTFAVYNTNLPLDATPEQRTEATVGYLGASYDVPSLVDKLLHQLASKQTIVVNVYDTTNASAPITMYGTDVADTGLLHISSLDFGDPLRKHEMHCRFKQRPPLPWTAINASVGVFVITLLLGHIFYAAINRIAKVEADYRQMRELKVRAEAADVAKSQFLATVSHEIRTPMNGVLGMLQMLMDTELDENQMDCAQTAHKSGKDLISVISEVLDQAKIEAGKLELEAVAFDPRAILDE

SEQ ID NO: 149783 - protein, 524 aa, Glycine max
  Coding DNA Sequence Number=SeqID_33005
  Gene Ontology: Mol. function=unfolded protein binding; Cellular component=mitochondrion; Biological process=protein folding
  Homolog annotation: Hit_ID=Q9S7E7; Match level="QueryCoverage=86%, HitCoverage=57%, E-value=0.0, Identity=79%"; Hit description =Putative heat-shock protein
  Pfam annotation: Domain name=HSP90; Domain location=21-516; Score =590.0; E_value=2.3e-174; Accession=PF00183.9; Description=Hsp90 protein
MAGKGIHQGSMALQSRFFQFDSTIYDRIIFSLSEVHRFQIVEVDDDTTTEGKKDDQDDKTEKKKKTKTVVERYWDWELTNETQPIWLRNPKEVTKEEYNEFYKKTFNEYLEPLASSHFTTEGEVEFRSILYVPAFAPSGKDDIINPKTKNIRLFVKRVFISDDFDGELFPRYLSFVKGVVDSNDLPLNVSREILQESRVVRIMRKRLVRKAFDMILGISMSENREDYEKFWENFGKHLKLGCIEDRENHKRIAPLLRFFSSQSDEELIGLDEYVENMKPDQKDIYYIAADSVTSAKNTPFLEKLAEKDLEVLFLVDPIDEVAIQNLKSYKEKNFVDISKEDLDLGDKNEEKEKEMKQEFGQTCDWIKKRLGDKVASVQISNRLSSSPCVLVSGKFGWSANMERLMKAQSMGDASSLEFMRSRRVFEINPDHSIIRNLDAAFKTNSDDEDALRAIDLLYDAALVSSGFTPDNPAQLGGKIYEMMGMALTGKWSTPGQFQSTVNQPHTPEIVEAEVVEPTEAGGQK

SEQ ID NO: 149784 - protein, 567 aa, Glycine max
  Coding DNA Sequence Number=SeqID_33006
  Gene Ontology: Mol. function=zinc ion binding
  Homolog annotation: Hit_ID=Q84N37; Match level="QueryCoverage=90%, HitCoverage=100%, E-value=0.0, Identity=86%"; Hit description =Potyvirus VPg interacting protein
  Pfam annotation: Domain name=DUF1423; Domain location=71-550; Score =948.9; E_value=2.1e-282; Accession=PF07227.2; Description=Protein of unknown function (DUF1423)
  Pfam annotation: Domain name=PHD; Domain location=225-287; Score =13.8; E_value=0.0024; Accession=PF00628.19; Description=PHD-finger
  Pfam module annotation: Pfam domain module=DUF1423::PHD; Domain location=71-550::225-287
  Subcellular localization annotation: CTP_CleavageSite=16; ConfidenceScore=5.14e-01
MLPPQQQSRVGGLQTSLSLVSSDPRLSPEEPRSNSDNLRESPTESASSRETWPTADAIAAKKMENGKAEMDCPDQSVIRCVSSADKISLQDIARERVDIICEKMHHLPDEFLEELKNGLRVILEGGNGSQHREEFFILQKLVQSRSDLTAKTLIRAHRVQLEILVAINSGIQGFLHPSISLSQTSLIEIFVYKRCRNIACQNQLPAEDCTCETCANGNGFCNLCMCVICSKFDFEVNTCRWIGCDLCSHWTHTDCAIREQLICMGPSAKNGAGPSEIVFRCQACNRTSELLGWVKDVFQHCAPSWDGEALMRELDFVSRIFHGSKDPRGRKLYWKCDDLKEKLKSGKVESKAACRAILMVFQELELDSPKSLENAESGRLIAPQEACNRIAEVVHEAIRKMEIVADEKMRMFKKARLAFDACERELADKAREAGELKMDRQKKKLQIEELERIVRLKNAEADMFQLKANEAKREAERLQRIALAKSDKSEEEYTSNYLKQKLSEAEAEKQYLYEKIKLQETSRVSQSSSGVDPSSMLVYSKIHDLLYSVPPKADGQSNECHPFRTNP

SEQ ID NO: 149785 - protein, 124 aa, Glycine max
  Coding DNA Sequence Number=SeqID_33007
MGRQGNDPSPTTTVNSSIALLQERFRQLEKVKERREGKQLLKLLSSESTSSSQNSQQQQQPRLVAPHRPTLHDSLSLGLNFTSKQGDHHNTINMKSPPSSNLWPHGASTSRNFDTSDVDTSLHL

SEQ ID NO: 149786 - protein, 87 aa, Glycine max
  Coding DNA Sequence Number=SeqID_33008
MKKSVYNFKSIVQIQNLVVATTLVVIVVTMIKVVVVVIWTMVIAMSMTIVVTTNYVNDNNDDGDDSVRVVMKEVILIVVAVTMTIEC

SEQ ID NO: 149787 - protein, 102 aa, Glycine max
  Coding DNA Sequence Number=SeqID_33009
MELLFSLRSDTNSTFNSKEQQHICQSFQHPSLKALTELLTSIPQIRICCYGLLPIPHWKTFIEIVQTMDKVEVVLENEHMIDVVVLIIASPRARTEEHTVFN

SEQ ID NO: 149788 - protein, 74 aa, Glycine max
  Coding DNA Sequence Number=SeqID_33010
MAGVIQNLIVKTSIPKHVICLNIRRHEIGLSERGAEGATAMVGTGLPIYSVLKGCKIQQTIKSCFLEAGTMIIQ

SEQ ID NO: 149789 - protein, 1213 aa, Glycine max
  Coding DNA Sequence Number=SeqID_33011
  Gene Ontology: Mol. function=transporter activity; Cellular component= integral to membrane; Biological process=RNA transport
  Homolog annotation: Hit_ID=Q2UY13; Match level="QueryCoverage=99%, HitCoverage=99%, E-value=0.0, Identity=76%"; Hit description =Nucleoporin
  Pfam annotation: Domain name=Nup133; Domain location=597-1061; Score=- 134.5; E_value=0.00038; Accession=PF04044.5; Description=Nup133 nucleoporin
  Pfam annotation: Domain name=Nup133_N; Domain location=72-553; Score =78.1; E_value=2.7e-20; Accession=PF08801.1; Description=Nup133 N terminal like
  Pfam module annotation: Pfam domain module=Nup133::Nup133_N; Domain location=597-1061::72-553
  Subcellular localization annotation: CTP_CleavageSite=53; ConfidenceScore=5.13e-01
MKTLRKSNVRSRREQGRDSTVVDSPVTPARTSFHDNAVPNRPTTGTPVPWAPRLSVLARVPQVNRTGKGDDTDPTKPVFVGEFPQVVRDEQSILLHNRIPVFEIMMYCNAAEDRVCGGIDKSTSLAWIICGNRVYLWCYLSPASSVKCAVLEIPLNDADVGRNHAGSWLLCVVNCDATSVGTNKVAKQCNSAAVVLCNCRTRAVIYWPDIYSQLHAPVTSLVSSDELEAVLTPDRKASFNRQRRQSKLGSSLSGLHTFNSMIASADPSCKFVCVALACSSSDELWQFKCTPTGIHRRKVYENIMHFPLQQGESGQIVSNIGYPRSLMWHFPHYSIQESSRQFLVLTDHEIQCFRVEFGSDIPISKLWSQAIVGTDAEVGIKKDLAGQKRIWPLDMQVDDHGKVITILVATFCNDRISSSSYMQYSLLIMQYKSGMGLETTNDRVLEKKAPIEVIMPKARVEDEDFLFSMRLRIGGKPSGSAVIISGDGTATVSHYYRNSTQLYQFDLPYDAGKVLDASILPSADDYEEGAWVVLTEKAGIWAIPEKAVILGGVEPPERSLSRKGSSNERSAQEEIRNLTFAGNFAPRRASSEAWSAGDKQRMVLSGIARRTALDEESEALLNNLFNEFLTSGQIDRSLEKLETSGHALQIILEHGEKLSAMIQLRELQNLISQNRSTNVDSSNSSLDIQTSGALWDMIQLVGERARRNTVLLMDRDNAEVFYSKVSDLEDLFYCLDAELEYVIRPEHPLGIQIQRACKLSTACVTIIRTCFNYKNENRLWYPPPEGLTPWYCKPVVRTGIWSVASVLLHLLNEISGLDKTAKLDLYNHLEALAEVLLEAYSGAVTAKNECGEEHKGLLNEYWERRDSLLESLYQKVKEFEDTRKDSIEGAGEQNEEALMKHESLGPNGGFSYYVFKKLHESRQFSQLLRLGEEFPDELSIFLREHPDLLWLHDLFLHQFSSASETLHALALLQNMQSTSVAEEEGEQEYMKMKLKLTDRKNLLFLSKVAAFAAGNEAGTQVKVDRIEADLKILKLQEEVMKRHPSIEDQLLHPEDLIKLCLEGEDRELSLWAFDVFAWTSSLFRKIHRKLLEDCWKKAASQDDWSKFHDSYIAEGWSDQEILQNLKNTILFQASSRCYGPQSETFEEGFGQVFSLRQENMETSILGDMGSSVETILMQHKDFPVAGKLMLMAIMLGSEHSSDIRIEEGPSPME

SEQ ID NO: 149790 - protein, 442 aa, Glycine max
  Coding DNA Sequence Number=SeqID_33012
  Gene Ontology: Mol. function=heat shock protein binding; Cellular component=integral to membrane; Biological process=protein folding
  Homolog annotation: Hit_ID=Q9S7L6; Match level="QueryCoverage=91%, HitCoverage=59%, E-value=6e-87, Identity=43%"; Hit description =Expressed protein
  Pfam annotation: Domain name=DnaJ; Domain location=66-127; Score =97.0; E_value=5.7e-26; Accession=PF00226.21; Description=DnaJ domain
MEANKEEALKAIEIAEKRFALRDFAGAKNYAVKAKTLCPGLEGISQMVATFEVYVASEVKHNGDLDYYSILGLKPFADKEAVKKQYKKLAVLLHPDKNKCVGADEAFKLVSEAWTWLSDSAMRSSYDLKRNVQLGGANQTNLSPAHATGTAGYTKCSNLPTPCGRLDTFWTICTSCKVQYEYLRKYVNKRLSCKNCRGTFVAVETGAAPANGSFPYCPWSYVAGNGYGSHSFDGVTYVPTSAPYFNGNGVTGYHSGHGYEYVPNVSFQWGSAGVVNQNGSTTLPADSVHRANGNVKRGRPKVKLGADKRHHVIETMVNTNSDVPFSCSEPQEDKLSRPDKKQKVVVGASFRNGYEEKGSKCASELIVANGNDSMGHGQKPSCTVEVQTKQCSMAPAFDARKLLIEKARKEIRKKLEEMKLSSAAAAAAALNEKEKSQAEVGK

SEQ ID NO: 149791 - protein, 145 aa, Glycine max
  Coding DNA Sequence Number=SeqID_33013
  Gene Ontology: Cellular component=nucleus; Biological process =gibberellic acid mediated signaling
  Homolog annotation: Hit_ID=Q9LUB6; Match level="QueryCoverage=90%, HitCoverage=94%, E-value=8e-15, Identity=46%"; Hit description=F-box protein SNE
MVQQQQHRVEQEKRPRFFINDNIDILREILKRLDGPSLGVAACQRRLAVGAPVLPPRVVSATGVGEGGGGGAGRVQEAVHGVRETGAESTRRLGAGEEASVDSARATRGSGVEGSPATRPHRPSCSSATPSTSDLISSHHTFAFL

SEQ ID NO: 149792 - protein, 364 aa, Glycine max
  Coding DNA Sequence Number=SeqID_33014
  Gene Ontology: Mol. function=transcription factor activity; Cellular component=nucleus; Biological process=regulation of transcription, DNA-dependent
  Homolog annotation: Hit_ID=Q9FKH1; Match level="QueryCoverage=94%, HitCoverage=79%, E-value=2e-44, Identity=44%"; Hit description =Transcriptional regulator STERILE APETALA
LFHVARGVAVGSAVAAAHETHLETHLSTEGHVAAGVHVLASDGQELLDRETQVFRPSSVRPFGSSPPSALSLPRPVRHSPGVRLRRRLRASLRPRNPSPRHHLLVSTRPPLWALLALRLGHRYNQLQHHLRQAGWGYLRDVVNNGVLVGFAGTGRWWVGLYAGIAGRAFQIWDARSEERVFVGGSLTDPETVMGWHMLTELVEAVGRVRVTEREYVVACTASRMVCFSFRNPEVLLRDVGSTMGFVVSSLDASQEAYVVLERNGVGTVRRASTYERLSRFRLNRLWVRGLWACMNLGYVLTYSPAPSPSPSLRVWDIEQAIGRLCVTLGVRAGYVNSLVANDRHVSISSNDNNINLLDFGVQDP

SEQ ID NO: 149793 - protein, 334 aa, Glycine max
  Coding DNA Sequence Number=SeqID_33015
  Gene Ontology: Mol. function=oxidoreductase activity, acting on the CH-CH group of donors, iron-sulfur protein as acceptor; Cellular component=chloroplast; Biological process=phytochromobilin biosynthetic process
  Homolog annotation: Hit_ID=Q588D6; Match level="QueryCoverage=85%, HitCoverage=83%, E-value=1e-112, Identity=67%"; Hit description =Phytochromobilin synthase
  Pfam annotation: Domain name=Fe_bilin_red; Domain location=51-278; Score=218.7; E_value=1.3e-62; Accession=PF05996.3; Description =Ferredoxin-dependent bilin reductase
  Pfam annotation: Domain name=RCC_reductase; Domain location=49-271; Score=-104.3; E_value=0.0079; Accession=PF06405.2; Description=Red chlorophyll catabolite reductase (R
  Pfam module annotation: Pfam domain module=Fe_bilin_red::RCC _reductase; Domain location=51-278::49-271
  Subcellular localization annotation: CTP_CleavageSite=32; ConfidenceScore=5.60e-01
MGFRISGSSSSSCFCLQRTLLPPLTAIATSTRGFKRRSNCIPSCSVSYRKFVEFALDETTLHTHLIPSPLQEKYNFMNSKDGKGTLSMLSFEGAKIRLLRSLIIETETMQVLDFTVFPKAEYDIPIFCANFFTSAKTNIVVLDLNPLHDIINQHEYKEKYFKSLIPLGLKYAELFPWGGKLTSESINFFSPIVIWTKFTSNPEKYDILYSAFREYYKVWLKLICKADKETDESQIFHNLEAQHRYLTWRVEKDPGQGVLKKLIGDTLAKDMLRSFLFNGVDELGSKTFNDYFPRYCCQEGTLNKKGNVIGKSFENRPWNARGEFIGNRFSNWPV

SEQ ID NO: 149794 - protein, 92 aa, Glycine max
  Coding DNA Sequence Number=SeqID_33016
  Subcellular localization annotation: CTP_CleavageSite=43; ConfidenceScore=5.78e-01
MSSTSSSSSSSSSSTSSSTPYDAVAPDIPGPSTRRTGGSGQFEASSSSQRQRAMNEVLPEPLLEALATQLALDAANYNGRLSAASALAILFQ

SEQ ID NO: 149795 - protein, 456 aa, Glycine max
  Coding DNA Sequence Number=SeqID_33017
  Gene Ontology: Mol. function=peroxidase activity; Biological process =protein folding
  Homolog annotation: Hit_ID=Q338Y6; Match level="QueryCoverage=89%, HitCoverage=96%, E-value=1e-43, Identity=30%"; Hit description =Expressed protein
  Pfam annotation: Domain name=DUF641; Domain location=58-178; Score =37.5; E_value=4.7e-08; Accession=PF04859.3; Description=Plant protein of unknown function (DUF641)
MTRKVSNFSDLIQRVTTSCFLHSFADDREEEYHSDSFGNKPQDEQGYYGEEKMVMGLKVISREEKKLKQMRALMEEVFEAVSAMKSAYVSLQEAHCTWDPQSLREADVAVVAQLKKLALLRDGFHGSVSTVEEDEGRRRRGGNAPYETVMKKEVKAKDLHKVKLGCVATLTSHENKARRPHPYTKRKLGCNSQMQEAGFVAAPSPEVLEATMAQVKEASKSFTSLLLSLMQDAKWDMAAAVRSIEAASDKYYNNPATSTTTVSTLHAKYALESYIFRKMFQGFDHESFYMDNNTLSSLLNPAQFRRDCFSQYHDMKSTDPSELLGVLPTCHFGKFCSNKYLSVVHPKMEESLFGDLVQHSLVSEGNHPRTRFYKEFLGVAKGVWLLHLLAFSFDPLPSKFEASSGAEFHPRYMETVVKFAGGRVPPGTVVGFSVSPGFKFRNGSVVKARVYLMARN

SEQ ID NO: 149796 - protein, 264 aa, Glycine max
  Coding DNA Sequence Number=SeqID_33018
  Gene Ontology: Mol. function=DNA polymerase processivity factor activity; Cellular component=PCNA complex; Biological process =regulation of DNA replication
  Homolog annotation: Hit_ID=Q9ZW35; Match level="QueryCoverage=94%, HitCoverage=95%, E-value=7e-38, Identity=40%"; Hit description =Proliferating cell nuclear antigen 2
  Pfam annotation: Domain name=PCNA_C; Domain location=134-255; Score =59.9; E_value=8.4e-15; Accession=PF02747.6; Description =Proliferating cell nuclear antigen, C-terminal domain
  Pfam annotation: Domain name=PCNA_N; Domain location=2-126; Score =42.0; E_value=3.9e-10; Accession=PF00705.9; Description =Proliferating cell nuclear antigen, N-
  Pfam module annotation: Pfam domain module=PCNA_C::PCNA_N; Domain location=134-255::2-126
MVMEVVLGEASEVKNVVEAIELVETGVAKFVFSSRGLSLKAMDSRECAMMEILIPSDAFAHYRCDNVFSVGLSLDQMLQLLHRAHDSDIVSLTALEGQDHVTFTFQCPSNLSFSDHRMNLMMDIDNGPLLDIHEDAEYHAIVELPSPVFTTICCHIDSLSNIPIISIIVTRDTPILLVAAGDFGLCMHLPRGGTVIEMTQCVSLAFEIRYLNLVMAAMSLSDTLTIRLSMELPEAVFEYKIAAEKGYVRFHLPIAFNASYLLDD

SEQ ID NO: 149797 - protein, 132 aa, Glycine max
  Coding DNA Sequence Number=SeqID_33019
  Gene Ontology: Mol. function=phosphopyruvate hydratase activity; Cellular component=phosphopyruvate hydratase complex; Biological process=glycolysis
  Homolog annotation: Hit_ID=Q9ZW34; Match level="QueryCoverage=80%, HitCoverage=22%, E-value=1e-46, Identity=86%"; Hit description =Putative enolase 2-phospho-D-glycerate hydroylase
  Pfam annotation: Domain name=Enolase_N; Domain location=8-125; Score =131.5; E_value=2.3e-36; Accession=PF03952.6; Description=Enolase, N -terminal domain
MRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKLFLVTLMDTIGIVLARLLLGNNSRW

SEQ ID NO: 149798 - protein, 71 aa, Glycine max
  Coding DNA Sequence Number=SeqID_33020
MRSGEKPIERKREEEVSNGAKGNEIRLLGRVKELPRQATGEITLDVKLSQPPSSDVPVILSPTSNSYPYKE

SEQ ID NO: 149799 - protein, 359 aa, Glycine max
  Coding DNA Sequence Number=SeqID_33021
  Gene Ontology: Mol. function=binding
  Homolog annotation: Hit_ID=Q2R0N3; Match level="QueryCoverage=94%, HitCoverage=78%, E-value=6e-69, Identity=39%"; Hit description =Armadillo/beta-catenin-like repeat family protein, expressed
  Pfam annotation: Domain name=Arm; Domain location=241-281; Score =31.8; E_value=2.4e-06; Accession=PF00514.13; Description =Armadillobeta-catenin-like repeat
  Pfam annotation: Domain name=Arm; Domain location=284-324; Score=4.4; E_value=3.4; Accession=PF00514.13; Description=Armadillobeta-catenin -like repeat
  Pfam module annotation: Pfam domain module=Arm::Arm; Domain location =241-281::284-324
MVCRHFNAVSGVVDAAARSLRMIYQSNLAPKYDFFKEQDMQFLLSLLKSGNENLTGLGASIVIHSCEKRDEQNMLCCAGALETLISLLDGSLSQRDSSLESLAAILKNNPEVVYKFVDLQNGRVLSSNSSSCYLQDIGIKAKLIHILLELLDESGQVGDSASFAFSSLVAEKEDLQKLAFEANAIDKFNSHLQNCALHPKRLEGIFLALADLCSKLECCRSKFLSLQVAALGAISNIVIDFTPQKSTFMECGGVKELIQLTKSMDSSLRLNAVLALRNMVFLADKMCKEGIFKELTVSSVASLICDPEPSVQEQALALVCNFVDGCIDCVEYAFAEDGIILDAVARQLKKSSKIEIGIQ

SEQ ID NO: 149800 - protein, 125 aa, Glycine max
  Coding DNA Sequence Number=SeqID_33022
  Gene Ontology: Mol. function=transferase activity, transferring glycosyl groups; Cellular component=integral to membrane; Biological process=carbohydrate biosynthetic process
  Homolog annotation: Hit_ID=Q9LSG3; Match level="QueryCoverage=97%, HitCoverage=31%, E-value=5e-23, Identity=50%"; Hit description =Glycosyltransferase QUASIMODO1
MKLDSNGGVESIRRSIIALKTDPLKLVWSRFASKLMIMALWLVYASYARKLKLESSKLASFQQSVLRQVVGDAKESFDNQLKTQKLKDTIFAVNAQLTKAKKQGANSKELALSLHEVDGREDCPS

SEQ ID NO: 149801 - protein, 190 aa, Glycine max
  Coding DNA Sequence Number=SeqID_33023
  Gene Ontology: Mol. function=binding
  Homolog annotation: Hit_ID=Q2R0N3; Match level="QueryCoverage=56%, HitCoverage=20%, E-value=7e-20, Identity=42%"; Hit description =Armadillo/beta-catenin-like repeat family protein, expressed
MVVAWYQSPYVLVIFLTITTVNQLHKMFMVGNSQQEIHFHHFFLLVWFNEVIFEINIYTFRLLHFESMVISKGNGMYLLSNIASGNESHREAIMQLLFSKAENVSHSFFYQFLQSNDSCLRTSAVWVIVNLTFPASPGVFGRVVKLRNVGIVSQIKKMVNDPCMDVKLRARQALGQIITFGDRLNCEVVF

SEQ ID NO: 149802 - protein, 45 aa, Glycine max
  Coding DNA Sequence Number=SeqID_33024
MDTCLTLLSILGRCGPHPEATRSPDSASQLWLHVGISPGAVWLCD

SEQ ID NO: 149803 - protein, 300 aa, Glycine max
  Coding DNA Sequence Number=SeqID_33025
  Gene Ontology: Mol. function=transcription factor activity; Cellular component=nucleus; Biological process=regulation of transcription, DNA-dependent
  Homolog annotation: Hit_ID=Q945M9; Match level="QueryCoverage=99%, HitCoverage=98%, E-value=4e-46, Identity=41%"; Hit description =Nuclear transcription factor Y subunit A-9
  Pfam annotation: Domain name=CBFB_NFYA; Domain location=132-188; Score=131.6; E_value=2.1e-36; Accession=PF02045.6; Description=CCAAT- binding transcription factor (CBF-BNF-YA) subunit B
MQSKSETANQLRSDPHSFTPNNAYSEPWWRGIQYNPVPQAMLGVNASNSSSLERPNGDSESSEEDDDATKESQPTAPNQSGNYGQDHQAMQHSSSSAPLAGASNLYYRGMLGYTPFIGMPHARMALPLEMAQEPVYVNAKQYQGILRRRQARAKAELEKKLIKVRKPYLHESRHQHAIRRARGNGGRFAKKTEVEASNHMNKEKDMGTGQVPLSRSISSSGFGSLPSDSAETWNSPSVQQDARGSQVHERFEERNYANVLQSSSTFCLHSGERVEEGDCSGQQRGSILSEHTSQRRLAIQ

SEQ ID NO: 149804 - protein, 756 aa, Glycine max
  Coding DNA Sequence Number=SeqID_33026
  Gene Ontology: Mol. function=transferase activity, transferring glycosyl groups; Cellular component=cytoplasm; Biological process =carbohydrate metabolic process
  Homolog annotation: Hit_ID=Q84NI7; Match level="QueryCoverage=99%, HitCoverage=99%, E-value=0.0, Identity=75%"; Hit description =Alkaline alpha galactosidase I
  Pfam annotation: Domain name=Raffinose_syn; Domain location=7-740; Score=1345.9; E_value=0; Accession=PF05691.3; Description=Raffinose synthase or seed imbibition protein Sip1
MTVGSGISVADGNLMVLGYKVLSHVHDKVLLTPARGGALLNGAFIGVQSHHKGSRTVFPIGKLQGLRFMCVFRFKMWWMTQRMGTCGQEIPIETQFLLVEAHSGSDTEGGEDQGAATYAVFLPLLEGDFRAVLQGNDQNEIEICVESGCPAVEEFDGTHLVYIGAGSDPFEVITNSVKTVEKHLQTFAHRERKKMPDMLNWFGWCTWDAFYTNVTSENVKQGLQRCFEKGGIPAKFVIIDDGWQSVGMDPNGVEWKSDSSANFANRLTNIKENHKFQKDGKEGQRVEDPALGLGHITNQIKLEHNIKHVYVWHAITGYWGGVRPGVPGMEHYESKMVFPVSSPGVESNQPDEALTTIAINGLGLVNPEKVFHFYDELHSYLASSGIDGVKVDVQNILETLGAGHGGRVKLARKYHQALEASIARNFPDNGIICCMSHNTDGLYSAKRSAVIRASDDFWPRDPASHTIHIASVAYNTIFLGEFMQPDWDMFHSLHPMAEYHGAARAVGGCPIYVSDKPGHHDFDLLKKLALPDGSILRAKLPGRPTKDCLFTDPARDGKSLLKIWNMNDFSGVIAVFNCQGAGWCKVDKKNLIHDENPGTVTGFVRAKDVDYLSRIVDDKWTGDAIIYSHLGGEVVYLPKDASIPVTLKTREYEVFTIVPVKELSNGVKFSPIGLIKMFNSGGAVKEFSWGSNESTNVAVKVPGCGQFGAYSSARPKLITVDLEEVEFKYEEESGLVTIDLRVPEKELYQWSISIDF

SEQ ID NO: 149805 - protein, 174 aa, Glycine max
  Coding DNA Sequence Number=SeqID_33027
  Gene Ontology: Cellular component=integral to membrane
  Homolog annotation: Hit_ID=Q9FF99; Match level="QueryCoverage=71%, HitCoverage=26%, E-value=1e-26, Identity=57%"; Hit description=Amino acid transporter
MGEEEIDDSPLIQGFPSGDVPFRRTGNVERAVAHIITGVIGAGVLSLAWSVAQLGWIAGPFIIIVFAGTTFLSANLLSDCYRFPHPLYGNIRCPSYIDAVKETQGKRCVECWCMRAYMVPPRPMSLHLPPASDVIPIELKDTDPTCYIGQSLREILVQRGGPSESERQPQNIFT

SEQ ID NO: 149806 - protein, 166 aa, Glycine max
  Coding DNA Sequence Number=SeqID_33028
  Homolog annotation: Hit_ID=Q1S4Q9; Match level="QueryCoverage=48%, HitCoverage=17%, E-value=1e-30, Identity=82%"; Hit description =Phosphoribosyltransferase; AAA ATPase; Phosphoribulokinase/uridine kinase
ISPSSFFRSVPHSYNSEFIRYVLPSFSIGLFDLLVSSRLVIYLDLDFLTSNCIQHSVFTTMAALSLTSLPMGTKSAVDLMESLSEVHFSGFHIDGLEQRKAGTEQPTTSTTDMYKQPFVIGVAGGAASGKTSVCDMIVQQLHDQRVVLVNQVFNSCKVPIIYLILV

SEQ ID NO: 149807 - protein, 357 aa, Glycine max
  Coding DNA Sequence Number=SeqID_33029
  Gene Ontology: Mol. function=transferase activity, transferring glycosyl groups; Cellular component=cytoplasm; Biological process =nucleoside metabolic process
  Homolog annotation: Hit_ID=Q1S4Q9; Match level="QueryCoverage=96%, HitCoverage=80%, E-value=1e-147, Identity=70%"; Hit description =Phosphoribosyltransferase; AAA ATPase; Phosphoribulokinase/uridine kinase
  Pfam annotation: Domain name=PRK; Domain location=2-160; Score=89.3; E_value=1.2e-23; Accession=PF00485.8; Description=Phosphoribulokinase Uridine kinase family
MSMVGETTANFTCQSVTQIVLYAYEHSKEAFDTEQLLRVMDKLKRGQAVDIPNYDFKGYKNDVFPARRVNPADVIILEGILVFHDPRVRALMNMKIFVDTDADVRLARRIKRDTADNARDIGAVLDQYSKFVKPAFDDFILPTKKYADIIIPRGRDNHVAIDLIVQHIRTKLGQHDMCKIYRNLYVIQSTFQVVEHGLGHLPFTEKQVTTPTASVYSGVDFCKRLCGVSIIRSGESMENALRACCKGIKIGKILIHREGDNGQQLIYEKLPNDISDRHVLLLDPILGTVPNVLHICMLSYCQAPQGVHVVCKRFPRIKIVTSEIEIGLNEAFRVIPGMGEFGDRYFGTDDDDQQASQ

SEQ ID NO: 149808 - protein, 311 aa, Glycine max
  Coding DNA Sequence Number=SeqID_33030
  Homolog annotation: Hit_ID=Q9LUA7; Match level="QueryCoverage=88%, HitCoverage=88%, E-value=5e-63, Identity=42%"; Hit description =Arabidopsis thaliana genomic DNA, chromosome 5, P1 clone:MIF21
  Pfam annotation: Domain name=DUF868; Domain location=32-310; Score =378.8; E_value=8.2e-111; Accession=PF05910.3; Description=Plant protein of unknown function (DUF868)
MANFLVESMMLAIPKSHFRKKTTCQDNEGTKIDAPQSSVTFVYQTKVAELLRSITISWCKDPTDHFLSMSVDNTLEENKYTCKIDLESGQSWGKKGLKSFEITGARVDIFWDFRRAKFSATGPQPYSGYYVALVYKKEVLLLLGDLEKDAYERTKSKPSLDEAALLCKRDNVYGKKMFCTRAILEDGKTEHDVVIEASLCGPGDPEMWISIDGMLASRIMNLHWRFRGNEILMVNNLPVQIFWDVHDWLFTNDLGLGPAFFVFKPVFLETTSDSNSIECLERSGGSNKRELLEENSSTQGFCHYLYAWRTI

SEQ ID NO: 149809 - protein, 370 aa, Glycine max
  Coding DNA Sequence Number=SeqID_33031
  Homolog annotation: Hit_ID=Q8LBJ2; Match level="QueryCoverage=48%, HitCoverage=43%, E-value=8e-45, Identity=49%"; Hit description =Contains similarity to regulatory protein RecX
  Pfam annotation: Domain name=RecX; Domain location=210-359; Score= -6.9; E_value=0.045; Accession=PF02631.7; Description=RecX family
MSGPHIGKQKLDKNKNRERRNERKMGNPCFGFAANIVFKISSHLPSRVFSIPQTIWKSQIVCLKSRDFSSSVPVRYISSTSCMVKILETALPVKSLGYCSCPDVNVLKINGGKDVHATIAHCEISQEPKEICPDLLFDDIEQGCRGTTSLLPIGSFDQMEEVGELTIHEGGDSCDEELIQINKFTSDVEEAAIKLLASRALTALELRKKLLGKRFSPDEVEAVINKFQKRGFINDRLYAETFSQSRWTSSSWGPRRIKQMPPKTLGMHKSSACLKALFKKGVSQADAEKAVEVVFKDNDCAEDLKSVIGLSKHSMDHLYTQASKQWFRGQNVPKETRKSRIVRWLQYRGFDWNVINFILKKLDRQDQNSP

SEQ ID NO: 149810 - protein, 89 aa, Glycine max
  Coding DNA Sequence Number=SeqID_33032
  Gene Ontology: Mol. function=protein binding; Biological process =response to DNA damage stimulus
  Homolog annotation: Hit_ID=Q708X5; Match level="QueryCoverage=98%, HitCoverage=33%, E-value=2e-19, Identity=58%"; Hit description =Leucine rich repeat protein precursor
  Subcellular localization annotation: CTP_CleavageSite=38; ConfidenceScore=5.09e-01
MDAGILPLRALSARFRTVRRESLLTSAGISPESLLPMRSKMRREGSALTQVEISPAMSFQSTTTRVVTVSMPQIAADAVPVEAVVGARP

SEQ ID NO: 149811 - protein, 1044 aa, Glycine max
  Coding DNA Sequence Number=SeqID_33033
  Gene Ontology: Mol. function=protein serine/threonine kinase activity; Cellular component=integral to membrane; Biological process=protein amino acid phosphorylation
  Homolog annotation: Hit_ID=Q6Z8S8; Match level="QueryCoverage=99%, HitCoverage=94%, E-value=0.0, Identity=58%"; Hit description =Putative receptor protein kinase
  Pfam annotation: Domain name=LRRNT_2; Domain location=1-38; Score =47.0; E_value=6.3e-11; Accession=PF08263.3; Description=Leucine rich repeat N-terminal domain
  Pfam annotation: Domain name=LRR_1; Domain location=114-136; Score =9.0; E_value=5.8; Accession=PF00560.23; Description=Leucine Rich Repeat
  Pfam annotation: Domain name=LRR_1; Domain location=138-160; Score =14.6; E_value=0.37; Accession=PF00560.23; Description=Leucine Rich Repeat
  Pfam annotation: Domain name=LRR_1; Domain location=162-185; Score =6.9; E_value=15; Accession=PF00560.23; Description=Leucine Rich Repeat
  Pfam annotation: Domain name=LRR_1; Domain location=187-209; Score =10.5; E_value=3.1; Accession=PF00560.23; Description=Leucine Rich Repeat
  Pfam annotation: Domain name=LRR_1; Domain location=211-233; Score =0.2; E_value=2.6e+02; Accession=PF00560.23; Description=Leucine Rich Repeat
  Pfam annotation: Domain name=LRR_1; Domain location=235-257; Score =14.5; E_value=0.38; Accession=PF00560.23; Description=Leucine Rich Repeat
  Pfam annotation: Domain name=LRR_1; Domain location=259-281; Score =11.2; E_value=2.3; Accession=PF00560.23; Description=Leucine Rich Repeat
  Pfam annotation: Domain name=LRR_1; Domain location=283-305; Score =16.4; E_value=0.1; Accession=PF00560.23; Description=Leucine Rich Repeat
  Pfam annotation: Domain name=LRR_1; Domain location=307-329; Score =11.0; E_value=2.5; Accession=PF00560.23; Description=Leucine Rich Repeat
  Pfam annotation: Domain name=LRR_1; Domain location=331-353; Score =14.7; E_value=0.33; Accession=PF00560.23; Description=Leucine Rich Repeat
  Pfam annotation: Domain name=LRR_1; Domain location=355-377; Score =6.2; E_value=19; Accession=PF00560.23; Description=Leucine Rich Repeat
  Pfam annotation: Domain name=LRR_1; Domain location=379-401; Score =16.5; E_value=0.099; Accession=PF00560.23; Description=Leucine Rich Repeat
  Pfam annotation: Domain name=LRR_1; Domain location=403-425; Score =9.4; E_value=5; Accession=PF00560.23; Description=Leucine Rich Repeat
  Pfam annotation: Domain name=LRR_1; Domain location=42-64; Score=5.2; E_value=30; Accession=PF00560.23; Description=Leucine Rich Repeat
  Pfam annotation: Domain name=LRR_1; Domain location=427-449; Score =13.3; E_value=0.9; Accession=PF00560.23; Description=Leucine Rich Repeat
  Pfam annotation: Domain name=LRR_1; Domain location=451-473; Score =14.5; E_value=0.38; Accession=PF00560.23; Description=Leucine Rich Repeat
  Pfam annotation: Domain name=LRR_1; Domain location=475-494; Score =14.8; E_value=0.31; Accession=PF00560.23; Description=Leucine Rich Repeat
  Pfam annotation: Domain name=LRR_1; Domain location=497-519; Score =14.7; E_value=0.35; Accession=PF00560.23; Description=Leucine Rich Repeat
  Pfam annotation: Domain name=LRR_1; Domain location=521-544; Score =13.2; E_value=0.96; Accession=PF00560.23; Description=Leucine Rich Repeat
  Pfam annotation: Domain name=LRR_1; Domain location=545-567; Score =11.3; E_value=2.2; Accession=PF00560.23; Description=Leucine Rich Repeat
  Pfam annotation: Domain name=LRR_1; Domain location=569-592; Score =1.9; E_value=1.3e+02; Accession=PF00560.23; Description=Leucine Rich Repeat
  Pfam annotation: Domain name=LRR_1; Domain location=594-615; Score =12.2; E_value=1.5; Accession=PF00560.23; Description=Leucine Rich Repeat
  Pfam annotation: Domain name=LRR_1; Domain location=617-638; Score =11.5; E_value=2; Accession=PF00560.23; Description=Leucine Rich Repeat
  Pfam annotation: Domain name=LRR_1; Domain location=66-88; Score=7.3; E_value=12; Accession=PF00560.23; Description=Leucine Rich Repeat
  Pfam annotation: Domain name=LRR_1; Domain location=90-112; Score =12.0; E_value=1.6; Accession=PF00560.23; Description=Leucine Rich Repeat
  Pfam annotation: Domain name=Pkinase; Domain location=732-1007; Score= 119.5; E_value=9.7e-33; Accession=PF00069.15; Description=Protein kinase domain
  Pfam annotation: Domain name=Pkinase_Tyr; Domain location=732-1007; Score=58.4; E_value=4.7e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::Pkinase::Pkinase _Tyr; Domain location=1-38::114-136::138-160::162-185::187-209::211 -233::235-257::259-281::283-305::307-329::331-353::355-377::379 -401::403-425::42-64::...
  Pfam module annotation: Domain location=427-449::451-473::475 -494::497-519::521-544::545-567::569-592::594-615::617-638::66-88::90- 112::732-1007::732-1007
  Subcellular localization annotation: CTP_CleavageSite=36; ConfidenceScore=5.20e-01
QGQALLAWKNSLNSTLDALASWNPSKPSPCNWFGVHCNLQGEVVEINLKSVNLQGSLPSNFQPLRSLKTLVLSTANITGRIPKEIGDYKELIVIDLSGNSLLGEIPQEICRLSKLQTLALHANFLEGNIPSNIGSLSSLVNLTLYDNKLSGEIPKSIGSLTALQVLRAGGNTNLKGEVPWDIGNCTNLVVLGLAETSISGSLPSSIGKLKRIQTIAIYTTLLSGPIPEEIGKCSELQNLYLYQNSISGSIPSQIGELSKLQNLLLWQNNIVGTIPEELGSCTQIEVIDLSENLLTGSIPTSFGKLSNLQGLQLSVNKLSGIIPPEITNCTSLTQLEVDNNDISGEIPPLIGNLRSLTLFFAWQNKLTGKIPDSLSRCQDLQEFDLSYNNLTGLIPKQLFGLRNLTKLLLLSNDLSGFIPPEIGNCTSLYRLRLNHNRLAGTIPTEITNLKNLNFLDVSSNHLVGEIPPTLSRCQNLEFLDLHSNSLIGSIPDNLPKNLQLIDLTDNRLTGELSHSIGSLTELTKLSLGKNQLSGSIPAEILSCSKLQLLDLGSNSFSGQIPEEVAQIPSLEIFLNLSCNQFSGEIPSQFSSLKKLGVLDLSHNKLSGNLDALSDLQNLVSLNVSFNNFSGELPNTPFFRRLPLNDLTGNDGVYIVGGVATPADRKEAKGHARLAMKIIMSILLCTTAVLVLLTIHVLIRAHVASKILNGNNNWVITLYQKFEFSIDDIVRNLTSSNVIGTGSSGVVYKVTVPNGQTLAVKKMWSTAESGAFTSEIQALGSIRHKNIIKLLGWGSSKNMKLLFYEYLPNGSLSSLIHGSGKGKSEWETRYDVMLGVAHALAYLHNDCVPSILHGDVKAMNVLLGPGYQPYLADFGLATIASENGDYTNSKSVQRTYLAGSYGYMAPEHASMQRITEKSDVYSFGVVLLEVLTGRHPLDPTLPGGAHLVQWVRNHLASKGDPYDILDPKLRGRTDSTVHEMLQTLAVSFLCVSNRAEDRPTMKDIVGMLKEIRPVESATTNPDVSKEVLTVHTSPAPPMNGVSHGT

SEQ ID NO: 149812 - protein, 107 aa, Glycine max
  Coding DNA Sequence Number=SeqID_33034
  Gene Ontology: Biological process=response to other organism
  Homolog annotation: Hit_ID=O80959; Match level="QueryCoverage=58%, HitCoverage=12%, E-value=4e-15, Identity=65%"; Hit description =Similar to latex allergen from Hevea brasiliensis
MRGILAGKALAYLEGMLKKKSGNQNATIANYFDMAIDVGVGGIFTAMLFSTKDHCCPIFSADDTGCSGSVSSTTTGFEKAMKKVFTTENGGGSLTQGHSKIDSDFVL

SEQ ID NO: 149813 - protein, 686 aa, Glycine max
  Coding DNA Sequence Number=SeqID_33035
  Gene Ontology: Mol. function=nucleoside-triphosphatase activity; Cellular component=integral to membrane; Biological process=transport
  Homolog annotation: Hit_ID=Q1S953; Match level="QueryCoverage=99%, HitCoverage=100%, E-value=0.0, Identity=74%"; Hit description=AAA ATPase
  Pfam annotation: Domain name=ABC2_membrane; Domain location=416-625; Score=165.2; E_value=1.7e-46; Accession=PF01061.14; Description=ABC -2 type transporter
  Pfam annotation: Domain name=ABC_tran; Domain location=120-308; Score= 147.1; E_value=4.6e-41; Accession=PF00005.17; Description=ABC transporter
  Pfam module annotation: Pfam domain module=ABC2_membrane::ABC_tran; Domain location=416-625::120-308
MEKEREDEIEDMSMSPPSIGSMQIAGSNGFGHSMEFMSQAYLPNMYTEIDIKVQDSSFNQDPPLPIYLKFEDVEFRVIDSQSASNNPVKTMMSKVGTQHHVEEDRYKKILKSITGSIGPGEILALMGPSGSGKTTLLRVVGGRLIDNVKGKITYNDIRFNPAVKRRIGFVTQEDVLFPQLTVEETLIFSAFLRLPSNMSKQQKYSRVENTVKDLSLERCRHTKIGGGYLKGISGGERKRTSIGYEILVDPSLLLLDEPTSGLDSTSANRLLLTLQGLAKGGRTIITTIHQPSSRIFHMFDKLLLISEGYPIYYGKAKDSMQYFSSLRFIPEIPMNPAEFLLDLATGQVNNISVPLDILKDQESADSSKAVINYLQVKYKDTLEPKEKGENHGAANTPEHLQLAIQVKKDWTVSWCDQFVILYKRTFRARSKDYFDKLRLVQALGIALLLGLLWWKSSINTEAQVRDQVGLMFYICIFWTSSCIFGAVYVFPFEKVYLVKERKADMYRLSVYYASSTLCDMVAHVFYPTFFMVILYFMAGFKRTVACFFLTLFAVWLIAITSQGAGELFGAAVMSIQRAGMVASLILMLFLLTGGYYVQHVPKMMQWLKYLSFVYYGFRLLLKVQYSGEQPYECESEGGCRTLQSSPSFDTVNLEGGLTEAWVLVVMALCFRVLAYFCLRRRIDICN

SEQ ID NO: 149814 - protein, 282 aa, Glycine max
  Coding DNA Sequence Number=SeqID_33036
  Gene Ontology: Mol. function=zinc ion binding; Cellular component =integral to membrane; Biological process=ubiquitin cycle
  Homolog annotation: Hit_ID=Q1S950; Match level="QueryCoverage=94%, HitCoverage=99%, E-value=4e-93, Identity=55%"; Hit description=Zinc finger, RING-type; RINGv
  Pfam annotation: Domain name=zf-C3HC4; Domain location=238-278; Score= 36.0; E_value=1.3e-07; Accession=PF00097.15; Description=Zinc finger, C3HC4 type (RING finger)
  Subcellular localization annotation: CTP_CleavageSite=47; ConfidenceScore=5.56e-01
MNSRCFLVHPQQEYSMVPFSSNSATEDRVASARNRPPRVTPPSFLVRIAMRISRARWFTFLRRVFHYQNGSRSNLGSNPFNSSTWMMLEFIALILQITITTFTLAISKRERPIWPMRIWVSGYDIGCVLNLLLLYGRYRQIYLTQGDSLSLSDIEQQRNNEETRMSHLMNKCRTSLELFFAICTLLGYNMNMASSNKGASNDQISQLPSWRHKEAGAKLELGNASEGSEKLINEDPECCICLAKYKDEEEVRQLPCSHMFHLKCVDQWLKIISCCPICKQGL

SEQ ID NO: 149815 - protein, 634 aa, Glycine max
  Coding DNA Sequence Number=SeqID_33037
  Homolog annotation: Hit_ID=Q9FG69; Match level="QueryCoverage=96%, HitCoverage=96%, E-value=0.0, Identity=57%"; Hit description =Arabidopsis thaliana genomic DNA, chromosome 5, P1 clone:MYN21
  Pfam annotation: Domain name=MFS_1; Domain location=74-595; Score= -50.1; E_value=0.062; Accession=PF07690.6; Description=Major Facilitator Superfamily
  Pfam annotation: Domain name=TatC; Domain location=69-240; Score= -86.5; E_value=0.1; Accession=PF00902.8; Description=Sec-independent protein translocase protein (TatC)
  Pfam annotation: Domain name=UPF0118; Domain location=173-606; Score=- 45.6; E_value=0.0029; Accession=PF01594.7; Description=Domain of unknown function DUF20
  Pfam module annotation: Pfam domain module=MFS_1::TatC::UPF0118; Domain location=74-595::69-240::173-606
  Subcellular localization annotation: CTP_CleavageSite=34; ConfidenceScore=5.21e-01
MFRSASLRKPTSDPPPPPSNADQKVNPSGDSQSQAQARLALYIAMAHAGLAMAILVLFSLYKLLQQYLKPLQWAVLCSIPLRLIHQTTVSFWSHPLKLGLLHTLLALPLSVFTLFFTTLVEIREASLRTLLRKPKPKPENDNDNTTKKRSGFSTVLRLLLSFGVFVAAYERLGAVGSLSLLGLAFVFSSKNVDFNFSLFCPSGGAFFTRGILKRLKTVVAVGLIVGMIVGFLSGVIFFSYKIGGEGKEAVISLKVRVEENNYADRIGLKKWMEENDVAGMVVKHTSQFYETVSDQIDGLAMQYNMTEFVTVIKQFVITAPASANSSSTDSLMVPSPYTEKLLSLKGRLRNREWGEIFAELDTLFQEFIITREDLVERAKGYAVKGMDVGQRVLASGTSVLGSGAKFVISILNSIVSGAAEVFNFVSQTMVFFWVLYYLITSESGGVTEQGMHMVPLSDSARVRCVEVLDKAISGVLLATAEIAFFQGCLTWLLFRLYRIHFLYVSTVIAFLSPLLPIFPSWLATIPAAIQLVLEGRYVVAIFLSVAHLSLMDYGATEILQDVPGHSAYLAGLSIIGGMALFPSALEGAILGPLITTVMIALKDLYAEFVLDEPDDKLKMSATTLFFVILSVELV

SEQ ID NO: 149816 - protein, 558 aa, Glycine max
  Coding DNA Sequence Number=SeqID_33038
  Gene Ontology: Mol. function=nucleotide binding
  Homolog annotation: Hit_ID=Q40474; Match level="QueryCoverage=86%, HitCoverage=84%, E-value=1e-180, Identity=63%"; Hit description=Axi 1 protein
  Pfam annotation: Domain name=DUF246; Domain location=123-464; Score =747.8; E_value=7.1e-222; Accession=PF03138.5; Description=Plant protein family
MKRKKHHTEKSRIIGLLVASFLRGRLLHRTLIIAISACLLLLFALFSLFAPSTLNKINLQTTQNNDQVRSRFHDSVFQVPAGGGSFRRDLWSSTHSRLFYGCSNAGVNFAKANAKTNPDRYLLISTSGGLNQQRTGIIDAVVAAYLLNATLVVPELDHTSFWKDTSNFSELFDTEWFITFLRNDVRIVKELPEMGGNFVAPYTVRVPRKCTPKCYEDRVLPVLVRKRAVRLTKFDYRLANMLDEDLQRLRCRVNYHALKFTDSIQGMGKLLVERMKIKSKHFIALHLRFEPDMLAFSGCYYGGGEKEKKELGEIRKRWKNLHASNPEKVRRHGRCPLTPEEVGLMLRALDFGSEVLLYVASGEIYGGEETIAPLKALFPNFHSKETIATKEELAPFVSFSSRMAALDFIVCAESDVFVTNNNGNMAKILAGRRRYLGHKVTIRPNAKKLNLLFMNRNNRTWEEFASRVRTFQVGFMGEPNELRPGSGEFTENPSACICQKNSAGGISYPLNHSNITEFQEQQEWSSEVDNNLNGTKIDSLPLIMTTDQLAEVQEFFSD

SEQ ID NO: 149817 - protein, 549 aa, Glycine max
  Coding DNA Sequence Number=SeqID_33039
  Gene Ontology: Mol. function=drug transporter activity; Cellular component=membrane; Biological process=multidrug transport
  Homolog annotation: Hit_ID=UPI000034F19D; Match level="QueryCoverage =68%, HitCoverage=81%, E-value=3e-92, Identity=47%"; Hit description =antiporter/ drug transporter
  Pfam annotation: Domain name=MatE; Domain location=256-420; Score =40.2; E_value=7.3e-09; Accession=PF01554.9; Description=MatE
  Pfam annotation: Domain name=MatE; Domain location=87-255; Score =17.6; E_value=0.00021; Accession=PF01554.9; Description=MatE
  Pfam module annotation: Pfam domain module=MatE::MatE; Domain location=256-420::87-255
MEATHFTTSQYQYHIDGGFTRRPFMRMRKRSHISYGYGPHFLRRSLYVPFIALGPKAKAKAEAEAEAEASSFSSVDVRRELISLTLPALASQAIDPLAQLMETAYIGRLGTVELASAGVSISIFNIISKLFNIPLLSVATSFVAEDIAKASSTADAKTKQQLSSVSTALLLALVLGFFEALALYLGSGAFLHLIGVSTQNPTYVPARHFLSLRAVGAPAVVLSLSLQGIFRGFKDTKTPVICLGNYDLWAVTGGFLLGRTLSVLSTMTLGTSMAARHGPVAMAAHQICMQVWLAVSLLTDALAASGQALIASSVSRHEYKVAKEVTSLVLRNLIVPFQIGLVMGICLTAILGASFGSLATIFTQDTEVLQVIRTLALFVSASQPFNALAYIFDGLHYGVSDFRYAAFSMMFVGAVSSAFLVFAPPLFGLQGVWLGLGLFMALRAAAGAVRCKQASSVLDVEVGDFIPEVAWFKIVGSILQSDEKFIAEIEGALDDARNDLGVLAKRRDRGPSHPHPPESSNHPNPAPPPAHASSPPSPAPPPHPPGRGM

SEQ ID NO: 149818 - protein, 474 aa, Glycine max
  Coding DNA Sequence Number=SeqID_33040
  Gene Ontology: Mol. function=hedgehog receptor activity; Cellular component=integral to membrane; Biological process=cholesterol transport
  Homolog annotation: Hit_ID=UPI000034F451; Match level="QueryCoverage =93%, HitCoverage=32%, E-value=1e-124, Identity=52%"; Hit description= hedgehog receptor
MKSRQVDGNTTVDGIDYHLTETFGQGLYESCKDVKFGTMNTRAIDFVGAGASNFKEWAEFLGQKVPPGFPGSPYSILFKTAILDSSPMKLMNASVYSCNDTSLGCSCGDCPSSPVCSGSEPSPPRKDPCSIGIGSLKVRCVDFSIAILYIVLVFVLFGWALLQRTRGRRRLGSSAEPLLDDMVGEGSSFANLPKDGTHPAEVQWIDPQGQNVVQFSFVQGCLSSFYRTYGRWAARKPTIVLCSSLAIVVLLCLGLLRFEVETRPEKLWVGPGSKAAEEKEFFDSHLAPFYRIEQVQYPVVDLLSVTDPACMVNISASLKNIIGDRPRTSLIIATIPESKHGKPPSIITEENIELLFEIQEKVDGIRANYSGFLVSLSDICLKPLGDDCATQSILQYFQMDPDNYDNYGGVEHAEYCFQHYTSTETCFSAFKAPLEPTTALGGFSGNNYSEQYKRYCTKYTSAPRYAEVWQPNTS

SEQ ID NO: 149819 - protein, 790 aa, Glycine max
  Coding DNA Sequence Number=SeqID_33041
  Gene Ontology: Mol. function=uridine kinase activity; Biological process=biosynthetic process
  Homolog annotation: Hit_ID=Q6EP64; Match level="QueryCoverage=49%, HitCoverage=59%, E-value=8e-44, Identity=31%"; Hit description =Hydroxyproline-rich glycoprotein family protein-like
  Pfam annotation: Domain name=DUF1296; Domain location=15-101; Score =95.2; E_value=1.9e-25; Accession=PF06972.2; Description=Protein of unknown function (DUF1296)
MSGGGGSSSCARVPIPNNVRKIIQDIREITGKQHTDDEIYAILRECSMDPNETAQKLLYLGQVAVHTSLHFFSACRVLFVGRGISYNTFHEVRRRRDRKKEGLSSRASDEPRLKQGGQGRGGRGASGGYSSNFPDGGGGRNQANRRENGVNHTAERSHALFTQPVSQKTKTNTTSQATRVSAVAPHGAANQSNGKSGHDSAGQSPIVSVPKSTSAAKDTGHQENVQPQAAVVAAASSPSQTSGSVTTTDQGKSVSSSDQLQTSVSNVHSSLDLVVASSVSRNPGVSGAISREVGSNWISAGPNHVKGNKVGHEVNDLSASKNEKYGSMNSTSKTNAPQKSNKVENNHLSEPSQLSSPSPNDSLRPSCSSGSQPSLANIAEVSTSEVCVQSSAELRHVTFPNHFQVPKALKSGLTFGSFDTFGPSEKSNSGAGGDNNASPALELSDETATSSNQNASLTAQGDHLDYPHSSPYWIEKTPATKGNPITGTDTKVDQPKKEVLLAPEGQQIPTVQTAQNYGLNFMSTMLGTQQVQFEGTEPQSQDASHFPNFVNASSQAVSPSPTPPLQSSIPVTPQSVSIFRPPYPANFFPYGHYYPPIYVSPIHQFLNHNGFPQQPSAGNMYLPAAAGIKFPVPQFKAGANTGNTAHIGIPSGSFITPPVGYAPGQTVNTGSSTGNQDLAVSQLKESQIYTTGQLSEGSAVWIPAPGQDMSSLQVNSLYNLTPQGQHLTFPPTQAAHGAFAGIFQAGQTVASPSTLLQQSQAVAGPVENVGPPSGSYQPPQPAQINWNSNF

SEQ ID NO: 149820 - protein, 76 aa, Glycine max
  Coding DNA Sequence Number=SeqID_33042
MDLSFFFMVKGRESEVLGYEFFGIINCSPNFGLGVAVGWWSSRWFEYLVESPIVRRENMTRVEEDEWGEAAGPRVD

SEQ ID NO: 149821 - protein, 56 aa, Glycine max
  Coding DNA Sequence Number=SeqID_33043
MEHPNEGGPCWLEITLVVSLEILPVIFALETAKRKGWDIQSFENPPFGPLESPYPM

SEQ ID NO: 149822 - protein, 760 aa, Glycine max
  Coding DNA Sequence Number=SeqID_33044
  Gene Ontology: Mol. function=oligopeptide transporter activity; Cellular component=integral to membrane; Biological process =oligopeptide transport
  Homolog annotation: Hit_ID=Q1SHX0; Match level="QueryCoverage=98%, HitCoverage=94%, E-value=0.0, Identity=77%"; Hit description =Ribosomal protein S2; Oligopeptide transporter OPT superfamily
  Pfam annotation: Domain name=OPT; Domain location=45-722; Score =778.4; E_value=4.3e-231; Accession=PF03169.6; Description=OPT oligopeptide transporter protein
MAGVVDNHQHDSELDIPDESDEVDDSPIEQVRLTVPTTDDPTQAALTFRTWTLGLASCIILSFVNQFFGYRTNPLSISSVSAQIVSLPVGKLMAATLPTKPIRVPLTKWSFSLNPGPFNVKEHALITIFASAGSSGVYAINIITIVKAFYHRNIHPLAAFLLALSTQMLGYGWAGIFRRFLVDSPYMWWPSNLVQVSLFRAFHEKEKRPKGGNTRLQFFFLVFVSSFAYYVIPAYFFQAITTISFVCLIWKNSITAQQIGSGMRGLGIGSFGLDWNTVAGFLGSPLAVPGFAIINILVGFVLFMYVLVPISYWNNLYDAKKFPIISSHTFDSSGATYNVTRVLNAKTFDIDMDSYKNYSKLYLSITFAYDYGLSFATLTATIAHVALFHGKMILQLWKKTRSALKGQEAGDVHTRIMKRNYEQVPEWWFVSILLLMIVVALITCEGFGKQLQLPWWGVLMSLVIALVFTLPIGVIQATTNMLSKGCVLFHGLQQVGLNVITELIIGYIYPGRPLANVAFKTYGYISMSQALGFLQDFKLGHYMKIPPKSMFAVQLVGTIVASGVYFGTAWWLLTTIPDICDDANLPAGSPWTCPGDEVFYNASIIWGIVGPQRMFTKDGIYPGMNWFFLIGLLAPVPVWMLSRKFPNHKWIELINMPLIIAGSGGIPPARSVNYITWGMVGILFNFYVYNKFKAWWARHNYILSAALDAGVAFMGVILYFALQYYDIFGPTWWGQDADDHCPLAKCPTAPGIISHGCPVL

SEQ ID NO: 149823 - protein, 425 aa, Glycine max
  Coding DNA Sequence Number=SeqID_33045
  Homolog annotation: Hit_ID=Q8LFZ9; Match level="QueryCoverage=99%, HitCoverage=100%, E-value=1e-134, Identity=56%"; Hit description =Sucrase-like protein
  Pfam annotation: Domain name=Suc_Fer-like; Domain location=75-289; Score=299.4; E_value=6.4e-87; Accession=PF06999.3; Description =Sucraseferredoxin-like
MASNREREEALTFTIPSSSSHSSPITVSDQLDSYLADPRSASGSFQNDGLLSAGEAAAAADPDFGFSRPDFRQSPLAGTVEFYQRHVFLCYKNPRVWPPRIEAAEFDRLPRLLHAAVVARKSHMKKETRLTICEGHDGTETSNGDVLIFPDMVRYRRLTHFDVETFVEEVLVKDGEWLPGTPEALRGSYVFVCSHGSRDRRCGVCGPVLVSRFREEIELHCLQGKVFVSPCSHIGASQYAGNVIVFGPIMNGEVTGHWYGYVTPDDVPSLLQHHIIKGEILDPLWRGQMGLSVDEQKKKQEQRLLLNDLRNLEDNTQDFVSCCQSSGVGCCQSNGGDSFFRQNHVLLERRMDPDVIESEAKLSADSKSSETVISRINSGKGASRKFLSMTTWLDGWEQEDTYAALAVVCAAVSVAIAYNCYKQLR

SEQ ID NO: 149824 - protein, 261 aa, Glycine max
  Coding DNA Sequence Number=SeqID_33046
  Homolog annotation: Hit_ID=Q1W2L0; Match level="QueryCoverage=77%, HitCoverage=93%, E-value=2e-48, Identity=51%"; Hit description =Putative CPF 0172 family protein
  Pfam annotation: Domain name=UPF0172; Domain location=5-219; Score =296.0; E_value=7e-86; Accession=PF03665.4; Description =Uncharacterised protein family (UPF0172)
MGSNGLRYEIEQNAYIKLVLHSLKHPTSAVNGVLIGRISASNDVVEIADAVPLFHSHIPLLPQLEISLIMIEEYFSAKGLNIVGYFHANERSDDSELGSVAKNIGDHICRYFPQAAVLLLDNKKLDALKKSKDRSAIMQFVAFALDSSSLLMLLYVRDTSKNWKLVQSDGNNRFSLKEPSANLVLLDYIASEKWNDVVDFDDHLDDISKAFQLIPALLSPFLPYLLCKWRILRLILVHILDPHRRTFRDYILTFDPRKVAS

SEQ ID NO: 149825 - protein, 138 aa, Glycine max
  Coding DNA Sequence Number=SeqID_33047
  Gene Ontology: Mol. function=transporter activity; Cellular component= membrane; Biological process=sodium ion transport
  Homolog annotation: Hit_ID=A0FKR1; Match level="QueryCoverage=77%, HitCoverage=20%, E-value=4e-26, Identity=54%"; Hit description =Vacuolar citrate/H+ symporter
MEKVVPMIKSIGLSPSHSKFTVTVVSLICSIVTEFITSNAATATLLVPLLYHIAGTMHVHPLILIIPGGIATEFAFWLPTSTPSNVVGFATGHIEIKDMFKVGVPLKVVGIVVLSLLMPSLGTIVFGTNNDTHNKGHH

SEQ ID NO: 149826 - protein, 227 aa, Glycine max
  Coding DNA Sequence Number=SeqID_33048
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=97%, HitCoverage=27%, E-value=3e-63, Identity=54%"; Hit description =Cellulose synthase-like protein CslE
MGEEEEGARQQESHVDVSLFETKEARFRGVYKVFASTIFAAICLIWVYRVANIPTVASGRWTWISVMVSELCFGIYWIITQSVRWKIVYQTPFKHRLLQRSISSTDSLNLNAIFVILYDEESLPAVDIFVCTADPTLEPPCMVMNTVLSAMAYNYPANKLSVYLSDDGGSELTFYALLKASIFSKHWLPFCRRFNVEPRSPEAFFAAHNCSNSSTEYSQAWFIYQGH

SEQ ID NO: 149827 - protein, 100 aa, Glycine max
  Coding DNA Sequence Number=SeqID_33049
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=86%, HitCoverage=11%, E-value=2e-22, Identity=54%"; Hit description =Cellulose synthase-like protein CslE
MKSEIESAVARGEVPDNAMNQHRGFSEWNPKITKQNHQPIVQIIIDGRDTNAVDEDGFQLPRVVYMAREKRHNYPHHFKAGAVNALVSNTHSIPLTMYAN

SEQ ID NO: 149828 - protein, 136 aa, Glycine max
  Coding DNA Sequence Number=SeqID_33050
  Gene Ontology: Mol. function=RNA binding; Biological process =regulation of transcription, DNA-dependent
  Homolog annotation: Hit_ID=Q9LK54; Match level="QueryCoverage=91%, HitCoverage=25%, E-value=2e-50, Identity=76%"; Hit description =Similarity to SUN and FMU proteins
  Pfam annotation: Domain name=NusB; Domain location=21-136; Score=0.5; E_value=0.0016; Accession=PF01029.9; Description=NusB family
MKLSGGGNRLLKTQKLNSEVSPHRAVSAVRLMRIELGGAFADLLNEKGKGSGENEMGYVQRTLGFRTRELNHHDLRLVTDIVGGTIRWRRYLDHLISSLCHDKDISSMEPLLLQILRIGFYEIVKLDMPPYAVVDE

SEQ ID NO: 149829 - protein, 52 aa, Glycine max
  Coding DNA Sequence Number=SeqID_33051
MVLWGSFNGFEGEEEEEEEGAVFWGSAGKGKPIYSTRAMLRFLAVCLALLFG

SEQ ID NO: 149830 - protein, 378 aa, Glycine max
  Coding DNA Sequence Number=SeqID_33052
  Gene Ontology: Mol. function=RNA binding; Cellular component=nucleus; Biological process=regulation of transcription, DNA-dependent
  Homolog annotation: Hit_ID=Q9LK54; Match level="QueryCoverage=99%, HitCoverage=66%, E-value=1e-138, Identity=67%"; Hit description =Similarity to SUN and FMU proteins
  Pfam annotation: Domain name=Nol1_Nop2_Fmu; Domain location=77-375; Score=102.8; E_value=1e-27; Accession=PF01189.8; Description =NOL1NOP2sun family
MQNVKLAKFALRPGAGNMVNGILRKLVVLKEKESLPLPKVEGDDRAQARALATLYSHPVWMVRRWTKYLGQEEAIKLMIWNNSEPSFSLRLVNISSIFLCSTQSSIANRARGFSRDDLVTQLNALKVPHKLSPHLDEFVRIKTGLQIIIQAGLLKKGLCSVQDESAVCHTSLIAGLVVSVVDPQPGETIIDCCAAPGGKTLYMASHLSGQGKVFAIDVNSGRLRILKETAKLHQVDGVITAIHADLRTLPDSGQLKSNKVLLDAPCSGLGVLSKRADLRWNKNLEDMEQLKELQDELLDAASKLVKPGGVLVYSTCSIDPEENDDRVVAFLARHSDFHIDPVDRYVPPDFETSSGFFFSNPVKHSLDGSFAARLVRDL

SEQ ID NO: 149831 - protein, 55 aa, Glycine max
  Coding DNA Sequence Number=SeqID_33053
MYGLIQIHDGVIVHNGQEEREHNPGMVKGVFAFVGSVLSLPLSSSHSHAFSFQPK

SEQ ID NO: 149832 - protein, 63 aa, Glycine max
  Coding DNA Sequence Number=SeqID_33054
MEHGNSFFHHAQCEKSISAVIPPIVPNPTMETIMGGDGSSSSSVNVYCDHPAACFNRDNSFGN

SEQ ID NO: 149833 - protein, 127 aa, Glycine max
  Coding DNA Sequence Number=SeqID_33055
  Gene Ontology: Mol. function=nucleotidyltransferase activity; Biological process=NAD biosynthetic process
  Homolog annotation: Hit_ID=UPI00004BDF5F; Match level="QueryCoverage =49%, HitCoverage=25%, E-value=2e-09, Identity=48%"; Hit description =Nicotinamide mononucleotide adenylyltransferase 3 (EC 2.7.7.1) (NMN adenylyltransferase 3).
MFGFGEVDPCSDGVAALEVEAGIELDGDEGEGEEEEEGEAVMDVPLPPDELALDLINNEPSPGNTRKYVPVCTLARDALNSNGYCIIGGYLSPVNDAYKKKGLISAEHRIQLYQLACKISDFVMVDP

SEQ ID NO: 149834 - protein, 279 aa, Glycine max
  Coding DNA Sequence Number=SeqID_33056
  Gene Ontology: Mol. function=hydrolase activity; Cellular component =cytosol; Biological process=carbohydrate biosynthetic process
  Homolog annotation: Hit_ID=Q67V42; Match level="QueryCoverage=96%, HitCoverage=89%, E-value=6e-81, Identity=54%"; Hit description=MutT domain protein-like
  Pfam annotation: Domain name=NUDIX; Domain location=105-236; Score =102.3; E_value=1.4e-27; Accession=PF00293.18; Description=NUDIX domain
MSISASSGDFEILPATDDAHGGVIIDLKEPMDSEIFVTLLRTSLSQWKKQEKCGVWIKLPTALVNLVETAVKEGFGYHHAEPNYLMLVYWIIPETSCTIPPNASHRVRVGGLVLNDNKEVLVVQEKRGIFHETGLWKIPTGIVEAGEELSAAVVREAKEETGIDTEFVELLAFRHAHNSFFGKSELYFLCMLRPLSTDIKKQDLEIDAAKWMPFEEYAARPITEPFKYEIELCLAKLERSYAGFSPRPISSYYKEELSYLYLNSHDLDKSSKSFEVFRS

SEQ ID NO: 149835 - protein, 77 aa, Glycine max
  Coding DNA Sequence Number=SeqID_33057
  Homolog annotation: Hit_ID=Q9FHG4; Match level="QueryCoverage=75%, HitCoverage=7%, E-value=7e-09, Identity=61%"; Hit description =Serine/threonine-specific kinase like protein
MRLSCVANPDSAERPSMRRVLQILNNVAAPLVVLKVKPTLTFSSDLPLLLTIEDIVSEADEEEFGTSSQSMCEIKIH

SEQ ID NO: 149836 - protein, 220 aa, Glycine max
  Coding DNA Sequence Number=SeqID_33058
MVKVISESSPSLLTLLIALLSTLFLVTLAKKKGSLHENLVQDNQQKLELQPSLEDVTIQQNETAERQAEAHSESSFSLDCESRNIMDTSFVLSAEKYYEQKADPQSDTSLPSDSESTTSSTMDEESIKIHHNTDQNLDISDSLVFDYDVDEEEEDGLIEIKLPNNYFLEFLPESIFKQQGLTELWAEINEMNEDENLIEIDISKGSTKHQDLRLEKELVC

SEQ ID NO: 149837 - protein, 388 aa, Glycine max
  Coding DNA Sequence Number=SeqID_33059
  Gene Ontology: Mol. function=potassium channel activity; Cellular component=integral to membrane; Biological process=potassium ion transport
  Homolog annotation: Hit_ID=Q9LLM5; Match level="QueryCoverage=89%, HitCoverage=100%, E-value=1e-115, Identity=61%"; Hit description =Outward-rectifying potassium channel KCO1
  Pfam annotation: Domain name=Ion_trans_2; Domain location=111-193; Score=81.5; E_value=2.6e-21; Accession=PF07885.6; Description=Ion channel
  Pfam annotation: Domain name=Ion_trans_2; Domain location=232-307; Score=66.8; E_value=6.9e-17; Accession=PF07885.6; Description=Ion channel
  Pfam module annotation: Pfam domain module=Ion_trans_2::Ion_trans_2; Domain location=111-193::232-307
MAYGCSFTFLPYLTDVASLNCFATESGPILLILVSKFLCMANNGAKDPLLSGSLDATQKTKQQLLNKRRLLRSRSAPHAELVPTETNCNESIPRTASIFQNLHPSFKRMAIYLAVYLGVGALIFYLVRNQIKGQKTDGILDALYFTIVTMTTVGYGDLVPNSHLAKLLACAFVFSGMALIGLIVSKAADYLVEKQELLLVKAMRMHQKIGSTEILREVETNKTRYKLFLVFSLLLILIIVGTIFLVTVEKLDVIDAFYCVCSTITTLGYGDQSFSTQAGRIFAVFWILTGTITLAQLFVYIAELNTEIRQKELVKWVLTRKVTNLDLEAADLDEDGTVGAAEFVIYKLKEMGKISQEDISLVMQEFEQLDVDDSGTLSTSDITLAQSS

SEQ ID NO: 149838 - protein, 54 aa, Glycine max
  Coding DNA Sequence Number=SeqID_33060
  Gene Ontology: Mol. function=DNA topoisomerase (ATP-hydrolyzing) activity; Cellular component=chromosome; Biological process =regulation of transcription, DNA-dependent
MAYDTKHLRVPEIQWLGAFPSDSERYFVPNQCLLPLTAEACWTFMCQALYKQLD

SEQ ID NO: 149839 - protein, 96 aa, Glycine max
  Coding DNA Sequence Number=SeqID_33061
  Subcellular localization annotation: CTP_CleavageSite=80; ConfidenceScore=5.08e-01
MEGKRTRFQSESQPQSNSLELCSQTSPTDAHRSFSSIASEATAPFPTPTGSILIPTNHRFTSSFLTQMFRNAAFVPPICRAERNFSRFAGNPTPTD

SEQ ID NO: 149840 - protein, 94 aa, Glycine max
  Coding DNA Sequence Number=SeqID_33062
  Homolog annotation: Hit_ID=Q9LK55; Match level="QueryCoverage=93%, HitCoverage=95%, E-value=9e-14, Identity=45%"; Hit description =Arabidopsis thaliana genomic DNA, chromosome 3, P1 clone:MJG19
MEIPEKVVKFRYHFLGAMLFSLVIMAPRFMTLLTYFWPLFLSTALVLALVFFFAKTSPLHSADATSSLHNAGEALLDYVAGHHDLPLDTRHNSD

SEQ ID NO: 149841 - protein, 444 aa, Glycine max
  Coding DNA Sequence Number=SeqID_33063
  Gene Ontology: Mol. function=pyridoxal phosphate binding; Cellular component=mitochondrion; Biological process=cysteine biosynthetic process from serine
  Homolog annotation: Hit_ID=Q10PZ5; Match level="QueryCoverage=76%, HitCoverage=88%, E-value=1e-104, Identity=59%"; Hit description =Pyridoxal-phosphate dependent enzyme family protein, expressed
  Pfam annotation: Domain name=PALP; Domain location=108-412; Score =134.6; E_value=2.7e-37; Accession=PF00291.15; Description=Pyridoxal -phosphate dependent enzyme
MKGLRHYIVSWNIGIDTGTVAEYIIKEHCVYLISRNCGEYPGAEEEWPKIGQEGHESWGHDHEREEHCPEKMVSELDHLLWDLHGNYVSEEEEQQIKQEGGRHRQHSFDDSDQQPLRRCQILGKCEFLNPGGSVNDRVAVHIIQEALESDQLRPDGIVTEGSAGSTAISIATIAPAYGCRTHVVIPDDAAIEKSETGVHYPQRPFCQIARRRASEANEFALKRTNSQQLNGKEDTEKINGYESDGCSYSSLFPEDCQGGFFADQFENLANFRAHYEAAGTGGTVAGVSKFLQEKNPNIKCFLVDPPGSGLFNRVTRAVMYTKEEADGRRLKNPFDTITEGIGINRITRNFAMAKLDGAFRGTDREAVEMSRFLLKNDGLFLGSSSAMNCVGAVRVAQAIGPGHTIVTILCDSGMRHLSKFYDAEYLSLLGLTPKATGLELLGIK

SEQ ID NO: 149842 - protein, 131 aa, Glycine max
  Coding DNA Sequence Number=SeqID_33064
  Homolog annotation: Hit_ID=Q8VYE2; Match level="QueryCoverage=43%, HitCoverage=15%, E-value=7e-07, Identity=47%"; Hit description =Import inner membrane translocase subunit TIM50, mitochondrial precursor
  Subcellular localization annotation: CTP_CleavageSite=22; ConfidenceScore=5.50e-01
MSLGILRSRAISLASKRFLCTNAASASPPLPPPPSAASPSRWSFLKYALVGALTGGTVFAGYASYAYSLDEIEQKTRSLRESAKYTAGDGVTALDVSIDYFLGFLRFQSSLLILCFDLIGWIVRIILAELD

SEQ ID NO: 149843 - protein, 243 aa, Glycine max
  Coding DNA Sequence Number=SeqID_33065
  Subcellular localization annotation: CTP_CleavageSite=24; ConfidenceScore=5.04e-01
MTHNLKAHYYLVKLTQLLVSVSVCSFIFSPSSLLVFLHYFKFYFSTFPFQLYTHNIDKNSMFLLCNGILVFVGITKSLSGSSCCDDNKPSTYVKDDGSQSRFSVIEANELMLEIVETEEQTSDPDEQNTVVEQVIEIENCAEEEVQENIEKIILVDEGEEKGSSLVLKEEKKEELDEETELLDVGDEEEDKGSETDYILIEERIEEEEESCMLSTEELNKKFEDFIRKMKEDLRIEAQRQLVM

SEQ ID NO: 149844 - protein, 188 aa, Glycine max
  Coding DNA Sequence Number=SeqID_33066
  Gene Ontology: Mol. function=protein serine/threonine phosphatase activity; Cellular component=integral to membrane; Biological process=protein transport
  Homolog annotation: Hit_ID=Q8VYE2; Match level="QueryCoverage=89%, HitCoverage=44%, E-value=6e-57, Identity=62%"; Hit description =Import inner membrane translocase subunit TIM50, mitochondrial precursor
  Pfam annotation: Domain name=NIF; Domain location=5-156; Score=36.7; E_value=1.3e-10; Accession=PF03031.8; Description=NLI interacting factor-like phosphatase
MHWISYCLASRWRSLHIIERDTGWQTFKRPGVDAFLEHLAQFYEIVVYTDEQNMFVDPVIERLDTKHCIRYRLSRPATKYQDGKHFRDLSKLNRNPGKVLYLSGHALESCLQPENCLPIKAWQQQDIDDTALLDFIPFLEFVARSSPPDIRPVLASYQGCDIPSEFIRRSKEHQRRMQEQKNRGRFWK

SEQ ID NO: 149845 - protein, 231 aa, Glycine max
  Coding DNA Sequence Number=SeqID_33067
  Gene Ontology: Mol. function=pectinesterase activity; Cellular component=cell wall; Biological process=cell wall modification
  Homolog annotation: Hit_ID=Q9FM79; Match level="QueryCoverage=89%, HitCoverage=59%, E-value=3e-62, Identity=51%"; Hit description =Similarity to pectin methylesterase
  Pfam annotation: Domain name=Pectinesterase; Domain location=57-231; Score=-95.5; E_value=2e-14; Accession=PF01095.10; Description =Pectinesterase
MGLVSSRVVFLFVVSVLVIWAQVDLAEGGGVRNYISWEDLQVDEQRLAVNSHNNVRVIIVNQNGGGHSKTVQGAVNMVPDNNTQRVKIYIYPGIYREKVYVPVTKPYVSFIGKTNQTASPVITWNSKSSDIGPNGTALGTYASATVGVDSNYFCATGVTFENSVITSAGGKGMQGVALRVSSPKAMFYRVRIKGSQDTLLDNIGNHYFFKCHIIGKVDFICGRAKSLYEVI

SEQ ID NO: 149846 - protein, 232 aa, Glycine max
  Coding DNA Sequence Number=SeqID_33068
  Gene Ontology: Mol. function=pectinesterase activity; Cellular component=cell wall; Biological process=cell wall modification
  Homolog annotation: Hit_ID=Q9FM79; Match level="QueryCoverage=79%, HitCoverage=49%, E-value=3e-65, Identity=63%"; Hit description =Similarity to pectin methylesterase
  Pfam annotation: Domain name=Pectinesterase; Domain location=18-230; Score=-27.6; E_value=1.4e-19; Accession=PF01095.10; Description =Pectinesterase
MNARGANITANAKALKNNITANANALNITEIANAIPIITNSTKASDKGSDGQEMGTVSTATVWVESDFFCATALTIENLVDKDADKRQAVALRVDGDKAVFYRVKLVGEQDTLLDSTGIHYFYRSYIQGSVDFICGNAKSLFHECVLDSVAEFWGAIAAHHRDSEDEDTGFSFVNCTIKGSGSVFLGRAWGKYATTTYSYCHMDDVIFPLGWSDWGDPSRQGYHTNYQLSLK

SEQ ID NO: 149847 - protein, 267 aa, Glycine max
  Coding DNA Sequence Number=SeqID_33069
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=60%, HitCoverage=13%, E-value=5e-45, Identity=45%"; Hit description=Chromo
MAGYATTSLPLFQLKLGVIHSTLSLLSISLNSPNGFEDEVQALKPQGTILAMSSSYHPQLDGQIENLNEIFEMYLKCFVFEHPKKVFGRPPPSVMHYEAQQYMKMQADKKRRDLQFKVGDLVLVKLQPYRQHSVALRKHQKLGMRYFGPFRVIKRIGTVAYKVKLSESAKIHPVFHVALQKPFHGKSPPPYLPFPLTSSELGPTLCPWKDKVVFDGKGNATCIKKEEELARNSIRREGHVAHDPQSKGDRRSTRLRRENIRLEDYTF

SEQ ID NO: 149848 - protein, 450 aa, Glycine max
  Coding DNA Sequence Number=SeqID_33070
  Gene Ontology: Mol. function=monooxygenase activity; Cellular component=membrane; Biological process=electron transport
  Homolog annotation: Hit_ID=Q1SDT3; Match level="QueryCoverage=63%, HitCoverage=56%, E-value=3e-86, Identity=57%"; Hit description=E -class P450, group I
  Pfam annotation: Domain name=p450; Domain location=4-294; Score= -87.3; E_value=5.3e-07; Accession=PF00067.12; Description=Cytochrome P450
MVHMKGVVETIEGFSLADLYPSIGLLQVLTGIKTRVEKIQRGMDTILENIVRDHRNKTLDTQAIGEENGEYLVDVLLRLPCLTVCCQSNHFESKLKGCLLLNRLERIQTCYNEFVRRTFSVKNPRVMEKVQIEVRRVFNGKGYVDETSIHELKYLRSVIKETLRLHPPSPLMLSRECSKRCEINGYEIQIKSKVIVNAWAIGRDPKYWIEAEKFSPERFIDCSIDYEGGEFQFIPYGAGRRICPGINFGIVNVEFSLANLLFHFDWKMAQGNGPEELDMTESFGLKNLYHFFTNKVLDTTCTKAHAAGIVREGSAQHQIVPLEDRNSCLVLELQALTLWFKLELENKIINLDDDDAGCTSKALHGKKAISQTIAENEHPCSSDAIRHKSIFTEAQRIEAIKRKCLYDMQSSTSSSSSDDSFEFDGSNPPKRRKTALDSSGLNSLPRYMEQ

SEQ ID NO: 149849 - protein, 508 aa, Glycine max
  Coding DNA Sequence Number=SeqID_33071
  Gene Ontology: Mol. function=monooxygenase activity; Cellular component=membrane; Biological process=electron transport
  Homolog annotation: Hit_ID=Q1SDT7; Match level="QueryCoverage=98%, HitCoverage=98%, E-value=0.0, Identity=67%"; Hit description=E-class P450, group I
  Pfam annotation: Domain name=p450; Domain location=40-500; Score =363.6; E_value=3.1e-106; Accession=PF00067.12; Description =Cytochrome P450
MEMELHISLSTILPFFILVFMLIINIVWRSKTKNSNSKLPPGPRKLPLIGNIHHLGTLPHRSLARLANQYGPLMHMQLGELSCIMVSSPEMAKEVMKTHDIIFANRPYVLAADVITYGSKGMTFSPQGTYWRQMRKICTMELLAPKRVDSFRSIREQELSIFVKEMSLSEGSPINLSEKISSLAYGLISRIAFGKKSKDQEAYIEFMKGVTDTVSGFSLADLYPSIGLLQVLTGIRPRVEKIRRGMDRIIDNIVRDHRDKNSDTQPVVGEENGEDLVDVLLRLQKNGNLQHPLSDTVVKATIMDIFSAGSETTSTTMEWAMSELVKNPRMMEKAQIEVRRVFDPKGYVDETSIHELKYLRSVIKETLRLHTPVPLLLPRECSERCEINGYEIPAKSKVIVNAWAIGRDPNYWIEAEKFSPERFIDCSIDYKGGEFQFIPFGAGRRICPGINLGIVNVEFSLANLLFHFDWKMAPGNSPQELDMTESFGLSLKRKQDLQLIPITYHTAA

SEQ ID NO: 149850 - protein, 866 aa, Glycine max
  Coding DNA Sequence Number=SeqID_33072
  Gene Ontology: Mol. function=binding; Cellular component =mitochondrion; Biological process=protein amino acid phosphorylation
  Homolog annotation: Hit_ID=Q7XHS8; Match level="QueryCoverage=97%, HitCoverage=96%, E-value=0.0, Identity=62%"; Hit description =Putative pentatricopeptide (PPR) repeat-containing protein
  Pfam annotation: Domain name=PPR; Domain location=129-163; Score=9.6; E_value=0.54; Accession=PF01535.11; Description=PPR repeat
  Pfam annotation: Domain name=PPR; Domain location=164-198; Score =18.8; E_value=0.019; Accession=PF01535.11; Description=PPR repeat
  Pfam annotation: Domain name=PPR; Domain location=199-233; Score =35.3; E_value=2.2e-07; Accession=PF01535.11; Description=PPR repeat
  Pfam annotation: Domain name=PPR; Domain location=234-268; Score =41.8; E_value=2.3e-09; Accession=PF01535.11; Description=PPR repeat
  Pfam annotation: Domain name=PPR; Domain location=269-303; Score =40.3; E_value=6.8e-09; Accession=PF01535.11; Description=PPR repeat
  Pfam annotation: Domain name=PPR; Domain location=304-338; Score =38.4; E_value=2.4e-08; Accession=PF01535.11; Description=PPR repeat
  Pfam annotation: Domain name=PPR; Domain location=339-372; Score =25.6; E_value=0.00018; Accession=PF01535.11; Description=PPR repeat
  Pfam annotation: Domain name=PPR; Domain location=373-407; Score =42.4; E_value=1.6e-09; Accession=PF01535.11; Description=PPR repeat
  Pfam annotation: Domain name=PPR; Domain location=408-442; Score =24.6; E_value=0.00035; Accession=PF01535.11; Description=PPR repeat
  Pfam annotation: Domain name=PPR; Domain location=443-477; Score =41.7; E_value=2.5e-09; Accession=PF01535.11; Description=PPR repeat
  Pfam annotation: Domain name=PPR; Domain location=478-512; Score =36.1; E_value=1.2e-07; Accession=PF01535.11; Description=PPR repeat
  Pfam annotation: Domain name=PPR; Domain location=513-547; Score =21.1; E_value=0.0039; Accession=PF01535.11; Description=PPR repeat
  Pfam annotation: Domain name=PPR; Domain location=548-582; Score =34.1; E_value=4.9e-07; Accession=PF01535.11; Description=PPR repeat
  Pfam annotation: Domain name=PPR; Domain location=583-617; Score =50.3; E_value=6.5e-12; Accession=PF01535.11; Description=PPR repeat
  Pfam annotation: Domain name=PPR; Domain location=618-652; Score =32.7; E_value=1.3e-06; Accession=PF01535.11; Description=PPR repeat
  Pfam annotation: Domain name=PPR; Domain location=653-687; Score =42.6; E_value=1.4e-09; Accession=PF01535.11; Description=PPR repeat
  Pfam annotation: Domain name=PPR; Domain location=688-722; Score =39.6; E_value=1e-08; Accession=PF01535.11; Description=PPR repeat
  Pfam annotation: Domain name=PPR; Domain location=723-757; Score =46.5; E_value=9e-11; Accession=PF01535.11; Description=PPR repeat
  Pfam annotation: Domain name=PPR; Domain location=758-792; Score =43.0; E_value=9.9e-10; Accession=PF01535.11; Description=PPR repeat
  Pfam annotation: Domain name=PPR; Domain location=793-827; Score =18.8; E_value=0.019; Accession=PF01535.11; Description=PPR repeat
  Pfam annotation: Domain name=PPR; Domain location=94-128; Score=18.5; E_value=0.025; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR; Domain location=129-163::164-198::199-233::234-268::269 -303::304-338::...
  Pfam module annotation: Domain location=339-372::373-407::408 -442::443-477::478-512::513-547::548-582::583-617::618-652::653 -687::688-722::723-757::758-792::793-827::94-128
MYGKVKVNSFVDDASHSQDNALKSEGMRKTVHDVCRVLDTYPWGAALEDALNTFDEMPQPELVVGVIRRLKDVRVALHYFRWVERKTKQLHSPEAYNALLMLMARTRNLEYLEQILEEMSMAGFGPSNNTCIEMVASFVKSRKLREAFGVIETMRKFKFRPAYSAYTTLIGALSAAHEADPMLTLLRQMQEIGYEVTVHLFTTLICVFAREGRVDAALSLLDEMKSNSFNADLVLYNVCIDCFGKVGKVDMAWKFFHELKSQGLVPDDVTFTSMIGVLCKAERVDEAVELFEELDSNKSVPCVYAYNTMIMGYGSVGKFNEAYSLLERQKRKGCIPSVIAYNCILTCLGRKGKVEEALRILEAMKMDAAPNLTSYNILIDMLCKAGELEAALKVQDSMKEAGLFPNIITVNIMIDRLCKAQRLDEACSIFLGLDHKVCTPDSVTFCSLIDGLGRHGKVNDAYMLYEKMLDSGQTPNAVVYTSLIRNFFKCGRKEDGHKIYKEMMHRGCSPDLMLLNNYMDCVFKAGEIEKGRALFEEIKAQGLTPDVRSYSILIHGLVKGGFSKDTYKLFYEMKEQGLHLDTRAYNIVIDGFCKSGKVNKAYQLLEEMKTKGLQPTVVTYGSVIDGLAKIDRLDEAYMLFEEAKSKAVDLNVVVYSSLIDGFGKVGRIDEAYLILEELMQKGLTPNTYTWNCLLDALVKAEEIDEALVCFQNMKNLKCPPNEVTYSIMVNGLCKVRKFNKAFVFWQEMQKQGLKPNTITYTTMISGLARVGNVLEAKDLFERFKSSGGIPDSACYNAMIEGLSNANKAMDAYILFEETRLKGCRIYSKTCVVLLDALHKADCLEQAAIVGAVLREMAKSQHATRLS

SEQ ID NO: 149851 - protein, 479 aa, Glycine max
  Coding DNA Sequence Number=SeqID_33073
  Gene Ontology: Mol. function=oxidoreductase activity; Cellular component=membrane; Biological process=electron transport
  Homolog annotation: Hit_ID=O48923; Match level="QueryCoverage=99%, HitCoverage=100%, E-value=0.0, Identity=69%"; Hit description =Cytochrome P450 71D10
  Pfam annotation: Domain name=p450; Domain location=43-472; Score =291.9; E_value=1.2e-84; Accession=PF00067.12; Description=Cytochrome P450
  Subcellular localization annotation: CTP_CleavageSite=2; ConfidenceScore=5.10e-01
MVMELQSQNNPFSIHLITFFLFLLFLLFKLVKKSSSNNTSKLPPGPKTLPLIGNLHQLVGSKSHHCFKKLADKYGPLMHLKLGEVSNIIVTSKELAQEIMRTQDLNFADRPNLVSTKIVSYNATSISFAPHGDYWRQLRKLCTVELLTSKRVQSFRSIREDEVSELVQKIRAGASEEGSVFNLSQHIYPMTYAIAARASFGKKSKYQEMFISLIKEQLSLIGGFSLADLYPSIGLLQIMAKAKVEKVHREVDRVLQDIIDQHKNRKSTDREAVEDLDMFIGGGETSSSTVEWSMSEMVRNPWAMEKAQAEVRKVFDSKGYVNEAELHQLTYLKCIIREAMRLHPPVPLLIPRVNRERCKINGYEIPAKTRVFINAWAIGRDPKYWTEAESFKPERFLNSSIDFKGTNYEFIPFGAGRRICPGISFATPNIELPLAHLLYHFDWKLPNNMKNEELDMTESYGATARRAKDLCLIPITVRP

SEQ ID NO: 149852 - protein, 783 aa, Glycine max
  Coding DNA Sequence Number=SeqID_33074
  Gene Ontology: Mol. function=DNA topoisomerase (ATP-hydrolyzing) activity; Cellular component=chromosome; Biological process=DNA topological change
  Homolog annotation: Hit_ID=Q0GPD2; Match level="QueryCoverage=32%, HitCoverage=93%, E-value=1e-116, Identity=86%"; Hit description=BZIP transcription factor bZIP107
  Pfam annotation: Domain name=DUF630; Domain location=1-60; Score =118.0; E_value=2.6e-32; Accession=PF04783.3; Description=Protein of unknown function (DUF630)
  Pfam annotation: Domain name=DUF632; Domain location=336-673; Score =474.9; E_value=1e-139; Accession=PF04782.3; Description=Protein of unknown function (DUF632)
  Pfam module annotation: Pfam domain module=DUF630::DUF632; Domain location=1-60::336-673
MGCASSKLEDLPAVALCRERCGFLDEAIHQRYALAAAHIAYINSLKSIGHSLHLFIQQDMDSPPSPSSSPSPPHKLAQHLPPSSPSPSDSLGSHLHFHSDSDDLPSLHHSPQSSSPIPIASYFTGPDHHPPHLHMNFMQNKASPSIVYEQMPLSPQTMYVGESSSSSFYPYQYPPYPYPYDPYSVGVPSSSPPPQQRLPVSKPPPPPPSPPRSSPWDFLNFFDNSDDKYYSQTPYPATATATPSRDSREVREEEGIPDLEDEDYHHHEVVKQVHGDQKLVQPKHEPPPSSHHKPDEEDEDDDDDDDDDDDDDDDEDEVEYEVHVVDKKVVDGDNNDGNKAKEHAALRTRRPGSRNPLEVAKEIQILFQRASDSGAQIAKILEVGKLPHNRKHAAYQASSKMLQVVAPSLSLVSSQPSTSKDAESASAANMDFDVDLTTGGRNLSSTLQKLLLWEKKLFNEVKAEEKMRVMHDRKCRKLKRLDDRGADFHKVDSTRTLVRNLSTKIRMAIQVVDKISMTINKIRDEELWPQLKELIQGLTRMWKSMLECHHDQCEAIREARILGSIGSRKKSSDSHLQATKQLEHELINWTFQFSGWISAQKGYVRALNNWLLKCLLYEPEETPDGIVPFSPGRIGAPQIFVICNQWSQALDRISEKEVVDSMHVFTMSVLQIWEQDKLEMHRQVMQNKDLERKVRNMDRDDQKLQKQIQALERKVVLVSGEGKGLSVSENIIYQSDKSSSLQASLQCIFEAMERFTDETVRAYEELLQRSKEESAARNHERVS

SEQ ID NO: 149853 - protein, 342 aa, Glycine max
  Coding DNA Sequence Number=SeqID_33075
  Gene Ontology: Mol. function=protein kinase activity; Cellular component=chloroplast; Biological process=protein amino acid phosphorylation
  Homolog annotation: Hit_ID=Q10S67; Match level="QueryCoverage=83%, HitCoverage=53%, E-value=1e-131, Identity=80%"; Hit description =Protein kinase family protein, putative, expressed
  Pfam annotation: Domain name=Pkinase; Domain location=75-326; Score =19.2; E_value=1e-09; Accession=PF00069.15; Description=Protein kinase domain
  Pfam annotation: Domain name=Pkinase_Tyr; Domain location=88-326; Score=-52.3; E_value=2.9e-09; Accession=PF07714.7; Description =Protein tyrosine kinase
  Pfam module annotation: Pfam domain module=Pkinase::Pkinase_Tyr; Domain location=75-326::88-326
MGCCQSSMLLRVGERETHPEKEKEREKEKEQAYGNHQRQSEGGEGDGEKEVVDFSFSEFSLAELKAATNNFSSEYIVSESGEKAPNLVYKGRLQNQSRWIAVKKFSKSAWPDPKQFVEEASGVGKLRHPRLANLIGYCCDGDERLLVAEYMPNDTLAKHLFHWETQTIEWAMRLRVALYIAQALHYCSSEGRPLYHDLNAYRVLFDQEGDPRLSCFGFMKNSRDGKSYSTNLAYTPPEYLRNGRVTPESVIYSFGTVLLDLLSGKHIPPSHALDMIQGKNNMLLMDSHLEGKFSTEEATVVVNLASKCLQYEPRERPDTKDLVTTLAPLHTKPDVQIPSLTS

SEQ ID NO: 149854 - protein, 1251 aa, Glycine max
  Coding DNA Sequence Number=SeqID_33076
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=95%, HitCoverage=95%, E-value=0.0, Identity=54%"; Hit description =Multidrug resistance-associated protein 3
  Pfam annotation: Domain name=ABC_membrane; Domain location=298-567; Score=82.8; E_value=1.1e-21; Accession=PF00664.13; Description=ABC transporter transmembrane region
  Pfam annotation: Domain name=ABC_membrane; Domain location=921-1198; Score=83.6; E_value=6.2e-22; Accession=PF00664.13; Description=ABC transporter transmembrane region
  Pfam annotation: Domain name=ABC_tran; Domain location=641-812; Score= 142.9; E_value=8.4e-40; Accession=PF00005.17; Description=ABC transporter
  Pfam annotation: Domain name=MMR_HSR1; Domain location=642-719; Score= -17.1; E_value=0.037; Accession=PF01926.13; Description=GTPase of unknown function
  Pfam module annotation: Pfam domain module=ABC_membrane::ABC _membrane::ABC_tran::MMR_HSR1; Domain location=298-567::921-1198::641- 812::642-719
MLSLSNVHLSTAVLLKPIFLHGLSGFLHLLLLVAVVLSWVWRKFTAGPGDESKKKPNNSLFKTTVFSSLALSAFNFLLCFINYFYWYTSGWSEEKLVTLLDLALKTLAWGVVCVCLQKGFFSSGQRRFSFFFRAWFTFYLSVSCYCIVVDIVVMSGRRVSLPTQYLVSDAVSTCVGFFFCYVGYFVKNEVHVDNDIQEPLLNADSLESKETKGGDTVTPFSNAGILSILTFSWVGPLIAVGNKKTLDLEDVPQLDSRDSVIGAFPTFREKVEADCGGINSVTTLKLVKSLIISAWKEILITAFLVLLKTLASYVGPYLIDGFVQYLDGQRLYENQGYFLVSAFFFAKLVECLTQRHWFFRLQQVGLRIRALLVTMIYNKALTLSCQSKQGHTSGEIINFMTVDAERVGVFSWYMHDLWMVALQVTLALLILYKNLGLASIAAFVATVAIMLANVPLGSLQEKFQKKLMESKDTRMKATSEILRNMRILKLQGWEMKFLSKITELRKNEQGWLKKYVYTAAVTTFVFWGSPTFVSVVTFGTCMLMGIPLESGKILSALATFRILQEPIYGLPDTISMIAQTKVSLDRIVSFLRLDDLRSDVVEKLPWGSSDTAIEVVDGNFSWDLSSPSPTLQNINLKVFHGMRVAVCGTVGSGKSTLLSCVLGEVPKISGILKVCGTKAYVAQSPWIQSGKIEDNILFGERMDRDRYEKVLEACSLKKDLEILSFGDQTIIGERGINLSGGQKQRIQIARALYQDADIYLFDDPFSAVDAHTGSHLFKECLLGLLCSKTVVYVTHQVEFLPAADLILVMKDGKITQCGKYTDLLNSGADFMELVGAHKKALSTLDSLDGAAVSNEISVLEQDVNVSDTHGFKEKEASKDEQNGQTDNKSELQGQLVQEEEREKGKVGFSVYWKCITTAYGGALVPFILLAQILFQALQIGSNYWMAWATPISEDVQPPVEGTTLIAVYVGLAIGSSFCILARAILLVTAGYKTATILFNKMHFCIFRAPMSFFDSTPSGRILNRASTDQSALDTDIPYQIASFAFILIQLLGIIGVMSQAAWQVFIVFIPVIAISILYQQYYIPSARELSRLVGVCKAPIIQHFAETISGTSTIRSFDQQSRFQETNMKLTDGYSRPKFNIAGAMEWLCFRLDMLSSITFAFSLIFLISIPQGFIDPGLAGLAVTYGLNLNMVQAWMIWNLCNMENKIISVERILQYTCIPCEPSLVVDDNRPDPSWPSYGEVDIQDLKVV

SEQ ID NO: 149855 - protein, 1020 aa, Glycine max
  Coding DNA Sequence Number=SeqID_33077
  Gene Ontology: Mol. function=RNA-directed DNA polymerase activity; Cellular component=chromatin; Biological process=chromatin assembly or disassembly
  Pfam annotation: Domain name=rve; Domain location=674-830; Score =109.5; E_value=1e-29; Accession=PF00665.16; Description=Integrase core domain
  Pfam module annotation: Pfam domain module=RVT_1::rve; Domain location=162-331::674-830
  Subcellular localization annotation: CTP_CleavageSite=62; ConfidenceScore=5.03e-01
GADLVLGVQWLRALGPVTTDYTALSMSFTHLGLPITLFADVPVTPPLASAHQLRRMLRTQVVAALFQLGPAPSSPLSTTPTLLPATEPPPLALHPLLTKFHHLFQEPTQLPPARLISHHIHLTPGAKPVTVKPYRYPHSQKTELEKQVQTMLDSGLIRLSHSPFSSPVLLVKKKDGSWRCCIDYRALNSITIKHSFPMPTIDELLDELGAASCFSKLDLRQGFHQIRMAEEDIHKTAFRTHSGHYEYCVMPFGLCNAPAKFQATMNEMLKPFLRKFVAVFFDDILVYSSSWDDHLLHLEAVFSTLARDSFYLRESKCVFAKTRLQYLGHILSATGVSPDPSKISAIVDWPTLTTTTALRGFLSLTGFYRRFIRGYAPLAAPLNSLLRKDGFHWTDDSQRAFDTLKQVMISAPVLIPPDFTIPFCLETDASGVAVGAVLSQNAHPIAYFSKTLCPRLQRSSTYVRELHAITSAVRKWRRYLLGHPFTIITDHQSLKDLMNQVIQTPEQQQYLVKLLGYSYTIQYRPSSGNAAADALSRVTPAGQCLILSVPLLDCMADIHHSVQQSPAYHELLATLHQQPEAHPDYSINSGRISFRGKLWLPPDNPFIPMLLEEFHSTPLGGHMGEKKTLRRLRDSFYWDHMHRDVHRFVSQCRICQQIKYEARKPAGLLQPLPIPSGLWEDLSLDFITGLPPSHGFTTILVVVDRYSKGTHLGALPPKYSAYKVACLFFDIVCKLHGFPRSLVSDRDPIFLSSFWRELFRICGTKLRYSTAYHPESDGQTEVLNRTLEQYLRSFVHDKPALWHSFLPLAEWSYNMSTHSGTGLSPYEITYGKPPPAFPPYTTGTSSVEAADSLLSTRQALHTKLQSRLLKAQMAMKNHADRHRRDVHFQPGDLVYVRLKPYRQLSMRPHYSKLAKRFYGPYPITECVGPVAYRLQLPADSKIHPVFHVSLLKPHHGQPPPVDDPLPPTQVDHHPLVEPLSFLDWKLDTTTDPPSRSVLDWDALRSLYNLGDEVEFPGEGV

SEQ ID NO: 149856 - protein, 208 aa, Glycine max
  Coding DNA Sequence Number=SeqID_33078
  Gene Ontology: Mol. function=RNA-directed DNA polymerase activity; Cellular component=chromatin; Biological process=chromatin assembly or disassembly
MALSKLQEDKLLDRRRTHRHHFPINTTPHYPPNPPPSSSASATNKPPVRRLTPEELALKRDKGLCYHCDERWSPGHRCNPRIHLLIAAEDPDPPLTTEPPDSPPPTSLPLHHDDSPPLLSLNALSGMPAPETFRVYGTVRCHQLTILVDGGSTHNFVQLRVAKFLGLRSTPVTPLPVMVGDGGVIHCDRRYPQVSITIQGHHFTTDLF

SEQ ID NO: 149857 - protein, 1750 aa, Glycine max
  Coding DNA Sequence Number=SeqID_33079
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=67%, HitCoverage=94%, E-value=0.0, Identity=56%"; Hit description =Multidrug resistance-associated protein 3
  Pfam annotation: Domain name=ABC_membrane; Domain location=373-642; Score=84.3; E_value=3.9e-22; Accession=PF00664.13; Description=ABC transporter transmembrane region
  Pfam annotation: Domain name=ABC_membrane; Domain location=996-1273; Score=83.3; E_value=7.5e-22; Accession=PF00664.13; Description=ABC transporter transmembrane region
  Pfam annotation: Domain name=ABC_tran; Domain location=716-887; Score= 137.6; E_value=3.4e-38; Accession=PF00005.17; Description=ABC transporter
  Pfam annotation: Domain name=CBS; Domain location=1581-1701; Score =91.5; E_value=2.6e-24; Accession=PF00571.18; Description=CBS domain
  Pfam annotation: Domain name=DUF21; Domain location=1385-1562; Score =120.6; E_value=4.4e-33; Accession=PF01595.10; Description=Domain of unknown function DUF21
  Pfam annotation: Domain name=MMR_HSR1; Domain location=717-794; Score= -15.7; E_value=0.028; Accession=PF01926.13; Description=GTPase of unknown function
  Pfam module annotation: Pfam domain module=ABC_membrane::ABC _membrane::ABC_tran::CBS::DUF21::MMR_HSR1; Domain location=373 -642::996-1273::716-887::1581-1701::1385-1562::717-794
MGDFGDGNLVKLWEDRWIRILILILFLGVAEPVATKILSIPLRRRYNNVKSDYFHALGTLKLHPSSLDVDPICSRSGQFMCCFYVKSLIEHAWFASPLGRRLNIVDEPNDLIIKRMPGENMYDCHRRKRIGKFTAGARDESKEKPNNTLIKMTVFCSLGVSAFNFIFCLLNYLYWYKGGWSEEKLCMTLLDLALKTLAWGVKKGSRSSSEPGALSTSLFLAIASWWTLLLCLGDAFLCQHSTWFLVSTCVGLFFCYVGYFVKNEVHVDNGIQEPLLNSDSLESKETKGGDTVTPFSYAGILSILTFSWVGPLIAVGNQKTLDLEDVPQLDSRDSVIGTFPTFREKVEADCGGINSVTTLKLVKSLIISAWKEILITAFLVLLNTLASYVGPYLIDGFVQYLDGQRLYENQGYFLVSAFFFAKLVECLTELHRSFRLQQVGLRIRALLVTMIYNKALTLSCQSKQDHTSGEIINFMTVDAERVGVFSWFIHDLWMVALQVTLALLILYKNLGLASIAAFVATVVIMLANAPLGSLQEKFQKKLMESKDTRMKATSEILRNMRILKLQGWEMKFLSKITELRKNEQGWLKKNVYTGAVTAFVFWGSPTFVSVVTFGTCMLMGIPLESGKILSALATFQILQRPIYRLPDTISTIAQTKVSLDRIVSFLRLDDLQSDVVEKLPWGSSDTAIEVVGGNFSWDLSSPNPTLQNINLKVFNGMRVAVCGTVGSGKSTLLSCVLGEVPRISGILKICGTKAYVAQSPWIQSGKIEDNILFGERMDRERYEKVLEACSLKKDLEILSFGDQTIIGERGINLSGGQKQRIQIARALYQDVDIYLFDDPFSAVDAHTGSHLFKECLLGLLCSKTVVYVTHQVEFLPAADLILVMKDGKITQCGKYADLLNSGADFMELVGAHKKALSALDSLDGATVYNEISVLEQDVNVSDTHGFKEKEASKDEQNGQTDNKSELQGQLVQEEEREKGKVGFSVYWKCITTAYGGALVPFILLAQILFQALQIGSNYWMAWATPISADVEPHVEGTTLIVVYVGLAIGSSFCVLARESLLATAGYKTATILFNKMNFCIFRAPMSFFDSTPSGRILNRASTDQSALDTNIPYQIASFAFIMVQLLGIIAVMSQVAWQVFVVFIPVVAVSIWYQQYYIASARELSRLVAVCKAPIIQHFAETISGTSTIRSFDQKSRFQETNMKLTDGYSRPKFNIAGAMEWLCFRLDMLSSITFAFSLIFLISIPQGFIDPGLAGLAVTYGLNLNMIQAWMIWNLCNMENKIISVERILQYTCIPCEPPLVVDENRPDSSWPSYGEVDIQDLQELLKRGIILAATVCGLLVFGCSRVFAVEGVVNAGYGVFGQSILLLRNTWPKVLQVLRIFKEQGLVLAVLLGLSAFFSMAETSITTLWPWKVRELAEKESENGVFRLLRSDVTRFLTTILIGTTVVNIGATALVTEAATAMFGEAGVSAATGVMTVAILLLTEITPKSIAVHNATEVARFVASGMAFPGVVSCRKNCYLSFNGDAEIAWPKRKKPYVTEDELKLMLRGAELSGAIEEEEQDMIENVLEIKDTHVREVMTPLVDVVAIDASSSLVDFHHLWVTHQYSRYFEDFQQRVDNIMGIAYAMDLLDYVQKGELLESTTVGDMAHKPAYFVPDSMSVWNLLREFRIRKVHMAVVLNEYGGTVGIVTLEDVVEEIVGEIFDENDSKEEIQKKTGYIVMRAEGVFDVDANTSIDQLSEDLNIKMPE

SEQ ID NO: 149858 - protein, 967 aa, Glycine max
  Coding DNA Sequence Number=SeqID_33080
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=81%, E-value=0.0, Identity=58%"; Hit description =Multidrug resistance-associated protein 3
  Pfam annotation: Domain name=ABC_membrane; Domain location=49-340; Score=22.5; E_value=0.00015; Accession=PF00664.13; Description=ABC transporter transmembrane region
  Pfam annotation: Domain name=ABC_membrane; Domain location=637-914; Score=77.5; E_value=4.3e-20; Accession=PF00664.13; Description=ABC transporter transmembrane region
  Pfam annotation: Domain name=ABC_tran; Domain location=357-528; Score= 137.4; E_value=3.8e-38; Accession=PF00005.17; Description=ABC transporter
  Pfam module annotation: Pfam domain module=ABC_membrane::ABC _membrane::ABC_tran; Domain location=49-340::637-914::357-528
MFPQLDSRDSVIGAFPTFREKVEADCGGINSVTTLKLVKSLIISAWKEILITAFLVLLKTLASYVGPYLIDGFVQYLGGQRLYENQGYFLVSAFFFAKLVECLTRRHWFFRLQQVGLRIRALLVTMIYNKALTLSCQSKQGHTSGEIINFMTVDAERVGVFSWYMHDLWMVVLQVTLALLILYKNLGLASIAAFVATVIIMLANVPLGSLQEKFQKKLMESKDTRMKATSEILRNMRILKLQGWEMKFLLKITELRKNEQGIPLESGKILSALATFRTLQEPIYNLPDTISMIAQTKVSLDRIVSFLRLDDLRSDVVEKLPWGSSDTAIEVVDGNFSWDLSSPSPTLQNINLKVFHGMRVAVCGTVGSGKSTLLSCVLGEVPKISGILKVCGTKAYVAQSSWIQSGKIEDNILFGECMDRERYEKVLEACSLKKDLEILSFGDQTIIGERGINLSGGQKQRIQIARALYQDADIYLFDDPFSAVDAHTGSHLFKECLLGLLCSKTVVYVTHQVEFLPAADLILVMKDGKITQCGKYTDLLNSGADFMELVGAHKKALSTLDSLDGAAVSNEISVLEQDVNLSGAHGFKEKKDSKDEQNGKTDDKSEPQGQLVQEEEREKGKVGFSVYWKCITTAYGGALVPFILLAQILFQALQIGSNYWMVWATPISEDVQPPVEGTTLIAVYVGLAIGSSFCILARAILLVTAGYKTATILFNKMHFCIFRAPMSFFDSTPSGRILNRASTDQSALDTDIPYQIASFAFILIQLLGIIAVMSQAAWQVFVVFIPVIAISVLYQQYYIPSARELSRLVGVCKAPIIQHFAETISGTTTIRSFDQQSRFQETNMKLTDGYSRPMFNIAGAVEWLCFRLDMLSSITFAFSLIFLISIPQGFIDPGLAGLAVTYGLNLNIVQGWMIWNLCNMENKIISVERILQYTCIPCEPSLVVDDNRPDPSWPSYGEVDIQDLKVV

SEQ ID NO: 149859 - protein, 77 aa, Glycine max
  Coding DNA Sequence Number=SeqID_33081
  Gene Ontology: Mol. function=metal ion binding; Biological process =metal ion transport
  Homolog annotation: Hit_ID=Q1SBG7; Match level="QueryCoverage=80%, HitCoverage=28%, E-value=4e-07, Identity=36%"; Hit description=Heavy metal-associated domain, putative
  Pfam annotation: Domain name=HMA; Domain location=7-70; Score=27.5; E_ value=4.6e-05; Accession=PF00403.16; Description=Heavy-metal -associated domain
MEQQKIVIEVPLHCERCKKKIMTICTMADGVTSVTFQREEKEKVVIIGEGIDAAGVAACLRKKVNKYARLVSVANDT

SEQ ID NO: 149860 - protein, 143 aa, Glycine max
  Coding DNA Sequence Number=SeqID_33082
  Homolog annotation: Hit_ID=Q9LK65; Match level="QueryCoverage=76%, HitCoverage=14%, E-value=2e-10, Identity=39%"; Hit description =Similarity to hemolysin
IGYIPRTGECIKVVLEREDEDDNNESNADQQDQKEKNQSFKLEYYFSSYTKDVNAIFFKKLDQQILAGNARKVSAVRFEHINNNDEMLETKVTRMIPKIMKRKWRSDANSDNDAEYDGDTFAKTPQDDISSEYLVDQENSNRG

SEQ ID NO: 149861 - protein, 556 aa, Glycine max
  Coding DNA Sequence Number=SeqID_33083
  Homolog annotation: Hit_ID=Q9FM80; Match level="QueryCoverage=73%, HitCoverage=88%, E-value=1e-124, Identity=55%"; Hit description =Arabidopsis thaliana genomic DNA, chromosome 5, P1 clone:MDF20
  Pfam annotation: Domain name=mTERF; Domain location=144-430; Score =29.0; E_value=5.2e-10; Accession=PF02536.5; Description=mTERF
  Subcellular localization annotation: CTP_CleavageSite=44; ConfidenceScore=5.12e-01
MAAILPLYPYNPLLYFSTPSSFRSQFWILERRRLGSASLKNLVKLAAHSNPRILKSNRKSKYGEALLFYDSDEEMDDDVSDDDEDDDWLSDEEFSEPANLDVNNNKRFKSKTTKGKDRQQEWEWGLRSFDNKQSIRLPRSERVASLQRNESGKHSRNVKDKKYPRLSEEIPLDVKWLPLLDYLSTFGMKESHFVQMYERRMQSLQINPQILEYTVENNLKSRVAFLRGLGIPNSRIGQIIAAAPSLFSYSVENSLKPTVRYLIEEVGIKEKDLGKVIQLSPQILVQRIDISWNTRSMFLTKELGAPRDSIVKMVTKHPQLLHYSIDDGLLPRINFLRSIGMKNSDIVKVLTSLTQVLSLSLEENLKPKYLYLVNELNNEVQSLTKYPMYLSLSLDQRIRPRHRFLVSLKKAPKGPFPLGSLVPTDECFCQQWAGTTVQDFSDVQELAPALPVQLVVGKATSLSTFWTEDLAKVQCFLGIEVAKSKNETPMDPNAKLYHLRGAIGWNTGLSYYYSSKYLFYSQCVTLELWDTLLQIEQDLPTDRISLLATAFLLVIP

SEQ ID NO: 149862 - protein, 419 aa, Glycine max
  Coding DNA Sequence Number=SeqID_33084
  Gene Ontology: Mol. function=nucleic acid binding; Cellular component= spliceosome; Biological process=mRNA processing
  Homolog annotation: Hit_ID=Q6ZK57; Match level="QueryCoverage=54%, HitCoverage=39%, E-value=1e-67, Identity=57%"; Hit description =Putative RNA recognition motif (RRM)-containing protein
  Pfam annotation: Domain name=RRM_1; Domain location=327-395; Score =30.1; E_value=8e-06; Accession=PF00076.12; Description=RNA recognition motif. (a.k.a. RRM, R
  Pfam annotation: Domain name=zf-CCCH; Domain location=174-199; Score =26.3; E_value=0.00011; Accession=PF00642.15; Description=Zinc finger C-x8-C-x5-C-x3-H type (and similar)
  Pfam module annotation: Pfam domain module=RRM_1::zf-CCCH; Domain location=327-395::174-199
MDSPYTRIVFEKIQKFEPEHARKIIGYLFFQGHGEQEMAKLASCPDYFICEVVVQAKKELQRLAAKPDMLPISRTVNPQQGLSDLSVISPRTPTSPNFQMPPPYWDPQSAANINPDFMGMNYLDSIVELQKQTQMLTLENQIDAVKTGTGGIANDHYGLDASAANLGGRRFSEFPMKMCHYFNKGFCKHGTSCRFYHGQVVPENFSQMHANDAIGEDQVISPGSLAQLESEIIELLRAKGGPMSIASLPMAYYDKYKKVLQADGYLTESQRHGKSGYSLTKLLARLKNSIQLIGRPHGQHSVVLAEDSPTQMQKGDFARNISASYQIYLTFPADSTFTEDDVSNYFNTFGPVADVRIPNQQRRMFGFVTFVHSETVKSVLDKGNPHCVRGSRVLVKPYREKAKVNERTTFGVLELAKLD

SEQ ID NO: 149863 - protein, 163 aa, Glycine max
  Coding DNA Sequence Number=SeqID_33085
  Homolog annotation: Hit_ID=Q9FM81; Match level="QueryCoverage=37%, HitCoverage=52%, E-value=1e-12, Identity=48%"; Hit description =Arabidopsis thaliana genomic DNA, chromosome 5, P1 clone:MDF20
  Pfam annotation: Domain name=A2L_zn_ribbon; Domain location=79-113; Score=30.5; E_value=6e-06; Accession=PF08792.1; Description=A2L zinc ribbon domain
  Pfam annotation: Domain name=DUF1610; Domain location=84-109; Score =11.0; E_value=0.1; Accession=PF07754.2; Description=Domain of unknown function (DUF1610)
  Pfam module annotation: Pfam domain module=A2L_zn_ribbon::DUF1610; Domain location=79-113::84-109
  Subcellular localization annotation: CTP_CleavageSite=25; ConfidenceScore=5.67e-01
MCCKFHQILQTCRTQTPSLQNPKLRTKTRRSRKNARRRRVGAVPVNVDDVTTVLDPAPVQVTWQIVVGAIGIEFSKRIIAQKRCEVCGGSGLVLREKEKDYLRCPECGMIAFTSSSSHIMYSIKRVSSLAILEKILLLLISTALYKKPYFNNDNFILAEIRCL

SEQ ID NO: 149864 - protein, 264 aa, Glycine max
  Coding DNA Sequence Number=SeqID_33086
  Gene Ontology: Mol. function=sequence-specific DNA binding; Cellular component=nucleus; Biological process=regulation of transcription
  Homolog annotation: Hit_ID=Q1SS80; Match level="QueryCoverage=100%, HitCoverage=72%, E-value=4e-77, Identity=62%"; Hit description=DNA -binding WRKY
  Pfam annotation: Domain name=WRKY; Domain location=232-264; Score =45.8; E_value=1.5e-10; Accession=PF03106.6; Description=WRKY DNA -binding domain
MDAAATNSGEPRPSSELQTTGESEDPNRSGSGQNSTARYKLMSPAKLPISRSPCITIPPGLSPTSFLESPVLLSNMKVEASPTTGSLRKLQQTVHGSMASAASATFPVTTACFNTNTVDARKSSFFEFKPLNRSNKVPADFNNHVSKQSTQVEGPGKAQSFASSPLVESEITVPSNELSLSSPVQMVSSSASAPVDVDLDEINHKGNTATGLQASHVEVRGSGLSVAAEKTSDDGYNWRKYGQKLVKGSEFPRSYYKCTHPNCE

SEQ ID NO: 149865 - protein, 140 aa, Glycine max
  Coding DNA Sequence Number=SeqID_33087
  Gene Ontology: Mol. function=transporter activity; Biological process= transport
  Homolog annotation: Hit_ID=Q6A6D5; Match level="QueryCoverage=78%, HitCoverage=27%, E-value=4e-23, Identity=54%"; Hit description=Sugar- binding periplasmic protein
VLQWLLFLSAVPPVQLLTGWCVTAKAPPDISAGKCSGHAARRVPFAIQAAQLLGRAIGAGLFAITPAGERGMCCKAIKLGNARVFPEFDDWVWGPTQVQAGQDMENNLVKVSKSYPITKALADTQESTLAKLKKQGIKVG

SEQ ID NO: 149866 - protein, 277 aa, Glycine max
  Coding DNA Sequence Number=SeqID_33088
  Homolog annotation: Hit_ID=Q6AAV0; Match level="QueryCoverage=45%, HitCoverage=51%, E-value=1e-41, Identity=72%"; Hit description =Putative phosphate transport system protein
  Pfam annotation: Domain name=PhoU; Domain location=71-154; Score =43.1; E_value=9.5e-10; Accession=PF01895.9; Description=PhoU family
AQYANRLSPRVGRFINAAGTTGFPTGKRAGTKAGTGPPLEVDGIDKLDHVAKIARLRFPEVAVPPQVADQFVEMSKIADSMIGKAEKTLADRDAEAAESLASEDSKMDDLRRDQFRLLLGDDWTYGVESAVDTALLGRYYERIADHAVAVGSRVIYIVTGEGPAGEDWPSAPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 149867 - protein, 48 aa, Glycine max
  Coding DNA Sequence Number=SeqID_33089
MTYTPYDVCSCPKASAKDPGRSVHSAPHEHTQHPTYERGQKLVPKTLE

SEQ ID NO: 149868 - protein, 245 aa, Glycine max
  Coding DNA Sequence Number=SeqID_33090
  Gene Ontology: Mol. function=structural molecule activity; Cellular component=flagellin-based flagellum; Biological process=ciliary or flagellar motility
  Homolog annotation: Hit_ID=Q56911; Match level="QueryCoverage=99%, HitCoverage=81%, E-value=1e-58, Identity=51%"; Hit description =Thermoregulated motility protein
  Pfam annotation: Domain name=Flagellin_C; Domain location=162-233; Score=136.4; E_value=7.8e-38; Accession=PF00700.11; Description =Bacterial flagellin C-terminus
  Pfam annotation: Domain name=Flagellin_N; Domain location=1-109; Score=124.8; E_value=2.4e-34; Accession=PF00669.10; Description =Bacterial flagellin N-terminus
  Pfam module annotation: Pfam domain module=Flagellin_C::Flagellin_N; Domain location=162-233::1-109
NGLTVAARNANDGISLAQTAEGALSEINNNLQRVRDLTVQAQNSSNSASDIDSIQAEVNQRMEEINRVTSQTDFNGIKVLNTGSGSKDYSFQVGSKDAETIAITISSSDGYNLAKAGTGTGTALNTRAMASGTDLVNGSARTTAAIGFDVLKGKVTGGASGAASGTTPLADIDAAIKSVDSQRSLLGASQNRFESTITNLNNTVNNLSAARSRIQDSDYATEVSNMSRAQILQQAGSSVLAQANQ

SEQ ID NO: 149869 - protein, 48 aa, Glycine max
  Coding DNA Sequence Number=SeqID_33091
MVSIASAANVYAQVNSILMLNVTNFKVCKEAIEIVLGCMDLDLALRTE

SEQ ID NO: 149870 - protein, 231 aa, Glycine max
  Coding DNA Sequence Number=SeqID_33092
MHSQTITFVSEKDNRPLPKVSVFGKDGSILAYSDIDGKIDKKALDPSQEKFQLVYDNFSVATLSYTEIDHDIIKLNDRIKEIETVVIKNNKPAKYIFIKGNFNSYVTVNNKLNAYADGIITYIFDNKSKKLKSTNVQQYRIYRLEDPKNEKKQTSSWDYGNSLNLPKLKHLGNPEDYKTKITEIKELKGDRKDQIEISGGVLQEKEFAFLGFRFYDIRTILNLTFEKGSSK

SEQ ID NO: 149871 - protein, 64 aa, Glycine max
  Coding DNA Sequence Number=SeqID_33093
MRNALRLDSMKKPFDNMYEMPPRKLSAKRSRRDATTEGTSAAPEFDSHQRMVVPPRGTHPAQGR

SEQ ID NO: 149872 - protein, 139 aa, Glycine max
  Coding DNA Sequence Number=SeqID_33094
MTMIVDTLPVFYYGKWWATHLQSFPDLVFASERIDVGPKRGKFDHPTRTTEKTGANEEGEKEGETHAVTAIPIRPSFPPTQQCHYSANNKPPPYPPPSYPQRPSLNQPQSLSTALPMTKTTFSTNQKTPTKRNFAAKSL

SEQ ID NO: 149873 - protein, 42 aa, Glycine max
  Coding DNA Sequence Number=SeqID_33095
VKNHVSPEPEVEDAGVASLANPKALRVMSSPSTLTSSCPKCD

SEQ ID NO: 149874 - protein, 95 aa, Glycine max
  Coding DNA Sequence Number=SeqID_33096
MFHSANSLTSCGNNLSNNEAQPPRNVSNLHGDEDDDDDYLVSNSYVEESLDEDDSVDGISDTDDEVTDMIQPVRIVHPAEVRIVHPNPKPLTPKP

SEQ ID NO: 149875 - protein, 160 aa, Glycine max
  Coding DNA Sequence Number=SeqID_33097
  Gene Ontology: Mol. function=zinc ion binding
  Homolog annotation: Hit_ID=Q1SSK8; Match level="QueryCoverage=86%, HitCoverage=15%, E-value=1e-47, Identity=67%"; Hit description =Helicase, C-terminal; Zinc finger, RING-type; Protein kinase C, phorbol ...
  Homolog annotation: Hit description=ester/diacylglycerol binding; Zinc finger, FYVE/PHD-type; RINGv
MYKTVRPPVGESNREMPLSELKSKYRKISSLEKAQSGWEEEYKVSSKQCMHGPNCKIGNFCTVGRRLQEVNVLGGLILPVWGAVEKALSKQKTNCKTKSVQARLSHRRLRVVRIETTVDTQRIVGLLVPNAAVETVLQGSLSLKDLSTTSSSLFYSTWDS

SEQ ID NO: 149876 - protein, 141 aa, Glycine max
  Coding DNA Sequence Number=SeqID_33098
MRKSQVQFVSPIRISFTKGQHPLIAKVQIGNGREKELVIVSTLDCPFLYILVLKMRLSLVKFISLQLCAIMDTSMTIKLLMIGTLNFHVSTKVKNRSLPLSLHGNFGKDTSPKASEKLERGLTQQPRFYFSDDKFSSGADK

SEQ ID NO: 149877 - protein, 457 aa, Glycine max
  Coding DNA Sequence Number=SeqID_33099
  Subcellular localization annotation: CTP_CleavageSite=29; ConfidenceScore=5.06e-01
MAHQKQKVVALDAPTPKRAKKAQLVAEPRAKSQSSSSSDGESTNDTPIIPLHKSALTTLPHPPPSPLHLERFRRETPREPLTDEQRFSQDAIVHFPPPTWTRPVQSTIAKMPPNWLALGTWHSLTGTIQQTKQRPFTRSGTSQGSVRKEDIQLSDEDHSSLGKLHEKMYLDDQATTYPSSLHISRATDIMMVADRDLLESNSVDGFPKSFHLWAMMEVILLFHETLFKCYNLPRRITLMMLVSASQEMMIATPSSNVFFSFFPFHKGNLQLEAQQKMKVVFGSATVESVAKEAIEKEANAIVQAEAFAKVVDDSVVDDTNVINETSEASNATMANEVEPLIPNLASIKTLLEIRAKMVLMSLLYIPQVLAPLLSIMHNLLPSLNATIRQFSNLDVVLLQNIQQAQLSMLGAIAPPTPTPIPPFIPASLEPPPQPLAPIPPPPSSSPPPSQPRPPPTS

SEQ ID NO: 149878 - protein, 349 aa, Glycine max
  Coding DNA Sequence Number=SeqID_33100
  Gene Ontology: Mol. function=zinc ion binding; Cellular component =nucleus; Biological process=positive regulation of transcription from RNA polymerase II promoter
  Homolog annotation: Hit_ID=Q1SSK8; Match level="QueryCoverage=59%, HitCoverage=24%, E-value=1e-82, Identity=73%"; Hit description =Helicase, C-terminal; Zinc finger, RING-type; Protein kinase C, phorbol ...
  Homolog annotation: Hit description=ester/diacylglycerol binding; Zinc finger, FYVE/PHD-type; RINGv
MPLWWELMSWLNIVCVFLETPRDHLLQHHYCNLKDIRLQRWQIWWISLTWCIWHRRNWIVFSNDSFKGHKLMDDALFFCWTWLKNLEKGFDIPFHYWSSKIRDGFCARGGLAYRYFVAGCLAYSQIYGCLILAMLAGPSLSAYNYDSAYGKKALTIMYKGIMEQDSLPVVPPGCSSHRPDTIQDFIVQAKAALVSVGIVRDTLGNGKSGRIIDSDMHEVGRFLNRILGLPPDIQNGLFELFVSILDLLVRNARIEGNLDTGIVDLKANVIELQGTPKTVHVDQLTGASTILFTFILDRGITWELASTMLNEKQKDGLGSANDGFYESKREWLGRRHFILAFERSFLNPT

SEQ ID NO: 149879 - protein, 352 aa, Glycine max
  Coding DNA Sequence Number=SeqID_33101
  Gene Ontology: Mol. function=nucleic acid binding; Biological process= DNA integration
  Homolog annotation: Hit_ID=Q1S7C5; Match level="QueryCoverage=96%, HitCoverage=71%, E-value=7e-19, Identity=40%"; Hit description =Integrase, catalytic region
MAAQNNSFITSPFPNSISHKLDYLTFLLWRQQVEPVIKSHRLQYFVANPQIPLLFLTKADCTAGIENPAYEACEQQDQVLIRWLQSTLSTSILSCVLGCVNSYERLPVVRLLVLANSTSLLLAVNCLYSVRRISGDRVPIHHEEYVDVLLEGLLFDYASMISFIESKKRTPSIVEIEALLYGYSHSNSYKSRDSGSSQGGYGHDDGSRGGFANRGADRHSDGSGRGLMSFQPHESLTFFDPAKQQPIPYLSGSVGTSNTWINPNSKSGTVAPASCLLIPLLMEMDMLAPPGFQILENVDGFINKFKARLLAKGFHQVHGFDFHETLSPVLDMNNAFLNGILEESVFMTQPPG

SEQ ID NO: 149880 - protein, 95 aa, Glycine max
  Coding DNA Sequence Number=SeqID_33102
  Homolog annotation: Hit_ID=Q1S7C5; Match level="QueryCoverage=88%, HitCoverage=6%, E-value=1e-14, Identity=44%"; Hit description =Integrase, catalytic region
MVGALIRPEINFAVNKVCQFMDKPLDSHWAMVKRILSHTTHMEIDVFFIRQKVLAKQLFILHIPALDQWADVLTKPLSSARFEFLRGKHNVKSFL

SEQ ID NO: 149881 - protein, 190 aa, Glycine max
  Coding DNA Sequence Number=SeqID_33103
MEGNVNILEIPKIEGYHLVGISMRVVVVELVGEGVADLLMFSVRFVANLGTKPLIAGTEMMQATPPSPLNQIPNTSSNSWYPDSGASHHVSRNIQQVTPFEGPDQITIGNGQGLPIDSSGYSKFASPLNPNVSLRLTNLLQPLQKPAACVSKSSVNTVVSNSSVNVASTSSLGGDSKFECVDLEEVEEEL

SEQ ID NO: 149882 - protein, 118 aa, Glycine max
  Coding DNA Sequence Number=SeqID_33104
  Homolog annotation: Hit_ID=Q1SRN1; Match level="QueryCoverage=60%, HitCoverage=4%, E-value=1e-07, Identity=37%"; Hit description =Integrase, catalytic region
  Subcellular localization annotation: CTP_CleavageSite=26; ConfidenceScore=5.03e-01
MASAAPPPPPPPGNSGSLLGSSAVITAKEFSHSISQELNNSNYLLWCQQLEPVLKEHRLFHLVTKPHIPPQYLTIADHDAGVVSSEFLLWEQRISSFCRGFNPLFLVRCLGLVGCKTA

SEQ ID NO: 149883 - protein, 347 aa, Glycine max
  Coding DNA Sequence Number=SeqID_33105
  Gene Ontology: Mol. function=zinc ion binding
  Homolog annotation: Hit_ID=Q1SSK8; Match level="QueryCoverage=82%, HitCoverage=40%, E-value=3e-87, Identity=53%"; Hit description =Helicase, C-terminal; Zinc finger, RING-type; Protein kinase C, phorbol ...
  Homolog annotation: Hit description=ester/diacylglycerol binding; Zinc finger, FYVE/PHD-type; RINGv
  Pfam annotation: Domain name=PHD; Domain location=245-293; Score =26.1; E_value=0.00012; Accession=PF00628.19; Description=PHD-finger
MWFLSYCSLISQDRLPEARVVYCSATGASEPRNMGYMVRLGLWGDGTSFIDFREFLGALDRGGVGALELVAMDMKARGMYLCRTLSYEGAEFEVIEAPLEDKMMRFFRHMCMSAKVPAAVRLAHKALVEEKCVVIGLQSTGEARTEEAVTKYGSELDDFVSGPRELLLKFVEENYPLPEKPELLPGEDGVKELQRKRHSATPGVSVKGRVRKVAKWQPPSDAESDEESESDSGIESTDSDDEFQICEICTTEEERKKLLQCSCCGKLVHSTCLMPPIGDIVPEEWSCHLCKEKTDEYLQARQAYIAELQKRYDAALERKTKILEIIRSLDLPNNPLDDIVDQVVNIA

SEQ ID NO: 149884 - protein, 53 aa, Glycine max
  Coding DNA Sequence Number=SeqID_33106
MRLGWQDNNDVVLKTWVFSPKRTWMTIEWYPKAASWLDVPYGVVLSCTCDRFH

SEQ ID NO: 149885 - protein, 101 aa, Glycine max
  Coding DNA Sequence Number=SeqID_33107
MARRKHYSSINGSLGAALLNLLRLMEWHERSVISELSSDEEEARSSLFPVNEIAYSLSPIFGLAFAHSLSPIFGFALIVLILTMEEQTLEVQLQIEPSLLS

SEQ ID NO: 149886 - protein, 65 aa, Glycine max
  Coding DNA Sequence Number=SeqID_33108
MFAYSPFAKCKPRAKRIFGHALSGEYLALSAQPLHLKLIWSAKLAKVERSPFQFDLNLAKRWPAS

SEQ ID NO: 149887 - protein, 101 aa, Glycine max
  Coding DNA Sequence Number=SeqID_33109
LTFECLSLAINLAYIRKNCWNIDDLTVAFQGTRRARPTNIPSSSTAPAHTPTSTFAAPSIPAHVDSQRFEAMLQSDSSSRIHPISGAVFREGSLAWDPTFS

SEQ ID NO: 149888 - protein, 70 aa, Glycine max
  Coding DNA Sequence Number=SeqID_33110
MKHRELIKNDLYAQNDLSFRRRVVLNPLTPSVLPIVATYPFAGEQGEAHGRQKRGSCSYVPSIEEEIRPA

SEQ ID NO: 149889 - protein, 99 aa, Glycine max
  Coding DNA Sequence Number=SeqID_33111
  Homolog annotation: Hit_ID=UPI000044A741; Match level="QueryCoverage =46%, HitCoverage=11%, E-value=3e-09, Identity=69%"; Hit description =PREDICTED: similar to Ac1147, partial
MGAGAWPFLVGGAICLVNSVNERDLSLLNSYVEIIAIVGLQRGIPSKRESSARVDYVPALCTHRPSLLPIEWSGEVFGLRRRERFAARDVVRSPLNLII

SEQ ID NO: 149890 - protein, 381 aa, Glycine max
  Coding DNA Sequence Number=SeqID_33112
  Homolog annotation: Hit_ID=Q72Y18; Match level="QueryCoverage=57%, HitCoverage=20%, E-value=2e-15, Identity=28%"; Hit description =Conserved domain protein
MGHTFQNPSYTTSYFSEVTVNIPAYLIKLKLGKGEYYSENTRKRDEIKKFVERDDLKDFTRPTSNNDTNLWIQLGMFIQLYWAYGDDFFPRLNQRYRAYRPAVTNDNEEIQTFMLYASMVAERNLTRFFNKWGLYPEDTIQREMIKYPEPAVPIWENIYNGFNVDQHVAPYSPPQATIKKNTIEYVIGSHLSQQEISDYLENLSGVHPPIKTTWIKDDNMEDDGRTFAEQVSGTPFEDGNILKLSVYAKGTYTVYSDSSVILPRNESDNLDFFLISERKFKRLLPEDRLPKATPVPASTDIGMPISAETLLRDHVSKHLCQYGTTELLHCALILTVKNVSFYVLMFEPKRWRPLPIQNGRDHLILAKDYALNLFCIALTRL

SEQ ID NO: 149891 - protein, 112 aa, Glycine max
  Coding DNA Sequence Number=SeqID_33113
  Gene Ontology: Mol. function=sequence-specific DNA binding; Cellular component=intracellular; Biological process=positive regulation of transcription, DNA-dependent
  Homolog annotation: Hit_ID=Q5PKG2; Match level="QueryCoverage=48%, HitCoverage=19%, E-value=4e-22, Identity=80%"; Hit description=HTH -type transcriptional activator rhaS
MAIVIAHKTDAAGAERLRLTIKYVDARALFHQHNFMKIMVMLRKRRLRHTWLNGYRARLTTLPLCGSVSSLTNTFANLPAVMTRWHSREGVCGAGFLLCRHVFTGSTRHESA

SEQ ID NO: 149892 - protein, 150 aa, Glycine max
  Coding DNA Sequence Number=SeqID_33114
  Gene Ontology: Mol. function=rhamnulokinase activity; Biological process=carbohydrate metabolic process
  Homolog annotation: Hit_ID=Q6DA23; Match level="QueryCoverage=92%, HitCoverage=28%, E-value=3e-42, Identity=62%"; Hit description =Rhamnulokinase
MVQEIQNACAEQAMPVPHSPAALARTIFDSLALLYSQTLQELSHLRGTALRQLHIVGGGCQNPLLNQLCADACQLPVFAGPVEASTLGNIGCQLIALGELRDVADLRRCIRHNFPLEKFIPLNHSVFAAHQARFAALSLPAKELAYDKAD

SEQ ID NO: 149893 - protein, 85 aa, Glycine max
  Coding DNA Sequence Number=SeqID_33115
  Gene Ontology: Mol. function=sequence-specific DNA binding; Cellular component=intracellular; Biological process=positive regulation of transcription, DNA-dependent
  Homolog annotation: Hit_ID=P09377; Match level="QueryCoverage=99%, HitCoverage=31%, E-value=4e-11, Identity=43%"; Hit description=HTH -type transcriptional activator rhaS
  Subcellular localization annotation: CTP_CleavageSite=45; ConfidenceScore=5.33e-01
YAATNRSDRPALPTQSPHCSAHSASPASGAGGHPGPAPDRCAPPRAAAPAAAKSAVPAAPDVPATSWPAASSASPAAAPAPSLYG

SEQ ID NO: 149894 - protein, 141 aa, Glycine max
  Coding DNA Sequence Number=SeqID_33116
  Subcellular localization annotation: CTP_CleavageSite=49; ConfidenceScore=5.11e-01
MTTWTQMWMTLLLKQRPAQAIITRTSLCRSVSWCMPPTRHPLDQDKSNRAMGFPALITGLCQTFGVPVTPREAQGDAPQAADTPPEPHQADPAGSFDMERVEFAWPGDWPEAQAGEVPVEALDDAEEARMDEEMTDLLGFL

SEQ ID NO: 149895 - protein, 309 aa, Glycine max
  Coding DNA Sequence Number=SeqID_33117
  Gene Ontology: Mol. function=sodium:dicarboxylate symporter activity; Cellular component=membrane; Biological process=dicarboxylic acid transport
  Homolog annotation: Hit_ID=Q5H3P2; Match level="QueryCoverage=79%, HitCoverage=52%, E-value=2e-72, Identity=60%"; Hit description =Proton glutamate symport protein
FDQVEAQLCAMAGVERIEQVIARLDDPAQRQVLQDLQQARWGGQGDLAPLRTRLREVFRDGPHWSAAAITADTGLAPLAFIFRGNPRMTAAAADKKKLPLHWKMGIGFAIGLILGLIVHALGGSVDGLQAGAKWVMDYITTPASGLFLNLIFMLIVPLIFSALIMGVSEMGDIRALGRIGWKTLAYTVLLSGIAVGIGLVLVNLLKPGAGVDPQVAAMMLSENAERSKEIVAGIHGTPKGMDMLLSIVPSNVLQAASDNGAILSLMFFALMFGIGMVLTDNEKVAPLRRAIEGVFEISMTLINLVIRLA

SEQ ID NO: 149896 - protein, 46 aa, Glycine max
  Coding DNA Sequence Number=SeqID_33118
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=98%, HitCoverage=14%, E-value=1e-15, Identity=90%"; Hit description =Acetyl-coenzyme A carboxylase carboxyl transferase subunit beta
MVSLDPIEFHSEEEPYKDRIDSYQRKTGLTEAVQTVYGGQYGIRSR

SEQ ID NO: 149897 - protein, 104 aa, Glycine max
  Coding DNA Sequence Number=SeqID_33119
  Subcellular localization annotation: CTP_CleavageSite=53; ConfidenceScore=5.15e-01
MYPPLFSLNNLVDVSFTRTDPQEMYPLLFSVTTTQVDVPSTCTTKDVPSNVLRQSSQAVKPLKLCEWGYKRILMREKGDTKEFRQLVLLLLEKGEERHKKNSGG

SEQ ID NO: 149898 - protein, 99 aa, Glycine max
  Coding DNA Sequence Number=SeqID_33120
HRQAQGGDPQAPDAPPPPHQADPTGSFDTERYLRHLSQGFASCPCPTPNQFRAEVAWPEDWPEAQVGEASAEAPGDADEARMDEEMTDLLDFLGGSGAT

SEQ ID NO: 149899 - protein, 50 aa, Glycine max
  Coding DNA Sequence Number=SeqID_33121
MVCTHQDEGGLAYSYSEWSNWGDAEATRVGLIKRSRSYPPHPKAGMYWLY

SEQ ID NO: 149900 - protein, 36 aa, Glycine max
  Coding DNA Sequence Number=SeqID_33122
MVCHSFLLPHDVVTAFLSHATLLLPLITKKVLRNML

SEQ ID NO: 149901 - protein, 762 aa, Glycine max
  Coding DNA Sequence Number=SeqID_33123
  Gene Ontology: Mol. function=zinc ion binding; Cellular component =nucleus; Biological process=regulation of transcription, DNA -dependent
  Homolog annotation: Hit_ID=Q9ZVC9; Match level="QueryCoverage=97%, HitCoverage=70%, E-value=7e-98, Identity=36%"; Hit description =Mutator-like transposase
  Pfam annotation: Domain name=FAR1; Domain location=199-375; Score =120.3; E_value=5.6e-33; Accession=PF03101.5; Description=FAR1 family
  Pfam annotation: Domain name=FAR1; Domain location=43-181; Score =48.0; E_value=3.1e-11; Accession=PF03101.5; Description=FAR1 family
  Pfam annotation: Domain name=SWIM; Domain location=648-684; Score =38.3; E_value=2.6e-08; Accession=PF04434.8; Description=SWIM zinc finger
  Pfam module annotation: Pfam domain module=FAR1::FAR1::SWIM; Domain location=199-375::43-181::648-684
MIVNEHSVGTELAMNNASVEEEIDFSCDPYIGLEFDTADEALKFYTSYANRTGFKVRIGQLYRSRTDGSVSSRRFVCSKEGHQLSSRTDCPAFIRVQINGSGKWVVDHFHKDHNHNLEISGENCSPTLQQKGAGATVINSLTEFPRRPRRKLLEEANDESSCPFGIIDFKRLRKEELEGQSRTEPYVGQEFISPDEAYQFYHAYAAHLGFGVRIGQLFRSKNDGLITSRRFVCSKEGFQHPLRVGCGAYLRIKRQPSGKWTVDRLRKDHNHDLDSEKEGRAKSLPASNILAEEVDTGLVNYDLFRRDNYPVPRGGRQNHIRSEWYGILLEYFQSRQAEDTGFFYAVEVDYGNCMNIFWADGRSRYSCSQFGDVLVLDTSYRKTVYLVPFATFVGVNHHKQPVLLGCALIADESEESFTWLFQTWLRAMSGRLPLTVIADQDIAIQRAIAKVFPVTHHRFSLWQIKAKEQENMGLMGNDFTKDYENCVYQSQTVDEFDATWNVVLNKYGLKDNAWLKEMYEKRESWVPLYLKGTFFAGIPMNESLDSFFGALLNAQTPLMEFIPRYERGLEQRREEERKEDFNTSNFQPILQTKEPVEEQFRKLYTLTVFKIFQKELLQCFSYLGFKIFEEGGLSRYMVRRCGNDMEKHVVTFNASNISISCSCQMFEYEGVLCRHVLRVFQILQLREVPCRYILHRWTRNTEDGVFPDMESWSSSQELKNLMLWSLRETASKYIDAGATSIEKYKLAYEILREGGRKLCWHR

SEQ ID NO: 149902 - protein, 407 aa, Glycine max
  Coding DNA Sequence Number=SeqID_33124
  Gene Ontology: Mol. function=protein binding; Cellular component =nucleus; Biological process=negative regulation of ethylene mediated signaling pathway
  Homolog annotation: Hit_ID=Q8LGK0; Match level="QueryCoverage=90%, HitCoverage=98%, E-value=1e-111, Identity=36%"; Hit description=F -box protein family, AtFBL4
  Pfam annotation: Domain name=LRR_1; Domain location=118-139; Score =8.2; E_value=8.3; Accession=PF00560.23; Description=Leucine Rich Repeat
  Pfam annotation: Domain name=LRR_1; Domain location=191-212; Score =2.9; E_value=81; Accession=PF00560.23; Description=Leucine Rich Repeat
  Pfam annotation: Domain name=LRR_1; Domain location=304-327; Score =7.9; E_value=9.3; Accession=PF00560.23; Description=Leucine Rich Repeat
  Pfam annotation: Domain name=LRR_1; Domain location=344-371; Score =4.2; E_value=46; Accession=PF00560.23; Description=Leucine Rich Repeat
  Pfam annotation: Domain name=LRR_2; Domain location=244-268; Score =16.2; E_value=0.096; Accession=PF07723.3; Description=Leucine Rich Repeat
  Pfam module annotation: Pfam domain module=LRR_1::LRR_1::LRR_1::LRR _1::LRR_2; Domain location=118-139::191-212::304-327::344-371::244-268
MSPTDKERRDSIQFDARPRLDQHADPRRATHRDLPPPGLEVEPRRRLPRLHAVAPPRALHTRRHLLAARFSNVTTVHIDERLSVSIPAHLGRRRASGNSSVKLHYVNDKHGSASDQSDLDSLCISDSGLTALAEGFPKLEKLRLIFCSNVTSEGLSSLARKCTSLKSLDMQAFGCYVGDQGLAAVGQCCKQLEDLNLRFCEGLNDIGLVELALGVGNALKSLGVAACAKITDVSMEVVGSHCRSLETLSLDSEFIHNKGVLSVIKGCPHLKVLKLQCINLTDDVLKVVGASDKGLEEIATGCKELTHLEVNGCHNIGALGQESVGKSCQIGDAGLLQVGQGCKFLQALHLVDCSNIGNEAMCGIAIGCRNLKKLYIRLCYKVLSAFHVWFSVRKRHSVCVIPFLASN

SEQ ID NO: 149903 - protein, 363 aa, Glycine max
  Coding DNA Sequence Number=SeqID_33125
  Gene Ontology: Mol. function=isomerase activity; Cellular component =intracellular; Biological process=proteolysis
  Homolog annotation: Hit_ID=Q1S6B6; Match level="QueryCoverage=93%, HitCoverage=91%, E-value=4e-45, Identity=34%"; Hit description =Cyclin-like F-box; F-box protein interaction domain
  Pfam annotation: Domain name=FBA_1; Domain location=218-344; Score= -42.2; E_value=0.0095; Accession=PF07734.3; Description=F-box associated
GYLHRIGFTRKRERLINPMDRTSPLPPSSVQKQQGMSESLPLPFLPDELVVEILSRLPVKSLLQFSTHFTHHRIILSATTAEFHLKSCSLSSLFNNLSTVCDELNYPVKNKFRHDGIVGSCNGLLCFAIKGDCVLLWNPSIRVSKKSPPLGNNWRPGCFTAFGLGYDHVNEDYKVVAVFCDPSEYFIECKVKVYSMATNSWRKIQDFPHGFSPFQNSGKFVSGTLNWAANHSIGSSSLWVIVSLDLHKETYREVLPPDYEKEDCSTPGLGVLQGCLCMNYDYKKTHFVVWMMKDYGARESWVKLVSIPYVPNPENFSYSGPYYISENGEVLLMFEFDLILYNPRDNSFKYPKIESGKGWFDAE

SEQ ID NO: 149904 - protein, 350 aa, Glycine max
  Coding DNA Sequence Number=SeqID_33126
  Gene Ontology: Mol. function=catalytic activity; Cellular component =cellular_component; Biological process=metabolic process
  Homolog annotation: Hit_ID=Q9MB42; Match level="QueryCoverage=94%, HitCoverage=45%, E-value=1e-147, Identity=72%"; Hit description=Beta- amyrin synthase
  Pfam annotation: Domain name=Prenyltrans; Domain location=198-240; Score=34.6; E_value=3.4e-07; Accession=PF00432.11; Description =Prenyltransferase and squalene oxidase re
  Pfam annotation: Domain name=Prenyltrans; Domain location=247-302; Score=34.3; E_value=4.1e-07; Accession=PF00432.11; Description =Prenyltransferase and squalene oxidase re
  Pfam module annotation: Pfam domain module=Prenyltrans::Prenyltrans; Domain location=198-240::247-302
SLCMLACWVEDPNGDAFKKHLARIPDYFWVSEDGMIVQPVIGSQAWDISFIVQALLATDLIEEFGPTLAKAHDFIKKSQLTDNLPGDFKSMYRHISKGAWTFSHKDDGWQLSDSTAECLKCCLLLSMMPQEIVGEKMEPEKLYDSVDFILSLQRLNPTEFYADLIIENDYVECTGSAIQSLVFFKSLYPEYRKKEIENFINKAVQFLEDEQSTDGSWSGKWGVYSTYSSWFALRGLAAAGKTYTNCVTIRKAVKFLLSIQTEDGGWGESYLSGAKNTYVPLEGNRSNVVQTAWALMALIHAGQAEKDPTPIHNAAKLLINSQLEDGDWPQQVPLKSRSLIIQLLLMCMLC

SEQ ID NO: 149905 - protein, 115 aa, Glycine max
  Coding DNA Sequence Number=SeqID_33127
  Homolog annotation: Hit_ID=Q2QQY1; Match level="QueryCoverage=52%, HitCoverage=29%, E-value=3e-08, Identity=46%"; Hit description=SAM domain family protein
  Pfam annotation: Domain name=SAM_1; Domain location=48-106; Score =14.3; E_value=0.0081; Accession=PF00536.20; Description=SAM domain (Sterile alpha motif)
  Pfam annotation: Domain name=SAM_2; Domain location=47-111; Score =12.1; E_value=0.076; Accession=PF07647.7; Description=SAM domain (Sterile alpha motif)
  Pfam module annotation: Pfam domain module=SAM_1::SAM_2; Domain location=48-106::47-111
  Subcellular localization annotation: CTP_CleavageSite=28; ConfidenceScore=5.02e-01
MWNFRILPALVPLSECPHALAVLLSQPRALSLTGKCFVLFRSLGKASPEFCVKNLAQWVVLGRYAPVFKIHKVDDEVLPLLMLEDLKDVGINAVGSRRKICFVQFKSLGRASPEL

SEQ ID NO: 149906 - protein, 390 aa, Glycine max
  Coding DNA Sequence Number=SeqID_33128
  Gene Ontology: Mol. function=isomerase activity; Cellular component =intracellular; Biological process=proteolysis
  Homolog annotation: Hit_ID=Q1RX34; Match level="QueryCoverage=85%, HitCoverage=94%, E-value=5e-71, Identity=47%"; Hit description =Cyclin-like F-box; F-box protein interaction domain; Galactose oxidase, central
  Pfam annotation: Domain name=F-box; Domain location=42-89; Score =49.9; E_value=8.6e-12; Accession=PF00646.23; Description=F-box domain
  Pfam annotation: Domain name=FBA_1; Domain location=242-363; Score= -31.5; E_value=0.0012; Accession=PF07734.3; Description=F-box associated
  Pfam module annotation: Pfam domain module=F-box::FBA_1; Domain location=42-89::242-363
  Subcellular localization annotation: CTP_CleavageSite=29; ConfidenceScore=5.47e-01
MAAGSDGVDINDAASPKTTTSKRGRFTTSTESRRQTLTSSSSHTHTLPIELIQEILQRLPVKFLLQLRCVCKSWKSLISHPQFAKNHLHSSPTATRLIAGFTNPAREFILRAYPLSDVFNAVAVNATELRYPFNNRKCYDFIVGSCDGILCFAVDQRRALLWNPSIGKFKKLPPLDNERRNGSYTIHGFGYDRFADSYKVVAIFCYECDGRYETQVKVLTLGTDSWRRIQEFPSGLPFDESGKFVSGTVNWLASNDSSSLIIVSLDLHKESYEEVLQPYYGVAVVNLTLGVLRDCLCVLSHADTFLDVWLMKDYGNKESWTKLFRVPYMGISDSYLYTKALCISEDDQVLMEFNSELAVYNSRNGTSKIPDIQDIYMYMTPEMLYYVTGA

SEQ ID NO: 149907 - protein, 70 aa, Glycine max
  Coding DNA Sequence Number=SeqID_33129
MPKSSPNMHVKQEVSTRVKPRLLCKQSMGQNTPNKIDDDGSNSHQGENKGFNSQNAKRLLFQKQLPITYT

SEQ ID NO: 149908 - protein, 257 aa, Glycine max
  Coding DNA Sequence Number=SeqID_33130
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-36, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GPLGTSTLTFGGLHVLPSRGLHVVAFRELHILAFIGLHALTFSGLDVLAFRGLHALTFRGLHALAFRGLHVLTFRGLHALAFRGLHVLAIKGLQALTFRGLHILTFRGLHVLTFRGLHILTFRDYTSSSLEDCTSSPSEGCTPSPSEGCTPSPSEDYTSSPSEGCTPSPLKDYTSSSSEGYTLSPSEDYTSSPSEGCTPSPSEDYTSSPSEDYTSSPSEGYTPSPSEDYTSSPSEDYTSLPLEGYASSFSVGSIATP

SEQ ID NO: 149909 - protein, 159 aa, Glycine max
  Coding DNA Sequence Number=SeqID_33131
  Subcellular localization annotation: CTP_CleavageSite=77; ConfidenceScore=5.82e-01
MNHFFRKVPGRGFPGVFRKKCSSGRRLVTSGRTLLPETFRKMFFRNFRKNPLRVFRKTSPSAFSAIFSGVLSSSPLSSSTLSDAHYKLRVRGRGTNMFAEKKKKALARLAEKKLHGEEKKKQVPREEEAVPGEKKKLCSGREEEAVRKKVFRKLHSRFL

SEQ ID NO: 149910 - protein, 148 aa, Glycine max
  Coding DNA Sequence Number=SeqID_33132
  Subcellular localization annotation: CTP_CleavageSite=67; ConfidenceScore=5.31e-01
MHKTLRSNAPLPHPHLITLFLQHFNVPLDSKPFVKVKRSFSIGVNVVSSFGYRKERDGSWVKKDAPVQAAEDRSPSPHSQRDDSSSLMHNILDKLDGLHTFIGERFDSLDSRIDAMDARFAAMDTRITKLEEDVTYVRQCFDLPPPSS

SEQ ID NO: 149911 - protein, 60 aa, Glycine max
  Coding DNA Sequence Number=SeqID_33133
MPSFTFQKISMSLLSALSTTEESGRASISRLHAKREISALSAIVVFSQAQRTTGAKLKST

SEQ ID NO: 149912 - protein, 69 aa, Glycine max
  Coding DNA Sequence Number=SeqID_33134
MDQMKRGGGSVIICDEMREAKSACMRYFKGVWGRDCGSSKDLAALVVVQDENEDVAKNRGEGVGFKNFG

SEQ ID NO: 149913 - protein, 125 aa, Glycine max
  Coding DNA Sequence Number=SeqID_33135
  Gene Ontology: Mol. function=RNA-directed DNA polymerase activity; Biological process=DNA integration
MCKEFFELMKGEFEMCMMGELNFFLGLQIIQKGDGIFIHQEKYVKDLLKRFIMDEAKPMATHMHPSTVIVKDEKGNDTSEKEYKAYCDADFVGDKVEKKSTSGACQFLGESLVSWTSKKQSTIAL

SEQ ID NO: 149914 - protein, 127 aa, Glycine max
  Coding DNA Sequence Number=SeqID_33136
MVQPVAAIVAAVTMVDHATRKTTTDRRKDAITCLSSSQASLIDKHSDLVDKYSELSGKVDFILNHLHLRSPNHHHPNSSTQVHQCNSVMLDIPRFDGHDPLGLPPPFLLSCFISGLTPEIHWEVLAL

SEQ ID NO: 149915 - protein, 762 aa, Glycine max
  Coding DNA Sequence Number=SeqID_33137
  Gene Ontology: Mol. function=RNA-directed DNA polymerase activity; Cellular component=chromatin; Biological process=chromatin assembly or disassembly
MNQTSRRRSKWAESNLDTPTIEALLKQFQHLFQTPTNLPPPRGVVHWINLLPSTAPVNVWPYRYFHFQKTEIEKQISDLISAGLIRPSTSPYSSPILLVKKKDGTWRMCMDYRALNSVTVRDLFPIPTIDELLDELGHTSWFSKLDLRQGFHQILMHEPDIEKMAFITHQGHYQYRVMPFDLCNVPSTFQAAMNSLLTPFLCQFAVVFFDDILVYSDSLSSHIKHLDAIFQALLQGQFYLKRAKCLFAQSQVEYLGHVVSGKGVEPEPSKVRAIVQWPTPTSTKELRAFLGLIGFYQKFVKNYASIAAPLTTLLCKDAFVWIEASQAAFDQLKIAMNSALILALPNFVEPFIVETDASGITMGAVLAQQGHPIAFFSKTFGPRLLHASTYIRELHAIVTTVRKWRQYLLRRSFTILTDHKSFRELMSQVIQTPEQYYYLSKLLGFDYTIQYKPSASNIIVDALSRVPSKSHGQLLLLSIPHFDFIDDLRRMLHANSDFQAQLSKVCSNPSDYRDYNIHNDLLLFQGCIWLNKNNPYIPTLLFEFHGTPLGGHLGVSSTRRPARLLQPLSIPNGVWEDLFMDFITHLPQSQGFTVILIVVDRYSKGIHFGALPTSYSAFKWHSFMHEYNISPIDQWPNRGDESPIGAVPAVVHPFTAAMKKHVDTKRKDVTFTIGQWVYVKLRPFRQCSVAGLTHPKLSKRFFGPFQITDRISAPSTKHGAHPSSISLFPLACTSQFDDSTSPPTRLVLTQWVNLQKIQLENH

SEQ ID NO: 149916 - protein, 146 aa, Glycine max
  Coding DNA Sequence Number=SeqID_33138
  Homolog annotation: Hit_ID=Q5N7J0; Match level="QueryCoverage=49%, HitCoverage=14%, E-value=1e-07, Identity=40%"; Hit description =Putative dual-specific kinase DSK1
MGIPLPSYVVVACDATRARNEHEVKLVVDHLRSRGDILSESDSLLVFCALHKVAHPMGYQTLACPESFAGTNIRAMEEEVNRKAAAYKSVLLPTYEERENKGLTLWCHSKDNILISSLQEFIGHGSLFDAARILQKLRAARIAFGA

SEQ ID NO: 149917 - protein, 197 aa, Glycine max
  Coding DNA Sequence Number=SeqID_33139
  Gene Ontology: Mol. function=RNA-directed DNA polymerase activity; Cellular component=chromatin; Biological process=chromatin assembly or disassembly
MTELHDKGGVISHYRHKLLQPFNPQDCIGTTYRKQMEGDLGVIEKCSDIVGCSQGLSCCLLTHKGVRRTELGGGGIVRCEDSEACVADDAEKAKGFSQRKARQSMEAYVRVFGIGYGLRINRGFKFCCDFWAWIIGFRDMIIHDEQEYSTLAVMASVPLFIAIVAKALLAAEDHLIWSSLDKWLFWFWVWVGWVIRR

SEQ ID NO: 149918 - protein, 475 aa, Glycine max
  Coding DNA Sequence Number=SeqID_33140
  Gene Ontology: Mol. function=protein serine/threonine kinase activity; Cellular component=integral to membrane; Biological process=multicellular organismal development
  Homolog annotation: Hit_ID=Q5N7J0; Match level="QueryCoverage=63%, HitCoverage=51%, E-value=1e-105, Identity=63%"; Hit description =Putative dual-specific kinase DSK1
  Pfam annotation: Domain name=Pkinase; Domain location=171-439; Score =118.8; E_value=1.5e-32; Accession=PF00069.15; Description=Protein kinase domain
  Pfam annotation: Domain name=Pkinase_Tyr; Domain location=171-439; Score=57.6; E_value=5.2e-16; Accession=PF07714.7; Description =Protein tyrosine kinase
  Pfam module annotation: Pfam domain module=Pkinase::Pkinase_Tyr; Domain location=171-439::171-439
DMRFYRNKISCKIALVKDDLSVDIWRSHHIHETDVTEQKLIYSLSKCVSLSDSHSIGDEEQSVIFCKSYPLSIASDTSNMSKSSMKHSNANKLGEHISSIDFGSSSGRSIQVEYKHPINSQILQKQNRYDFLPNSSETPILCAGCGTQTALYTNELKRFSYSEIQLATNDFSKDNLLGEGGYGHVYKGMLKDGQQIAAKVRKEESRQGFSEFTSEVYVLNFARHKNIVMLLGYCFKDRLNILVYEYICNKSLDWHLVDNKNAAVLEWHQRYVIAIGTAKGLRFLHEECRGGPIIHRDMRPSNILLTHDFVPMLGDFGLAKWKTSDNTLHTRIMGTLGYLAPEYAEDGIVSVGVDVYAFGIILLQLITGRKPTSSPEQHLSLRQWAELKIEKLAFDELIDSRLGDSYNSNELYTMAKVAYYCVQRDHQKRPSIGEGIDSISFGLPSIETPLMKVFTLFWIWLNCHHLECLAKEVPR

SEQ ID NO: 149919 - protein, 264 aa, Glycine max
  Coding DNA Sequence Number=SeqID_33141
  Homolog annotation: Hit_ID=Q47522; Match level="QueryCoverage=21%, HitCoverage=77%, E-value=4e-19, Identity=74%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGVVAMGRTAQDHKLARKDHRGTSILIFLYSAISSHWWKPKRNTRPGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149920 - protein, 198 aa, Glycine max
  Coding DNA Sequence Number=SeqID_33142
DCIIYNPVLAIRQLGYPMRGAPSEEGLIPFLTRGFNSTNAGVLQRVHKAWEMSQRKDKELRWSSNGPIGGYRMWLKAYTQDLDWLPSLRTTKGIEIETPEEDEEENAKLRYVNIATTKALEQETKMARREEHGQNKFRGALWGSNSELMLRREERDQSRVDGLILKDELRVCLRSKRSFVSAVMRDRNKHVSHHQQVP

SEQ ID NO: 149921 - protein, 161 aa, Glycine max
  Coding DNA Sequence Number=SeqID_33143
  Gene Ontology: Mol. function=helicase activity; Biological process =viral genome replication
  Homolog annotation: Hit_ID=Q9LW42; Match level="QueryCoverage=99%, HitCoverage=9%, E-value=3e-36, Identity=48%"; Hit description =Helicase-like protein
MARDRLQDVQVNNIKLKLIANREKDGRTYNVPTVPEVAALIVSDFDANSKRDIIIETQHGQLQRIHELHSSYLALQYPFLFPYKEDGYRPDILHSIQSDGEKRKRNRLTMKEWFSYRLQCRSNESKTLLNSRRLFQQFLVPGYTMVESERLSYIRNNQKKL

SEQ ID NO: 149922 - protein, 135 aa, Glycine max
  Coding DNA Sequence Number=SeqID_33144
MARTKQTGDMTTEAAKEIAEEDRKIPLRSRRHRDPSSPMDHPGRVRAAGAGVTIKHYFGSAPRTSRNSSSLPPEELQQLLTQQIRDQLEESITEKETKTGDSDRCGLYIEADPACLVGVEEVKDPNAPVPIPTDE

SEQ ID NO: 149923 - protein, 82 aa, Glycine max
  Coding DNA Sequence Number=SeqID_33145
  Subcellular localization annotation: CTP_CleavageSite=55; ConfidenceScore=5.52e-01
MNIWTFYIGYKAYSTSGPTSSLNKKTRLCLLMRLRGSGGNNTRCGGQEMQQCRVPFAEVRETAQCQGGERDIQVKQSTGADT

SEQ ID NO: 149924 - protein, 70 aa, Glycine max
  Coding DNA Sequence Number=SeqID_33146
MSSLVGMSVTVEDGDGVDVGTRDSLRASIGNVDGLTLVGVGDDVGATFEVDGDRVDDDKLPLHGYMHRKM

SEQ ID NO: 149925 - protein, 65 aa, Glycine max
  Coding DNA Sequence Number=SeqID_33147
MLVKKDMMEKIHPFFQRFWTERFDTLELQVDMCFNEMESRITKVEKDVSYIRSSFDLPPPSPPSS

SEQ ID NO: 149926 - protein, 125 aa, Glycine max
  Coding DNA Sequence Number=SeqID_33148
MSFRTVGKLGLCKGGKSVTKVKARVISRARVISKICTIMQNFAIVFVQKMLMHGWLWKGLYIFGSGRFLADPNGQNVGNWGWWVSCVICGCGESTCTIARSPPSTTYDGVVLGDMSWGSGDLGDV

SEQ ID NO: 149927 - protein, 98 aa, Glycine max
  Coding DNA Sequence Number=SeqID_33149
MSKHNLWVECEEHEKSMSFLNNELLKYQELKGQPQDVVKLHEEIRTLKPWIFFINGVLCFLKSMAVEWRRKKENWRHHFKEKISQEQAHHHRKPWIRA

SEQ ID NO: 149928 - protein, 87 aa, Glycine max
  Coding DNA Sequence Number=SeqID_33150
MRGVTTNVYSRKTSEKPERCGLRTLSVKGSGVVFTHGEESLRIAQQCFLSTSDMPWNLTNYLTMGVKYFKAIKRRLHPTKQMVPGRN

SEQ ID NO: 149929 - protein, 329 aa, Glycine max
  Coding DNA Sequence Number=SeqID_33151
  Gene Ontology: Mol. function=[protein-PII] uridylyltransferase activity; Biological process=nitrogen compound metabolic process
  Homolog annotation: Hit_ID=Q6ZI91; Match level="QueryCoverage=92%, HitCoverage=67%, E-value=2e-84, Identity=55%"; Hit description =Putative ACT domain-containing protein
  Pfam annotation: Domain name=ACT; Domain location=104-168; Score =35.2; E_value=2.2e-07; Accession=PF01842.15; Description=ACT domain
  Pfam annotation: Domain name=ACT; Domain location=11-74; Score=14.9; E_value=0.047; Accession=PF01842.15; Description=ACT domain
  Pfam annotation: Domain name=ACT; Domain location=240-311; Score =16.2; E_value=0.032; Accession=PF01842.15; Description=ACT domain
  Pfam module annotation: Pfam domain module=ACT::ACT::ACT; Domain location=104-168::11-74::240-311
MDSFYFFISKNNTQFDSINKPGILLEVVQILTDLDFIITKAYISSDGGWFMDVFHVTDQQGKKITDSKTIDFIEKTLGPKGQSTEGVKSWKGKRVGVHSIGDHTVIELIGRDRPGLLSEISAVLASLQFNVIAAEVWTHNRRIACVLYVNDATNQAMDDSKRLSIIEEQLNHILRGCEDDEKVARTSFSMGITHMDRRLHQMLFADRDYESAGVTTTDVDCPPCFRPNIRIERIVEKGYSVVSVKCKDRAKLMFDIVCTLTDMEYVVFHATISSEGQYASQEYFIRHMDGCTLDTEGEKERAIKCIEAAIQRRVSEPSTCIVANGTADK

SEQ ID NO: 149930 - protein, 129 aa, Glycine max
  Coding DNA Sequence Number=SeqID_33152
  Subcellular localization annotation: CTP_CleavageSite=59; ConfidenceScore=5.41e-01
MRKIPKMRGKKVFLLSFLDPSLPRLASGSPEPPNGFRVKKPARLGKPITSGVSLSSLGRAAMVLSALFSINRCKREAEEGFQGSKGEGIERRDKEEEERRGNKVKALPNYDHDHPLHRSLLGVLRAIVG

SEQ ID NO: 149931 - protein, 64 aa, Glycine max
  Coding DNA Sequence Number=SeqID_33153
MAGLDRQWIRKCLDGLNGEDGKTIPLVKVIGVPLMNAMRRMKSKIRWGNHIRIFSKLGRDMETA

SEQ ID NO: 149932 - protein, 158 aa, Glycine max
  Coding DNA Sequence Number=SeqID_33154
  Gene Ontology: Mol. function=nucleic acid binding
MANIWKPLKGVTISYIGNGTFLFRFYHQVDIQRVLKGGSWRFDRYMLILGVITEDENPLEIPLFNVPFWVQIHNLPLGFMSKRRNPTAAGGSKYLRDGGNRGSDEPKTQTARDLEIQGINCRGTTTINANDLEIQKRVELMAEIFKNPKLIFSNSVQQ

SEQ ID NO: 149933 - protein, 56 aa, Glycine max
  Coding DNA Sequence Number=SeqID_33155
MVDIIFYGNLQTSTSFSSIFRSLIGGSSMMKGIKICEGVGFYWVWVRDKSNEKSKF

SEQ ID NO: 149934 - protein, 97 aa, Glycine max
  Coding DNA Sequence Number=SeqID_33156
MNGEVALKKWMTDRDTLGCSGQKGEEDSPIQPTTFQEQDTTIEVYEDEGDFIDDEDLAPSETTFYQGVCGEEIFREEMVSSTRNETSRKTKATILRI

SEQ ID NO: 149935 - protein, 83 aa, Glycine max
  Coding DNA Sequence Number=SeqID_33157
MVWPCHRKECVRVRVRRKAREMSDSENESARVRVRDVVGLWPKIQQIMCKWQKLQCPMIKIVADLPLFNGPTGGEGMKKFGTP

SEQ ID NO: 149936 - protein, 149 aa, Glycine max
  Coding DNA Sequence Number=SeqID_33158
MHGVKVSYIDVDHLIRKQLQASLFRHQWRKMIEILTSTVDADDARRWMLVRGSWLLLTATRLPSRWFVAEEEDEDGSARKKNGCKENARKKNGFVGGGGGRRRMQGSKGCKEEDEREEEEECWVREEERESSGRERVKRFFFKLTQGHK

SEQ ID NO: 149937 - protein, 88 aa, Glycine max
  Coding DNA Sequence Number=SeqID_33159
MGAKYLKVVKRGSHPNNGWSPDEIRNDHNLSLRFVGHDRAWAARHRMAIICLCVPPDTIASGWRKGVRNDKGCRICLCAFITQLAKSE

SEQ ID NO: 149938 - protein, 133 aa, Glycine max
  Coding DNA Sequence Number=SeqID_33160
  Gene Ontology: Mol. function=nucleic acid binding
MAQPPPRERTLREMAALDFTYESLCIQYPDEDVPYVLKTGLIHLLPKFHGLAGEDPHKHLKEFHIVCSTMKPPDVQEDHIFLKAFPHSLEGVAKDWLYYLAPRSITSWDDLKRVFLEKIFPASRTTAIRKNIS

SEQ ID NO: 149939 - protein, 134 aa, Glycine max
  Coding DNA Sequence Number=SeqID_33161
MSLHSSSSVNGEGSTPKDPLYKILDELRSLKLWKEKQERKEKGKKRAKEISQDEKEKIREDERRKILKELRKEKHASYSSHNSCKSLSEELRDYYEGRHRSHLRPHSHRRENGRKPQEVNIKLPYFHGEGQCRG

SEQ ID NO: 149940 - protein, 133 aa, Glycine max
  Coding DNA Sequence Number=SeqID_33162
MTTHWDFSMNGSKRTNWRHTETWKELEVLKDRVPCFKGMSAMEVYLKWEMKTEQVFACCKYSEAEKVKVAALVFKDHTIIWWDQEKKYRKRFNETPVATWLEMKTLMRKRYVDAILPRKGRITRAMSKRIQED

SEQ ID NO: 149941 - protein, 202 aa, Glycine max
  Coding DNA Sequence Number=SeqID_33163
MIEAMINDPMKTLMDYLTLKDPMMHMRRIVWLCNTIKQPNVIKEYIRLKPRKDSKSFQHYGFNQHRIVHIFYGGVSNPYNNSRDRRIMKRPINQTQPQVPNSSPLYHTCDNCRCVNGLGECIVGDELGQTMNENDQCLKLIKSQLASIQALLSQRASNTLPSQTEANPKNEEVKVVSTSSGWSMTEIKKKKKSLPPPKKGSY

SEQ ID NO: 149942 - protein, 127 aa, Glycine max
  Coding DNA Sequence Number=SeqID_33164
MTIQSIQFQQETRASIQSLTNQMGQLATQLNQIQVPQPVAAPAPEPIKLNSTHEKEDEIVAQKRKLPNKNFHAGGTSSSNYDLQQPLIPLPFPPRAIPNKKMEEAEKEILKTFRKVEVNIPLLDSIK

SEQ ID NO: 149943 - protein, 73 aa, Glycine max
  Coding DNA Sequence Number=SeqID_33165
DKYPKGETLKKKIAADSDDEESSSESSDDESSRAISYRTPFFTQQHAAQHDQIPEVFQNLAAKLIIVEVKVFQ

SEQ ID NO: 149944 - protein, 294 aa, Glycine max
  Coding DNA Sequence Number=SeqID_33166
  Gene Ontology: Mol. function=heat shock protein binding; Cellular component=integral to membrane; Biological process=protein folding
  Homolog annotation: Hit_ID=UPI00001971A6; Match level="QueryCoverage =88%, HitCoverage=62%, E-value=3e-91, Identity=66%"; Hit description =heat shock protein binding / unfolded protein binding
MNGFLDRETMLDPMAVFALLFGSELFEDYIGHLAVASMASSELADETEDPDKLNEKLKARMFYIHFSAVQKEREEKLARILRDYLGQYVRGNKKGFFQRAESETRRLSRAAFGVDMLHTIGYIYSRQAAQELGKKAIYLGVPFLAEWVRNKGHFWKSQFTAAKGAYQLLQLQDDMRKQFKMDGSSVPENDVDSHIRLNKDTLMNSLWKLNVVDIEVTLVHVCQMVIVFIVAYPDTMKLLVLRENNVKKEELRLRATALKILGKIFQVQIFRYFGINYFSFQLSRNIAHYNNFCV

SEQ ID NO: 149945 - protein, 84 aa, Glycine max
  Coding DNA Sequence Number=SeqID_33167
MESKRRKKKKERKRGMGREGVTRKWRLYSSDGQYCISREVLFRGRKQFFKRFGPTGSRTQVAGFKVQSANHYTIEPLDNRRKPK

SEQ ID NO: 149946 - protein, 94 aa, Glycine max
  Coding DNA Sequence Number=SeqID_33168
  Homolog annotation: Hit_ID=UPI0000612705; Match level="QueryCoverage =84%, HitCoverage=90%, E-value=2e-07, Identity=29%"; Hit description =UPI0000612705 related cluster
MSQSLIRVDPWVLVPIAFRGLHVLAFRGLHVLAFRGIHVLTFKGLQVLAFRGLYVLPFRGLHVLAFRELHVQDFRGLLVHAFRGLHAFSFRGPH

SEQ ID NO: 149947 - protein, 147 aa, Glycine max
  Coding DNA Sequence Number=SeqID_33169
  Gene Ontology: Mol. function=nucleotide binding; Cellular component =membrane; Biological process=small GTPase mediated signal transduction
  Homolog annotation: Hit_ID=Q40207; Match level="QueryCoverage=97%, HitCoverage=57%, E-value=1e-52, Identity=72%"; Hit description=RAB1Y
  Pfam annotation: Domain name=Ras; Domain location=1-88; Score=-0.7; E_ value=3.2e-09; Accession=PF00071.12; Description=Ras family
MVYDVTRRETFTNLSDIWAKEIDLYSTNQDCIKMLVGNKVDKESERVVSKKEGIDFAREYGCLYTECSAKTRVNVAQCFDELVMKSTFVLHSLPPRNACSLMAVLDKFQMILETPSLLAEGSSGVKKNIFKQKPPQSDASSSGCCSW

SEQ ID NO: 149948 - protein, 42 aa, Glycine max
  Coding DNA Sequence Number=SeqID_33170
  Gene Ontology: Mol. function=nucleotide binding; Cellular component =membrane; Biological process=small GTPase mediated signal transduction
  Homolog annotation: Hit_ID=Q40207; Match level="QueryCoverage=86%, HitCoverage=17%, E-value=6e-13, Identity=94%"; Hit description=RAB1Y
MGGKKLKLAIWDTAGQERFRTLTSSYYRGAQGIIMVWYLVKL

SEQ ID NO: 149949 - protein, 60 aa, Glycine max
  Coding DNA Sequence Number=SeqID_33171
MVGERSSKVSELIGNSRLDLDSVESGSRRKRKEIEENEDLVEGCGRSKKTRFKFVACMLR

SEQ ID NO: 149950 - protein, 107 aa, Glycine max
  Coding DNA Sequence Number=SeqID_33172
MTNDQRQQQNYDEKDNYDEHGGYGNIGSNNKERPFDMKQHFGHKEDVKGDRVEQDRVSHMMGRGFKPLLVPLSGVKDYILYKPLQCDIFIILSFLKIEGRLSSPRLM

SEQ ID NO: 149951 - protein, 120 aa, Glycine max
  Coding DNA Sequence Number=SeqID_33173
  Gene Ontology: Mol. function=cysteine-type peptidase activity; Cellular component=cytoplasm; Biological process=fucose metabolic process
MGYRLEDMLCDLGQESFQQAHAPVYDTLESDSKKPLYSGCKKSLTLLSVCGVSRYKVKDDDESRDEESIKKGPPVKVLWYLSIIPRLKCLFANGDDAKDLTWHAKERNWNGMLRHSNDSS

SEQ ID NO: 149952 - protein, 177 aa, Glycine max
  Coding DNA Sequence Number=SeqID_33174
  Gene Ontology: Mol. function=hydrolase activity; Cellular component =proton-transporting two-sector ATPase complex; Biological process =ethylene biosynthetic process
  Homolog annotation: Hit_ID=Q1SGA8; Match level="QueryCoverage=97%, HitCoverage=47%, E-value=2e-31, Identity=40%"; Hit description=2OG -Fe(II) oxygenase
  Pfam annotation: Domain name=2OG-FeII_Oxy; Domain location=26-127; Score=94.3; E_value=3.6e-25; Accession=PF03171.10; Description=2OG -Fe(II) oxygenase superfamily
GLARAVSETLGFEENYIEKEFNLKSGFDVMAMNLYPPNSRSKGAIGIPEHTDPGFVVSLVQDVDGGLQILSHQGKWINAYIPHHAILIQLGDHLEVLTNGKYKSHIHRVIVNNNKVPRISVVTLHGPALDKFISPGVEFVDEEHPQNYHGMTYKESLEANGGDQIDVQSSLDKLRLV

SEQ ID NO: 149953 - protein, 99 aa, Glycine max
  Coding DNA Sequence Number=SeqID_33175
ESELRQEAATPERTSQTPEGPLLLGIDLSFAQQVADPPTPVWERQADPPTPIMEMPEDPTMPILRLSSTPPAIPVLHLTDEDDMLDQDTQGTQDQFQEF

SEQ ID NO: 149954 - protein, 119 aa, Glycine max
  Coding DNA Sequence Number=SeqID_33176
  Gene Ontology: Mol. function=chitin binding; Cellular component =extracellular region; Biological process=chitin metabolic process
  Homolog annotation: Hit_ID=UPI000069F178; Match level="QueryCoverage =94%, HitCoverage=28%, E-value=1e-10, Identity=34%"; Hit description =UPI000069F178 related cluster
  Subcellular localization annotation: CTP_CleavageSite=10; ConfidenceScore=5.48e-01
VRTCGPLKVRACSPTKVRTCSPLMARACSPLKVRACSPLMVRVCSPTKVKAHDPLTVRTCSPLKVKARTYSPLEVRACSPLVVRTCSPLKARTACSPLMVRTRSPLKARTCSPLNGEGN

SEQ ID NO: 149955 - protein, 70 aa, Glycine max
  Coding DNA Sequence Number=SeqID_33177
MKVKHKRYAENTLYSSLHVMWYHFSVKNLVGRLGVHDRTCLTMGLKEHSNRMTPKACTPKSPLGPLPPDS

SEQ ID NO: 149956 - protein, 87 aa, Glycine max
  Coding DNA Sequence Number=SeqID_33178
MACTQEHRSLEQTDQWLAPTFRIYTRWLTPRSTGHLSKQTNGLHPHSGFTRDSPQIPSSPYQLDFAPYALEPYNAQWNAPGLLRDKH

SEQ ID NO: 149957 - protein, 104 aa, Glycine max
  Coding DNA Sequence Number=SeqID_33179
MANQGDWVPFMDVLTLLIFGVVLFPNVDGLVDLAAIDAFLAYHHSKESPVVAVLADLFDTFDRRRMDWDQLLAGIGGRTISCSPDGRKEKKESFSHVEDTQTFR

SEQ ID NO: 149958 - protein, 158 aa, Glycine max
  Coding DNA Sequence Number=SeqID_33180
  Gene Ontology: Cellular component=membrane; Biological process=cell division
  Homolog annotation: Hit_ID=UPI00006BCA8C; Match level="QueryCoverage =89%, HitCoverage=46%, E-value=4e-27, Identity=43%"; Hit description =cell division protein
MVISVVLVTFVSLTFVGAAILMQGQIGVMRGYWAERAQVAVYMCSAVSESDTCIDGAASEEQVAAVRAQLEGEALAPLISSMTFDTKEETYAKLVDQLGEDQASVLSPEQAFEVFFVTMKDPGQSQVLAEAFSGQAGVEQVKDQLQYLEPLFSALTVA

SEQ ID NO: 149959 - protein, 109 aa, Glycine max
  Coding DNA Sequence Number=SeqID_33181
MYPPLELIHKRCTLSCYQSTTQVDVPSTCTTKDVPSNVLRQRSQAVKPMILCEWGYKRILRREKGDTKEFRRLVLRSLGKGRRETQKEFRRLVLGEFFLAKGEGNEKDE

SEQ ID NO: 149960 - protein, 55 aa, Glycine max
  Coding DNA Sequence Number=SeqID_33182
MAVVGTTEFSKTGDEVLNQYGNTSIYSTKFTTVYKQHRLCILLFLRRCLQKHRLR

SEQ ID NO: 149961 - protein, 44 aa, Glycine max
  Coding DNA Sequence Number=SeqID_33183
MHVIFVTYTEPRSHWRVEACVESTSKDEKESSSDTTRNPRGSSR

SEQ ID NO: 149962 - protein, 849 aa, Glycine max
  Coding DNA Sequence Number=SeqID_33184
  Gene Ontology: Mol. function=protein binding; Cellular component =membrane; Biological process=defense response
  Homolog annotation: Hit_ID=Q1SW19; Match level="QueryCoverage=97%, HitCoverage=96%, E-value=1e-135, Identity=40%"; Hit description =Disease resistance protein
  Pfam annotation: Domain name=LRR_1; Domain location=511-532; Score =7.1; E_value=14; Accession=PF00560.23; Description=Leucine Rich Repeat
  Pfam annotation: Domain name=LRR_1; Domain location=534-555; Score =11.5; E_value=2; Accession=PF00560.23; Description=Leucine Rich Repeat
  Pfam annotation: Domain name=LRR_1; Domain location=557-578; Score =12.8; E_value=1.1; Accession=PF00560.23; Description=Leucine Rich Repeat
  Pfam annotation: Domain name=LRR_1; Domain location=699-721; Score =8.8; E_value=6.3; Accession=PF00560.23; Description=Leucine Rich Repeat
  Pfam annotation: Domain name=LRR_1; Domain location=723-749; Score =2.6; E_value=95; Accession=PF00560.23; Description=Leucine Rich Repeat
  Pfam annotation: Domain name=LRR_1; Domain location=772-794; Score =3.7; E_value=58; Accession=PF00560.23; Description=Leucine Rich Repeat
  Pfam annotation: Domain name=NB-ARC; Domain location=158-397; Score =116.2; E_value=9.4e-32; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=511-532::534-555::557 -578::699-721::723-749::772-794::158-397
MAETAVSLAGQHALPKILEAIKMVRDLPKEVRDITDELESFQDFINDADKVAEAEQDDGRRHRIKERVMRLREAAFCMEDVIDEYNISCEDKQPGDPRCAALLCEAVAFIKTQILLLQSAYKIQDVKSLVRAERDGFQTHFPLEPRLTSSRGNQDVTWQKLRMDPLFIDEDDVVGLDGPRDTLKNWLTKGREKRTVISVVGIPGVGKTTLAKQVYDQVRNNFECHALITVSQSYSAEGLLRRLLDELCKVKKEDPPKDVSNMESLTEEVENPLAQQEAFQYSSDGDCPEELKDISLHIVRKCKGLPLAIVAVGGLLSQKDESAPEWGQFSRDLSLDLERNSELNSITKILGLSYEYLPINLRSCLLYFGIYPEDYEIKSDRLIRQWIAEGFVKHETGKTLEEVGQQYLSGLVRRSLVQVSSFRIDGKVKSCGVHDLIHDMILRKVKDTGFCQYIDGCDQSVSSKIVRRLTIATDDFSESIGSSSIRSIFISTGEDEISEHLVNKIPTNYMLLKVLDFEGSGLRYVPENLGNLCHLKYLSFRYTGIESLPKSIGKLQNLETLDIRDTGVSEMPEEISKLTKLRHLLSYFTGLIQWKDIGGMTSLQEIPPVIIDDDGVVIREVGKLKQLRELSVVYFRGKHEKTLCSLINEMPLLEKVRIDTADESEVIDLYITSPMSTLKKLVLRGTLTRLPNWISQFPNLVQLYLSGSRLTNDALKSLKNMPRLMLLFLSDNAYEGETLNFQSGGFQKLKTLLLKSLNKLESILIDRGALCSLELFSLRELSQLKTVPSGIQHLEKLKDLYIKDMPTEFEQRTAPDGGEDHWIIQDVPHVRIWSEDAEEPLHMFGRSHH

SEQ ID NO: 149963 - protein, 173 aa, Glycine max
  Coding DNA Sequence Number=SeqID_33185
  Gene Ontology: Mol. function=RNA-directed DNA polymerase activity; Biological process=RNA-dependent DNA replication
  Pfam annotation: Domain name=AT_hook; Domain location=129-141; Score =14.9; E_value=0.061; Accession=PF02178.9; Description=AT hook motif
DVNHRIQAGWMKWRKASGVLCDAKVPIEAKGKVYRTVVRPAILYGTECWAVKSQHENKVGVAEMRMLRWMCGKTRHDKIRNEAIRERVGVAPIVEKMVENRLRWFGHVERRPVDSVVRRVDQMERRQTIRGRGRPKKTIREVIKKDLEINGLDRSMLKGFVSLTIAFSYYNLS

SEQ ID NO: 149964 - protein, 60 aa, Glycine max
  Coding DNA Sequence Number=SeqID_33186
MIMTLLADTQRAKLTKKLSEANQQNRFLKRQHLFKYDIDRLHRVNANRVKAALDIGSKRR

SEQ ID NO: 149965 - protein, 230 aa, Glycine max
  Coding DNA Sequence Number=SeqID_33187
  Gene Ontology: Mol. function=calcium ion binding; Cellular component =flagellin-based flagellum; Biological process=ciliary or flagellar motility
  Homolog annotation: Hit_ID=Q9AR93; Match level="QueryCoverage=59%, HitCoverage=81%, E-value=2e-54, Identity=78%"; Hit description =Putative calmodulin-related protein
MSHLVTERQCYYYHHLRATHHLLELFEIDVAVAVGIDVSDHPPAVAEGALLPQPPHHGVQLLRRDQPVLVQIVQLERLPELPPVATAAAVELAELLQVNVAVAVPVQLRHHALHLVRRRFGSQRRHHLLQLRARDLAVAVLVELAEDLAHLFFVHGDAERRIINLRVQFARDQRLAHVNALSRKQVEERKKGTVVLVRAKRGVVECGRSGEEFGRASRPRGVHENQDIMS

SEQ ID NO: 149966 - protein, 95 aa, Glycine max
  Coding DNA Sequence Number=SeqID_33188
MKMIQFHSVTLMNATSGLWVFEASGIGQPMTYTRQRIQKRKKPLSVEDVAPKTKRGQRRVRAQGLEVEGEGLERKGGRESEADAKLPPWREVVRD

SEQ ID NO: 149967 - protein, 45 aa, Glycine max
  Coding DNA Sequence Number=SeqID_33189
MCDNALATKTPARVLSKASTLNPLTSPLGTKDCKEIDETEESDSN

SEQ ID NO: 149968 - protein, 279 aa, Glycine max
  Coding DNA Sequence Number=SeqID_33190
  Homolog annotation: Hit_ID=Q1STZ2; Match level="QueryCoverage=30%, HitCoverage=18%, E-value=1e-07, Identity=32%"; Hit description=IMP dehydrogenase/GMP reductase
MGQLQRQAFRKAYCKIWDLARVEVSMEPIASLSQYYDQPLRCFTFEDFQLVPTVKEFEEILGCPLGGRKPYLFSGFYPSTTRVAKAVKISAQELDRLSSFRLWKGLVDLVVIDAFLAFQHGKESPVVAILAMYDKFDRGCEKSGARIEGKIRILSSCEGCPMRGVPSDQSITPFIARGFSDHNARDRELRGSSNGIIGGYHKWLRVRTQGLDWLPNLKTVRDDEVKASEESDEVQALKAELERAWVVEEKFKAAIVSSSSEEVKGIITGQRHDLEGRAK

SEQ ID NO: 149969 - protein, 52 aa, Glycine max
  Coding DNA Sequence Number=SeqID_33191
MAINKRGKENLLGTIEIAICSLCTSVALSEHSVTFEFSKFKFTCLERQTRSA

SEQ ID NO: 149970 - protein, 510 aa, Glycine max
  Coding DNA Sequence Number=SeqID_33192
  Gene Ontology: Mol. function=aminocarboxymuconate-semialdehyde decarboxylase activity; Biological process=metabolic process
  Homolog annotation: Hit_ID=A0B3A0; Match level="QueryCoverage=72%, HitCoverage=99%, E-value=2e-93, Identity=49%"; Hit description =Amidohydrolase 2
  Pfam annotation: Domain name=Amidohydro_2; Domain location=31-373; Score=72.9; E_value=1e-18; Accession=PF04909.4; Description =Amidohydrolase
  Pfam annotation: Domain name=MFS_1; Domain location=168-509; Score= -13.7; E_value=0.0013; Accession=PF07690.6; Description=Major Facilitator Superfamily
  Pfam module annotation: Pfam domain module=Amidohydro_2::MFS_1; Domain location=31-373::168-509
MEIVNAPHLPVREHWLALHHEPALMPDLPMVDAHHHLWDRQSGRYLAPEFSHDIETSGHRILSTVYIQCRSMLRRNGPEAFKPVGEVEFASGVAAMFDSGHYGAAAGCEAIVGGASLLAGDDLLPVIESMTERSGGRLCGMRNPLAWHDDPRVVSSPVTPPAGLAASAAFRRGAACLARKGLSLDVWVYHTQLDEIAELARALPDLHIIVDHCGGPIGSGPYADKRDATFQEWKKAIIALAALPNVSIKISGFGMTVMGYSFAQHATPPDSLTLSQAWRPQFETLVDAFGVGRSTAYSGMPVKGWLSTLRRPKENSCSGAPRLHAIAYPPWRIWMNIKSRLHEAPPLAQDESAAAISYTSAEKRTLALGGLGWTFESYDSFLLSLLLPVLGVVFDVSKTELGVFISTTAGGQIIGGILFGLVADKIGRVRTAFICIAIYSLFSGLLAFSHNPQAFAALRFCGALGMGGMWTSGAALIAETWRPERRARGGALMQMGLAVGAILAIGLTAL

SEQ ID NO: 149971 - protein, 127 aa, Glycine max
  Coding DNA Sequence Number=SeqID_33193
  Gene Ontology: Mol. function=oxidoreductase activity, acting on the CH-CH group of donors; Biological process=electron transport
  Homolog annotation: Hit_ID=UPI00006807C1; Match level="QueryCoverage =91%, HitCoverage=28%, E-value=6e-32, Identity=58%"; Hit description =conserved hypothetical protein PA2325
MSLTLADSAALPRKVNTQQTEAPVPLPAGAAHIIRDDAEAIAVAHQLAVSFAREAALRDREGILPLKELDAFSQSGLWAMAIPKAWGGAGVSWTTVARVIAIISAADPALGQLPQNHLAGVAHLLED

SEQ ID NO: 149972 - protein, 414 aa, Glycine max
  Coding DNA Sequence Number=SeqID_33194
  Gene Ontology: Mol. function=monooxygenase activity; Cellular component=intracellular
  Homolog annotation: Hit_ID=Q40Z75; Match level="QueryCoverage=98%, HitCoverage=69%, E-value=1e-125, Identity=52%"; Hit description =Similar to Coenzyme F420-dependent N5 N10-methylene tetrahydromethano pterin reductase ...
  Homolog annotation: Hit description=and related flavin-dependent oxidoreductases
  Pfam annotation: Domain name=Bac_luciferase; Domain location=5-370; Score=-108.6; E_value=0.049; Accession=PF00296.11; Description =Luciferase-like monooxygenase
MPSPFLLFAFMMNVPGHLSAGLWRHPQDQAHRYTELDYWTTLARQLDTAGFDALFIADALGQLDVWQGKPDAALRLAAQMPVNDPLLLVSAMAAVTQHLGFGITVSATYEHPYLLARKFTTLDHLTRGRIAWNVVTSMLDSAARNLGLTRQLPHDERYDRAQEFLDVTAKLWEGSWEEDAVSRDKANSLYSDPQKVHAIQHYGRWYQVPDAHLSEPSPQRTPVLFQAGTSARGAQFAARNAEVIFLGGVTAQAIASDIQRIRQLAVAEGRDPASLRFVTAITVITAEDDAAARAKLEDYQQYISEEAALALFSAWTGIDWSQEDPDMPLAFRETDACRSALASLTRIDDQKRWTLREAARYIGIGGLHPLLVGGGETIADRLDQFAAESGVDGFNLGWAISPGSFNDFIAWVMP

SEQ ID NO: 149973 - protein, 258 aa, Glycine max
  Coding DNA Sequence Number=SeqID_33195
  Gene Ontology: Mol. function=transporter activity; Cellular component= membrane; Biological process=transport
  Homolog annotation: Hit_ID=Q3JMM2; Match level="QueryCoverage=58%, HitCoverage=40%, E-value=6e-21, Identity=42%"; Hit description =Ribose transport system permease protein RbsC, internal deletion
HGWRRHCRQGRHLSNPAAAGGRRGGDYPVFHRSAGTANARRPHYCAGARRAGRHSVRPAHQSPGDSVPGFRHGRIDGANPMSELSQPAVVTAAGKPQGQPWLQHVALLIIVLVLAVFAWLSPIFLSMINLSNVLHQTAVVGTLALGLTLVLSGGGVQGISGGIDLSIAANMGLCAAVFASQIAEQHSVTYALLLTLLTGIAVGIFNALAIVWLGILPLLATLTSMNIAMGLEMVLSGNASISASSALAKPADSQRTAG

SEQ ID NO: 149974 - protein, 596 aa, Glycine max
  Coding DNA Sequence Number=SeqID_33196
  Gene Ontology: Mol. function=nucleoside-triphosphatase activity; Cellular component=membrane; Biological process=transport
  Homolog annotation: Hit_ID=Q3JMM1; Match level="QueryCoverage=94%, HitCoverage=83%, E-value=1e-137, Identity=41%"; Hit description=ABC transporter, ATP-binding protein domain protein
  Pfam annotation: Domain name=ABC_tran; Domain location=330-519; Score= 168.0; E_value=2.4e-47; Accession=PF00005.17; Description=ABC transporter
  Pfam annotation: Domain name=Peripla_BP_1; Domain location=36-313; Score=-45.1; E_value=0.0012; Accession=PF00532.11; Description =Periplasmic binding proteins and sugar b
  Pfam module annotation: Pfam domain module=ABC_tran::Peripla_BP_1; Domain location=330-519::36-313
MHKHRLAGLLLASASLLAGLSLHARAADASIPSLAGKRIGITVAGTDHYWDLKAYQGQIDEVKRLGGTPIALDGGRKESQQIAQIQTLIAQKPDAIIETLGTASVLEPWLKKIRDAGIPLFTVDTASPSSINVTTSDNFYIGEQLALKLVNDLRGEGNILVFNGFYGVPVVAMRYDQLKAVLKWYPKIKIIQPELRDVIPNTVQDAYAQISQLLNKYPQGSVQAIWAAWDVPQIGATQAVDAAGRSEIKTYAVDGSPDVVSLVKDPKSSAAAVVAQQPYLIGQTAVQNVAKYLAGDRSLPPATYVPAILISKAFDGIPALQAVSLDVHAGEVHGLIGHNGAGKSTLIKVLGGIHAADEGSVTLEGRPLVLTSPAQAQQQGIAIVHQERLLPGTLTVAEALLLGNEPRIGSTPFIDRRRMRQQARQLLQQHFDLQIDPDALIAGLSVAEQQLVQICRVLQRAPRVVVLDEPTAALARHEVQALFRVIERMRQQGIALIYVSHYLDEIQALCQRVTVLRDGKDVAHFTGDALSPHALINAMIGETQQAIAPRGLPPDGEPVLTVDALSAPGRFHNVCFSARRGEIVGITGLLGSGGKA

SEQ ID NO: 149975 - protein, 90 aa, Glycine max
  Coding DNA Sequence Number=SeqID_33197
MPISPCGSISWSVSFRHGDHARKTLSGPGEVQQGPGVSSSDYGPLQAQDETPHHNRRTAATSKAPQLIYKAGALPTTYGRPAGDQVQSQR

SEQ ID NO: 149976 - protein, 269 aa, Glycine max
  Coding DNA Sequence Number=SeqID_33198
  Gene Ontology: Mol. function=oxidoreductase activity, acting on the aldehyde or oxo group of donors, NAD or NADP as acceptor; Cellular component=cytoplasm; Biological process=electron transport
  Homolog annotation: Hit_ID=Q93RZ4; Match level="QueryCoverage=99%, HitCoverage=92%, E-value=1e-83, Identity=58%"; Hit description =Putative oxidoreductase
MGMRISANLQHSAYQVFYCENSPQAQQQVIAQGRELSDAASVVPLSDVVILAVPDIVLGKVSQSVVPQMQSGAVLLTLDPAAAYANLIAQRDGIEYAVAHPCHPSVFLARYTKEEHADAFGGVAAVQHVAAAWESGSAEQKAELSKVISVMYGPVDQVHWVTVTQLAYLEPTLVETVACMVGAFMKEALDETVKHSGVPEEAAKAMLYGHIQIALAVAFRATNPFSDACMIAMEYGREKIIKPDWKQIFDQQELDKVIARMLKIDAIQR

SEQ ID NO: 149977 - protein, 700 aa, Glycine max
  Coding DNA Sequence Number=SeqID_33199
  Gene Ontology: Mol. function=nucleoside-triphosphatase activity; Cellular component=membrane; Biological process=ion transport
  Homolog annotation: Hit_ID=Q6D8V2; Match level="QueryCoverage=45%, HitCoverage=100%, E-value=1e-147, Identity=83%"; Hit description =Putative transcriptional regulator
  Pfam annotation: Domain name=ABC_tran; Domain location=362-543; Score= 214.9; E_value=1.8e-61; Accession=PF00005.17; Description=ABC transporter
  Pfam annotation: Domain name=Crp; Domain location=24-54; Score=14.2; E_value=0.1; Accession=PF00325.11; Description=Bacterial regulatory proteins, crp fa
  Pfam annotation: Domain name=Sugar-bind; Domain location=60-318; Score=313.7; E_value=3.4e-91; Accession=PF04198.3; Description =Putative sugar-binding domain
  Pfam annotation: Domain name=TOBE_2; Domain location=604-676; Score =43.6; E_value=6.6e-10; Accession=PF08402.1; Description=TOBE domain
  Pfam module annotation: Pfam domain module=ABC_tran::Crp::Sugar -bind::TOBE_2; Domain location=362-543::24-54::60-318::604-676
MEKNTLSQDSELLTEIAVAYYQDEITQEEIARKFGISRIKVGRLLKRAREEGIVEINVRYHPVFSTRLEQQLQTRFPHLQRALIALDSPDSDEQRRQVAALVSAHLAQSLKDNAIVAVGQGRNVAAVADYPGQVPTRNCLFISGIGGTHRPGDAINADHISRRLAKKFGGISETLYAPAYVENRALRDAFMQNGTIKETLDRARKADVALVGIGDMNENSYMVKLGWFTPHEIIDASVNQGVTGDVAGYDFFNAQGQHVDTVMNDRVIGLSIDELRKIPCVIAIAAENTKAMAILGALRTGAIDIIATTAQNIRTILSMSQGILRQGAVHHPTVTHLSLQHITKTWGDKIALQDISFDVAQGSFVALLGPSGCGKSTLLRTLAGLETADSGRIYFNHTDVTPLPPAQRKLSMVFQSYALFPHLSVRENLLFGLKARGEDKQQFAARLAQVSALLELEPLLARLPSQLSGGQQQRVALGRAVIANNTLCLMDEPLSNLDAKLRQSMRREIRALQKQLGLTMLYVTHDQTEAMSMADHIILLNDGRIEQHGTPDQLYNQPASCFAAQFIGAPPMNILPLHSKGAHHYLSHLNTPLLSYAGETALSLGLRAEDIQLVAPQQAALSARVVSYEYMGADTLLVCRLPGITESLTVKVPGLQRFTDDSLVGLQWSTSRQYLFSTTSGQRCVAAEHPMLLAEKKYAV

SEQ ID NO: 149978 - protein, 70 aa, Glycine max
  Coding DNA Sequence Number=SeqID_33200
  Subcellular localization annotation: CTP_CleavageSite=23; ConfidenceScore=5.62e-01
MASSGMGAGDGSGSGGVSSSSPSAATVGCSSSGSWASEAPPFPEGEGWAPGQATFASNSSMLIMDGKPKP

SEQ ID NO: 149979 - protein, 105 aa, Glycine max
  Coding DNA Sequence Number=SeqID_33201
  Gene Ontology: Mol. function=methyltransferase activity; Biological process=cell cycle
  Homolog annotation: Hit_ID=Q6CYI7; Match level="QueryCoverage=99%, HitCoverage=56%, E-value=6e-32, Identity=70%"; Hit description =Methyltransferase gidB
MVTPVQHVLQRRKGAADHPVKRWLSRKLFHPALHRRDETHAFPEAFPVFVKCACGRTIARGGSKGRPGPVPTSIKRSPCRWGSTTMLSRMWRTSICCGSRTEVRL

SEQ ID NO: 149980 - protein, 90 aa, Glycine max
  Coding DNA Sequence Number=SeqID_33202
MAPKKLPAKRSRKDATGEGSSAAPQEDIDFHRQQFRSTEHQQWKASTVSSPKGGVKPPTLMRRLSVSCYALWGMTVGSSGLRIIKKGRLN

SEQ ID NO: 149981 - protein, 107 aa, Glycine max
  Coding DNA Sequence Number=SeqID_33203
MQICKALLLSNILPKDHNSNLPLSKCECPHHLADRCCYLPVCKDYASETPSGPRDVQQGLRFPALITGLCQLYGVAANPTKLIWTPISRAYSDRYYMPRKMKGQAPQ

SEQ ID NO: 149982 - protein, 102 aa, Glycine max
  Coding DNA Sequence Number=SeqID_33204
MQICKALLLSNIPPNDHNSDLPLSKCQLAYAILTQFAWIMPPRHLVDQQKPNRALGFPALITTLCLFYRVAANPTKLIWPPISRAYINRYYMPRKMKGRAPQ

SEQ ID NO: 149983 - protein, 126 aa, Glycine max
  Coding DNA Sequence Number=SeqID_33205
MARKADHHNLSPRANGLDCLWKAKGDCNNLDRKTLKSLKRRQMTTLDGPTDGRPYELGGVGRHSIELIETCNQSRKPRALLDFSGSTRCLGGIILANWKADDHNLSLRANRLDCLWMAKGDSRSLN

SEQ ID NO: 149984 - protein, 154 aa, Glycine max
  Coding DNA Sequence Number=SeqID_33206
TPRGRMCRKGTGHPDAKHRPPRVVSWGTEAVIDPPSPIRRHVKWKMARTKKTGQMTTKAAKEIDEKIDSLEEQASQGSFVPYGRQDLLTAAIRRPEHPGRVRAARATADSTNQGLAGGVDHKKSDSAADVILQPDAVPVAITDPITGTCTDFGA

SEQ ID NO: 149985 - protein, 364 aa, Glycine max
  Coding DNA Sequence Number=SeqID_33207
  Gene Ontology: Mol. function=nucleoside-triphosphatase activity; Cellular component=membrane
  Homolog annotation: Hit_ID=Q66CQ9; Match level="QueryCoverage=48%, HitCoverage=93%, E-value=7e-59, Identity=77%"; Hit description =Siderophore/cobalamin ABC transporter, ATP-binding subunit
  Pfam annotation: Domain name=Esterase; Domain location=1-178; Score =86.0; E_value=1.1e-22; Accession=PF00756.11; Description=Putative esterase
GAGFYLNATQQPWAAHYRMFDYLSEELPALVADNFKLSDRQSVMGHSMGGHGALVLALRLGGRFASASAFAPIVNPTEVPWGQKAFTAYLGDDRQTWREWDSCLLMQNAEHRLPVLIDQGDSDQFLADQLRPERLEAVAREQNFPLELRIQPASWKTICGSTRSIYWRSALLCPSDAEGQNVSDVRPAIPPPAHQSLPAACPLPLLQHQRVIGMTQRDIDVMHHHHRHHVAQPAAAVPDGESATAPARPAASGHRTADRDNASPGGQCPAAPAGTLRHDDRLQHVQMHTGWQRLRQIDHALRAPGKRLAHQLFTVEPQLALPFAQTGQRAQQRRFAAAVGAQQYGDFAAWQLRDIEIVDDVPLW

SEQ ID NO: 149986 - protein, 120 aa, Glycine max
  Coding DNA Sequence Number=SeqID_33208
MQRQAETNKKQRRTMSKGSSQCGVATANNDGLWWLMVVVGDGESAWDVRNGFGRKKEEEMVFFLSYTKARAENAQVRNGLGHGNITHTPDIFSKIPTAAHVASSRSFIKRLPQEASLWLV

SEQ ID NO: 149987 - protein, 212 aa, Glycine max
  Coding DNA Sequence Number=SeqID_33209
  Gene Ontology: Mol. function=nucleic acid binding; Biological process= DNA integration
MKKKYRKENKKKKKKKKKLKKIKKKRVRVKKQEKKNKETTSNEGKKVPYPLVLSKKDKECHLARFLDIFRKLEITMPFGEALEQMPLYSKFLKDMLTRKHKYIHQENIVVEGNCSAVIQKILPPKHKDLGNVTIPCSIGEVTVGKALIDLGASINLMPLSMCRRLGVLEIMSTRMTLLLADRSITRPYGVIEDFLVKVREVEQEVLKGEDQI

SEQ ID NO: 149988 - protein, 320 aa, Glycine max
  Coding DNA Sequence Number=SeqID_33210
MLKRFALLCWCLIGANALAAGPNANIKYYGYDWLDFYETATPSFSATEALKAITGTGFSMTNLNVVHTLASLNLPVCAGGTCAVNIQAGSGAVSGSPFIDICPGADSNGSCQAAGSWNAIWTAVKKIAEAKHKPGAIYFIDEPFDVPALQTAGKYDAYQYSSYVCTLRQAMQQYGVAIPIYTILSYRHANNAEWIREIQQGAPATACPANVKSTPDWVGVDNYNWSVADMWSTYNRLAPISAAGQKWVLVPPSTASLGMNDQQLHAQIQLYWDFINQYPNAPVVYIMNWRFDREVTENRAAYPQSTALLSFMANTLLAKP

SEQ ID NO: 149989 - protein, 246 aa, Glycine max
  Coding DNA Sequence Number=SeqID_33211
  Homolog annotation: Hit_ID=O04892; Match level="QueryCoverage=19%, HitCoverage=9%, E-value=5e-11, Identity=73%"; Hit description =Cytochrome P450 like_TBP
DGAAALLSRAMESRAPSGPFLVSRTGDAGMNRKLGYGAQLRANLDPTKGVGRLRQQDGGHGKSKSAKECGAAVAAKLQGASPGGAVVGADPWVVVANIPNENFEGRRGGKGIGLKFLNRDVAADGNVRESGDVGGGPGKSYLFCLTACPPWKRLRKEVGSSGWKSTARRVVSGAPPAALENPEDRVPPTPGRTHNRIRQGKSAKWIRNLGKRIGSEGWARGSQSRTRRLSVDCSSCFRGENGSLRA

SEQ ID NO: 149990 - protein, 130 aa, Glycine max
  Coding DNA Sequence Number=SeqID_33212
  Subcellular localization annotation: CTP_CleavageSite=47; ConfidenceScore=5.38e-01
MDSGRFQISIPGDSCPIPLYLSKTNTLNFSGMTTSGTRHNSAMVVVVGDTEGPPKCLAGVCHQTPAPQWHIRGKAWSRLEYGLGYFMCLPHGLKDLYLTRLGLLALNEYGSGVIDILIRSMCNIGWCIVG

SEQ ID NO: 149991 - protein, 195 aa, Glycine max
  Coding DNA Sequence Number=SeqID_33213
  Homolog annotation: Hit_ID=Q1SMF0; Match level="QueryCoverage=65%, HitCoverage=23%, E-value=1e-13, Identity=35%"; Hit description =Tetratricopeptide-like helical
MGLKSTLRLMRTLGPSLASLAQSSWSLLSNALGGCGVGEGTGVECCGGRRRHPRYAEGGAAVGMKHVVRMNHVDCSDAFNTSQVFECREDILRWARSVAHENGFVAVILRSDTNTGSRGRTTFVLIGCERSGEYRCRKKEFIRKDTRTRKCGCPFKLRCKPVVGGEGWMVKLIYGVHNHELAKSLVGHPYVGQLT

SEQ ID NO: 149992 - protein, 122 aa, Glycine max
  Coding DNA Sequence Number=SeqID_33214
  Gene Ontology: Mol. function=nucleic acid binding
  Homolog annotation: Hit_ID=Q1SKA8; Match level="QueryCoverage=65%, HitCoverage=31%, E-value=2e-09, Identity=42%"; Hit description=Zinc finger, CCHC-type
  Subcellular localization annotation: CTP_CleavageSite=63; ConfidenceScore=5.09e-01
MGSKIYPKIHENPKPSLSTLAQSSWSLLLMALVTGPFLGRIASKWQPKVTTITESRDLTNMCLATLFGKLQEHEMELMRLNQHEENDKKKKGITLKALSSVQEESDKEDLNEVEEMMISVSS

SEQ ID NO: 149993 - protein, 153 aa, Glycine max
  Coding DNA Sequence Number=SeqID_33215
  Homolog annotation: Hit_ID=Q8GVE8; Match level="QueryCoverage=77%, HitCoverage=10%, E-value=1e-07, Identity=37%"; Hit description =Phosphoenolpyruvate carboxylase 4
MITSFSSEGNDEEDHHEHWNGSMSRSQSKHPNQQASPLPTKLPAGAHIPSCAWPEEGGSEYPRHMPGADHKQPNHKGGETSSSTESNGGSQNVRSSIPILPNSSSSLVSMTYSPSFNSSQLVAQRKLFAESQIGRTSFQRLLEPNSGSWNCSL

SEQ ID NO: 149994 - protein, 459 aa, Glycine max
  Coding DNA Sequence Number=SeqID_33216
  Gene Ontology: Mol. function=transporter activity; Cellular component= outer membrane-bounded periplasmic space; Biological process=sulfur metabolic process
  Homolog annotation: Hit_ID=Q1LNM3; Match level="QueryCoverage=65%, HitCoverage=90%, E-value=1e-74, Identity=48%"; Hit description=ABC transporter, substrate-binding protein, aliphatic sulphonates precursor
  Pfam annotation: Domain name=HTH_8; Domain location=102-142; Score =30.8; E_value=4.7e-06; Accession=PF02954.9; Description=Bacterial regulatory protein, Fis family
  Pfam annotation: Domain name=NMT1; Domain location=192-388; Score= -52.1; E_value=0.0015; Accession=PF09084.1; Description=NMT1THI5 like
  Pfam annotation: Domain name=OpuAC; Domain location=167-383; Score= -62.2; E_value=0.035; Accession=PF04069.3; Description=Substrate binding domain of ABC-type glycine betaine transport system
  Pfam annotation: Domain name=Sigma54_activat; Domain location=1-48; Score=-156.5; E_value=0.00022; Accession=PF00158.16; Description =Sigma-54 interaction domain
  Pfam module annotation: Pfam domain module=HTH_8::NMT1::OpuAC::Sigma54 _activat; Domain location=102-142::192-388::167-383::1-48
RREDIPLLAQHFLSRYARRLGRPARRLSPDALEALRDYSWPGNIRELENTLHNAVLLSRDETLTPTQLRLAGYSERGYSETDDLTLDSFLRQQITREPQQLFDRVIQSLISNALEIADNNQTQAATMLGISRHTLRTHLAQMGIIKGRRKSAVMAFVHASGAARPERELRIGFQKFGNLGVLKARQTLEQCFNQQGISVVWSEFPAGPQLLYALQNNEIDFGTTGEVPPIFAQASGNAVTYIAWEPPAPGSVGIVVPHDSTIHSLADLRGKRISVNKGSNVHWLLLQLLEEAGIGLDEIKVVYTPPKYPLTASDYLAVDAWMMWDPLLSAAESNADLRVLEKGEGRVRNHQFYLARHDYVQQHDDIVQQLVTSLQQTGTFIDNHRHEAATMLAQELGLEFAAVERALSRRSHQTRAMVFHVIKEQQTIADRFYALGLIHKPVRVRDAVWQSPSQTALMA

SEQ ID NO: 149995 - protein, 529 aa, Glycine max
  Coding DNA Sequence Number=SeqID_33217
  Gene Ontology: Mol. function=nucleoside-triphosphatase activity; Cellular component=membrane; Biological process=amino acid transport
  Homolog annotation: Hit_ID=Q4KDF9; Match level="QueryCoverage=34%, HitCoverage=39%, E-value=1e-81, Identity=80%"; Hit description =Monooxygenase, NtaA/SnaA/SoxA family
  Pfam annotation: Domain name=ABC_tran; Domain location=237-408; Score= 167.8; E_value=2.7e-47; Accession=PF00005.17; Description=ABC transporter
GTFFNVPGIHLCEPSPQRTPVLYQAGASSRGKQFAAEHAECVFVAAPSKVLLKKTVADIRRRAAEAGRDPRSILIFNLQTVIVGETDRAAQAKWQEYKNWVSYEGALALVSGWTGIDFGQYQPDQVLKYLHTNAIQSAVETFSTADPDRQWTVKALADWVGIGGFGPLLVGSAATVADELQSWRAAAGGHMIEIERLSKHYRAPDGRVTDVLKTSRCRCRKPASPPWSDRAVPENLTLAKCISLLEQPSGGSIRVNGSDLSRLDGEALRRARRAIGTVFQSSALLQRKSAWENIALPLRYLGVVERDIRARVGELLESVGLSHKASAFPAQLSGGQRQRIGIARALALRPSVLLADEATSGLDPEATVTILELLKKLRDDYRLAIVLITHEMDAVRQAADAVAEIRDGEIVQYGTVSALLAQPDSALGQRLLPLTAQVSDAGLVLQLSYRTDVAVASDWISRISQQFALKVDLLGAHVERVNGIQAGRLQVGIHFQQEQVPLARLLTQLEQYGLAASVAVSVPPLREAV

SEQ ID NO: 149996 - protein, 128 aa, Glycine max
  Coding DNA Sequence Number=SeqID_33218
MAVLSFAKHKSPKFLPLPNSATPSASGVPFEGTLNDDWKFDFSVPHAPGAQPNDDEGHLPIGEDSSLLQSILDRFDGLQTYVGERFDALEQQVDMRFDEMDSRITKVEGDVTFIRTYFDLPPPPPPSS

SEQ ID NO: 149997 - protein, 115 aa, Glycine max
  Coding DNA Sequence Number=SeqID_33219
MRLSKANDPARSLPVISAWLVQTNRGHEAQRNQISNHHSVYLQMCMARGNPGDLQSFDPEIDRTFHRLVRHSVHLGHSVHFEHFEYSVAGDFEYSDFEHSTTNFHIENMAQPPPR

SEQ ID NO: 149998 - protein, 352 aa, Glycine max
  Coding DNA Sequence Number=SeqID_33220
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=5e-38, Identity=33%"; Hit description= UPI00006A17C9 related cluster
MTKDNNCGLHVLTLRGLHTLPFRGLHVLAFKGLHVLTFRGLHTLAIRRLHILAIRRLHVLTFRGLHALTFKGLHVLGFRGLHVLTFRGLHALTFRGLHVLAIRGLHDLTFRGLYALTFRELHALTFRGLHVLAFRGLHAFTFRGLHALTFRGLHALTFRGLQVLAFRGLHALDLRGLHFLAFRGLHVLTFGEQQVLAFRGLHTLARPHLQRTTGLHFQRNTRPRLQRTARPHLQRTKQGNTPSPSEGNTPSPSEDYTSSPSDDYTSSPSESCMPSPIITFRGLHVLAFRGLHALAFTGLHILPLRGLHVLTIRGLHVLAIRGLQVLAFRGLHVLAFTGLEYPHLQRATRPRL

SEQ ID NO: 149999 - protein, 87 aa, Glycine max
  Coding DNA Sequence Number=SeqID_33221
MVSDHLETIEGHVSIIKAKFDGKIVTITIPTIPGKVSKKEAESNPGDEKEGTPTDDDQKKTIVSDQVPKLIVECKEEIDHEASTPSN

SEQ ID NO: 150000 - protein, 384 aa, Glycine max
  Coding DNA Sequence Number=SeqID_33222
  Homolog annotation: Hit_ID=UPI000066ADC2; Match level="QueryCoverage =34%, HitCoverage=54%, E-value=2e-45, Identity=67%"; Hit description =Thioredoxin
MAQLRHSARQTHRRDDGPAFWRSLFQRPAARHHGSDGFRAADHRYPGGGKAGGARAGHAAPHSAGALSRRPAHRRYAGAGSVGERIGVAFGGVYRRNAFQHRRANRAAHRGKPGATGQSARPGLPDLCAAGQRRPLEKPAGRRRAGVTYLSRPGCRGGSFDPHEPPFRAHVVTEPAIPPRVHLQRLLAKFQRDVADLRAFRVMLMVDRFAVLNWQLGGEVTHVRPVIQPHLRHGVAGKIDQPALALRLHRHFAPHAAPGVLPIHTARPLRLRPLRQALAQQAHVVLRFVIVRRQRQVGLCLEQFPGAHQRQRHVVVGRGDGLLAQAAKLAPGRLIAKDVGSFGVILPLIGLFSQFGVARHLWAVGGDVRLVNVCPGPGAGEDAA

SEQ ID NO: 150001 - protein, 88 aa, Glycine max
  Coding DNA Sequence Number=SeqID_33223
MILQTTSYQIKDYMRDHGSIGLSLGMGSFGGKFGWQGLTFSPWVKVHDKLGFWLKACRTVGHDICQGLASGSGIKGTSHIISMIYMQQ

SEQ ID NO: 150002 - protein, 101 aa, Glycine max
  Coding DNA Sequence Number=SeqID_33224
LSSFWHHQKLHTTYASTAIIEADARTSGGGYGSDPRKERRDGVRDRNRKMERRGRMKVFGIERFFDILDEKTMFTEQQHNLNRVAMRASPKDDTCSVLARP

SEQ ID NO: 150003 - protein, 56 aa, Glycine max
  Coding DNA Sequence Number=SeqID_33225
MCSNTLPSLSGHIQLYKYTSTKTRKRLLLALVDVSSIGASAEWRRKRGGDATSRRR

SEQ ID NO: 150004 - protein, 166 aa, Glycine max
  Coding DNA Sequence Number=SeqID_33226
MFVSDFHEDIPVSAANGKPKIEKKIANGEDEDSSESESDDDSSEDQEEGDDESDEETPKKIEASNNTGIDSSKKTLVSVKKTKFVTPQKTNSKNVGYVATPHPSKQTGKPTLLITSSRLRSQEITAATLTTAIRHINSHIIFILACMSFKTADALSSHNNVKHSAN

SEQ ID NO: 150005 - protein, 184 aa, Glycine max
  Coding DNA Sequence Number=SeqID_33227
  Gene Ontology: Mol. function=hydrolase activity
MGTMYNSDSKKDSSHNRKQITWTQENQHIGNDDLILFRRKLDIMKRHEEPYSTNLMSVLPPICLVGSVLWCAVVPLICFQVIEWHQLDKVLRQFGMQQPIPSSPPQPFNIQGITLKGKHDKNWGQLLGPMINQWNNQADFRVDAYPRQEGLLIFNSDYMVWLKLQRRYSTWCRHKREIHGQLMI

SEQ ID NO: 150006 - protein, 44 aa, Glycine max
  Coding DNA Sequence Number=SeqID_33228
  Gene Ontology: Mol. function=structural constituent of ribosome; Cellular component=ribonucleoprotein complex; Biological process =translation
  Homolog annotation: Hit_ID=P42795; Match level="QueryCoverage=99%, HitCoverage=24%, E-value=6e-16, Identity=88%"; Hit description=60S ribosomal protein L11-1
MDFFVVLERPGYRVGRRCRCKARVRIQHRVTKEDAMKWFQVKYE

SEQ ID NO: 150007 - protein, 117 aa, Glycine max
  Coding DNA Sequence Number=SeqID_33229
  Gene Ontology: Mol. function=structural constituent of ribosome; Cellular component=ribonucleoprotein complex; Biological process =translation
  Homolog annotation: Hit_ID=P42795; Match level="QueryCoverage=51%, HitCoverage=33%, E-value=2e-24, Identity=86%"; Hit description=60S ribosomal protein L11-1
MMINEEVPILELVDIVELSKTFIKYHNLLLPRPLNYEANSVSFKSVNAPIYFSYKDDTFVFNLEPLHGILLRDTMLNSNTSLAPTASSHTVARALQNDKEIHSVNASRRIIPEAQKC

SEQ ID NO: 150008 - protein, 159 aa, Glycine max
  Coding DNA Sequence Number=SeqID_33230
MGENALPRKLFPKESSSGIISEDTFFKKVSEEPSSERRFCDSGKTQKYFSKEHHPECFRKNEGSSGRQPSSSGRRIWWSREAGVPYLKFFVRVNLWMWLYDNLNVLVYDAYVLKMDEDQWRYNYAMSQEVHMDYDYDNEKECGVNEPHVDCSNAFNTSQ

SEQ ID NO: 150009 - protein, 85 aa, Glycine max
  Coding DNA Sequence Number=SeqID_33231
  Gene Ontology: Mol. function=structural constituent of ribosome; Cellular component=ribonucleoprotein complex; Biological process =translation
  Homolog annotation: Hit_ID=P42795; Match level="QueryCoverage=99%, HitCoverage=50%, E-value=9e-26, Identity=93%"; Hit description=60S ribosomal protein L11-1
  Pfam annotation: Domain name=Ribosomal_L5; Domain location=9-56; Score=16.4; E_value=0.00036; Accession=PF00281.9; Description =Ribosomal protein L5
MASEKKLANPMREIKVQKLVLNISVGESGDRLTRAAKARIRKCSNNSVAKPLFSPKEEREDRVSCDSERGQGDAASGEWLEGEGV

SEQ ID NO: 150010 - protein, 47 aa, Glycine max
  Coding DNA Sequence Number=SeqID_33232
QKVGVGNEKVLPLSGNQARTKGRGYESHGENGECRLTEFTELVTVKE

SEQ ID NO: 150011 - protein, 225 aa, Glycine max
  Coding DNA Sequence Number=SeqID_33233
MVRIRERPLQGNKWHKMDQSYPIPYYCQPEAFQGKFEILFLTLTMPKKATSQVAPKQQEVGTSHEIGEVKHTENWKKQFKRRLSVSPPSPDLKAQQKKDSQILLEPIKDQKVKKELVPKPTPPPRVATMQTYEKSQKGQEVSESKPTTTMLTNFKTTEISQKGEEESEAKLEPTMLTKVKTAKRAQKGEEEFQAKQTPTMLTKVNTAESPQKGEEEFEANQHQQY

SEQ ID NO: 150012 - protein, 69 aa, Glycine max
  Coding DNA Sequence Number=SeqID_33234
  Gene Ontology: Mol. function=structural constituent of ribosome; Cellular component=intracellular; Biological process=translation
  Homolog annotation: Hit_ID=Q1S7V4; Match level="QueryCoverage=90%, HitCoverage=21%, E-value=1e-22, Identity=85%"; Hit description =Ribosomal protein S3Ae
MREIMTNQATSCDLKELVRKFIPEIIGKDIGKATSSIDPVKNVFDRKVKILKAPKFDLGKLMEENSVNA

SEQ ID NO: 150013 - protein, 58 aa, Glycine max
  Coding DNA Sequence Number=SeqID_33235
MANIKEGATILFSFSNYGDGDAIEDDIDNDIGEVLMLIERDAELVKVAEKLGAVEGLE

SEQ ID NO: 150014 - protein, 155 aa, Glycine max
  Coding DNA Sequence Number=SeqID_33236
  Gene Ontology: Cellular component=membrane
  Homolog annotation: Hit_ID=Q5VQN0; Match level="QueryCoverage=96%, HitCoverage=25%, E-value=1e-28, Identity=48%"; Hit description =Exostosin family protein-like
MEALWWQRSHTPRASSPVFQVSVRRYVKNAIWLLPDMDSIGNLYKPGQVYLGRDPVLPYVPNVDLCDAKCLSERRIQREAHYFSFEAGSREIWPYGIWGITMTGYWLFIVWLSDLIGGKIRFKLGAELSGVDGVVIEEGTTGDGGKDVAQKGMCK

SEQ ID NO: 150015 - protein, 50 aa, Glycine max
  Coding DNA Sequence Number=SeqID_33237
  Gene Ontology: Mol. function=transporter activity; Cellular component= membrane; Biological process=transport
  Homolog annotation: Hit_ID=Q2Z1Q0; Match level="QueryCoverage=88%, HitCoverage=8%, E-value=5e-15, Identity=91%"; Hit description=NRAMP family metal transporter
GFLDLRLKSWIRNLLTRCLAIVPSLIVALIGGSAGAGELIIIASVRIPCH

SEQ ID NO: 150016 - protein, 342 aa, Glycine max
  Coding DNA Sequence Number=SeqID_33238
  Gene Ontology: Mol. function=protein binding; Cellular component =integral to membrane; Biological process=defense response to fungus
  Homolog annotation: Hit_ID=Q1T435; Match level="QueryCoverage=80%, HitCoverage=85%, E-value=5e-61, Identity=36%"; Hit description =Leucine-rich repeat; Leucine-rich repeat, cysteine-containing type
  Pfam annotation: Domain name=LRRNT_2; Domain location=23-61; Score =58.5; E_value=2.3e-14; Accession=PF08263.3; Description=Leucine rich repeat N-terminal domain
  Pfam annotation: Domain name=LRR_1; Domain location=118-140; Score =14.1; E_value=0.5; Accession=PF00560.23; Description=Leucine Rich Repeat
  Pfam annotation: Domain name=LRR_1; Domain location=142-164; Score =15.8; E_value=0.16; Accession=PF00560.23; Description=Leucine Rich Repeat
  Pfam annotation: Domain name=LRR_1; Domain location=166-188; Score =17.5; E_value=0.047; Accession=PF00560.23; Description=Leucine Rich Repeat
  Pfam annotation: Domain name=LRR_1; Domain location=190-212; Score =18.5; E_value=0.024; Accession=PF00560.23; Description=Leucine Rich Repeat
  Pfam annotation: Domain name=LRR_1; Domain location=214-237; Score =3.0; E_value=78; Accession=PF00560.23; Description=Leucine Rich Repeat
  Pfam annotation: Domain name=LRR_1; Domain location=266-293; Score =6.1; E_value=21; Accession=PF00560.23; Description=Leucine Rich Repeat
  Pfam annotation: Domain name=LRR_1; Domain location=295-318; Score =9.8; E_value=4.1; Accession=PF00560.23; Description=Leucine Rich Repeat
  Pfam annotation: Domain name=LRR_1; Domain location=321-340; Score =10.1; E_value=3.7; Accession=PF00560.23; Description=Leucine Rich Repeat
  Pfam annotation: Domain name=LRR_1; Domain location=93-116; Score =13.9; E_value=0.58; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=23 -61::118-140::142-164::166-188::190-212::214-237::266-293::295 -318::321-340::93-116
MEGIIILMMFQVVVSAQDHIMCIQTEREALLQFKAALLDPYGMLSSWTTSDCCQWQGIRCTNLTAHVLMLDLHGGEFNYMSGEIHKSLMELQQLKYLNLSWNSFQGRGIPEFLGSLTNLRYLDLEYCRFGGKIPTQFGSLSHLKYLNLALNSLEGSIPRQLGNLSQLQHLDLSANHFEGNIPSQIGNLSQLLHLDLSYNSFEGSIPSQLGNLSNLQKLYLGGGALKIDDGDHRLSNLISLTHLSVLQMPNLNTSHSFLQMIAKLPKLRELSLSECSLPDQFILPLRPSKFNFSSSLSVLDLSFNSLTSSMILQWLSNVTSNLVELDLSYNLLEGSTSNHFGR

SEQ ID NO: 150017 - protein, 900 aa, Glycine max
  Coding DNA Sequence Number=SeqID_33239
  Gene Ontology: Mol. function=protein binding; Cellular component =integral to membrane; Biological process=xylan catabolic process
  Homolog annotation: Hit_ID=Q1T435; Match level="QueryCoverage=99%, HitCoverage=87%, E-value=1e-147, Identity=32%"; Hit description =Leucine-rich repeat; Leucine-rich repeat, cysteine-containing type
  Pfam annotation: Domain name=LRR_1; Domain location=114-136; Score =8.5; E_value=7.3; Accession=PF00560.23; Description=Leucine Rich Repeat
  Pfam annotation: Domain name=LRR_1; Domain location=12-34; Score =12.3; E_value=1.4; Accession=PF00560.23; Description=Leucine Rich Repeat
  Pfam annotation: Domain name=LRR_1; Domain location=138-160; Score =15.3; E_value=0.22; Accession=PF00560.23; Description=Leucine Rich Repeat
  Pfam annotation: Domain name=LRR_1; Domain location=162-184; Score =11.4; E_value=2.1; Accession=PF00560.23; Description=Leucine Rich Repeat
  Pfam annotation: Domain name=LRR_1; Domain location=191-212; Score =11.5; E_value=2; Accession=PF00560.23; Description=Leucine Rich Repeat
  Pfam annotation: Domain name=LRR_1; Domain location=214-235; Score =9.0; E_value=5.8; Accession=PF00560.23; Description=Leucine Rich Repeat
  Pfam annotation: Domain name=LRR_1; Domain location=238-260; Score =8.8; E_value=6.4; Accession=PF00560.23; Description=Leucine Rich Repeat
  Pfam annotation: Domain name=LRR_1; Domain location=262-284; Score =5.6; E_value=26; Accession=PF00560.23; Description=Leucine Rich Repeat
  Pfam annotation: Domain name=LRR_1; Domain location=291-312; Score =8.5; E_value=7.3; Accession=PF00560.23; Description=Leucine Rich Repeat
  Pfam annotation: Domain name=LRR_1; Domain location=314-336; Score =11.4; E_value=2.1; Accession=PF00560.23; Description=Leucine Rich Repeat
  Pfam annotation: Domain name=LRR_1; Domain location=338-361; Score =9.9; E_value=4; Accession=PF00560.23; Description=Leucine Rich Repeat
  Pfam annotation: Domain name=LRR_1; Domain location=363-383; Score =9.0; E_value=6; Accession=PF00560.23; Description=Leucine Rich Repeat
  Pfam annotation: Domain name=LRR_1; Domain location=37-59; Score=9.4; E_value=4.9; Accession=PF00560.23; Description=Leucine Rich Repeat
  Pfam annotation: Domain name=LRR_1; Domain location=388-410; Score =2.7; E_value=90; Accession=PF00560.23; Description=Leucine Rich Repeat
  Pfam annotation: Domain name=LRR_1; Domain location=412-435; Score =2.2; E_value=1.1e+02; Accession=PF00560.23; Description=Leucine Rich Repeat
  Pfam annotation: Domain name=LRR_1; Domain location=439-462; Score =6.9; E_value=14; Accession=PF00560.23; Description=Leucine Rich Repeat
  Pfam annotation: Domain name=LRR_1; Domain location=483-504; Score =4.9; E_value=35; Accession=PF00560.23; Description=Leucine Rich Repeat
  Pfam annotation: Domain name=LRR_1; Domain location=509-531; Score =14.6; E_value=0.36; Accession=PF00560.23; Description=Leucine Rich Repeat
  Pfam annotation: Domain name=LRR_1; Domain location=533-555; Score =18.5; E_value=0.025; Accession=PF00560.23; Description=Leucine Rich Repeat
  Pfam annotation: Domain name=LRR_1; Domain location=557-579; Score =14.0; E_value=0.54; Accession=PF00560.23; Description=Leucine Rich Repeat
  Pfam annotation: Domain name=LRR_1; Domain location=581-604; Score =12.4; E_value=1.4; Accession=PF00560.23; Description=Leucine Rich Repeat
  Pfam annotation: Domain name=LRR_1; Domain location=606-628; Score =9.4; E_value=5; Accession=PF00560.23; Description=Leucine Rich Repeat
  Pfam annotation: Domain name=LRR_1; Domain location=61-83; Score=7.5; E_value=11; Accession=PF00560.23; Description=Leucine Rich Repeat
  Pfam annotation: Domain name=LRR_1; Domain location=630-652; Score =6.3; E_value=19; Accession=PF00560.23; Description=Leucine Rich Repeat
  Pfam annotation: Domain name=LRR_1; Domain location=704-726; Score =13.0; E_value=1.1; Accession=PF00560.23; Description=Leucine Rich Repeat
  Pfam annotation: Domain name=LRR_1; Domain location=728-750; Score =16.2; E_value=0.12; Accession=PF00560.23; Description=Leucine Rich Repeat
  Pfam annotation: Domain name=LRR_1; Domain location=752-774; Score =10.3; E_value=3.4; Accession=PF00560.23; Description=Leucine Rich Repeat
  Pfam annotation: Domain name=LRR_1; Domain location=776-797; Score =10.8; E_value=2.8; Accession=PF00560.23; Description=Leucine Rich Repeat
  Pfam annotation: Domain name=LRR_1; Domain location=91-112; Score =19.0; E_value=0.017; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1::LRR_1::LRR _1; Domain location=114-136::12-34::138-160::162-184::191-212::214 -235::238-260::262-284::291-312::314-336::338-361::363-383::37 -59::388-410::412-435::...
  Pfam module annotation: Domain location=439-462::483-504::509 -531::533-555::557-579::581-604::606-628::61-83::630-652::704 -726::728-750::752-774::776-797::91-112
MILQWLSNVTSNLVELDLSYNLLEGSTSNHFGRVMNSLEHLDLSYNIFKADDFKSFANICTLHSLYMPANHLTEDLPSILHNLSSGCVKHSLQDLDLSDNQITGSLPDLSVFSSLKSLFLDQNQLRGKIPEGIRLPFHLESLSIQSNSLEGGIPKSFGNSCALRSLDMSGNNLNKELSVIIHQLSGCARFSLQELNIGGNQINGTLSDLSIFSALKTLGLSRNQLNGKIPESTKLPSLLESLSIGSNSLEGGIHKSFGDACALRSLHMPNNSLSEEFPMIIHHLSGCARYSLERLYLSMNQINGTLPDLSIFSSLRGLYLEGNKLNGEIPKDIKFPPQLERLDMQSNSLKGVLTDYHFANMSKLDHLELSDNSLVTLAFSQNWVPPFQLRFIGLRSCKLGPVFPKWLETQNQFQGIDISNAGIADMVPKWFWANLAFRELISMNISYNNLHGIIPNFPIRNIQHSLILGSNQFDGPVPPFLRGFVFLDLSKNKFSDSLSFLCVNVKVETLYELDLSNNHFSGKIPDCWSHFKSLTYLDLSHNNFSGRIPTSMGSLLHLQALLLRNNNLTDEIPISLRSCTNLVMLDISENRLSGLIPAWIGSELQELQFLSLGRNNFHGSLPLQICYLSDIQLLDVSLNRMSGQIPKCIKNFTSMTQKTSSRDYQGHSYLVNTIGIYYYYTYDLNALLMWKGSEQMFKNNVLLLLKSIDLSSNHFSGEIPLEIEDLFGLVSLNLSRNHLTGAIPSNIGKLTLLDFLDLSRNHLIGSIPWSLTQIDRLGVLDLSHNNLSGEIPTGTQLQSFNASCYEDNLDLCGPPLEKLCIDGKPAQEPIVKLPEDENLLFTREFYMSMAIGFVISFWGVFGSILMNRSWRHAYFKFISNLSDAIYVMVAVKVFKWRHRR

SEQ ID NO: 150018 - protein, 95 aa, Glycine max
  Coding DNA Sequence Number=SeqID_33240
MQDGGSSQHCIIIVILQRIILLGERAVYAMMLVFPPEFSPLKTILFGNPSQNTVESLMEALEEDYKDGNEINESRQFIEGVLDLEKRINRLDTLT

SEQ ID NO: 150019 - protein, 153 aa, Glycine max
  Coding DNA Sequence Number=SeqID_33241
  Gene Ontology: Mol. function=protein kinase activity; Biological process=protein amino acid phosphorylation
  Homolog annotation: Hit_ID=Q9LTU4; Match level="QueryCoverage=74%, HitCoverage=7%, E-value=8e-27, Identity=52%"; Hit description =Helicase-like protein
  Pfam annotation: Domain name=DUF889; Domain location=34-150; Score= -43.5; E_value=1.5e-08; Accession=PF05970.5; Description=Eukaryotic protein of unknown function (DUF889)
MAYKFCFEALDQSLRDVIKAKSSSDKIFGGKVMIFGGDFRQILPVIPRGSRSDIVNATINSSYLWNHCHVLALSKNMRLEANIDATDREETLAFAQRILNIGDGIVGQQNDGSLGKLWKVLFFTFSLSQSAGLASVRKTQHSWAKREEDSGRK

SEQ ID NO: 150020 - protein, 167 aa, Glycine max
  Coding DNA Sequence Number=SeqID_33242
GTSFVVQEEGTSTWVVVTENKRGYISCGLVLVEGTSTRLFKENKEGYIPCGSLLVKDFTRLKRNLKDRRSLGDWMYARVVAEPSDNLKNENYNQLGHTLLEVFVVLGGKGEHYLWICSRGSPKSDFVGFIAVYVTIIHADAQKWKKKLLMCLEIREGFGVQWNRKPR

SEQ ID NO: 150021 - protein, 132 aa, Glycine max
  Coding DNA Sequence Number=SeqID_33243
  Gene Ontology: Mol. function=RNA-directed DNA polymerase activity; Biological process=DNA integration
MKALLGAHDVREMVGKGYKESQDETSLSQAQIKTFKDSRKRYKKDRVHYQLFSRILIVSNQLKRSGEKLEDVRIMENILHSLYPKFEHIVVTIEETNDLETMMIEQLQGSLQAYEEKHKKKQEITKQLSRCN

SEQ ID NO: 150022 - protein, 130 aa, Glycine max
  Coding DNA Sequence Number=SeqID_33244
MIEVSVEAIASLAQYYDQSLRCFMFGDFQLRLEERAEALADQGEWTSFIDILALLGFGTILFPNVDGLVDLATIDAFLAYHHNKESPVITDAILPRKGQVTRAMSKRLQEDWARAAEEGPRILMNLRVDF

SEQ ID NO: 150023 - protein, 230 aa, Glycine max
  Coding DNA Sequence Number=SeqID_33245
  Gene Ontology: Mol. function=DNA binding; Biological process=DNA integration
  Pfam annotation: Domain name=zf-CCHC; Domain location=65-82; Score =11.9; E_value=0.011; Accession=PF00098.13; Description=Zinc knuckle
MREGTPPKEHFDELNYVLIELYGIDVKIEDEDLAMILLASLRLSYKNLKKKKDKGSKKSKVDPKDIYDYCEEPGHWKKDCLEKICDGIAKALTNAHHAPELKKNLVFVGAMDSKGFSCWVEGGVMQIKGKGEVCGNVGPLQFCEYHVYKKQHQTKFPKVVHATKAILDCVYFDCWGPLRVPSLGGARYFLSIIDDYSRMTLVFMMKQKSKAFKCFKHWMILMKNQTGKTM

SEQ ID NO: 150024 - protein, 125 aa, Glycine max
  Coding DNA Sequence Number=SeqID_33246
MKHPFEDHSIFRAEIIDQIVDDYMFDFDYALHGRKHPFLSYMHTCHSLCIESESEFEFDPVSDFYAKNKSEFESGSDFLGVVPLDVDFLESECINHVSYPNFVRGPLFGGMQLSFDHFEELDTHR

SEQ ID NO: 150025 - protein, 199 aa, Glycine max
  Coding DNA Sequence Number=SeqID_33247
MTMETLLGKLLTHEHELQSHVEDIEKKREGIALKASSSKEDRKESSSDDKDVENLSLMVNKFGKVLKRTKDRKFTKPLKKVESNNNTFTCFESWEDNASTTSDSSSKEEVTNVCLMADSKDESSTIDETKRCSGRKRRRGEGRHHPLGNKPWKKELHHQECALDKKLEEDALMEEKKEGEKERGGSTKLKEEKGREVEL

SEQ ID NO: 150026 - protein, 130 aa, Glycine max
  Coding DNA Sequence Number=SeqID_33248
MTIMTMVVIEVALVMVAILMSVATLVVGMMTMVVMVPMLMVAPSGGDGDNGTENGIDGGSDGDSNIGDDGDGGGGSDVSGGGDDVVKCITSRCPCAAPLFSSQINEVFPPGSGFPPKSEHQSKCLLPQAE

SEQ ID NO: 150027 - protein, 152 aa, Glycine max
  Coding DNA Sequence Number=SeqID_33249
  Gene Ontology: Mol. function=oxidoreductase activity, acting on the CH-OH group of donors, NAD or NADP as acceptor
  Homolog annotation: Hit_ID=Q8S7N0; Match level="QueryCoverage=93%, HitCoverage=38%, E-value=4e-23, Identity=38%"; Hit description =Putative transposase
MDPKELTIKLGLEFNSLEEAYLFWTDYGGKKGFGVRKKNSSKSKKDGSITHYKYVFCKEGVRQYDKRDPKTTNPKAETRTGITENQAYELEVAEDAGIQQKASFDLMSKYVGGRENLGYTRQDAKNYLNSKRRRVWLMVKLGVCYNISNNNS

SEQ ID NO: 150028 - protein, 264 aa, Glycine max
  Coding DNA Sequence Number=SeqID_33250
  Pfam annotation: Domain name=GRP; Domain location=156-260; Score= -24.6; E_value=0.025; Accession=PF07172.2; Description=Glycine rich protein family
MSRNLMDYATVPSLASEMLRNFTDCPLTLLFDSRHVTEFHRLPNDGCQVPRSGQEKVASHQIDGPWTKLGVLLFGGDDNGDGSDVSDNNDDRNINGGHGGSGSDGRGGSDNVVVTEVVLVVVMVIMSVVMVMVVVGTMVGVVVAVLVTLAMVVVAMTKVILLVVVVTMTVAVTLMVVVVVVVVVMVMLMAMMVGPSDGGCDNIGGVCGGDDGGDGDNDNGIDINGGGGSNAGGEGDVSVNGGDNDDSGGGSSVGGHGGGSQLWQ

SEQ ID NO: 150029 - protein, 143 aa, Glycine max
  Coding DNA Sequence Number=SeqID_33251
MYIKQSHNPKLTKPCSYVIEAFHRALGGRMFGHKLQENGSNVACPIASEYNLGLRPFHSNPQFKKTSTKANQNCLTIISMFSQFKAPKDEENTSMGSKNLKDGILTCWSELKHQKRKQNAIKSGLGEQEPGCSPKRAQLAQAS

SEQ ID NO: 150030 - protein, 57 aa, Glycine max
  Coding DNA Sequence Number=SeqID_33252
  Homolog annotation: Hit_ID=O64438; Match level="QueryCoverage=63%, HitCoverage=15%, E-value=4e-14, Identity=94%"; Hit description=ARG10
MFCLFQHITRCFYSTAVGGLRCYENPKNKITTVPAEEEEIWGALFKVILELKKLELN

SEQ ID NO: 150031 - protein, 86 aa, Glycine max
  Coding DNA Sequence Number=SeqID_33253
MLRNLTDCVTMLPFDFRHVTEFHVLCNNGCQVPLSGQAKVMRLHCYQASQRPSMTTDRPPLLMAHIDPGIGPNISMCVRGVGAMCA

SEQ ID NO: 150032 - protein, 141 aa, Glycine max
  Coding DNA Sequence Number=SeqID_33254
  Gene Ontology: Mol. function=3-oxoacyl-[acyl-carrier-protein] synthase activity; Cellular component=chloroplast; Biological process=fatty acid biosynthetic process
  Homolog annotation: Hit_ID=Q5ECI5; Match level="QueryCoverage=78%, HitCoverage=23%, E-value=1e-40, Identity=70%"; Hit description =Plastid 3-keto-acyl-ACP synthase II-B
MTGMSVVTSLGHDPDVFYSNLLEGVSGIIKIDTFDCEEFSMRIGGEIKSFSTDSWVARKLSKRMDKYMLYLLTVGKKALADGGITHDKMDELNKEKCGILIGSVGWHTVNDIRLIDEEVKTAVYKKITCDYSVRLFDNVTS

SEQ ID NO: 150033 - protein, 77 aa, Glycine max
  Coding DNA Sequence Number=SeqID_33255
MALFRSWKGSTTMLIDDKGSVDLRTNPLQEGGDDVILPRRGPITRAMARRLQEDWVRDAREDLRILMSLRLDFGSMG

SEQ ID NO: 150034 - protein, 49 aa, Glycine max
  Coding DNA Sequence Number=SeqID_33256
MPFRFFKRGDTRKRVLLKKERGKKHGEFGKGELNVRGIEFGGGMRGRKG

SEQ ID NO: 150035 - protein, 127 aa, Glycine max
  Coding DNA Sequence Number=SeqID_33257
TASQVVGGETLWSSAPFVNQGERVRRHSSPTMHEILLCWAGTIKFDSVWKHRDRGVSQHALLRASEARLKCALSKGGKMCGVATNEGISTSHVDKSGAFAPTYPPSKRKSDLRSSFMRESNDSFYLK

SEQ ID NO: 150036 - protein, 277 aa, Glycine max
  Coding DNA Sequence Number=SeqID_33258
MSSGQATPGGISINDLEKAYDRLNYTLDRETLQDIGLPNSFLDLVWTCIITPRKGYGLSSYLKSGCSRHKTRKRSMFLDLKSLEGGFVTFEGMGKEGTVGKGKIVVAQGTVRKGKIARTTWVDVDALDGIDEEDASPHVHMNSVFSINTTAHVALFRALHRAPQCALLCHNLKCLVTFYNSSSNYCRIPCSFGFVPSPSSLRSVRGLLLRTLRCISSFTASFASPAGGGNGSAGTGDSGRGDDSGSESGDANLKLVGDATQELSGLSPNVINLDVLV

SEQ ID NO: 150037 - protein, 66 aa, Glycine max
  Coding DNA Sequence Number=SeqID_33259
MQENFKYEKPQQIDIIENAEDGKGKRSTSTSEQQRKHSRTHQNRSFSVFVHLLCQPKNRGTTVKES

SEQ ID NO: 150038 - protein, 171 aa, Glycine max
  Coding DNA Sequence Number=SeqID_33260
SHEEAKRFRFKVIPNWDDIVDLCAKDRATGLGAENALDADDIMSKETNEEEAIHSVSFDLEGSSSATRKNIRPSKSGEKEGMISSMKEVAESLKEFVEVTKKKMENKKKMEIKEAQEVVHEVVSELDNIPNFNGALRHRAIDWLTENLIKFAIIKALPLDEKEDYILSFMP

SEQ ID NO: 150039 - protein, 588 aa, Glycine max
  Coding DNA Sequence Number=SeqID_33261
  Gene Ontology: Mol. function=RNA-directed DNA polymerase activity; Cellular component=nucleus; Biological process=RNA-dependent DNA replication
ELEENVLRQKAKIDWLKLGDGNNSFFYTTVKSRANAKGMNMLRKIDGTICATQEDIENLVLEFYGELMGKKSTNLKHIDADAMRRGGQLSMEQRQFLVAPVNDQEILKALNGIGDLKSPGIDGYGANSLNPAFNCIIVTLIPKHEKAVSVKDYRPIAGCTILYKIISKILTARLGKVLNSIVSLCQAAFVPGQQIHNHILLAYELIRGYARKNGTPRCMIQLDLQKAYDMVDWFALETILLETGIPKEFVKWIVLIVTFVTYRFNINGNYTKCMKANRGIRQGDPLSPVLFVIIMEYLNRLLHKMQRNPDFNHHSKCEKLNITNLAFADDVLLFAIGDYRSVEMLMQTLNTFSETTGLVGPLPFKYLGVPLTSKKLSISHYLSLIDRITRKINHWSNKLLSYAGRLQLIKSVTFSIANYWMQCFPLPKPRKYGGLNVIPLQTWNHVTMMKLLWSLSEKADNLWSDLGQKDRGKFNMKTLYLKMRCKGSNEVVWNRLFCGNPAKPRALITLWQACHDRLPTKDHLQRFGMLGDKICCFCEGPESHDHLFFGCSVLGDVWKQVLEWIQLAVTETVYGIWKYRNAKIFEET

SEQ ID NO: 150040 - protein, 147 aa, Glycine max
  Coding DNA Sequence Number=SeqID_33262
MLSFNQMQSQQPHLLEPYVALSSFHVSTKGSCVNINVDLLGQDLDTDISNRHVLYVDDIPLCLVSLGRVYEGSSIVHHVCLANGMVKVGVEELRDANSCVPIPTKVVQLVRQALNTFFAWAKHLDKEVPKKLKKPVDKLEPDDNPIY

SEQ ID NO: 150041 - protein, 55 aa, Glycine max
  Coding DNA Sequence Number=SeqID_33263
MTEARQKGVRKNSPLQPIYRKKGEEVAAQLAQKHYGCPRSPEIPFFNKTGEVVAT

SEQ ID NO: 150042 - protein, 94 aa, Glycine max
  Coding DNA Sequence Number=SeqID_33264
  Subcellular localization annotation: CTP_CleavageSite=23; ConfidenceScore=5.38e-01
MYGKVVAKNRYYAFHYKLPSSPKCSSSRSSSSPMFVRAGWFNDITVRSTLAHNFDDHKGKDKNKGMNKGFVEEVVTRADLAITRSEKGTMICDF

SEQ ID NO: 150043 - protein, 87 aa, Glycine max
  Coding DNA Sequence Number=SeqID_33265
MSRINPEFHYYRLAICLQARPVAQRKRKLDPEKGKTMDKIPIFKQDEEKTMFMTDTTNYYYSVISLDLKNGKATYQRLMDSQFELNP

SEQ ID NO: 150044 - protein, 90 aa, Glycine max
  Coding DNA Sequence Number=SeqID_33266
  Subcellular localization annotation: CTP_CleavageSite=11; ConfidenceScore=5.41e-01
MIASPFMNKFICVTKSPTCLFGSENPLLQLMFNNFHPCGSCASTIPSTKVSFCFKDASLSVGRWSMSDHQAPTRGTCHVCWVPLFRGTHN

SEQ ID NO: 150045 - protein, 69 aa, Glycine max
  Coding DNA Sequence Number=SeqID_33267
MQKKNRKSKVENTLKLEDRNENEIGIKSRKRNWNLKQKTKMELLREQYHAREHNRPIPKTLAAGLTKGH

SEQ ID NO: 150046 - protein, 43 aa, Glycine max
  Coding DNA Sequence Number=SeqID_33268
MRKLIKEMMENKVVNFVGLNKVKWWLDRNIEMAITEATGLQMR

SEQ ID NO: 150047 - protein, 50 aa, Glycine max
  Coding DNA Sequence Number=SeqID_33269
MELENASASIVIAFKYLEVPQRFTLGGSKNLRVIEIIFWCGFHCQSNRQP

SEQ ID NO: 150048 - protein, 174 aa, Glycine max
  Coding DNA Sequence Number=SeqID_33270
MAKEREGAIEEREILPIFPVPGLFEVRVVGEPCDGKSSCIVRRGSPPSLVVTAVPNMSPQKTTDIPVLARHTQEINVVPRMPPCRPSSIPIPVQYWKQETPPSRVLKACYFPNSSPLEAKKLFQSSYTWTNIASTNDLVEEGISWRIGNDDAVKIWSNRSIPNNLILTEESVAP

SEQ ID NO: 150049 - protein, 151 aa, Glycine max
  Coding DNA Sequence Number=SeqID_33271
MRKKVMTAKNKSLLSDTYACIANRKPKGEISYEGKRPDLKCHHLEHLVEQSRKGDKEVSSSANSNSTTLLGKFAGLLGNSKLPSHESIEGMPTAFSTSMKFSTVNDFWIDDSDIEDHMTNKLSNLLDFKKFSTPSHVSIANGVLVIGKKKT

SEQ ID NO: 150050 - protein, 110 aa, Glycine max
  Coding DNA Sequence Number=SeqID_33272
MFILVGTGYAHGKRRGITLLAVWRAGIYEQGEMKHIKVTLPVIEQIKNTRCYSGLRLQHSNIVPVRLRCQGVWSAAFVVNYGSNRNGIVFNEAIPDAASVLDMIIVRSWS

SEQ ID NO: 150051 - protein, 340 aa, Glycine max
  Coding DNA Sequence Number=SeqID_33273
  Gene Ontology: Mol. function=DNA binding; Cellular component=beta -galactosidase complex; Biological process=DNA integration
  Homolog annotation: Hit_ID=Q1SS89; Match level="QueryCoverage=50%, HitCoverage=20%, E-value=2e-44, Identity=52%"; Hit description =Integrase, catalytic region
MVVSSKGLFLNQQKYILDLLEDAKMIDSKPALTPLDSKLKLDTTSAPLQAINDYHRLVGKLIYLTIARPDITYVVSLASQFMHVPTVFHLGIVKRILRYLKGSIGCGIVLTKNGHTQITGYNDSNWVGNALDRKSTTGFCMFVSDNLVAWRSKKQHVVAQSSAMASTTCEMIWIKGKRPSHFLFHPPFLFCSMGTFRSFMKVSFRWGIIVLMLCLNYLANPAKFLASILLSVLITRRVLVFDKSFYEDVPSGSISLILKGSKFYYDVTNNSIITTILGFFYPWGRSILSRFWLKEKKVQVADVSLSEAYALSESHPLSEAHSSLSMPGNPRRGSVRDVLA

SEQ ID NO: 150052 - protein, 117 aa, Glycine max
  Coding DNA Sequence Number=SeqID_33274
MSCYKFLYPDKENKIIESMNAKFLELDVADPVVPSDDIDVESRETISFSLPLPNLVVSVSNAVPINVGVQTVPIETRVSIVPVETIIATGDIVEFEANDMLDPSTMNENAQLIELIP

SEQ ID NO: 150053 - protein, 54 aa, Glycine max
  Coding DNA Sequence Number=SeqID_33275
MEQSERQGRRAGWGWEWVWVEGSRTLGKAWKKNGNGVSFPHDQLVKERKNDQVL

SEQ ID NO: 150054 - protein, 373 aa, Glycine max
  Coding DNA Sequence Number=SeqID_33276
  Gene Ontology: Mol. function=RNA-directed DNA polymerase activity; Biological process=RNA-dependent DNA replication
TLEEAMEIIENMAASDHAILHDRTHIPTKRSLLELSSKDALLAQNNICRGAHESGRCIPLDDIAQEVNYMGGTKIGQDSMHVDIHLFNKVQIITSNKGSGGHSLYDRTTKLEETLAQFMQVTMSNHKSTESAIKNLEIQVGQLAKQLAENSSSTFGANTEKNPKEECKGIMTRGKEVPYPLVPSKKDKEQQLAQFLDIFKKLEITIPFGEALQQMPLYSKILKDLLTKKSKILPPKHKDPGSVTIPCFFGPVSVGKALIDLGASINLTPLSMCKRLGELEIMPTKMTLQLADHSITKPYGVIEDVLVRVKHFTFPVDFVVMDIEEDTEVPLILGPPFMLTAKKHLLDQNVCSKVDEGWKEMVLKVGTKFDLDP

SEQ ID NO: 150055 - protein, 197 aa, Glycine max
  Coding DNA Sequence Number=SeqID_33277
MDMDLGSLISSQISQMAQCNSSRFGFPTLIIAQCVAKRVISDSLTFESLSPTINLAYIRKNCWNLDDPMITFPGTRKARARGPSNTSASSSSAPTPSAPASPASVLSIHDLAQHRPIMSMEAFMAQVAWPGVQPSPLGGGKAPKAQEPQPKPEDTPEATPEVTPTATPLMEIVEDEGGVEDIDYAADMVAAQSTWDP

SEQ ID NO: 150056 - protein, 119 aa, Glycine max
  Coding DNA Sequence Number=SeqID_33278
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=Q9S7J8; Match level="QueryCoverage=78%, HitCoverage=10%, E-value=7e-17, Identity=50%"; Hit description =Copper-transporting ATPase RAN1
  Pfam annotation: Domain name=HMA; Domain location=47-110; Score=28.0; E_value=3.4e-05; Accession=PF00403.16; Description=Heavy-metal -associated domain
MAPGIGGLQLTSLAGDRRTAAADSDELEDMRLLDSYDEINGGARRIQVEVTGMTCAACSNSVESALKSLDGVISASVALLQNKADVVFNTALLKVRLSYLVAFASFYCFGKLNFEVLAD

SEQ ID NO: 150057 - protein, 147 aa, Glycine max
  Coding DNA Sequence Number=SeqID_33279
  Gene Ontology: Mol. function=transferase activity; Biological process= RNA-dependent DNA replication
MKKKVCLNLGLCWHGEPEANGEGLYSVKSAYKIIMTQVFYLSDFKIPRDWNCVWKLSVPPRMQTLIWRLARECLPTRANIKAKGVACSLLRPLCEIVVETAFRTFFACQTNIGCWNYADGALVVARTMWREPCMQARRRSMGNSTSA

SEQ ID NO: 150058 - protein, 807 aa, Glycine max
  Coding DNA Sequence Number=SeqID_33280
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=Q9S7J8; Match level="QueryCoverage=95%, HitCoverage=80%, E-value=0.0, Identity=70%"; Hit description=Copper -transporting ATPase RAN1
  Pfam annotation: Domain name=E1-E2_ATPase; Domain location=293-533; Score=307.0; E_value=3.5e-89; Accession=PF00122.10; Description=E1 -E2 ATPase
  Pfam annotation: Domain name=Hydrolase; Domain location=537-785; Score=111.9; E_value=1.9e-30; Accession=PF00702.16; Description =haloacid dehalogenase-like hydrolase
  Pfam module annotation: Pfam domain module=E1-E2_ATPase::Hydrolase; Domain location=293-533::537-785
MVGLLIFRYEITVFWTPRLQTYSFFLLHDEDIKNAIEDAGFEADILPESSTVGKVPQGTLVGQFTIGGVRRAVVALATSSGEVEYDPSVISKDDIVNAIEDSGFDGSFIQSNEQDKIILRVVGVYSLIDAQVLEGILSSTKGVRQFHFDQVSGELDVLFDPEVLSSRSVVDAIQEGSNGKFKLHVRSPYTRMASKDVAETSTIFRLFISSLFLSIPLFFMRVVCPHIPLFYSLLLWRCGPFLMASRALRNGSTNMDVLVAVGTTASYVYSVCALLYGALTGFWSPTYFETSAMLITFVLLGKYLECLAKGKTSDAIKKLVELTPATALLVVKDKGGKSIEVREIDSLLIQPGDTLKVLPGAKIPADGIVTWGSSYVNESMVTGESVPIMKEVNASVIGGTINLHGVLHIQATKVGSDTVLSQIISLVETAQMSKAPIQKFADYVASIFVPSVVSLALLTLLGWYVAGSIGAYPEEWLPENGNHFVFALMFSISVVVIACPCALGLATPTAVMVATGVGANNGVLIKGGDALERAQRVKYVIFDKTGTLTQGKATVTAAKTFTGMERGEFLKLVASAEASSEHPLAKAILAYARHFHFFDDSSDTTGTEIDAENDAKSGWLFDVSDFSALPGIGVQCFIDGKLILVGNRKLMEENGIDISTEVENFVVELEESAKTGILVAYNDILTGVLGIADPLKREASVVIEGLQKMGVTPVMVTGDNWRTARAVAKEVGIQDVRAEVMPAGKADVVRSFQKDGSIVAMVGDGINDSPALAAADVGMAIGAGTDIAIEAAEYPSIFPGRPFLVFD

SEQ ID NO: 150059 - protein, 199 aa, Glycine max
  Coding DNA Sequence Number=SeqID_33281
MRRARIMGVLMKVACATNAEKSRKIVCARGGGATSRVGGDAIQVENKRYRCDSREVSVPRPARRNDYHEMELLRPSQTQVDVPSTCTTKDVPSNVLRQRSQAVKPLILCEWGYKRILRREKGDTKEFRRLVLCSFGKGRRETQKEFRRLVLGEFFLAKGEENEKMNNTSFQGLENQKTSKSFWYKEEEEVQRDSRLVKD

SEQ ID NO: 150060 - protein, 456 aa, Glycine max
  Coding DNA Sequence Number=SeqID_33282
  Gene Ontology: Mol. function=RNA-directed DNA polymerase activity; Cellular component=chromatin; Biological process=chromatin assembly or disassembly
TLPLHEHEFGGWCGSIVPFPFEDGEARRETLDEFRTTLNQKEAKIASGQFPVLGSEGRFPIRTQSDIYLGSHIISDIPTMARFLRLPPGMSLLSIEGWKEEVQEMDPLLWAVVDESPEILLHDVVEYLSLIVRFRVEEKDGHKMSRILSCPKIALPTGRWGLEEDEVNPRVSSSLEVILDTVKSFRKAQVATDRCRVKFLHNNGNKCVIRGKPYLLMEEDQVTADGEPFMFWKLVDVIYQGGSKLGRDNESRVPEEGGGLLFWGLNDLPHEVLETLVVSVNDEVTVVQVMAPFTDNDSDGMQFADIGGCSLKSSTEHLTVESDGMGTLDEGTGYGGVTFDKAKVETREAEEAMSSLENHLACPNSSKSLSMVGITGDENGLWLIRMRPLASMEATCSGTGGHLRGGLRKEVDVGVPWRIEMSPITMRGETGPIYYLFGICVKPVERIRSWAGMGHL

SEQ ID NO: 150061 - protein, 59 aa, Glycine max
  Coding DNA Sequence Number=SeqID_33283
MDPSPRLHQQSQQSNSINVVVLSLLASPLLDYVKIYQVRNLEIPEKIEIENRHLPELLH

SEQ ID NO: 150062 - protein, 475 aa, Glycine max
  Coding DNA Sequence Number=SeqID_33284
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=90%, HitCoverage=55%, E-value=0.0, Identity=82%"; Hit description =Adenosine/AMP deaminase active site
AQTISVKERNSGKRDRESQRLIIHGYARGAFGPGGARRSLRRGRVGVLHAPQDAGAAAGEAPQRRIPPGLRVAAGRHGDLWRVRRGREAERAGARRGDSGGAAKVAHAPGSLLRPTSPKSPVASASAFESVEGSDDEDNMTDKVKLDTTYLHANGTVGPEGKIPFETLPNHVNANGEQMAITPSMIRSHSVSGDLHGVQPDPIAADILRKEPEHETFTRLRITPLEAPSPDEIEAYVVLQECLEMRKRYVFREAVAPWDKEVISDPSTPKPNPDPFLYIPEGNSDHYFEMQDGVIRVYPDRDAKEELFPVADATTFFTDLHHLLRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLSGYDLNVDLLDVHADKSTFHRFDKFNLKYNPCGQSRLREIFLKQDNLIQ

SEQ ID NO: 150063 - protein, 99 aa, Glycine max
  Coding DNA Sequence Number=SeqID_33285
  Gene Ontology: Mol. function=unfolded protein binding; Cellular component=chloroplast; Biological process=protein folding
  Homolog annotation: Hit_ID=Q39641; Match level="QueryCoverage=98%, HitCoverage=17%, E-value=2e-34, Identity=66%"; Hit description=Heat shock protein 70
MAKFEELCLDLHDRLRTLVENSSRDAKLLFKDLDEVILVGGSTRALGATIQASVLVGDVSNIVLLDVTPLSLGLETIGGVMTKIIPRNATLPTSKSEVF

SEQ ID NO: 150064 - protein, 179 aa, Glycine max
  Coding DNA Sequence Number=SeqID_33286
  Gene Ontology: Mol. function=nucleotide binding; Cellular component =chloroplast; Biological process=protein folding
  Homolog annotation: Hit_ID=Q08080; Match level="QueryCoverage=69%, HitCoverage=22%, E-value=1e-46, Identity=73%"; Hit description =Stromal 70 kDa heat shock-related protein, chloroplast
MFVLNNALKGLDDTPQSKSKAAARWIVVKYFNDARPLESERLKALCIQWETYYLKVLRKLVDDASKFLSDKVTKVVVTVPAYFNDSQRTVTKDVITEAICLTAYGFEKKNNEAILVFDLRGGTFDDSMLEVGDGVFKVLSTSRDTHLGGDDLYKRIFDWLASNFKRDESIGLLKDKQVL

SEQ ID NO: 150065 - protein, 98 aa, Glycine max
  Coding DNA Sequence Number=SeqID_33287
MSPNIIREEEVDDVHANCKWLHHPALLLLLLLLLTRKAIHLRSLATRPIGAKRPLVHVDPAIGKANGPHKKKLRTYLGIITRDKVNVTYENWKQVSTT

SEQ ID NO: 150066 - protein, 78 aa, Glycine max
  Coding DNA Sequence Number=SeqID_33288
MNDPKTLNNIAPQDARDNLNRETNAKLHYALDLTRVTWRVTEPACLLSPLAASVLHVSVHGNTYFFILTGCHLLVNPL

SEQ ID NO: 150067 - protein, 226 aa, Glycine max
  Coding DNA Sequence Number=SeqID_33289
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=84%, HitCoverage=22%, E-value=1e-106, Identity=97%"; Hit description =Adenosine/AMP deaminase active site
  Pfam annotation: Domain name=A_deaminase; Domain location=1-197; Score=145.3; E_value=1.6e-40; Accession=PF00962.12; Description =AdenosineAMP deaminase
VVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQIGLAMSPLSNNSLFLDYHRNPFPMFFLRGLNVSLSTDDPLQIHLTKEPLVEEYSIAASVWKLSSCDLCEIARNSVYQSGFSHALKKAERFMCLKLERVNWTSRRITPQKLLLVVGESKAV

SEQ ID NO: 150068 - protein, 84 aa, Glycine max
  Coding DNA Sequence Number=SeqID_33290
MVIFLRQVWWAAVAIQHEILRRNQLHNLLQSLTLMKMTQNLKKMKNQSLSLKKSVKFTKLLQQKTQNNILFKNNKTKKNTNIED

SEQ ID NO: 150069 - protein, 41 aa, Glycine max
  Coding DNA Sequence Number=SeqID_33291
MRFFTDMGVTEAVSMFSEASMELKTCNVALLETPGKSWDEV

SEQ ID NO: 150070 - protein, 107 aa, Glycine max
  Coding DNA Sequence Number=SeqID_33292
  Gene Ontology: Mol. function=RNA-directed DNA polymerase activity; Cellular component=intracellular; Biological process=RNA-dependent DNA replication
METKKLHCVLRQYRKVNRYTISDIKGIHPTFCMLRIFMEEGHIPYIDCQHRLNPNMKAEVKKEVLKLLGAMVIYPISDSPWVSPVHVVPKKGGKLNSATRKDHFPLP

SEQ ID NO: 150071 - protein, 118 aa, Glycine max
  Coding DNA Sequence Number=SeqID_33293
MTSPTPTPPFYIDTNKTLWEHDDALHVNRFYRFLRCHHALVDVLGYQPCIIDLKVSWTQPTPSYYRFTMLAPKLVIPFELHSPPANDVISSSRSHSSYKDTETISPTMMSPRSILPKF

SEQ ID NO: 150072 - protein, 54 aa, Glycine max
  Coding DNA Sequence Number=SeqID_33294
MALLSLEIPLFLLPRARMEILIMGQGLWWFEVLAQKACRTAEHDICQGVGLAND

SEQ ID NO: 150073 - protein, 90 aa, Glycine max
  Coding DNA Sequence Number=SeqID_33295
MTAVMAAKIRWRQRQQKHFTVVKHNKYMAKGLIKVMGFSSKFFGVIFELLYEMQKKVEEKFNDLGTCEREEYESREAYEQQKKFESLMVS

SEQ ID NO: 150074 - protein, 153 aa, Glycine max
  Coding DNA Sequence Number=SeqID_33296
  Homolog annotation: Hit_ID=Q1SAW3; Match level="QueryCoverage=55%, HitCoverage=9%, E-value=8e-37, Identity=94%"; Hit description =Cytoplasmic fragile X mental retardation protein interacting protein
MINLRSLITERMNKFFRENIEFLFDHFECQDLCAIVELEKLLDVLKYSHELLSRDLSVDSFSLMLNEMQENISLVSFSSRLASQITLHEPMITGLQDSAKINWASSFRWRCDSDAILPRKGPVTRAMSKRLQEDWARAAEEDLRVLMNLRIDF

SEQ ID NO: 150075 - protein, 103 aa, Glycine max
  Coding DNA Sequence Number=SeqID_33297
MSNGYNAIYRHSRIGNLVPGGHDVALGLFHELVDSLCKILPGGGASISRMATNILIDSAYTIPCYIITSTKGVEGSGRAVLLSSCYKTFNFRHLFMYLCCLLP

SEQ ID NO: 150076 - protein, 703 aa, Glycine max
  Coding DNA Sequence Number=SeqID_33298
  Gene Ontology: Mol. function=transition metal ion binding; Biological process=proteolysis
LLAIGPNLNVPTWKGYDINHYSFYTKSQDDKSSMQNSGVSVDGQSHHFCSASDNSPIEACMPYYGVIEDIWELDYGEFRVPLFKCKWVNGNTGVRQDKMGFTLVDLKKVGYKDDTFIMTVQARQVFYVEDPYDSRWVVVLQGRTISTSHHIDGSTLDAPDMLPFSKYMPSTTNEQMEDDVYANRTDHDEGLWENIPTLDNPRPIVNVNPATGRGSGPHKEKFHSYLGVVTREKIPIVHANWSVVPDNLKNLIWEDILESFTYCYITPFVVHHKLDIPEREEAKKKSSLTSKFVYADNEGQQISDPTVKYGLDLATWAEFAKSHQTPNWQKLMDEKRKRRDQQDEFTENPTLNLDPPSPVSRHLKWKMARTKRYGQMTSEAAQQIANKIEQATQGSFVLHRRQDILNTTISRPEHLGHVRVTRTGVTISQYFSKVSCASSTSSPSINQQQLPEIISGIKDEIRKEPSDVDVDLMGLFVVEDESTLLVALGKVYDNSSTIHNVCYADDVVRVNVVTYYHPDTEVLFPTSEPPSKSVEQTDRANVVATDDPLGELVKKLAHWQLLVLCPRENIVVWFCSIRRKHDVHIKATVNSAMKKISITFQGKENGPPPQWIEPKSYVQAGAYECGYYVMHRMWCIVTGGLKNEWNKCFSNGTPLDSDTMTTLRKKWAAYFLQVGKMDVVPVTLQQLHAPTKAPYWPVAADGW

SEQ ID NO: 150077 - protein, 90 aa, Glycine max
  Coding DNA Sequence Number=SeqID_33299
MNRKLGYGAQLRANLDPTKGVGRLRQQDGGHGSRNPLRRRGGRCKTQGASPGGAVVGADLGGTGEARLIALCARTPKGNRPAHPGNGSAG

SEQ ID NO: 150078 - protein, 296 aa, Glycine max
  Coding DNA Sequence Number=SeqID_33300
  Homolog annotation: Hit_ID=Q8TGM6; Match level="QueryCoverage=32%, HitCoverage=78%, E-value=9e-11, Identity=40%"; Hit description =Protein TAR1
ICTDDRSARARALGFAATAAPSYSSGLGPCPDGRNSPAGSSYPEGNFGGNQLLDGSISLSPLYPKSDERFARQYRCGPPPEFPLASPRSGIVHHLSGPDRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWA

SEQ ID NO: 150079 - protein, 89 aa, Glycine max
  Coding DNA Sequence Number=SeqID_33301
  Subcellular localization annotation: CTP_CleavageSite=56; ConfidenceScore=5.46e-01
MQLCAKRAIQISVSKKSKAVALWVLPLHPNLCTFLPLSTCVFSTSFVLFLCIFIASFQEHSNTAKHTLCTKPECYFVESELSVPCSDGI

SEQ ID NO: 150080 - protein, 262 aa, Glycine max
  Coding DNA Sequence Number=SeqID_33302
  Gene Ontology: Mol. function=receptor activity; Cellular component =anchored to membrane; Biological process=protein amino acid phosphorylation
  Homolog annotation: Hit_ID=O22784; Match level="QueryCoverage=93%, HitCoverage=80%, E-value=2e-97, Identity=65%"; Hit description =Expressed protein
  Pfam annotation: Domain name=DUF26; Domain location=191-242; Score =52.2; E_value=1.8e-12; Accession=PF01657.8; Description=Domain of unknown function DUF26
  Pfam annotation: Domain name=DUF26; Domain location=87-141; Score =55.3; E_value=2.1e-13; Accession=PF01657.8; Description=Domain of unknown function DUF26
  Pfam module annotation: Pfam domain module=DUF26::DUF26; Domain location=191-242::87-141
MGFTRKPMLFPFLPVLFITILLEPPHVAESASSDYSTLVYKGCSKEPFTDPNGVYSQALSALFGSLVSQSTKAKFYKTTSGSGQNTITGLFQCRGDLTNSDCYNCVSRLPVLCDKLCGKTTAARVQLLGCYVLYEVAGFSQISGMQMLYKTCGATNAAGRGFEERRDTAFSVMENGVVSGHGFYTTSYQSLYVMGQCEGDVGDSDCGECVKNAVQRAQVECGSSISGQVFLHKCFISYSYYPNGVPSRSSSSSSASYSSSSS

SEQ ID NO: 150081 - protein, 174 aa, Glycine max
  Coding DNA Sequence Number=SeqID_33303
MEAMKDQMTTMMEAMMSMRKMMKFNAVALAATSVAVEVEPTHPSGQGGKALGSAGDPHFVQVQSKHPFLPYDLPPNYAPPNVVHVLDENVDHFALIPLESQQPQSGHAHVSQPIGETPKVPRDHTLADFEPHLGYATEQQAFGGVPLPNALGAFNTAHNHNPYILQWEGCLLPW

SEQ ID NO: 150082 - protein, 150 aa, Glycine max
  Coding DNA Sequence Number=SeqID_33304
  Gene Ontology: Mol. function=transition metal ion binding; Cellular component=cytoplasm; Biological process=fucose metabolic process
MQSGSQCKSFDVEIGDRLEDMIRDLGHESFQPAHVPMYNTLQTHSKKPLYLGCKNSLTLLSTVLSLVNVKAIYGWSDKSFSSQLQVVNDMLPEENTLPKSYYQAKKILCPMGIEYQKIHACPNDCILYRNEFQEMHKCPRCEVSWVQSEG

SEQ ID NO: 150083 - protein, 70 aa, Glycine max
  Coding DNA Sequence Number=SeqID_33305
MCYNVLQSKSLVRTCSNRKERRVFKKEFPGSKEYLRSTKLRQERGLRAIGQFELVYGRVEVEAARVLDLA

SEQ ID NO: 150084 - protein, 227 aa, Glycine max
  Coding DNA Sequence Number=SeqID_33306
  Subcellular localization annotation: CTP_CleavageSite=17; ConfidenceScore=5.34e-01
PLDPTPLASTEVSTPIVAAVVVVPTDVVVITSAPPPPSTMPIQEATPTVVVSTLSTSACSIVVPSSIIVAPLLSMGVATTSAHVLPPLSSLAPPALASTLLVMASPSMSYCPNVSFDHLYIYNETNSLWDFDKNLIWSVGENEKQHQEAMRKVASLEVEVAKWRATARIVWRVERPKVANATVAFIETVKSNHQFSSKEEKKDLAGKVEGIAVERDELAKVVAELEA

SEQ ID NO: 150085 - protein, 173 aa, Glycine max
  Coding DNA Sequence Number=SeqID_33307
MGSRKPRGPKDLLNMKIVKKSRSKQPIRIVRRGIQSEEYGASEIRKSEEYVASEIRKQKNHRGSNKKSNESLKSTESMEEFVIPGDIPELDSLVVYEKELRSDFFSNVAAACLEPSRERKKKNRHKSRNKDESHDLIKSITDFVIPGDVPAIDSLMGFDNNFFSDFFTNIPVF

SEQ ID NO: 150086 - protein, 271 aa, Glycine max
  Coding DNA Sequence Number=SeqID_33308
  Homolog annotation: Hit_ID=Q9SJZ7; Match level="QueryCoverage=29%, HitCoverage=24%, E-value=4e-17, Identity=62%"; Hit description =Putative DnaJ protein
  Pfam annotation: Domain name=DnaJ_CXXCXGXG; Domain location=216-271; Score=-34.5; E_value=0.025; Accession=PF00684.9; Description=DnaJ central domain (4 repeats)
MAVSRDLAFFSLLASILQLRSTMVKFGGLHDVEDDSEDEHENDLQVLVDAKVVVEKSAQPSTLIYPKEDDQSGAVVKENVHWKSKSAIKQKKKDNSSKDQKESQDQSDSINVGSRTFETAGIEKAEDVSAIDVKVKLKKNKNGLQLVSQHMYSQLKPQVSVDAQAGTAWGLLGRNQNGLSGGVATSVDIDDLAIHLICSNHCLRAIIVAQVPKVLGMEQMMLNMSIIVLAKLGTTPSRCSTCGGQGRVFSSTRTPLAIFQRSMTCSACNGT

SEQ ID NO: 150087 - protein, 490 aa, Glycine max
  Coding DNA Sequence Number=SeqID_33309
  Gene Ontology: Mol. function=UDP-glucose 4,6-dehydratase activity; Biological process=UDP-rhamnose biosynthetic process
  Homolog annotation: Hit_ID=Q9SYM5; Match level="QueryCoverage=99%, HitCoverage=75%, E-value=0.0, Identity=73%"; Hit description =Probable rhamnose biosynthetic enzyme 1
  Pfam annotation: Domain name=Epimerase; Domain location=208-404; Score=-24.8; E_value=0.00015; Accession=PF01370.11; Description=NAD dependent epimerasedehydratase family
  Pfam annotation: Domain name=RmlD_sub_bind; Domain location=207-484; Score=-148.8; E_value=0.00027; Accession=PF04321.7; Description=RmlD substrate binding domain
  Pfam module annotation: Pfam domain module=Epimerase::RmlD_sub_bind; Domain location=208-404::207-484
MLVMAYHRSYDLPIITSRGNNVYGPNQYPEKLVPKFILLAMKGEKLPIHGDGSNVRSYLHCGDVAEAFEVILHKGEIGQVYNIGTKKERSVLDVAEEICKLFKLNPKDVIEFVQDRPFNDKRYFLDDQKLKKLGWQERTPWEEGLKMTIEWYKKNPDWWGDVSTALNPHPRFSAINLSDEAQWSFQYGYSRLARSYTEVGRKKSRLKFLIYGRTGWIGGLLGKLCDEERIDWEYGRGRLEDRKSLMEDIRRVMPTHVLSAAGVTGRPNVDWCESHKAETIRTNVVGILTLADVCREYSLYMMNFATGCIFEYDKEHPLGSGIGFKEEDKPNFIGSFYSKTKAMVEDLLKNYDNVCTLRVRMPISSDLSNPRNFITKISRYNKVVNIPNSMTVLDELLPISIEMAKRNLKGIWNFTNPGVISHNQILELYRDNIDPQFKWENFDLKEQAKVIVAPRSNNEMDASKLKNEFPNLLSIKDSIIKFVFEPNKKT

SEQ ID NO: 150088 - protein, 90 aa, Glycine max
  Coding DNA Sequence Number=SeqID_33310
  Gene Ontology: Mol. function=UDP-glucose 4,6-dehydratase activity; Biological process=UDP-rhamnose biosynthetic process
  Homolog annotation: Hit_ID=Q9SYM5; Match level="QueryCoverage=98%, HitCoverage=13%, E-value=8e-26, Identity=66%"; Hit description =Probable rhamnose biosynthetic enzyme 1
MYEPKNILITGAAGFIASHVTTRLIDRYPSYKIVALDKLDYCSTFKNLLSCSSSSKFKFIKGDIATADIVNHILIEEEIDTIMHFAAQTH

SEQ ID NO: 150089 - protein, 111 aa, Glycine max
  Coding DNA Sequence Number=SeqID_33311
  Gene Ontology: Mol. function=unfolded protein binding; Biological process=protein folding
  Homolog annotation: Hit_ID=P55737; Match level="QueryCoverage=75%, HitCoverage=12%, E-value=1e-29, Identity=84%"; Hit description=Heat shock protein 81-2
VEDVDEEEKEEKKKKKIKEVSHECSLVNKHKPIWMRKPEEIAKEEYSAFYKSLTNDWEEHLAVKHFSSEGQLEFKPILFVPKRAPFDKLTQGRSLTILRFRTEDLRLVKFN

SEQ ID NO: 150090 - protein, 68 aa, Glycine max
  Coding DNA Sequence Number=SeqID_33312
TPEYIPKERVPECFRKKGLSEDNLLIPEEALASHLKEVNLAIRELLKEVFSKKLLKKVFSRKLLKEAT

SEQ ID NO: 150091 - protein, 130 aa, Glycine max
  Coding DNA Sequence Number=SeqID_33313
MASDSSSNTGDNIASQEEDATVATTRVHQPNKEVQLVSKTKRRIVRPTLLAKVFTVSAKAKFDIAEATKVKTKVMSTVATRWRQFKSILTSKFVFAKSEGQQTQDVVTQYGLDPEAWKQFEETRLTPNWE

SEQ ID NO: 150092 - protein, 99 aa, Glycine max
  Coding DNA Sequence Number=SeqID_33314
  Homolog annotation: Hit_ID=Q84TV1; Match level="QueryCoverage=48%, HitCoverage=12%, E-value=2e-08, Identity=64%"; Hit description =Nodulin-like protein
MGAGLVAFLLMVLVQLVYAVMNITSMLAIESGMSPLVLVAYRQLFATVYLPTTTGARATVVETSKNNDSVLTTDVDILPNNVGGEPATDVERKPNKYGC

SEQ ID NO: 150093 - protein, 74 aa, Glycine max
  Coding DNA Sequence Number=SeqID_33315
MGLWAMVPFLKTTSCWLHRFVLVFKFDFEIDRPASYETRLQTLGKLTSLGKVDNGAATLEKTMSAAENSKELGT

SEQ ID NO: 150094 - protein, 172 aa, Glycine max
  Coding DNA Sequence Number=SeqID_33316
  Gene Ontology: Mol. function=protein disulfide oxidoreductase activity; Cellular component=chloroplast; Biological process=cell redox homeostasis
  Homolog annotation: Hit_ID=Q1SKN3; Match level="QueryCoverage=74%, HitCoverage=44%, E-value=2e-38, Identity=67%"; Hit description =Glutaredoxin; Glutaredoxin-related protein
  Subcellular localization annotation: CTP_CleavageSite=58; ConfidenceScore=5.67e-01
MATLNLSSLQALSSHRLCSSFPQNTPTPSFNFQLKPSINPRPISLKPYVSEKPRARVVALAVKSLGDTEALAVSPENDGPAGELPSGAGVYAVYDTNGDVQFIGLSRNIAASVAAHWKSVPELCGSVKMLRKGGDALQTSFCYQRPFATDTQTCLEVEFWRRKGTPYILIVN

SEQ ID NO: 150095 - protein, 71 aa, Glycine max
  Coding DNA Sequence Number=SeqID_33317
  Subcellular localization annotation: CTP_CleavageSite=65; ConfidenceScore=5.42e-01
MDLKPFDPSRVLALIALQPSTTMPPLLLSKTIVRRSFVNLTSYSLVFVLSLLAIGFDSTPIFGFFATVEQG

SEQ ID NO: 150096 - protein, 197 aa, Glycine max
  Coding DNA Sequence Number=SeqID_33318
  Gene Ontology: Mol. function=protein disulfide oxidoreductase activity; Cellular component=chloroplast; Biological process=cell redox homeostasis
  Homolog annotation: Hit_ID=Q1SKN3; Match level="QueryCoverage=79%, HitCoverage=53%, E-value=5e-75, Identity=85%"; Hit description =Glutaredoxin; Glutaredoxin-related protein
  Pfam annotation: Domain name=Glutaredoxin; Domain location=79-146; Score=92.7; E_value=1.1e-24; Accession=PF00462.14; Description =Glutaredoxin
AGVVDEPDRETLTQAWKSWMEEYIKDSGKVPPGNESGNATWVRQAPKRKPDLRLTPGRRMQLTVPLENLIDGLVKENKVVAFIKGPRSAPLCGFSQRVIAILENEGVDYESVNVLDEEYNYELRETLKKYSNWPTFPQIFVDGELVGGCDILTSMYEKGITGFQTVEVKAVTNMKGKKLGGSGGDRRFVDLDGGGWG

SEQ ID NO: 150097 - protein, 158 aa, Glycine max
  Coding DNA Sequence Number=SeqID_33319
  Gene Ontology: Mol. function=oxidoreductase activity
  Homolog annotation: Hit_ID=Q9LSQ5; Match level="QueryCoverage=70%, HitCoverage=77%, E-value=5e-21, Identity=40%"; Hit description=1,4 -benzoquinone reductase-like; Trp repressor binding protein-like
MELENGTVMAAREKKLHGEEGDQRTTQEDKTYYSLYGHVERLAEEIKKGTNCVEGVEAKLWQMQAEVYGKHNNLQANLLESSTAPDPKILRNINDEKLWDEYAWLTAIAQPVHHGMLFVPIGYTFSAGMFEMEELKGGSPYGSVVQELMLVMVQNNQA

SEQ ID NO: 150098 - protein, 144 aa, Glycine max
  Coding DNA Sequence Number=SeqID_33320
  Gene Ontology: Mol. function=structural constituent of ribosome; Cellular component=small ribosomal subunit; Biological process =translation
  Homolog annotation: Hit_ID=Q1S8Y4; Match level="QueryCoverage=78%, HitCoverage=47%, E-value=1e-56, Identity=100%"; Hit description =Ribosomal protein S3
  Pfam annotation: Domain name=KH_2; Domain location=45-102; Score =45.9; E_value=1.4e-10; Accession=PF07650.7; Description=KH domain
MATQMSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAKIAVAVTQNLPRKTLYCIHSCIPGDRVLKP

SEQ ID NO: 150099 - protein, 217 aa, Glycine max
  Coding DNA Sequence Number=SeqID_33321
  Homolog annotation: Hit_ID=Q1RWU1; Match level="QueryCoverage=20%, HitCoverage=11%, E-value=2e-08, Identity=50%"; Hit description =Resistance-like protein HAAS-2-related
  Pfam annotation: Domain name=DUF1723; Domain location=56-105; Score =28.1; E_value=3.1e-05; Accession=PF08330.1; Description=Protein of unknown function (DUF1723)
MVLKRSVENNAPSLCETTPPITSARRQQEATHVAKDVQYMDHAANEERPELKLSSHGRKGLISTFAERWHKKTSIFHLTVQEVTITFNDVASLLHLPMTSAFYSFEALHMDKVVLLLVELLEVSVDESGSYAWGVASLVHMYNNLNDASKSSARQLAGYITLLQCWIYEHFPSVTESIAAKDYDERKPRACCWNSGKALSVSTYRKRIDRLTSDVVC

SEQ ID NO: 150100 - protein, 102 aa, Glycine max
  Coding DNA Sequence Number=SeqID_33322
MRHIACAPSNIMERFIVSALVEVKVLWRYVGKWWLWWWLLMVEMNEDQWMHDSIMSEEVDMNEQKEDEAGVKSKHVDYSDAFNTSQVFATCDDVLNWVRAVA

SEQ ID NO: 150101 - protein, 118 aa, Glycine max
  Coding DNA Sequence Number=SeqID_33323
MYFCGRARRSSRVDKSEAFAPTYPPSKRKSDLRSSFEGESSESFYLEGDHFKALDLKNDPFTWRENGLNDRLKLVKNGRKETEIERNKNESQETRNELKVSDLETYPLKNEERMKNGE

SEQ ID NO: 150102 - protein, 232 aa, Glycine max
  Coding DNA Sequence Number=SeqID_33324
  Homolog annotation: Hit_ID=Q2HRE1; Match level="QueryCoverage=72%, HitCoverage=44%, E-value=1e-42, Identity=42%"; Hit description =Lipopolysaccharide-modifying protein
  Pfam annotation: Domain name=DUF821; Domain location=78-232; Score= -19.3; E_value=2.6e-18; Accession=PF05686.3; Description=Arabidopsis thaliana protein of unknown function (DUF821)
  Subcellular localization annotation: CTP_CleavageSite=59; ConfidenceScore=5.44e-01
MFLTATGARNCGLTRHREIPKVRMFSGASSSKSAQSTTPYGTSPFTVSIRKPIAPLNCTAYNLTGTCPTNLQDHQSTPATATCPDYFRWIHEDLRPWARTGITQDMVERAKQTANFRLIILKGRAYLETYSRPYQTRDVFSIWGILQLLRRYPGKIPDLELMFDCVDWPVVLSDRYNGPNVEQPTPLFRAEINIKPWHILLGELKEGTTRIPWLNREPYAYWKGNPAVAQTR

SEQ ID NO: 150103 - protein, 235 aa, Glycine max
  Coding DNA Sequence Number=SeqID_33325
  Homolog annotation: Hit_ID=Q9SWB3; Match level="QueryCoverage=85%, HitCoverage=37%, E-value=2e-69, Identity=71%"; Hit description=Seed maturation protein PM39
MSRVKKKRKVSGKDTLESSGSQSWKSKVSGNQTSSVGVEQDKGVSVKDYLVDKLRPGDEDGALSEVISETLHKKELPPVEVTEEGVRKVVSDAVHKREDNPERRMEHQRILGKVTESEEVKRRLGGESVVTEKKYQEMYVNSPGKGVVDKFKGMVGTWFTNPAENQSSQVFRFSYLGRSVLRNKRNYDYQSATLILNLWFAWAEDSSMNYEAGRAEVEQVNQGAAGERRQQESSN

SEQ ID NO: 150104 - protein, 58 aa, Glycine max
  Coding DNA Sequence Number=SeqID_33326
MGDLASHCHERVTNTKRKQEPACAREAHMQSPSDISECALSRKVQAKPHMRTRPPHTG

SEQ ID NO: 150105 - protein, 103 aa, Glycine max
  Coding DNA Sequence Number=SeqID_33327
MIMKGQDIYSSQDEVTTSPSSSESEEAKGEESSEEIDSQEERDLLMVRRLLGGQSCHLAGDIFLLDIGYKVAPTNVDEKKLGLRQLNKPSAAINRKQTLSMSA

SEQ ID NO: 150106 - protein, 116 aa, Glycine max
  Coding DNA Sequence Number=SeqID_33328
IFSECVFWIILEVGISFIFGSVATCPFAGERGEAHRCAFQRRKDAWSRLQRLFVENVRKTEGNRSKRIFQVRELYLRLRKVDKSGALAPTYLPSKRKSDLRSSFLRVNQAILFTWK

SEQ ID NO: 150107 - protein, 118 aa, Glycine max
  Coding DNA Sequence Number=SeqID_33329
  Gene Ontology: Mol. function=zinc ion binding; Cellular component =intracellular
  Homolog annotation: Hit_ID=Q8LHS7; Match level="QueryCoverage=80%, HitCoverage=17%, E-value=3e-24, Identity=55%"; Hit description =Putative histone deacetylase
MKESPGIFPRRCYSIPAREITPEELITDVFIMTNVSDCSYFTSDTYANEHSALAARLAARLCVDLASAIVSRRAKNGFVLVKPPGHHAGVRQAMGFCLHNNGVERKHRHWRTSCMHRY

SEQ ID NO: 150108 - protein, 77 aa, Glycine max
  Coding DNA Sequence Number=SeqID_33330
MKKRVTEMCRSIKRFSKRRPEFRDTTGSSGTSPETAKTQKKDDRARERARKRVRVLGFGEKCVSERETEVNERNHRK

SEQ ID NO: 150109 - protein, 57 aa, Glycine max
  Coding DNA Sequence Number=SeqID_33331
MEILILGQGLWWFEVLGQKACRMAGHDAYLAFSAIKDRKVIGKVMIVFDEKTTRSKL

SEQ ID NO: 150110 - protein, 216 aa, Glycine max
  Coding DNA Sequence Number=SeqID_33332
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=3e-25, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=PT; Domain location=103-138; Score=7.9; E_value=0.097; Accession=PF04886.3; Description=PT repeat
MTAHRNESISYFLIRVDPWVLVPSPSKNYTFLPLEDYMSSPSEDYTSSLSEDYTPCLQRTTCPRLQRTTPLAFRGLHPSPSEDYTSSPSEGCTPSPSEGRMSSPSEGRTSSPSEGYTPLPSEGYTSSPSEGYTSSPLEGGTSSPLEDCMPSPLEGRTPSPSKGYMPSLSEGYTPSPSEGYTSLPSEDCMPSPSEGCTPSPSKGHTPSPLEGRTPSS

SEQ ID NO: 150111 - protein, 71 aa, Glycine max
  Coding DNA Sequence Number=SeqID_33333
MKERTRHRRVIVGHPLPSSLPFVVVVVVNGRTHDFEVRELVCCSCLSRCSSHLGFQTQGLGLGWVSPKQPM

SEQ ID NO: 150112 - protein, 389 aa, Glycine max
  Coding DNA Sequence Number=SeqID_33334
  Gene Ontology: Mol. function=nutrient reservoir activity; Cellular component=outer membrane-bounded periplasmic space
  Homolog annotation: Hit_ID=Q7N4K6; Match level="QueryCoverage=99%, HitCoverage=99%, E-value=0.0, Identity=80%"; Hit description=Similar to oxalate decarboxylase OxdC protein of Bacillus subtilis
  Pfam annotation: Domain name=Cupin_1; Domain location=233-369; Score =71.4; E_value=2.9e-18; Accession=PF00190.13; Description=Cupin
  Pfam annotation: Domain name=Cupin_1; Domain location=55-197; Score =48.2; E_value=2.8e-11; Accession=PF00190.13; Description=Cupin
  Pfam annotation: Domain name=Cupin_2; Domain location=266-341; Score =31.4; E_value=3.1e-06; Accession=PF07883.2; Description=Cupin domain
  Pfam annotation: Domain name=Cupin_2; Domain location=86-160; Score =42.9; E_value=1.1e-09; Accession=PF07883.2; Description=Cupin domain
  Pfam annotation: Domain name=Cupin_3; Domain location=90-165; Score= -7.6; E_value=0.1; Accession=PF05899.3; Description=Protein of unknown function (DUF861)
  Pfam module annotation: Pfam domain module=Cupin_1::Cupin_1::Cupin _2::Cupin_2::Cupin_3; Domain location=233-369::55-197::266-341::86 -160::90-165
MLSRRDILKVSAVSAAAAGMIGGIVKNAAADDHRNIVPPSSYQPPADAQHLYKYKFTDSKKRSLPSGWAREATVEQFPISEGVAGVDMTLEPGGVRELHWHAIAAEWAFMLEGHARITILDPEGKCEVADFGPGDVWYFPKGYGHSIQALADGAHFILAFDNGHFSEFGTFSITDWVAHMPKEVLEKSVNMPAAVFSKAKQSEAYIVDGAVPPTLPLPKNDGGLNNTPLTHRYELMKQKPFFENDAGSVHLVSSKEFPISTTMTGIIEIVKPGAIRELHWHPNANEWQYYIAGKGRMTVFSSHGHAQTEEYAPSDVGYVPQGFGHYIENIGDEDLKVLIVMDNGIYQDISLSDWLAKTPAYLLADNFNNQIEDWQDRPKDKRVMSRRSR

SEQ ID NO: 150113 - protein, 74 aa, Glycine max
  Coding DNA Sequence Number=SeqID_33335
MVVDRGSGRHQKWMISMNNGLSCVADAWIHYLGDCHLKAGDEVIFFYNIDQHLWEVLYRKQVKWDDTEDEADSP

SEQ ID NO: 150114 - protein, 175 aa, Glycine max
  Coding DNA Sequence Number=SeqID_33336
MPTDTREIETALCIPGRGFILNAEGRPGKILRKDLTTLAQVWSVLSYSNLAPNSHTSDLTVDRARLIFGLVTQLDMNVGALISGQITSMAQSNSSRLGFPTLITTLCKIRGVTSDSLGARRPRARLVETPSTSAAAHPASTSAAPPPARITTAPSTPPTADFQHFKAMLRSIHQG

SEQ ID NO: 150115 - protein, 132 aa, Glycine max
  Coding DNA Sequence Number=SeqID_33337
  Gene Ontology: Mol. function=nucleic acid binding; Biological process= RNA-dependent DNA replication
AVIQKILPPKHKDPGSVTIPCSIGEVNVEKALIDLGANINLLPLSIRVGQGKAFYFPADFVVMDISEDIDIPVILGRPFMLTASFIVDMGKRKLELGFEDQKIDFDLFVEDKHAPEHNVCLQVMGEGQKVLK

SEQ ID NO: 150116 - protein, 72 aa, Glycine max
  Coding DNA Sequence Number=SeqID_33338
MYPEKVLDSFWKSRSDMMSFPPSPPHYATATSIARSPFLLILDLLEEALCAFDGLGFWEDKGYQWEVEEEPE

SEQ ID NO: 150117 - protein, 105 aa, Glycine max
  Coding DNA Sequence Number=SeqID_33339
MTRSETKQSVDTLQQMVVDILNKTQVEKDEGPSGEGKRPKWRRMKAQAEKDEGQRFLAEPILDLSSYLPKTSQGRLLACHIIDDYGHILLKRTLLVYVSLPNQIL

SEQ ID NO: 150118 - protein, 1034 aa, Glycine max
  Coding DNA Sequence Number=SeqID_33340
  Gene Ontology: Mol. function=protein binding; Cellular component =integral to membrane; Biological process=defense response to fungus
  Homolog annotation: Hit_ID=Q1T2W9; Match level="QueryCoverage=98%, HitCoverage=90%, E-value=0.0, Identity=53%"; Hit description=Leucine- rich repeat; Leucine-rich repeat, cysteine-containing type
  Pfam annotation: Domain name=LRRNT_2; Domain location=29-74; Score =45.5; E_value=1.8e-10; Accession=PF08263.3; Description=Leucine rich repeat N-terminal domain
  Pfam annotation: Domain name=LRR_1; Domain location=104-126; Score =14.2; E_value=0.46; Accession=PF00560.23; Description=Leucine Rich Repeat
  Pfam annotation: Domain name=LRR_1; Domain location=128-150; Score =9.9; E_value=4; Accession=PF00560.23; Description=Leucine Rich Repeat
  Pfam annotation: Domain name=LRR_1; Domain location=181-203; Score =1.2; E_value=1.7e+02; Accession=PF00560.23; Description=Leucine Rich Repeat
  Pfam annotation: Domain name=LRR_1; Domain location=208-230; Score =12.4; E_value=1.3; Accession=PF00560.23; Description=Leucine Rich Repeat
  Pfam annotation: Domain name=LRR_1; Domain location=232-254; Score =4.6; E_value=40; Accession=PF00560.23; Description=Leucine Rich Repeat
  Pfam annotation: Domain name=LRR_1; Domain location=256-278; Score =7.5; E_value=11; Accession=PF00560.23; Description=Leucine Rich Repeat
  Pfam annotation: Domain name=LRR_1; Domain location=280-302; Score =3.4; E_value=67; Accession=PF00560.23; Description=Leucine Rich Repeat
  Pfam annotation: Domain name=LRR_1; Domain location=304-326; Score =14.1; E_value=0.5; Accession=PF00560.23; Description=Leucine Rich Repeat
  Pfam annotation: Domain name=LRR_1; Domain location=328-350; Score =20.6; E_value=0.0057; Accession=PF00560.23; Description=Leucine Rich Repeat
  Pfam annotation: Domain name=LRR_1; Domain location=352-373; Score =9.3; E_value=5.3; Accession=PF00560.23; Description=Leucine Rich Repeat
  Pfam annotation: Domain name=LRR_1; Domain location=375-398; Score =19.7; E_value=0.011; Accession=PF00560.23; Description=Leucine Rich Repeat
  Pfam annotation: Domain name=LRR_1; Domain location=400-422; Score =8.5; E_value=7.3; Accession=PF00560.23; Description=Leucine Rich Repeat
  Pfam annotation: Domain name=LRR_1; Domain location=424-444; Score =10.6; E_value=2.9; Accession=PF00560.23; Description=Leucine Rich Repeat
  Pfam annotation: Domain name=LRR_1; Domain location=448-470; Score =17.2; E_value=0.06; Accession=PF00560.23; Description=Leucine Rich Repeat
  Pfam annotation: Domain name=LRR_1; Domain location=472-492; Score =8.9; E_value=6.1; Accession=PF00560.23; Description=Leucine Rich Repeat
  Pfam annotation: Domain name=LRR_1; Domain location=496-519; Score =6.7; E_value=16; Accession=PF00560.23; Description=Leucine Rich Repeat
  Pfam annotation: Domain name=LRR_1; Domain location=520-540; Score =7.2; E_value=13; Accession=PF00560.23; Description=Leucine Rich Repeat
  Pfam annotation: Domain name=LRR_1; Domain location=542-562; Score =8.7; E_value=6.8; Accession=PF00560.23; Description=Leucine Rich Repeat
  Pfam annotation: Domain name=LRR_1; Domain location=569-590; Score =8.5; E_value=7.4; Accession=PF00560.23; Description=Leucine Rich Repeat
  Pfam annotation: Domain name=LRR_1; Domain location=592-614; Score =13.9; E_value=0.57; Accession=PF00560.23; Description=Leucine Rich Repeat
  Pfam annotation: Domain name=LRR_1; Domain location=616-637; Score =9.5; E_value=4.8; Accession=PF00560.23; Description=Leucine Rich Repeat
  Pfam annotation: Domain name=LRR_1; Domain location=640-659; Score =11.1; E_value=2.4; Accession=PF00560.23; Description=Leucine Rich Repeat
  Pfam annotation: Domain name=LRR_1; Domain location=661-683; Score =4.9; E_value=35; Accession=PF00560.23; Description=Leucine Rich Repeat
  Pfam annotation: Domain name=LRR_1; Domain location=686-708; Score =7.7; E_value=10; Accession=PF00560.23; Description=Leucine Rich Repeat
  Pfam annotation: Domain name=LRR_1; Domain location=710-729; Score =12.8; E_value=1.2; Accession=PF00560.23; Description=Leucine Rich Repeat
  Pfam annotation: Domain name=LRR_1; Domain location=735-757; Score =13.8; E_value=0.61; Accession=PF00560.23; Description=Leucine Rich Repeat
  Pfam annotation: Domain name=LRR_1; Domain location=759-781; Score =1.1; E_value=1.8e+02; Accession=PF00560.23; Description=Leucine Rich Repeat
  Pfam annotation: Domain name=LRR_1; Domain location=783-805; Score =6.9; E_value=14; Accession=PF00560.23; Description=Leucine Rich Repeat
  Pfam annotation: Domain name=LRR_1; Domain location=807-830; Score =4.5; E_value=41; Accession=PF00560.23; Description=Leucine Rich Repeat
  Pfam annotation: Domain name=LRR_1; Domain location=833-856; Score =7.0; E_value=14; Accession=PF00560.23; Description=Leucine Rich Repeat
  Pfam annotation: Domain name=LRR_1; Domain location=908-930; Score =6.8; E_value=15; Accession=PF00560.23; Description=Leucine Rich Repeat
  Pfam annotation: Domain name=LRR_1; Domain location=932-954; Score =13.3; E_value=0.9; Accession=PF00560.23; Description=Leucine Rich Repeat
  Pfam annotation: Domain name=LRR_1; Domain location=956-978; Score =19.3; E_value=0.014; Accession=PF00560.23; Description=Leucine Rich Repeat
  Pfam annotation: Domain name=LRR_1; Domain location=980-1002; Score =8.7; E_value=6.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1::LRR_1; Domain location=29 -74::104-126::128-150::181-203::208-230::232-254::256-278::280 -302::304-326::328-350::...
  Pfam module annotation: Domain location=352-373::375-398::400 -422::424-444::448-470::472-492::496-519::520-540::542-562::569 -590::592-614::616-637::640-659::661-683::686-708::710-729::735 -757::759-781::783-805::807-830::...
  Pfam module annotation: Domain location=833-856::908-930::932 -954::956-978::980-1002
MELVASLLVMSFYWLCLGNHIIVVSGLCLGDQKSLLLQFKNNLTFTNMADRNSSRLKSWNASDDCCRWMGVTCDNEGHVTALDLSRESISGGFGNSSVLFNLQHLQSLNLASNNFNSVIPSGFNNLDKLTYLNLSYAGFVGQIPIEIFQLTRLITLHISSFFQHLKLEDPNLQSLVQNLTSIRQLYLDGVSISAPGYEWCSALLSLRDLQELSLSRCNLLGPLDPSLARLESLSVIALDENDLSSPVPETFAHFKSLTMLRLSKCKLTGIFPQKVFNIGTLSLIDISSNNNLHGFFPDFPLRGSLQTLRVSKTNFTRSIPPSIGNMRNLSELDLSHCGFSGKIPNSLSNLPKLSYLDMSHNSFTGPMTSFVMVKKLTRLDLSHNDLSGILPSSYFEGLQNPVHIDLSNNSFTGRTPSILFTLPSLQNLWLSDNLFTQLEEFMNVTSSRLVTLYMSNNNLSGTIPSSLFALPLLQEIRLSHNHLSQLDEFINVSSSILDTLDLSSNNLSGPFPTSIFQISTLSVLRLSSNKFNGLVHLNKLKSLTELELSYNNLSVNVNFTNVGPSSFPSISYLNMASCNLKTFPGFLRNLSTLMHLDLSNNQIQGIVPNWIWKLPDLYDLNISYNLLTKLEGPFQNLTSNLDYLDLHYNKLEGPIPVFPKDAMFLDLSSNNFSSLIPRDIGNYLSQTYFLSLSNNSLHGSIPESICNASSLQMLDLSINNIAGTIPPCLMIMSETLQVLNLKNNNLSGSIPDTVPASCILWSLNLHGNLLDGPIPNSLAYCSMLEVLDVGSNQISGGFPCILKEISTLRILVLRNNKFKGSLRCSESNKTWEMLQIVDIAFNNFSGKLPGKYFATWKRNLSLLEKYEGGLMFIKKLFYESEDSRVYYADSLTLAFKGRQVEFVKIYTILTSIDASSNHFEGPIPKDLMDFEELRVLNLSNNALSCEIPSLMGNLRNLESLDLSQNSLSGEIPMQLTTLYFLAVLNLSFNHLVGKIPTGAQFILFDNDSYEGNEGLYGCPLSKNADDEEPETRLY

SEQ ID NO: 150119 - protein, 50 aa, Glycine max
  Coding DNA Sequence Number=SeqID_33341
MIIGELEGATKPRPVPKDLDHYLKGSSKLENFKSVRLICKLYGRFNSRYH

SEQ ID NO: 150120 - protein, 653 aa, Glycine max
  Coding DNA Sequence Number=SeqID_33342
  Gene Ontology: Mol. function=protein binding; Cellular component =integral to membrane; Biological process=protein amino acid phosphorylation
  Homolog annotation: Hit_ID=Q1T2W9; Match level="QueryCoverage=95%, HitCoverage=84%, E-value=1e-156, Identity=34%"; Hit description =Leucine-rich repeat; Leucine-rich repeat, cysteine-containing type
  Pfam annotation: Domain name=LRRNT_2; Domain location=21-66; Score =18.8; E_value=0.0093; Accession=PF08263.3; Description=Leucine rich repeat N-terminal domain
  Pfam annotation: Domain name=LRR_1; Domain location=120-142; Score =10.8; E_value=2.8; Accession=PF00560.23; Description=Leucine Rich Repeat
  Pfam annotation: Domain name=LRR_1; Domain location=173-195; Score =1.2; E_value=1.7e+02; Accession=PF00560.23; Description=Leucine Rich Repeat
  Pfam annotation: Domain name=LRR_1; Domain location=200-222; Score =12.4; E_value=1.3; Accession=PF00560.23; Description=Leucine Rich Repeat
  Pfam annotation: Domain name=LRR_1; Domain location=224-246; Score =4.6; E_value=40; Accession=PF00560.23; Description=Leucine Rich Repeat
  Pfam annotation: Domain name=LRR_1; Domain location=248-270; Score =10.1; E_value=3.7; Accession=PF00560.23; Description=Leucine Rich Repeat
  Pfam annotation: Domain name=LRR_1; Domain location=272-294; Score =2.2; E_value=1.1e+02; Accession=PF00560.23; Description=Leucine Rich Repeat
  Pfam annotation: Domain name=LRR_1; Domain location=296-318; Score =14.5; E_value=0.39; Accession=PF00560.23; Description=Leucine Rich Repeat
  Pfam annotation: Domain name=LRR_1; Domain location=320-342; Score =20.6; E_value=0.0057; Accession=PF00560.23; Description=Leucine Rich Repeat
  Pfam annotation: Domain name=LRR_1; Domain location=344-365; Score =8.0; E_value=9.2; Accession=PF00560.23; Description=Leucine Rich Repeat
  Pfam annotation: Domain name=LRR_1; Domain location=367-390; Score =19.5; E_value=0.012; Accession=PF00560.23; Description=Leucine Rich Repeat
  Pfam annotation: Domain name=LRR_1; Domain location=392-414; Score =13.5; E_value=0.78; Accession=PF00560.23; Description=Leucine Rich Repeat
  Pfam annotation: Domain name=LRR_1; Domain location=416-436; Score =10.6; E_value=2.9; Accession=PF00560.23; Description=Leucine Rich Repeat
  Pfam annotation: Domain name=LRR_1; Domain location=440-462; Score =15.4; E_value=0.21; Accession=PF00560.23; Description=Leucine Rich Repeat
  Pfam annotation: Domain name=LRR_1; Domain location=464-484; Score =7.6; E_value=11; Accession=PF00560.23; Description=Leucine Rich Repeat
  Pfam annotation: Domain name=LRR_1; Domain location=488-511; Score =7.0; E_value=14; Accession=PF00560.23; Description=Leucine Rich Repeat
  Pfam annotation: Domain name=LRR_1; Domain location=515-531; Score =8.4; E_value=7.8; Accession=PF00560.23; Description=Leucine Rich Repeat
  Pfam annotation: Domain name=LRR_1; Domain location=542-563; Score =8.0; E_value=9; Accession=PF00560.23; Description=Leucine Rich Repeat
  Pfam annotation: Domain name=LRR_1; Domain location=565-587; Score =13.9; E_value=0.57; Accession=PF00560.23; Description=Leucine Rich Repeat
  Pfam annotation: Domain name=LRR_1; Domain location=589-610; Score =7.4; E_value=12; Accession=PF00560.23; Description=Leucine Rich Repeat
  Pfam annotation: Domain name=LRR_1; Domain location=613-632; Score =11.6; E_value=1.9; Accession=PF00560.23; Description=Leucine Rich Repeat
  Pfam annotation: Domain name=LRR_1; Domain location=634-653; Score =2.4; E_value=1e+02; Accession=PF00560.23; Description=Leucine Rich Repeat
  Pfam annotation: Domain name=LRR_1; Domain location=96-118; Score =14.2; E_value=0.46; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=21-66::120 -142::173-195::200-222::224-246::248-270::272-294::296-318::320 -342::344-365::367-390::392-414::416-436::440-462::464-484::488 -511::515-531::542-563::565-587:...
  Pfam module annotation: =:589-610::613-632::634-653::96-118
MTVRTKLRTKTQKVKNAEVKWKTQWQTETAFKNNLTFTNMADRNSSRLKSWNASDDCCRWMGVTCDNEGHVTALDLSRESISGGFGNSSVLFNLQHLQSLNLASNNFNSVIPSGFNNLDKLTYLNLSYAGFVGQIPIEISQLTRLITLHISSFLQHLKLEDPNLQSLVQNLTSIRQLYLDGVSISAPGYEWCSALLSLRDLQELSLSRCNLLGPLDPSLARLESLSVIALDENDLSSPVPETFAHFKSLTMLRLSNCKLTGIFPQKVFNIGALSLIDISSNNNLHGFFPDFPLRGSLQTLRVSKTNFTGSIPPSIGNMRNLSELDLSHCGFSGKIPNSLSNLPKLNYLDMSHNSFTGPMISFVMVKKLNRLDLSHNNLSGILPSSYFEGLQNLVHIDLSNNSFTGRTPSILFTLPSLQNLWLSDNLFTQLEEFMNVTSSRLVTLYMSNNNLAGTIPSSLFALPLLQEIRLSRNHLSQLDEFINVSSSILDTLDLSSNDLSGPFPTSIFQLNKLKSLTELDLSYNKLSVNGNFTIVGPSSFPSILYLNIASCNLKTFPGFLRNLSTLMHLDLSNNQIQGIVPNWIWKLPDLYDLIISYNLLTKLEGPFPNLTSNLDYLDLRYNKLEGPIPVFPKDAMFLDLSNNNFSSLIPRDI

SEQ ID NO: 150121 - protein, 317 aa, Glycine max
  Coding DNA Sequence Number=SeqID_33343
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=78%, E-value=1e-149, Identity=69%"; Hit description =Photosystem II P680 chlorophyll A apoprotein
  Pfam annotation: Domain name=PSII; Domain location=1-317; Score =467.5; E_value=1.6e-137; Accession=PF00421.9; Description =Photosystem II protein
MHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVESVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYAR

SEQ ID NO: 150122 - protein, 221 aa, Glycine max
  Coding DNA Sequence Number=SeqID_33344
  Gene Ontology: Mol. function=protein binding; Cellular component =integral to membrane; Biological process=protein amino acid phosphorylation
  Homolog annotation: Hit_ID=Q1T2W9; Match level="QueryCoverage=98%, HitCoverage=72%, E-value=1e-59, Identity=50%"; Hit description =Leucine-rich repeat; Leucine-rich repeat, cysteine-containing type
  Pfam annotation: Domain name=LRR_1; Domain location=32-54; Score =17.0; E_value=0.068; Accession=PF00560.23; Description=Leucine Rich Repeat
  Pfam annotation: Domain name=LRR_1; Domain location=56-78; Score =12.1; E_value=1.6; Accession=PF00560.23; Description=Leucine Rich Repeat
  Pfam annotation: Domain name=LRR_1; Domain location=8-30; Score=6.8; E_value=15; Accession=PF00560.23; Description=Leucine Rich Repeat
  Pfam annotation: Domain name=LRR_1; Domain location=80-102; Score =12.0; E_value=1.6; Accession=PF00560.23; Description=Leucine Rich Repeat
  Pfam module annotation: Pfam domain module=LRR_1::LRR_1::LRR_1::LRR _1; Domain location=32-54::56-78::8-30::80-102
MLIGKYIILTSIDASSNHFEGPIPKDLMDFEELRVLNLSNNALSGEIPSLMGNLRNLESLDLSQYSLSGEIPMQLTNLHCLEVLDLSFNHLVGKIPTGAQFSTFENDSYEGNEGLYGLPLSKKADDEEPEPRLYGSPLSNNADDEEAEPRLAYTIDWNLNSVGFGLVFGHGIVFGPLLVWKQWSVWYWQLVHKVLCRIFAQMYLEYVTGGGHTYTTLRWGH

SEQ ID NO: 150123 - protein, 102 aa, Glycine max
  Coding DNA Sequence Number=SeqID_33345
MVPLLEHGCQSGKGIDHLILLSRNVVKGYVIEVLYQFPDVGLVRLSPIYHEQLDLCRNLPFDGRATRGLTGASSMGGRCAESPPMFIRGKRRKNRKGVVYEL

SEQ ID NO: 150124 - protein, 454 aa, Glycine max
  Coding DNA Sequence Number=SeqID_33346
  Homolog annotation: Hit_ID=Q1SCS1; Match level="QueryCoverage=48%, HitCoverage=49%, E-value=1e-49, Identity=65%"; Hit description =Transketolase, C-terminal-like
VDKDALVEVDTGSGSHSGTKDIIEFEASLCGHELKAGMGLVAAAEVFEAHRISAKEFRSSTLSIIKNENLVLKFRERYLLWEKVAPLVLGITVFGLDLLIEPKDTIPVGLDDVVKAKNDAPGPASSGRRWRLWPMPFRRVKTIDHTNSVSSEEVFVDSKSDFQTSIVEPSPTSAMPISKFITISQKWMLQGRILDSHTSLSMCQKMSRSMDGEHWSRHTPKGTKLEAEWNAKFVEYEKKYNEEAAKLKAIIIGKLPGRKRALLPIEHLASFRAMPNTFMLRPADGNDTAGSYKVVVVNKKRPSIVALCWQKLTQLPRTSIEGVEKGGYLISDNSSSNKPDVILIGTGSKLEIVVAFAEDLWKEGKSDEFNESVLPASITARVSIEAGSTFGCHNRAFAKRNTPGLSVRKNPEEDELYRFAKRTASVHPLSEKGALSQKSLTCTKRSICVLSARA

SEQ ID NO: 150125 - protein, 144 aa, Glycine max
  Coding DNA Sequence Number=SeqID_33347
MSNKALGFPALVTGLCQSYRVPVPPARSCHRDIGIAPTKTPSGPGEVQQGPGGSCPQDTQWTRRSPTGSWSCQALITGLCQFYGVPVALSKVIKPPTNRAFIKKYCVPRQAQGETPQQPGDGRQRATDAPPSPLEFTSAHPQKG

SEQ ID NO: 150126 - protein, 470 aa, Glycine max
  Coding DNA Sequence Number=SeqID_33348
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=93%, HitCoverage=48%, E-value=1e-137, Identity=59%"; Hit description =Kinesin-like protein
  Pfam annotation: Domain name=Arm; Domain location=201-241; Score =13.2; E_value=0.27; Accession=PF00514.13; Description=Armadillobeta -catenin-like repeat
  Pfam annotation: Domain name=Arm; Domain location=242-283; Score =29.3; E_value=1.3e-05; Accession=PF00514.13; Description =Armadillobeta-catenin-like repeat
  Pfam annotation: Domain name=Arm; Domain location=284-325; Score =18.5; E_value=0.024; Accession=PF00514.13; Description=Armadillobeta- catenin-like repeat
  Pfam annotation: Domain name=Arm; Domain location=326-366; Score =18.5; E_value=0.025; Accession=PF00514.13; Description=Armadillobeta- catenin-like repeat
  Pfam annotation: Domain name=Arm; Domain location=376-416; Score=3.0; E_value=5.2; Accession=PF00514.13; Description=Armadillobeta-catenin -like repeat
  Pfam module annotation: Pfam domain module=Arm::Arm::Arm::Arm::Arm; Domain location=201-241::242-283::284-325::326-366::376-416
MEIERRFFDIKILEIEATGLQSGCGFNQVPNYKNCSFKERLKCQMEYMESVKQLEQKLVSNEKRHGSNYFVDGCGEGPTPSSEDEVSEIRKLFENECNRRKAAEAEVEHLKILLGKNTHTQAGGDAEVIKVHSILEDEVNQKKKLEEEIIILRSQLLQLNFEAEQMKRCLGSERSVNASSAMDSSMSQVRHSQLKDTGNGQKASVATLFEQVGLQKILSLLDSDDPLVQIHAVKMVANLAAEEVNQKGIVEAGGLSSLLMLLRRYEDETVRRVAAGAIANLAMHEANQELIMAEGGITLLSMTASDAEEPQTLRMVAGAIANLCGNDKILMKLRSQGGIKALLGVVRCGHPDVLSQVARGIANFAKCESRASSQGIKSGTSFLIEDGALPWIVHNANNEAAPIRRHIELALCHMAQQEVNAKDMINGGALWELVRISRDCTREDIRNLARRTLTSILPFKSELRRLRIDV

SEQ ID NO: 150127 - protein, 52 aa, Glycine max
  Coding DNA Sequence Number=SeqID_33349
MVPIRWGIKDSTDGNNISLRLRAKSIHKGGNFEIMKATSIMSGKTIPFNFMS

SEQ ID NO: 150128 - protein, 187 aa, Glycine max
  Coding DNA Sequence Number=SeqID_33350
MVQISMRCLYMSSNLPSLDDEGVDNHAMSPVWIIMRCLRVSSDLSSLDDEDPDVSENGADDHIVLCVSLDLLSSDDEGADNHQVSLHVSSDFPSSDDEDDEGADNHEVSPCVIGLPVSRVQITIGCLSVSSDLPSLDDKGADNHTITMSCLRVSSDLPSPDDKGADNHKGVGNHEVSTHVIELAISG

SEQ ID NO: 150129 - protein, 157 aa, Glycine max
  Coding DNA Sequence Number=SeqID_33351
MAQLISDAIHYLQGSRPQDTQWTRRSPTGPWGFQLWLWASINPTGCLFPPSKFYGVPIAPNKVIRPPINWAFIKKYCTPQAGAGRDTTVAWEWPVASNRRTAATSRAHQLIYKGLSIAYDPWQTIRRPSPKPKVSKSTRSVTDKSSRVQLKMLKKRY

SEQ ID NO: 150130 - protein, 105 aa, Glycine max
  Coding DNA Sequence Number=SeqID_33352
MLPRCKLSSTKSCANAIEAFHRTLGGRMFKHENQGNGDNVACPIISECTIGLGPSPTTPQFIKNKQQSKDKSLTFFSKYMQFRAPKYINGKLESPRMRYLVVGDE

SEQ ID NO: 150131 - protein, 57 aa, Glycine max
  Coding DNA Sequence Number=SeqID_33353
  Subcellular localization annotation: CTP_CleavageSite=22; ConfidenceScore=5.17e-01
MATPPYGSSPVMTCWRASYGTTASMNSRYGTAGSYIALNVVAFQAFAPFIMFISKRK

SEQ ID NO: 150132 - protein, 77 aa, Glycine max
  Coding DNA Sequence Number=SeqID_33354
MVEVKAMLLIGGIPVIIGVVSHQSGCWSSEASWEDASEEGMLWKKYFDERGFMITLYTLINPRIPKCMWSMIDRLPC

SEQ ID NO: 150133 - protein, 54 aa, Glycine max
  Coding DNA Sequence Number=SeqID_33355
MTKVLSELRGLRSYVGERFDSLDTRFAGMDIRLTQLEEDDLYCHHQKGGDCRSK

SEQ ID NO: 150134 - protein, 57 aa, Glycine max
  Coding DNA Sequence Number=SeqID_33356
MKGKREKGIKLSYLYGSKGEVVQGLEGISFCFWAKPHLGYYCVAGLGLGRRNRIDDG

SEQ ID NO: 150135 - protein, 137 aa, Glycine max
  Coding DNA Sequence Number=SeqID_33357
  Gene Ontology: Mol. function=monooxygenase activity; Cellular component=integral to membrane; Biological process=electron transport
  Homolog annotation: Hit_ID=Q1S4F4; Match level="QueryCoverage=98%, HitCoverage=39%, E-value=1e-51, Identity=63%"; Hit description=E -class P450, group I
MGWPFLGETIGYLNLYPAVTLGEFMENHIARYGKIYKSNLFGGPTIVLADAGLNRKWSMLVLVGDMHKEMRNISLNFLSNAKLQTHLVKEVERHALLIINSWNNNSTFSALQEAKKFTFNFMEKRIMSLEPGNPETG

SEQ ID NO: 150136 - protein, 94 aa, Glycine max
  Coding DNA Sequence Number=SeqID_33358
  Homolog annotation: Hit_ID=Q7EYZ3; Match level="QueryCoverage=75%, HitCoverage=22%, E-value=7e-17, Identity=61%"; Hit description =Putative placental protein 6
METSWKLSEENELSKNKLVISMRKPETKHRGDLSEDFAFSTFSPEFLRLVIDPIASIFHRMLNGRYDASNDGQGNNMESEPLPGSDSIEASRRR

SEQ ID NO: 150137 - protein, 97 aa, Glycine max
  Coding DNA Sequence Number=SeqID_33359
  Gene Ontology: Mol. function=helicase activity
  Homolog annotation: Hit_ID=Q9ZQR0; Match level="QueryCoverage=96%, HitCoverage=7%, E-value=1e-27, Identity=59%"; Hit description =Putative helicase
MKLDELHADLTKKRILGRVVADMYTIEFRKRGRPHTHLLLFMHPSYKYPTTNDIDKIILAEMPCEHNQKELYNLVKSHMIHGPCGLANNTSPCMKSE

SEQ ID NO: 150138 - protein, 414 aa, Glycine max
  Coding DNA Sequence Number=SeqID_33360
MAKPQNTKPGCFSFSSFLRVFLCAGNGTTPPVHPYHITESEESENAHFTKEKMVVNDNDDIASAPGVVARLMGLDSLPNPKWVVKCGTPDSVPRSRSVNFVDYLLEFDASHVSSHRRVKTSASFREVPSLVQNQKGNGYGNGNNLFVFCMAGDNNMREEQEGRNEMREVEKLRQRKRQKESVSVKKERNQGKKNKKISKLKNEPRRVPSSSKNGSRGRNHHGEVRDFSSVSSNPSKCSSSCSSRHNGASSRTRFNTSLPNKNKKGVVEPNIRNRNQQSVLKEESECSLENHSPVSVVESNDYLFLYGADFLDGSSSLTSKWESPSLLSLGDDVEDNASTNEGYTFIDVNKEAEYYSELMLKLRTLTEQDIRESDCTSKRVRDIESFGDICLMFEHKIFDHLLYEVVNEVIELYC

SEQ ID NO: 150139 - protein, 285 aa, Glycine max
  Coding DNA Sequence Number=SeqID_33361
  Homolog annotation: Hit_ID=Q1SQ46; Match level="QueryCoverage=40%, HitCoverage=18%, E-value=1e-12, Identity=40%"; Hit description=IMP dehydrogenase/GMP reductase
  Pfam annotation: Domain name=Alg14; Domain location=41-170; Score= -47.4; E_value=0.00015; Accession=PF08660.1; Description =Oligosaccharide biosynthesis protein
  Pfam annotation: Domain name=BRF1; Domain location=102-218; Score =27.3; E_value=2.5e-06; Accession=PF07741.3; Description=Brf1-like TBP-binding domain
  Pfam module annotation: Pfam domain module=Alg14::BRF1; Domain location=41-170::102-218
MLPPFLILLRMLFMRKTRHGDEDGEQCSKPLSKRASKPFSTLIILGSGGHIAEMLNLLAVLQKGRFNPRFYIVVATDNMSLQKAQLLENSLAAEYVHDESETLSDIDDEEVDLYIHDEEGKHIKKILWETTYREYLEEQAAKEAAAAASKKAFEAKFENCSEDILAARELAASSTEAVAKSKKEMRQKRAYEAKNTRPAQSAAEAFGQMSNKKREQVAKEAAAAANKKAFEAKFGNCSEDILAARELAASSTEAVAKSRKVRGVHVRGYGVHVRFIVIDHFLAST

SEQ ID NO: 150140 - protein, 83 aa, Glycine max
  Coding DNA Sequence Number=SeqID_33362
MWVSRERFPADFRWEEKEKTDFKQEEKKKRKRRPSARLTSVLPKPMLTSNRLNDHRKRDGMATTSTKYVEELVQEEGSLEDAS

SEQ ID NO: 150141 - protein, 115 aa, Glycine max
  Coding DNA Sequence Number=SeqID_33363
MVFILILDLIFIEAYKLQESISLLLEPIGLMGEAKFLNDVVIGTPGDNPNDSKEPVGMLSADNLTKGISVSEGLITTKKKAFYIGSNGLSTSVMMRGGNTVSLNIDIGSRTIFEG

SEQ ID NO: 150142 - protein, 277 aa, Glycine max
  Coding DNA Sequence Number=SeqID_33364
  Subcellular localization annotation: CTP_CleavageSite=46; ConfidenceScore=5.32e-01
MPFHFKPFAGSSWYYHYPTAQAPFATVPNGASMQYSANRSHPTNARQGQVGQPWMRLASDLHQTDPTDRSSHTITTPRHPSAPLHRTMLTTIAMASARIDGRTMNRYPPPESQMSFFQRVVPLAATLLLSATATAAMAEPVAPAALGTAATQGQAQPRAPAAPQERLRIGLTESDTKLVLPWFVTELTDVVNQGKPLNETGKALGRAPRALARRHRSFKDFSRRCRARNSTSDRTLPAISRWWVINANTGRGGVSDATSNGCRRPAATWSAIAQAGA

SEQ ID NO: 150143 - protein, 95 aa, Glycine max
  Coding DNA Sequence Number=SeqID_33365
  Subcellular localization annotation: CTP_CleavageSite=49; ConfidenceScore=5.40e-01
MWGANTFPARKYNSRAFHLKVRRSRLFRFFRRFPQINVGGDSARIPFVEHASRESRVALPPKGPSAQSSKPSLSMLQSLHQGQLLIMQSLEDVVQ

SEQ ID NO: 150144 - protein, 201 aa, Glycine max
  Coding DNA Sequence Number=SeqID_33366
  Gene Ontology: Mol. function=transition metal ion binding; Cellular component=cytoplasm; Biological process=electron transport
MIRDLRQESFRQAHVPMYNTFQTDSKKPLYPRCKNSLMLLSVVLSLVNVKAKYRWSDKSFSSLLQVVHDMLLHENTLPKSYYQAKKILYPMGMEYQKIHVCPNDCVFYKHEFEEMRKCPRCGVSWYKVKDDDDCSSDENSKKSPQRRCCGIFRSFQGLSVCLPMETMQKTLLCIQIRDQLKESITEKVAQQLMLSFVMPLG

SEQ ID NO: 150145 - protein, 56 aa, Glycine max
  Coding DNA Sequence Number=SeqID_33367
MLRVITLNIFFKNILCAPLHLSKRTASVHPLSKKGALSQKSLMCAKRSIHALSARA

SEQ ID NO: 150146 - protein, 97 aa, Glycine max
  Coding DNA Sequence Number=SeqID_33368
  Homolog annotation: Hit_ID=Q1SFG1; Match level="QueryCoverage=51%, HitCoverage=6%, E-value=5e-17, Identity=84%"; Hit description=AAA ATPase
MKKQGVFEEHRELLKGVSGVFRPRVLTALMGAIQGVPKIKEGYNPATWMLEVTSAGIEASLKVNFTNVYRNSELYRLDSLLNPTNIGTDVILFLFFL

SEQ ID NO: 150147 - protein, 108 aa, Glycine max
  Coding DNA Sequence Number=SeqID_33369
  Homolog annotation: Hit_ID=Q1S8I5; Match level="QueryCoverage=78%, HitCoverage=51%, E-value=2e-11, Identity=34%"; Hit description =Probable Ta11-like non-LTR retroelement protein [imported] -Arabidopsis thaliana
MMNRGVNLIVFKSTILQAWNVKNRVEVRDVARNLFFFRFFDRRDMERVMEAGSWNFDRRLIVLKEMKGDENPKTMYDLPLSRRTKTITKMMGSSWHGTIERRVDLGRL

SEQ ID NO: 150148 - protein, 986 aa, Glycine max
  Coding DNA Sequence Number=SeqID_33370
  Gene Ontology: Mol. function=endonuclease activity; Biological process=proteolysis
  Homolog annotation: Hit_ID=Q9FHU7; Match level="QueryCoverage=84%, HitCoverage=95%, E-value=1e-138, Identity=35%"; Hit description =Similarity to nonsense-mediated mRNA decay trans-acting factors
MEGETTSKKKKANDDHGFIDLIFSWSIEDILNEDMYKNKVQKIDLSFQSIDHYVQSYAYPLLEETRAQLCSSMEIIHQAPYTEVIGIKEAKPLQNKLYNLKIDGWKNRFSHHGGEPYRTLPGDVLILADYKPEAVRDLQRIRRLWCFASTVWTTEDEGDSTSLKVKASKDIDLEERRNKTLFLIFLTNVNPNRRIWGALHMPGNLKLLRQILCSRDDVEECCGCSYPSDALRDDCTYQMLLSELNESQNKAISACLSGLNCNHNSAVKLIWGPPGTGKTRTLGTLLYALLKMKYRVLVCAPTNVAIKEVASRVVDIMKEAHSKESGDLFCSMGEVLLFGYNERLKIGEDVEDVYLDHRVQQLTECFSPYNGFSSSLKSMIGFLEYCVSDYHIYVENMKREGSMAKSFLVFLREGFHSIALPLKAFISILCTHVAMSHLLKHNYQNLLCLNEALESFQDLLLKNTLFSERLEKLFSYKKLPVAYQTISWSFDGDAYQLYEKRTACLNALLAVEHSLQDFMLKKSNNSEIREFCFQTSSLIFSTASGSHKLHSLTMKPLNILVIDEAAMLKDCESIIPLLLPGISHALLFGDECQLSSMVRSNVSNEAGFGRSLFQRLSSLGFPKYLLNMQHRMHPQISSFPNSYFYFNKIQDASNVERIDYVKQYLPGPMFGPYSFINVFEGKEQFDDAGRSYKNMAEVAVVMTILKNLFKAWLNSKHKLSIGIVSPYVGQVVAIQEKLGQIYESHDGFNVDVKSIDGFQGGEKDVIILSTVRTNNRTSLEFISSPQRTNVALTRARHCLWILGNERALASNENVWKAIVLDAKNRKCFFDADQDKELGKAILDAKKASNQLDDLLDTNSVLFKSQLWKVHFSDKFLRSFKRIRSEKIKKNVINLLIRLSSGWRPKRFSVDLSCENSSQMLKQFKVESFYVICSIDIVKASRYIQVLKIWNILPLEDIPQLAKRLDKVFKGYTNEYISRCRCKKKDG

SEQ ID NO: 150149 - protein, 225 aa, Glycine max
  Coding DNA Sequence Number=SeqID_33371
MVDLAYLEFPWGWNFSNVRLHQGWSLSLSSFELGTLGLTKGDLGFCEPYRGLTRELSNLCFEHRALAYMPLVLGGTLWRHGDMLLCICHSSWVAHTRVMMTICSYMHVYYSLWVTHTEGLLRCSCSHATSRGWHGAHVHMPLVVDDMYWSHRHDIHLMHAHENPKAFYCIYGPIYLESSIQCPCGLGLHHYLSLEKDLTSNPEVRSENPFPGHLPMKEHGSSPTQ

SEQ ID NO: 150150 - protein, 104 aa, Glycine max
  Coding DNA Sequence Number=SeqID_33372
MDGIPEIQRGGLLQRTLLHLSTRLVYKSEKERKVITCMHVETKAQEQELSFKIKTQLTQEQTPYVHVYLNLMRREGRNEASFEALVQCRGIKSSARWKELDYNL

SEQ ID NO: 150151 - protein, 63 aa, Glycine max
  Coding DNA Sequence Number=SeqID_33373
MDKEKKETKSKRFEDDEVDDNSDPRCKYKLFASKIFDEEALVKSDEEEKDDEEGKDDSSSVCD

SEQ ID NO: 150152 - protein, 149 aa, Glycine max
  Coding DNA Sequence Number=SeqID_33374
MVELCLVLDVVIPLKFKVSGFDKYKGTTCPKNQLKMYNRKMRAYSKNEKLLMHFFQESLTGAIVTCSSSTPITEKEMITMIVDTLLVFYYEKMVGYTPLSFADLVFAGERIEVDLKRDKFDYPALMNRKPGANGENEKEGGTHTASYLK

SEQ ID NO: 150153 - protein, 131 aa, Glycine max
  Coding DNA Sequence Number=SeqID_33375
MAPTRHSLDPDKFNRALGFPALITGLCQSYGVPITPSKAVGAPPPPRQADPARPLGVERYLQHLPQSAGAGFRPFRMPYPEQFGAEVAWPGDWTDAQAREESTRSPGEADESRMDEDMTNLLGFLGGSGAV

SEQ ID NO: 150154 - protein, 107 aa, Glycine max
  Coding DNA Sequence Number=SeqID_33376
  Subcellular localization annotation: CTP_CleavageSite=32; ConfidenceScore=5.07e-01
MKEPSKKRKGTSSRSQRHSGAQEAPIPSSIPSGSLFSSEEQRIRYTNLFSSRSIEDPKFIDMEFFSNENFECFQAFENSNLIPFMSLKLPVYYELVKAFYSNLGGIL

SEQ ID NO: 150155 - protein, 98 aa, Glycine max
  Coding DNA Sequence Number=SeqID_33377
MHAPDLNSQMQCGTIHQGNSLSVSTRHSHLEKLGSKCRGHPVVHRQLPPMVISLSLKGVLNQVTCSQVQVFLLMRNYKYILTKFILFSCYETWAPSMH

SEQ ID NO: 150156 - protein, 143 aa, Glycine max
  Coding DNA Sequence Number=SeqID_33378
MENEWRERGERNFEREKRENELWLSLLIQDQILDSPLSVLRCHEASHGSKIYPKVHENPRAFSCILGPIFLQSPNHGSGDGSSPWEDCIMVEIVGMMKEKGGVRDMGHGGRDREEKIIEKIWMKYPKWEMKVEQIFACHKYSE

SEQ ID NO: 150157 - protein, 59 aa, Glycine max
  Coding DNA Sequence Number=SeqID_33379
  Homolog annotation: Hit_ID=Q43587; Match level="QueryCoverage=86%, HitCoverage=28%, E-value=6e-10, Identity=67%"; Hit description=PAR -1a protein
  Pfam annotation: Domain name=PAR1; Domain location=1-59; Score= -101.2; E_value=0.016; Accession=PF06521.2; Description=PAR1 protein
MHQGLLVGQKILWNLINSLMESGFAQNLCFPQCYKSCPNILDLYFDLAAGEGFKGNYEG

SEQ ID NO: 150158 - protein, 199 aa, Glycine max
  Coding DNA Sequence Number=SeqID_33380
  Gene Ontology: Mol. function=protein binding
  Homolog annotation: Hit_ID=Q1SWI7; Match level="QueryCoverage=48%, HitCoverage=15%, E-value=8e-31, Identity=63%"; Hit description =Leucine-rich repeat
MLDLSYNHLKGKIPTGTQLQTFDASSFIGNNLCGPPLPINCSSNGKTHSYEGSHGHGVNWFFVSATIGFILGFWIVIAPLLICRSWRYAYVHFHDHVVQTSIFSLRGRVAERKEGKDRRCGEMELRITNTNTKMLYLPVAVVCFFPNCANARRQMGEIKSSGMVAPGPVHSLQFTSISPQPFDAMELSDEPAVAPFPQY

SEQ ID NO: 150159 - protein, 76 aa, Glycine max
  Coding DNA Sequence Number=SeqID_33381
  Homolog annotation: Hit_ID=Q1SJY5; Match level="QueryCoverage=85%, HitCoverage=9%, E-value=1e-09, Identity=39%"; Hit description =Integrase, catalytic region
MVQKLRGFDPHESHLKNVKRILHYLVGNTNQCLFHKKNHDFSKKQNSIALSTTEAEYVSTASGYSQLLWVAARLKY

SEQ ID NO: 150160 - protein, 64 aa, Glycine max
  Coding DNA Sequence Number=SeqID_33382
MLFPQEACLAIAERLERLLNLRIVIEGTKAYTVTTEECLRIARGVTMQRDMYIRSRQRWRMEDA

SEQ ID NO: 150161 - protein, 38 aa, Glycine max
  Coding DNA Sequence Number=SeqID_33383
MGMQFGKLSGAGKWEGIMRIYRREASEIIVGRYQGVHL

SEQ ID NO: 150162 - protein, 57 aa, Glycine max
  Coding DNA Sequence Number=SeqID_33384
MLIDVGMLWHVHVVYVRGGRSALTFQGLWHLLWAIVCSWGVSALTLSDGPDVGDKRG

SEQ ID NO: 150163 - protein, 241 aa, Glycine max
  Coding DNA Sequence Number=SeqID_33385
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=100%, E-value=6e-31, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYIVAIRGLHVLAFRGLHVLPFRGQHDLPFRGMHALALTGLHVLTFRGLHNLAFRGLDALAFRGVHILPLRGLHALAFVGLHTLTFKGVHVLNIRGLYIVAIRGLHVLAFRGLHALTFRGLHMLAYRGLHAFAFVGLHALTFRGLHILVFRAIHALAFRGLHDYMSSTSEDYMSSTSEDYTFSPLEDYMSLPYEGYTASPFEDYTPSPSEDYTGLHVLTFKGLHVIAFRGLHVLAFRGLQ

SEQ ID NO: 150164 - protein, 58 aa, Glycine max
  Coding DNA Sequence Number=SeqID_33386
MTKVKSAGPNGSRISSGLPPLDDKRLVLTEVVCAEDDVNLRVSTGLLAAIDKGCRRRC

SEQ ID NO: 150165 - protein, 67 aa, Glycine max
  Coding DNA Sequence Number=SeqID_33387
MNEILDVSISLLNEHLEETLGSTKIEENHSKCINLTWGKVHGELGPWLKACRMDGYDICQGVGLVQG

SEQ ID NO: 150166 - protein, 458 aa, Glycine max
  Coding DNA Sequence Number=SeqID_33388
  Gene Ontology: Mol. function=RNA-directed DNA polymerase activity; Biological process=RNA-dependent DNA replication
  Subcellular localization annotation: CTP_CleavageSite=58; ConfidenceScore=5.44e-01
MPPPVCGSPQPAVSEVPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASVRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGEKCPCCKQCQESLEGHFAKKKDQEVGMVAHGKPQQNFTPYRQVANVASAIPNPSYHQQRPHYPYPYPPHPYPPQQYPPQQYPPQQYPPQQYHQPQYPQKQQNRPQTPQQPYHSQNRQKTTFDPIPMKYADLLPALLAKNLVQVRTPPRTPDVLPPWFRHDLTCAFHQGAPGHDVENCYVLKNE

SEQ ID NO: 150167 - protein, 90 aa, Glycine max
  Coding DNA Sequence Number=SeqID_33389
  Gene Ontology: Mol. function=DNA binding; Biological process=DNA integration
  Homolog annotation: Hit_ID=Q0ZCD2; Match level="QueryCoverage=72%, HitCoverage=9%, E-value=4e-10, Identity=45%"; Hit description =Integrase
MSPYRVVFERACLFPVEIEHKAYWAVKTCNFFMDQAGEERKLQLMEIKRDSTNKSFKVNGHGLKPFLTNPFLGEVGGEETSLLPPTLPPP

SEQ ID NO: 150168 - protein, 106 aa, Glycine max
  Coding DNA Sequence Number=SeqID_33390
MSGFTCDSPQISASPHQLDLAPYASEPYNAQWNAPGLLRDKHTLRSSRILGEMEVDEPWLGLWLPLNYQVDMGARMAFVDNWVVGKEKVGYWLSNDIVGLVGNLAV

SEQ ID NO: 150169 - protein, 216 aa, Glycine max
  Coding DNA Sequence Number=SeqID_33391
  Gene Ontology: Mol. function=nucleic acid binding; Cellular component= oxygen evolving complex; Biological process=DNA integration
MSDEYWVKAMQEKLALYQKNDVCKLVEFPKGKFVDEAKWVCRNKFDETCKVGRNKVKVVAKGYSQQEGINYTETFALVARVEEIRILLSFVAHHVSNCPNIYGQYRIQSGEKEYRFVGYCDADFVEDKVERKSTSGRCHFIGGCLVSRMSKKHRTIALSTTEAKYIYTASCYSQLLWIKHQLEDYNLYESKIHILFDNIAVIDLSKNPSCVHVPNT

SEQ ID NO: 150170 - protein, 100 aa, Glycine max
  Coding DNA Sequence Number=SeqID_33392
  Subcellular localization annotation: CTP_CleavageSite=45; ConfidenceScore=5.48e-01
MAKKQNQPQLSKSHLISQTTPATFSRNGSHVQITRPALVTIFATQVTMKDKEPRAHVKHFFDIYLLENVGYVINAQLMLCGIHHFFEDPKVVMAELIKEF

SEQ ID NO: 150171 - protein, 121 aa, Glycine max
  Coding DNA Sequence Number=SeqID_33393
  Subcellular localization annotation: CTP_CleavageSite=37; ConfidenceScore=5.18e-01
MHTQSFTIPQFPKIGLTHKNIPQWSRQLSQHALLRAREARLSGALSKGGNMRGVATHVYLWKTSEKPKETGRKEKFQVRKLYLRLRKVNKSGALAPTYPPSKRKSDLRSSSLCVNQVILFT

SEQ ID NO: 150172 - protein, 36 aa, Glycine max
  Coding DNA Sequence Number=SeqID_33394
ILFESKRQEGGLRNIGRVEWVYSRVEGNAARFLDLA

SEQ ID NO: 150173 - protein, 176 aa, Glycine max
  Coding DNA Sequence Number=SeqID_33395
MATMMEAMMSIKVIMEVNAVAIATTSTIVEVDMTPPYGLNQINHPTSDMVGLEGKELGAYTPNENANNSTPILIESQQPQSDHAHVSRPIGETHEMPHHNLADFEPCLGYATEGQAVRDIPLQNTLEGPQYHPQPHPLHSTAVKNLHAMEEMGMLDHLEERLRAIEGGEDYAFANL

SEQ ID NO: 150174 - protein, 117 aa, Glycine max
  Coding DNA Sequence Number=SeqID_33396
  Gene Ontology: Mol. function=DNA binding; Cellular component =mitochondrion; Biological process=DNA integration
  Homolog annotation: Hit_ID=Q1SAZ0; Match level="QueryCoverage=58%, HitCoverage=4%, E-value=3e-19, Identity=70%"; Hit description =Integrase, catalytic region
MTKSKGKDPLEGLGGPMTRAIARKAKEALQQVLSILFEYKPKFQGEKSKVFTKTYGIDYSETFAPVTNTVRILLSLDANLDWFLHQLDVKNAFLDNGLEEEVYMDSHPGSKHKVGTK

SEQ ID NO: 150175 - protein, 98 aa, Glycine max
  Coding DNA Sequence Number=SeqID_33397
MKAMCSKQNWQEESSQHLHSKSGDLWGGGNDPCPHPCRAYDEIFIPIPVPWENIPCLWAPNRIVPSGIPIYGVVRCLGLILYIGGLESSNWLQGQVQR

SEQ ID NO: 150176 - protein, 137 aa, Glycine max
  Coding DNA Sequence Number=SeqID_33398
LHLLLLFLHHQQLQFFQVPPLRAFLVYAEEPASGPAPDHAEFAGCGVQPSPLGWGEASVAQEPQQDQVDNILEASEPTPPEPFIFETDPVIVQEDVAVLEPSPQPEPESSALVLDLRLSQDPSSAPALDLNEHAQDH

SEQ ID NO: 150177 - protein, 85 aa, Glycine max
  Coding DNA Sequence Number=SeqID_33399
MGLCQFYGVPVTSSKGIRPPTNRALIKKYCVSRQVQGETPQQPGDGQQWATDAPPSPLEFISAHPQKAIKRPAQDVKEALLGGNL

SEQ ID NO: 150178 - protein, 91 aa, Glycine max
  Coding DNA Sequence Number=SeqID_33400
  Gene Ontology: Mol. function=transporter activity; Cellular component= integral to membrane; Biological process=transport
  Homolog annotation: Hit_ID=Q1SYF9; Match level="QueryCoverage=69%, HitCoverage=13%, E-value=1e-26, Identity=84%"; Hit description=Major facilitator superfamily MFS_1
MSVSIMLCTCLQKALHMTSCQRCLSYIAYNFVIGTYSYWGPKAGYNIHHMTEVDLIFGGITIVSGIAGTLAGGFVLDYMSNTLSNAFKVGI

SEQ ID NO: 150179 - protein, 106 aa, Glycine max
  Coding DNA Sequence Number=SeqID_33401
NASPTLLALYSCPSKLLLLHDRFYLYLQAYRDRDTSPPYLDLCLFVLQGFGLWNLCSLQGFGLWKSWSLLGLFGVLTLQSVWGAQSCSQGLILSKVIQIASCPLNA

SEQ ID NO: 150180 - protein, 76 aa, Glycine max
  Coding DNA Sequence Number=SeqID_33402
MAEITSSLTQLQLSSKPKLNAPDYYDAPSQKAVVGHHYHAGLYSASDDEIPTVDYSLLFSNNPVQRFLTLENLRQA

SEQ ID NO: 150181 - protein, 440 aa, Glycine max
  Coding DNA Sequence Number=SeqID_33403
  Pfam annotation: Domain name=WD40; Domain location=168-206; Score =2.1; E_value=21; Accession=PF00400.22; Description=WD domain, G-beta repeat
  Pfam annotation: Domain name=WD40; Domain location=214-252; Score =1.9; E_value=22; Accession=PF00400.22; Description=WD domain, G-beta repeat
  Pfam annotation: Domain name=WD40; Domain location=258-296; Score =21.2; E_value=0.0036; Accession=PF00400.22; Description=WD domain, G- beta repeat
  Pfam module annotation: Pfam domain module=WD40::WD40::WD40; Domain location=168-206::214-252::258-296
MEWTTLQHLDLRHVGRGVRPLQPHAASFHPHQALVAVAIGTYIVEFDALTGSKISALDIGAPAVRMSYSPTSGHTVIAILQMVQTNNNLGISILLNRRSVLLDEDCTIRSCDFDLEQTCVLHSPEKKTEQISSDTEVHMALTPLQPVVFFGFHKRMSVTVVGTVEGGRAPTKIKTDLKKPIVNLACHPRLPVLYVAYAEGLIRAYNIHTYAVHYTLQLDNTIKLLGAGAFAFHPTLEWIFVGDRQGTLLVWDVSTERPIMVGIKQVGSQPITSVAWLPMLRLLVTLSKDGNLHVWETRVTVNPNGPPTQANFFEPAAIESIDIPRILSQQGGEAVYPLPRIKALEFHPKSNLAALVFAVTCYLTLFIPCLMRQLPTIQKIRPDTVEKGESSFLQFYKVHEDLQRCYAASVLKEKLSALGSSGVLADHQLQAQLQEHHLKG

SEQ ID NO: 150182 - protein, 248 aa, Glycine max
  Coding DNA Sequence Number=SeqID_33404
  Gene Ontology: Mol. function=RNA-directed DNA polymerase activity; Biological process=RNA-dependent DNA replication
MAPSSLSVFLPIKAKELSLTEGGYRVLVASSLDFLACEAEEWTAVRMDKDINGTTLVDEDPSHHEICNDDRVNHELVLIDGVDALEVPIRESDRRVLLLVEVVIHAVIVGVFVCIGHLFFFLLPGSCASPLHILQGLDPACRMDTSMLNASLRIMVRLGVRGEEHGMQHYLDVKILDLDGCLSKSVHEFFEGLIVCLLQTDQGSRGHAVRPAGGVLHTEPFNKGIKTVYGPGWESTELDKERVGLPTG

SEQ ID NO: 150183 - protein, 40 aa, Glycine max
  Coding DNA Sequence Number=SeqID_33405
FDALTGSKISALDIGAPAVRMSYSPTSGHTVIAILQVDHT

SEQ ID NO: 150184 - protein, 72 aa, Glycine max
  Coding DNA Sequence Number=SeqID_33406
MYLRRYTATPITTTTTTCQRTTITMCFDQTRHNNEGGVRPQLTTMNGYEEKNERCMKKKKEEEKVSRASLGI

SEQ ID NO: 150185 - protein, 85 aa, Glycine max
  Coding DNA Sequence Number=SeqID_33407
MDDHRVGVVTRSHEADMVTPIEFERVGYEEGDLPICFLVFRWKSMILCEHQRWNGLAMTCAKVCRWTCSRKEGSFEDISRVQVGI

SEQ ID NO: 150186 - protein, 91 aa, Glycine max
  Coding DNA Sequence Number=SeqID_33408
MYKDKWAHTEPMGPKSILRLMRILGPSPASFAQSSWSLLSNALGGVGLHQYVAPMEVFVALSVSYANFILIVSPLHTTKSPVLYVGVAKFG

SEQ ID NO: 150187 - protein, 32 aa, Glycine max
  Coding DNA Sequence Number=SeqID_33409
MVGAFSQNSVTHPNWSPCELAHGDYRTKDEEA

SEQ ID NO: 150188 - protein, 105 aa, Glycine max
  Coding DNA Sequence Number=SeqID_33410
  Gene Ontology: Mol. function=RNA-directed DNA polymerase activity; Biological process=RNA-dependent DNA replication
MRFHGLKMNPDNYAFRVSADNFLGFLVHQKGIEIDKNKTKEVLEARPPQNQKELQSFIEHVYIGENDEANRLAQHASGYKKIKDEALESSIEEYCIMEIRSTDPL

SEQ ID NO: 150189 - protein, 103 aa, Glycine max
  Coding DNA Sequence Number=SeqID_33411
MTEKEMIAMIVDTLLVFYYEKMVGYTPSSFTDLVFTGERIEVGLKRGKFDYLALMNEKAGTNEENKKEGGSHAVTTIPTWPNFPQAQQCHYSANINPSHYPPP

SEQ ID NO: 150190 - protein, 46 aa, Glycine max
  Coding DNA Sequence Number=SeqID_33412
MEVEKPWLRLWIPFNYRVDMGARWCLALDVQQAGFVADLGVAFVVD

SEQ ID NO: 150191 - protein, 75 aa, Glycine max
  Coding DNA Sequence Number=SeqID_33413
MGEIHEAPHHNLADFEPCLGYALEGQAVPNFDKYKGTTCPKNHMKMYCQKMGAYSKDEKLLMHFFEESITGAAVT

SEQ ID NO: 150192 - protein, 435 aa, Glycine max
  Coding DNA Sequence Number=SeqID_33414
  Homolog annotation: Hit_ID=O80572; Match level="QueryCoverage=62%, HitCoverage=49%, E-value=1e-09, Identity=23%"; Hit description =Expressed protein
  Pfam annotation: Domain name=mTERF; Domain location=223-435; Score= -87.1; E_value=0.02; Accession=PF02536.5; Description=mTERF
MEGDGCNVKMLVKIHTNWFAPFAFPVRLAHKIEGCFELSKYVLFTRPPISSSFEVDNDKARKRRSSWRCGCGSEEARRAVSSYLGELGVSEEDSVWISSKSPEYVKMLVEGVRDLEQWQIALAGLSFKDKIIHIAAQKGDKGKVAYLESLGFTLSSSMNIARYLPSDTHTLPSLMHKVTRIKQLLFFSPTPDHHLLIKSIRLMMRHLSISIDEDLQHTLSFFEKLQAKPGGLGILAYKNAAFRSLIESFPRLLQLSVDNHFTPILHFLHNFGIPTFRISNIILAFPPLLFWDLQLLQTRLLVFKEIDLPDKDYAKLLLKYPWLLSTSIQENYTELLAFSYSIKVPKTQIDRAIESHPHLLSCSTSKLKSMVDQFAELGVRNKKLNQVIAKSPQLLLRKPKDFLQLTQLSRHLKEKLVSCCFGSNLSLSISNMKHS

SEQ ID NO: 150193 - protein, 181 aa, Glycine max
  Coding DNA Sequence Number=SeqID_33415
  Gene Ontology: Cellular component=mitochondrion; Biological process =response to cold
  Homolog annotation: Hit_ID=O80618; Match level="QueryCoverage=87%, HitCoverage=55%, E-value=1e-19, Identity=33%"; Hit description =Predicted by genefinder and genscan
  Pfam annotation: Domain name=mTERF; Domain location=1-161; Score= -7.6; E_value=1.3e-07; Accession=PF02536.5; Description=mTERF
MGFDKETIGRILARCPEIFAASINKTLQRKIEFLGRVGVSKTFLPGVIRKYPELLVSDIDKTLLQRIMYLMKLGLSEKDIAYMVRTFSPLLGYSIEGVLRPKIEFLVNSMERPVRDVVDYPRYFSYSLEKKIKPRYWVLKGRDIKCSLKDMLGKNDEEFAAEFMGIGRMLVYPPVSSNDSQ

SEQ ID NO: 150194 - protein, 248 aa, Glycine max
  Coding DNA Sequence Number=SeqID_33416
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=83%, HitCoverage=26%, E-value=3e-84, Identity=72%"; Hit description =Protein kinase; UspA
  Pfam annotation: Domain name=Pkinase; Domain location=1-206; Score= -55.4; E_value=2.9e-05; Accession=PF00069.15; Description=Protein kinase domain
  Pfam annotation: Domain name=Pkinase_Tyr; Domain location=1-190; Score=-135.7; E_value=0.00038; Accession=PF07714.7; Description =Protein tyrosine kinase
  Pfam module annotation: Pfam domain module=Pkinase::Pkinase_Tyr; Domain location=1-206::1-190
MANGSLEDCLFQKKNKSVLSWQLRFRIAAEIGTGLLFLHQTKPEPLVHRDLKPGNILLDQNYVSKISDVGLARLVPAVAENVTQCCMTSAAGTLCYIDPEYQQTGMLGVKSDVYSLGIIFLQLLTGRPPMGLAHLAGESIEKDTFVEMLDPSVTGWPLEQALCLAKIAVKCAELRRKDRPDLAKLVLPELDKLRDFAEQNMSMPIFLGCTASSPSHSEAFVHQDVISDLRLVHSESSSAPSTPTEGKP

SEQ ID NO: 150195 - protein, 548 aa, Glycine max
  Coding DNA Sequence Number=SeqID_33417
  Gene Ontology: Mol. function=RNA polymerase II transcription termination factor activity; Cellular component=nucleus; Biological process=transcription termination from RNA polymerase II promoter
  Homolog annotation: Hit_ID=Q6BWT0; Match level="QueryCoverage=45%, HitCoverage=12%, E-value=1e-44, Identity=41%"; Hit description =Debaryomyces hansenii chromosome B of strain CBS767 of Debaryomyces hansenii
MTILGIKHHPSLWKVQSDCPGISIDSNLYANPPLITKSIPDITEPVVERDVKSFFQYRMHPEICKFPSLHFYDNKLLNGSQMSNKSAPFHQTKGLGPYVFYDIIDGQEVRGKNSGVMSLCNEQEADAAVEVLKFFKKRYPAEFVGGRIGVITPYKCQLSLLRSRFLNAFGPSSVADIEFNTVDGFQGREVDIILLSTVRAAHSGITASEINSNSIGFVADVRRMNVALTRARLSLWILGNSRTLQTNQNWAALVKDAKERNLIMKAKMPYHSMFKTDKNKSYVENSDNHARRLKHKKVKDTGQSVTKILVHGKDIVERKTKCVASEVRDRKGNVDENTSSALGKYTPCKERKSEDEHISITKDMGYEVEKYESRSSCGDMFTMSGQQVCNGGREGKDKLKISMGKTALGKRQLKFEHSRNNLEYSVEETGGGHKASKLSVSDRQVMHSGGNRSSSSEISASSMKGCHKERDAIDQGTAPNRSKVDEISKRKQQREAVDAILYSSLISAKKDETLPKVSAKRPFSSFVASGSTKPPKTKSDDILLEKLP

SEQ ID NO: 150196 - protein, 63 aa, Glycine max
  Coding DNA Sequence Number=SeqID_33418
MADVRLERGQKARNSRSTNKTEGAKHATDAKRAKQNVLSAQQALSARNKTILAKREELTKRAM

SEQ ID NO: 150197 - protein, 998 aa, Glycine max
  Coding DNA Sequence Number=SeqID_33419
  Gene Ontology: Mol. function=RNA polymerase II transcription termination factor activity; Cellular component=nucleus; Biological process=transcription termination from RNA polymerase II promoter
  Homolog annotation: Hit_ID=Q51H96; Match level="QueryCoverage=61%, HitCoverage=45%, E-value=4e-42, Identity=25%"; Hit description=TRNA splicing endonuclease, putative
MGLSQPGSQVERVIKMVALFFASCPNLAHLTYGYTLEELTAQVSCLSVSLSREGSHNFLEANVKSKSLVSERLPFEKDCFTPDIHSSSMEDTGARNVETKIITGKKSSDSVIILSDDEVEPKVSSKKDFLSVSEAGPHISDGNIMPPDAGNSLPAGDLVNQNVSFMNTSKKMEQTFQKKASSGTLHDKPVVTSFIDSKGSSSCRTGVSSKSKDMVNLTKFSDEAVNAKSLNKACSSMASKTGDTSSSTCSKMLCDIQDAEDDPLETALKSVGRVQLHVPKPTVMRRQVIQLKTPLENKSGYLRKLEDPMKRFRPPRLDDWFKAILEINYFATVGLSSARKDENRIVNKLKEVPIYFLSPEQYVEIFRPLVLEEFKAQLQNSFLEMSSWEEMFYGILSVMSVERIDDFHLVRFVHDDGDSTKCRSFSENDFLLLTKDPPQKSSHDVHMVGKVERREKDNKRGSSIILIRFYFQNGSSRLNQARRNLTERSKWNACRIMNITPQIREFHALSSIKDIPLLSLILNPVNNSFCVNECKDVDLNNLCQSLQQTLRSSFNVTQLQAISVAIGRGKVKKTVELCLIQGPPGTGKTRTIVAIVSALLASQQKMTSLKNPFDENLYQKSSTYSRPKISQSTAIARVWQDAALARQLGDDMQNSSKSFGNYAKQRVLICAQSNAAVDELVARISSGGIYGSNGKMYKPYLVRVGNAKTVHSNSLPFFIDTLVDQRVAEERMHSNDGRNDLGVDSSAMLRSKLEKLVDSIRFYEAKRANSRDGISNVKSPLHNDSHMGNEKEMSETEIEMKLRKLYEQKRQIYKDLCNVQAQEKKANEETKSLRNKLRKAILKEAEIVVTTLSGCGGDLYGVCSERMLNSKFGGPSEHTLFDAVVIDEAAQALEPATLIPLQLLKSSGTKCIMVGDPKQLPATVLSNVASKFRYSCSMFERLQKAGHPVIMLTEQKRKRGNFCHGRCKPPWHHGHGGQHHSMANNEWQMEEWSKNAMF

SEQ ID NO: 150198 - protein, 107 aa, Glycine max
  Coding DNA Sequence Number=SeqID_33420
MPPTPFEALFKNAVDGPVCQGCKKADWAFEDQLVGLAFTEVSDGSKFEVFSQRLCGMSGAAIPVHGGLEMNQAVGKNETAKNGFRVEACGDCCKTGQKISTVVGGAQ

SEQ ID NO: 150199 - protein, 66 aa, Glycine max
  Coding DNA Sequence Number=SeqID_33421
MRLKAHVEPKVTNICNMAILTEKLTLKISKSATTATSIEATIVVTGTTSTATAVSETTTITTVATI

SEQ ID NO: 150200 - protein, 37 aa, Glycine max
  Coding DNA Sequence Number=SeqID_33422
MASRKQGCVSVWHSYFRNSFIITSDTGIVVDTGGIII

SEQ ID NO: 150201 - protein, 511 aa, Glycine max
  Coding DNA Sequence Number=SeqID_33423
  Gene Ontology: Mol. function=nucleic acid binding; Biological process= DNA integration
  Homolog annotation: Hit_ID=Q1SRN1; Match level="QueryCoverage=94%, HitCoverage=78%, E-value=6e-49, Identity=35%"; Hit description =Integrase, catalytic region
MASASPNFVSKSFPNSIAEKLDDLNYLFWRQHVDLVIKSRKLQRFVVNLVVPLCYLNEENRVADYVNPDNEAWEIHEYISLQMKSCACQLQTPMRAISLEGKLIDEYLRKIKFYVDELASVGVSVRHEEYVDALLEGLQSNYAPMISVIESKKRMPSIGEIKALLYSHETRLVIRSLTHTNLVIPVVLGVHMVATVVIVVVSLTAVAVDVVPVTTMVASIEVAVPQHSQVLCSPIPTHGNANSIWIPDFGASFHVTVNPPTVSHFVSQQSSTFESNSLHSQTSEFTTSSLLPFESMLVANPALVNTHPMQTRSKSGIHNPRLHPSLFLVHSEPKTFLYPPIDKLLDVRVKVNVDGSINKFKARLVAKSFHQVHGFDFHETFSPMVKPITIHIVLTLGLSHGWELFQLDVNNAFLNGLLEESVFMTQPPGFEVGDRSLVCKLNKTLYGLKQAPSKCDSSLFIYKHQSHHVVYFLVYVDDIIERASPGAAVKLCLGDLLVMGSNLEIASLHMQ

SEQ ID NO: 150202 - protein, 101 aa, Glycine max
  Coding DNA Sequence Number=SeqID_33424
MKSKLKKLKISIMRFRLTSSTMENKASTKGLEGRGGEKLSMCVKSFHEILMKFDSEEQFALTTAREREKSQVGASWVGLDLATMGLGFGGVVVLGEDYEGK

SEQ ID NO: 150203 - protein, 393 aa, Glycine max
  Coding DNA Sequence Number=SeqID_33425
MVFLWCHIVLVRATHHPHHLLWFILAPNAPWKVVLVLTLFRYLIPCYSLLKPCKTGSLKSSVDSASCCTPRLQDEPALSSLRVCTYVLPEQFSTSVLDRGPALVSSLKDSSLHNSLRQPAFDLIQTIIVSDATALIYSVLNCCATRSTDSSIADEVVELDDENDNWLPTIPDGEEQDSSSSWSQFRLQSGITSQECQEWMCIPMLWVDVLLDINPSILPISFSKAVFWARSRFPMVEFEKGAEMVLPIRSFLSSYAAEISSSFGWKVPTGSDDGGDGSKSKNSVEVLTMPFPLLRTFIRLTTHFLVQIRQGELRSQWTWEPLMSESLILSLLDPNDDVRQFGKSMLEQVSDTWGLSSGLKFLCSHNPSLYAIILGLKHAMKLEISLENYDLGE

SEQ ID NO: 150204 - protein, 272 aa, Glycine max
  Coding DNA Sequence Number=SeqID_33426
MGPLLETFYNYFKDDRQDSPLRLLWKRISDEMRQCLQCISQHHQAQDMYNTEYESSSIGPLLDVLQKLDCERVTFHLRDINTKIVGEKYNPSCDNGEVVNVLYEVLMFPILLDYQPLFTEFELFVEAIDNKHELALSGHQQFPGVYALLFCKRSVRSVGYRLAGSMGKLRRATDLEPLQPLLKKFISCLEADALPVTLETSTSRTQLDRVSLWIGIKSLLGFLDPSTFEEGILERYPFFVDIVLNHISGDSLEFSHAVTCLRLLFEMLGISY

SEQ ID NO: 150205 - protein, 70 aa, Glycine max
  Coding DNA Sequence Number=SeqID_33427
MGGVPVALIVLRWCSDDQIWSGAAVELFGVRKGSKRREGKGRECEEGSSGRYYYCYQLGLGLEVRTTYIN

SEQ ID NO: 150206 - protein, 269 aa, Glycine max
  Coding DNA Sequence Number=SeqID_33428
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=59%, HitCoverage=14%, E-value=1e-44, Identity=57%"; Hit description =Putative calcium-transporting ATPase 9, plasma membrane-type (EC 3.6.3.8) (Ca(2+)-ATPase isoform 9)
  Pfam annotation: Domain name=Cation_ATPase_N; Domain location=182 -266; Score=60.2; E_value=6.9e-15; Accession=PF00690.16; Description =Cation transporterATPase, N-terminus
MAGCFQCASTWSKGGEEATYEDLDAPVKMSKRDRDMSNVNIASTSRGSTSSSNGLLTVTITSTSHPDDPPTDDNDDDDLLADPDDPFDITHTKNAPPEALKRWRQAAFVLNASRRFRYTLDLKKEEEKEQKKSMIRSHAQVIRAALLFRLAGERELVTSKAAVASPSPVGEYTVGLEQLVSMTKNQNISALQQYGGASLSNLLKSNPDKGISGDDVDLSKRKNAFGTNTYPRKKGRSFWRFLWESWQDLTLIILIIAAVVSLVLGIKTE

SEQ ID NO: 150207 - protein, 456 aa, Glycine max
  Coding DNA Sequence Number=SeqID_33429
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=99%, HitCoverage=96%, E-value=1e-112, Identity=47%"; Hit description =Pentaxin
MGSRFPSHQLSNGLYVSGRPEQPKERTPTMTSVAMPYTGGDIKKSGELGKMFDIPMDASKSRKSGQLNNAPSRTGSFAAAASHSGPILPNTAPRSIYTTSSGGMAASLSMKKTNSGPLNKHGEPVKKSSGPQSGGVTRQNSGPIPHVLPTTGLITSGPLNSSGAPRKVSGPLEFSGSMKSHTSVTHNPAMTTLSLDDEYSFRRNFPKPILWSVILIFVMGFIAGAFILGAVHNAILLVVVVVLFGAVAALFTWNSCCGRTAIVGFISRYPDAELRTAKNGQFVKVSGVVTCGNVPLESSFQKVPRCVYTSTSLFEYRGWDSKAANPKHRHFTWGLRAAERHVVDFYISDFQSGLRALVKTGYGARVTPYVDDSIVIDVNPDNKDMSPEFLRWLRERNLSSDDRLMQLKEGYIKEGSTVSVMGVVQRNDNVLMIVPPPEPLTTGCQWAKCIFPASLE

SEQ ID NO: 150208 - protein, 165 aa, Glycine max
  Coding DNA Sequence Number=SeqID_33430
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=78%, HitCoverage=22%, E-value=1e-48, Identity=71%"; Hit description=Cell division cycle protein 23 homolog
  Pfam annotation: Domain name=APC8; Domain location=1-161; Score =192.4; E_value=1.1e-54; Accession=PF04049.4; Description=Anaphase promoting complex subunit 8  Cdc23
MSSKESCRSELRIAIRQLSDRCLYCASKWAAEQLVGIEQDPAKFTPSNTRFQRGSSSIRRKYKTHEIAGTPSAGVSYVATPVMEEDELVDGDFYLLAKSYFDCREYKRAARVLRDQNGRKSVFLRCYALYLFSFMAKSISVGDVGYLLNGLQLIGGNTLYAAIDH

SEQ ID NO: 150209 - protein, 109 aa, Glycine max
  Coding DNA Sequence Number=SeqID_33431
MVMAWKWIVRRTRESKPFFLAFATICGVVPGVIGYGVMQLTNTRNEKLESHLRTNARPESLCIFSRLLVDTVVAVLAGVKPFVLLYIQLYKYNTWVLHWWAASISVPGV

SEQ ID NO: 150210 - protein, 472 aa, Glycine max
  Coding DNA Sequence Number=SeqID_33432
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=91%, HitCoverage=74%, E-value=0.0, Identity=75%"; Hit description=Cell division cycle protein 23 homolog
  Pfam annotation: Domain name=TPR_1; Domain location=231-264; Score =30.0; E_value=8.1e-06; Accession=PF00515.18; Description =Tetratricopeptide repeat
  Pfam annotation: Domain name=TPR_1; Domain location=265-298; Score =27.9; E_value=3.6e-05; Accession=PF00515.18; Description =Tetratricopeptide repeat
  Pfam annotation: Domain name=TPR_1; Domain location=299-332; Score =17.1; E_value=0.049; Accession=PF00515.18; Description =Tetratricopeptide repeat
  Pfam annotation: Domain name=TPR_1; Domain location=333-368; Score =9.4; E_value=0.4; Accession=PF00515.18; Description=Tetratricopeptide repeat
  Pfam annotation: Domain name=TPR_1; Domain location=369-402; Score =13.3; E_value=0.14; Accession=PF00515.18; Description=Tetratricopepti de repeat
  Pfam annotation: Domain name=TPR_1; Domain location=410-443; Score =4.4; E_value=1.6; Accession=PF00515.18; Description=Tetratricopeptide repeat
  Pfam annotation: Domain name=TPR_2; Domain location=163-196; Score =4.7; E_value=9.3; Accession=PF07719.7; Description=Tetratricopeptide repeat
  Pfam annotation: Domain name=TPR_2; Domain location=231-264; Score =23.8; E_value=0.00063; Accession=PF07719.7; Description =Tetratricopeptide repeat
  Pfam annotation: Domain name=TPR_2; Domain location=265-298; Score =19.8; E_value=0.01; Accession=PF07719.7; Description=Tetratricopeptid e repeat
  Pfam annotation: Domain name=TPR_2; Domain location=299-332; Score =15.8; E_value=0.16; Accession=PF07719.7; Description=Tetratricopeptid e repeat
  Pfam annotation: Domain name=TPR_2; Domain location=333-368; Score =12.2; E_value=1.2; Accession=PF07719.7; Description=Tetratricopeptide repeat
  Pfam annotation: Domain name=TPR_2; Domain location=369-402; Score =18.7; E_value=0.02; Accession=PF07719.7; Description=Tetratricopeptid e repeat
  Pfam annotation: Domain name=TPR_2; Domain location=410-443; Score =16.3; E_value=0.11; Accession=PF07719.7; Description=Tetratricopeptid e repeat
  Pfam annotation: Domain name=TPR_2; Domain location=70-103; Score =2.4; E_value=17; Accession=PF07719.7; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _2::TPR_2; Domain location=231-264::265-298::299-332::333-368::369 -402::410-443::163-196::...
  Pfam module annotation: Domain location=231-264::265-298::299 -332::333-368::369-402::410-443::70-103
MTIMVNDCATSWCTVWLKIKSLDPMAGEKRKEEEMIELEGPLGKSDAVNHELVSLERELSTLRKNGKVDAFGLYLYGLVLKQKGSENLARTVLVESVNSYPWNWNAWTELQSLCKTVDILNSLNLNSHWMKDFFLASVYQELRMHNDSLSKYEYLLGTFSNSNYIQAQIAKAQYSLREFDQVEAIFEELLSNDPYRVEDMDMYSNVLYAKECFSALSYLAHRVFMTDKYRPESCCIVGNYYSLKGQHEKSVVYFRRALKLNKNFLLAWTLMGHEFVEMKNTPAAVDAYRRAVDIDPRDYHAWYGLGQAYEMMGMPFYVLNYFKKSVFLQPNDSRLWIAMAQCYETDQLRMLDEAIKCYRRAANCNDREAIALHNLAKLHSELGCPEEAAFYYKKDLERMESEEREGPKMVEALLYLAKYYRAQKSFEEAEIYCTRLLDYTGPERETAKSILRGMQSTQSNFPSMDVEHFPPS

SEQ ID NO: 150211 - protein, 233 aa, Glycine max
  Coding DNA Sequence Number=SeqID_33433
  Gene Ontology: Mol. function=transcription factor activity; Cellular component=nucleus; Biological process=regulation of transcription, DNA-dependent
  Homolog annotation: Hit_ID=Q9CAN9; Match level="QueryCoverage=73%, HitCoverage=66%, E-value=2e-25, Identity=37%"; Hit description =Transcription factor DREB1A, putative; 22554-23300
  Pfam annotation: Domain name=AP2; Domain location=62-125; Score =100.8; E_value=4.1e-27; Accession=PF00847.10; Description=AP2 domain
MSEKERYEENKIVPQISKLQEVPFHIPFLRCIHWSKSSFGTCEPHLNSISMAPSSSPSSKRHPLFHGIRCRGRKWVSEIREPRKASRIWLGTFPTPEMAAAAYDVAALALKGDGAVLNLPHSVSKYQMPLTNSPADIRSAASAAAAMIKAETETEATHNHNMNIASITDNEATYTASTSWFETDFIDEEVIFGMPSLLVDMAGGMLLSPPRMSPPPSDNSLEKQNGETLWSYF

SEQ ID NO: 150212 - protein, 87 aa, Glycine max
  Coding DNA Sequence Number=SeqID_33434
MAAGNRQRKSSSGFFSIFNIFSSRKPRGGYSDAPDSWRRVYPSDYDKGNWGVAEPNIDMKAEAFIAKYKKRVSESALYQLDPAAENA

SEQ ID NO: 150213 - protein, 89 aa, Glycine max
  Coding DNA Sequence Number=SeqID_33435
MANYDDAPKQWTKVWPSDEDRGRWGVADPVIDLRATAFIAQYKKRVSESEIHCQAQVQHLSSLLQGSRATTVKTPKNVDPLICLSLKYM

SEQ ID NO: 150214 - protein, 87 aa, Glycine max
  Coding DNA Sequence Number=SeqID_33436
MDHRKHTKLTKFNNFLDVIFVLVTIKMAIVQHLVMDNKKRRPIIRRTKPDLNKTLKEATKAIEVAQVLLTTLMEVFQIGVHNNNKLS

SEQ ID NO: 150215 - protein, 344 aa, Glycine max
  Coding DNA Sequence Number=SeqID_33437
  Gene Ontology: Mol. function=DNA binding
  Homolog annotation: Hit_ID=Q1SDS1; Match level="QueryCoverage=68%, HitCoverage=60%, E-value=7e-15, Identity=26%"; Hit description=IMP dehydrogenase/GMP reductase
ENGVVGIPRKCLEAKARILASKGEWALFIDILALLIFGGVLFPNVDGLVDLAAIDAFLAYHDHKESPVVAMLADLYDTFERRCEKSKKGGANWDQLLANKEGASVNWFPRWKEGRTGVLISCGGFPNVPLMGTRGCISYNLVLAIRQLGYPMRGAPLEDELSTVISRGFNKTNVETLQKVGKAWEVLQKRTKNSGAVTMGPSVAIAPEEDEEVQALRAELEQAQTVKERFKSAALKIQKENTELRDVNVATTKALERETKRACREEHGRNKFRGALWVATTNMLAIITKYREELNLAAAHEHRVADEYAQVYAEKEARGRVIDSLHQEATMWMDRFALTLNGSQ

SEQ ID NO: 150216 - protein, 361 aa, Glycine max
  Coding DNA Sequence Number=SeqID_33438
MASGSGKPRTYQMVVAKANHRKTRTLLLLKDYLRDDLSSCSSSGFRSLPRRQCCLQQLQPRASAKSVLQKALEALFNAIKSRNKGGVGVLSRSFFWKKASKRESISTCSLTDVEMEGSVTTTNTCSVTNSARVDSRGKKDWTKVKEQFSPVSVLDCPLFDDDEESTSPFSSPSRSTLEGAKHIQQRRHFNRVDLEKKMSWSELQEDESIYNYPTKPCPVLVSITSTQNENNNLLHDSVEKNALDLLTRVKNSISSVCLRIEMEKLLFDFFKQSIWENTDIKNSMKCHLCNVAEDWIRGQSHVQDLSLQTRKGREIYVKEMDKCGSWRTFEEEIQGLAMELEVEFSTRLVNELVVDLTMCFF

SEQ ID NO: 150217 - protein, 552 aa, Glycine max
  Coding DNA Sequence Number=SeqID_33439
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=68%, HitCoverage=31%, E-value=2e-54, Identity=35%"; Hit description=Chromo
MTESVTVKTKNLEWIVLVFNSKNPKCHARSSTTLPVAPSSSPPTSPFCIIIIAHPSDYDKSNKGVVEPNIDMKVEVFIAKYKKSLNAITIKDRFPIPIIDELLDELGGDDVFWPVQCTLFVPSHYEYHLIHLEKVFEVLLHDQLVLKFSKCFFAQRQVEYLGHVVSGQGVEPVASKVQVIYQWPVPQSTWALHNFLGLIGFYRKFICGYASIVAPLIKVTTKDPFEWSTDAQHVFHTLKEALTSASVLFLPDFTLPFTLEKDASGIGMGVVLSQKGHPIVFFNKPFNHKLLQAFTYPQGVHDPVADALSRIPDNPAGTMFLLSVPCLTFLEELKKHLAQDYVFTEFRRAIITHPEAHPEYSVTQNLVLKRGCIWLLQGLPFIQTLLTEYHSTPTDGHMRVAKTLARAFMSFTDALSAMGGSFLGLYYWPTTSISRQYYYTCFCISLLKWHSSGHASTPPYFSFGSSLIHGHYREASRHVAKSTFRSRPKPSPWGEFLNLVEWSYNTSCHSSLGASPYEITFGKKPFNFPQYIAGSSKVDEFLIDKEAVFAEF

SEQ ID NO: 150218 - protein, 93 aa, Glycine max
  Coding DNA Sequence Number=SeqID_33440
  Homolog annotation: Hit_ID=Q23500; Match level="QueryCoverage=54%, HitCoverage=6%, E-value=7e-07, Identity=55%"; Hit description =Probable aconitate hydratase, cytoplasmic
MAGTDLDTTIIDGLGVARWRVGGIEAEAAMLGQNTLVELCSTQMVGTDSDTSIIDGLGVGGWGVAGIEAKVTMLGQVNLEYLGRVVFNTNGGN

SEQ ID NO: 150219 - protein, 56 aa, Glycine max
  Coding DNA Sequence Number=SeqID_33441
MVGPRTRLLCGHGLGHHTTRIFMDNDDMAKVETGCCLLLTLDPGCLPLRLQSPAIK

SEQ ID NO: 150220 - protein, 198 aa, Glycine max
  Coding DNA Sequence Number=SeqID_33442
  Gene Ontology: Mol. function=sugar porter activity
  Homolog annotation: Hit_ID=Q8S7U2; Match level="QueryCoverage=59%, HitCoverage=26%, E-value=8e-31, Identity=52%"; Hit description =Putative sugar transport protein
MVVNLSLYAVALIVFSVINGKTHDDVENQYCWIAYLSIFIGCCFVGVFHLATKEPRLKVDVHGMVHARISWDYWFKRILYYHVGPVYVLTRLVLNVSQAYLAFFVINDLQMAQSAKALLLSSMILTMRILEFKISHALIYLINDFYRDKELSPFYIGPITIVEGCGFSTTAATTSGHNRCRKGQIIDVESLISSSECN

SEQ ID NO: 150221 - protein, 139 aa, Glycine max
  Coding DNA Sequence Number=SeqID_33443
  Homolog annotation: Hit_ID=Q1SYP9; Match level="QueryCoverage=61%, HitCoverage=9%, E-value=1e-08, Identity=33%"; Hit description=Myb, DNA-binding
MPSQLEGLNRNYSCKEAEVNANFSGSKEMNYFPIIITDFSRSKITTARISGWGFEMPVLQCMQGECQSFVIPMQVLDKYLEQVLKLGGSGDGTAQRSSEVLCSTLYGKLLEETNKLGFGSMVRNNMGPMAAPKWDYLSQ

SEQ ID NO: 150222 - protein, 484 aa, Glycine max
  Coding DNA Sequence Number=SeqID_33444
  Gene Ontology: Mol. function=DNA-directed RNA polymerase activity; Cellular component=nucleus; Biological process=transcription
  Homolog annotation: Hit_ID=Q1L5X6; Match level="QueryCoverage=82%, HitCoverage=35%, E-value=7e-97, Identity=45%"; Hit description=RNA polymerase IV largest subunit
MAGAVIFIVADYDEISIPSTLVVSASLQMLQLDYSLLKKRNSMLQLYIRNTMSPFHVAIPTEMKCSADSMVKEGEDTSIDKEEGDDCIMVTIVENSKNPIQLDSVRDLVIPFLLGTAIQGFLDVKKVDILWNNQSKVTNSRNGFSGELYLRVTLSSEGSRGRFWGVLLKLCHKIMHIIDWTRSHTDNINHFSSAYGIDAGWQYFFNSLACATSDTGKSILPKHLCLVANSLSCSGEFVGLNAKGMALQRKHASVSSPFVQACFANPGSCFIKAAKSGATDNLQGSLDGLAWGNCLSMGTSGMFDVIYSEKGHQVAKSVDVYELLEASFDKPNNKIGTHLHKYSSDKCGSEFRHKNGYALKEGKQWKTILRNFVTVNDIQKLTFASRCILNKYSIDELLSESDRSTMLRVLNFHPHKSEKFGIGPQDIKVGWHPKYKDSRCFHIIRTDGTVEDFSYRKCILGALDIVDPKKSKIQEKKWSGHGDT

SEQ ID NO: 150223 - protein, 609 aa, Glycine max
  Coding DNA Sequence Number=SeqID_33445
  Gene Ontology: Mol. function=pyridoxal phosphate binding; Cellular component=cellular_component; Biological process=metabolic process
  Homolog annotation: Hit_ID=Q9FGL6; Match level="QueryCoverage=98%, HitCoverage=97%, E-value=1e-130, Identity=43%"; Hit description =Arabidopsis thaliana genomic DNA, chromosome 5, P1 clone:MJM18
  Subcellular localization annotation: CTP_CleavageSite=35; ConfidenceScore=5.21e-01
MYPPCAGGASQPCYNGCFPSSFLASNSDNSHNTPNSSHDFEAATSTTLHPHTQFTNHEALPSLEESYINFTRAYPSFGNTSQVDRIRDQEYHHLNPSNVCFDYTGYGLFSHAQQQKQTASVASSSSCPPPSLPEPPFFVISYKPVTLHSQILYGGQESELESKIRERIMAFMSISEADYTLVFIANEVSAFKLVADSFQFHPDGELLTVYDHKSEAVDEIIETCKEQGVHVSSAKFFWPSLRIMSRKLKKKIMSRRGKRKRGLFVFPPHSNVTGTPYSYIWMSLAQENGWHVLLDARALGSKEMDTLGLAMFKPDFMVCSFYKVFGENPSGFGCLFIKKSTISALKESDNATSMGIVGLFPASRQETEPKEQEFVMDNEETETKSVSAHGTEEVFSTEIVELSLSASLESGKCRERFGTVSGGLEVECRGLDHADSVGLIAISIRGKYLINWLVNALISLQHPHAPTGLSLIRIYGPKIDSHRGPAVAFNVFDWKGEKVDPAIVQKLADRNNVSLSSAFLQNIWFSDKSDEEGQRTLESKVHRVKVLGQPNKTQSSGFGITVVTASLGFLTNFEDLYRLWAFLSRFLDADFVEKEKWRYLALNHKTIYI

SEQ ID NO: 150224 - protein, 137 aa, Glycine max
  Coding DNA Sequence Number=SeqID_33446
  Gene Ontology: Mol. function=nucleic acid binding
MLSGYEFWIAEIWRPKEGVVLLILGRLSVDGTPKIVTMHDVPFWIPIHNLPIGFMIETVGKHLGNFVGEFMEYDPNNNLGVWRAYMRIQVRVDRRLPLKKVKKPGGEWRLVQFKYERLGTFFFLYGPLVHSDKFCPN

SEQ ID NO: 150225 - protein, 245 aa, Glycine max
  Coding DNA Sequence Number=SeqID_33447
MEWFVGRDGGSVIGVWNSEANWVVKASISGRVVSDGDPDASLSVFAQIMSAASIDQNHDILFGYLAQKNREAHLWPLVNFSSQLKQRPLSLPLVISSSVRLFKGKGGGLLGEGKKGSRANPTTWTKVKVQPRYEATEEEWWQKHYNAIGKRLKFFQDVRPGSELMVSHHPLKPCQGWSLHIERRNSKGIGVGMSDEDEGEGNGWKLFSRLVTLLILSWLSLNESTNVMIRELSTQGNEQFLAFEA

SEQ ID NO: 150226 - protein, 226 aa, Glycine max
  Coding DNA Sequence Number=SeqID_33448
  Gene Ontology: Mol. function=chromatin binding; Cellular component =chromatin; Biological process=chromatin assembly or disassembly
  Homolog annotation: Hit_ID=Q1SAV4; Match level="QueryCoverage=81%, HitCoverage=46%, E-value=4e-41, Identity=49%"; Hit description =Integrase, catalytic region
  Pfam annotation: Domain name=Chromo; Domain location=135-186; Score =17.2; E_value=0.0092; Accession=PF00385.14; Description='chromo' (CHRromatin Organisation MOdifier
MNIEAVDDWLSHRDTILASLTKKLTKAQQRMKHDADQRRRDMQFEEGDWVLVKLRPRQQTSVTEGHYSKLAKRFYGPFQVTKKIGTIAYQFNLLATSRIHPVFHYSLLKPYLTPTNQVDAPLELPNFAEDNQPIITPLTILDAKWENIDIGRKLLVLVQWQGLFPEDTSWEKWEDLKLECNLEDKVALEAHGDVMTKNKEQQNTEKEENRRPRREINKPRYLRDFA

SEQ ID NO: 150227 - protein, 380 aa, Glycine max
  Coding DNA Sequence Number=SeqID_33449
  Gene Ontology: Mol. function=RNA-directed DNA polymerase activity; Cellular component=chromatin; Biological process=chromatin assembly or disassembly
  Pfam annotation: Domain name=zf-H2C2; Domain location=298-339; Score =10.5; E_value=0.014; Accession=PF09337.1; Description=His(2)-Cys(2) zinc finger
  Pfam module annotation: Pfam domain module=RVT_1::zf-H2C2; Domain location=12-181::298-339
MLLNGIIKSNSSPFSLPVLLVKKRDGSWHFCVDYRALNAMTVKDQFPIPTIDELLDELGGACWFSKWDLLQGYHQILMKETDISKTTFQTHHGHYEFLVMPFGLCNAPSTFQATMNTTFAPYLRKFIIVFFDDILIYNKTFVGHLEHLKTTFQVLRVGQFFLKLLKCSFATQQVEYLEHIVSKQGVEPIPAKIEAIQQWPTPSAPLTTLLAKDHFHWNSEAQHLFTNLKDALCRAPVLGLLDFSLPFVVETEAFGVSMGAILSQQNHPIAFFRIEDRIVESSGIPGLPTIQITLVEFHSTPTGGHMGVAKTLAHVSENFIWATMSKDVYRFVTTCVDCQQTKVDHWKRPGLLCPLPIPAQPWEDLSLDFIVGLPTFKGHI

SEQ ID NO: 150228 - protein, 81 aa, Glycine max
  Coding DNA Sequence Number=SeqID_33450
MPVIIVGSSQNSKTFINKGDHKINDGIGGASSNTKEGIMSDNQHGNEEAINHNFNKATNDCGQRKKIVDLAPRHARRNDYP

SEQ ID NO: 150229 - protein, 801 aa, Glycine max
  Coding DNA Sequence Number=SeqID_33451
  Gene Ontology: Mol. function=nucleic acid binding; Cellular component= membrane; Biological process=DNA integration
MASIKQGDQTITDYFTRLRVIWDELESYRPNPQQDRVMQFLRGLNDQFSTIRYNVLMMDPLPSRAKVFSYAAQQEREINNNEMIGSMSLINSSSIEKNGFPQNYASSEGKGSQSSSSRTNSRGKGNKIYPHCGLANHTVDECYKKHGYPPRHKFHKPQSSNINNVNVVKEEGDSSSLDRNQETQNKDVRLTHQQYKALNTTVTTSTLAINRKKLDPRPATFVFLSFKPNTKGFVTFDLETRAISISRNVNFYEDCFPFTDQDNPKPVTILPTPSSHSIVSYPNFVRGPLLDDMRLFFGPCEAVASGGSNLARLGELGDNHLPYFAINRGGSEEEKAEALLKRFRNVFREEFRKGFNRSSTFFIRSSSFFDLQRSRLSSSYHSVILSITQSVEPQSYTESSKDPIWIEDMNADIEALELNDTWVLTDLPEHKNAIGCKWVYKIKHKSNGSIERYKARLIAKGYTQLTTVRLMLALATINQWYLKQLNVNNAFLHGDLNEKVYMVIPQGMQVTKPRQVCKLQRSLYGLKQASRPWKYALDILNDDGMLGSKLVSTPSNYTTKLHQHLRTLLSTEDASSFGRLMGRLIYLTNTRLNITYVVQHLSQFVVTPILAHQQVAFRIHRYLKGTPDAHQRPSIGHWAVPLLSYNGSTICWHIVKLFPIPSTNQLAYIYTKALMPSTFQILYFKQGMSDLPLQASSVSFAFIHGTHEFYENMLRNLSSLSPLPFYPYTWSKSKGTPHVVEERLDKAMATNDWLYLSPNVELKNVMAFMKLSTPMPTRYCEQDLWVSRGVGGLGEKSEKLV

SEQ ID NO: 150230 - protein, 180 aa, Glycine max
  Coding DNA Sequence Number=SeqID_33452
MSLFWRWLETPPELRRKSSTHRGSKKSALNRIDTLFTNESKKNDFKMIYIVNNVRIPKYLDLEWFFQQGFNFPNMLEAQGLSKLVRMKGTFYPELVKVFYTCARTDLEGLMKLGEKNCIFACIVSQRALRGRARARLTGALSKGGKMCGVATNVYLWKTSEKPKETGQNENSKFGSCIYA

SEQ ID NO: 150231 - protein, 78 aa, Glycine max
  Coding DNA Sequence Number=SeqID_33453
MEREMITMIVDTLPVFYYEKLVGYTPSSFADLVFVGERIEVGLRRGKFDYPTLMNMKPGENGQSKNEGGTHVVTAIHT

SEQ ID NO: 150232 - protein, 100 aa, Glycine max
  Coding DNA Sequence Number=SeqID_33454
MLRDSIRHPSKKLWSLNWLRDSTFNFERLDILRDSIRYPSKKLWSLNWLRDSTFNFERLDILRDSIRHPSITLLLFELAESFNIQFRASRYITGLNQISE

SEQ ID NO: 150233 - protein, 656 aa, Glycine max
  Coding DNA Sequence Number=SeqID_33455
  Gene Ontology: Mol. function=nucleoside-triphosphatase activity; Cellular component=integral to membrane; Biological process=transport
  Homolog annotation: Hit_ID=Q1SP34; Match level="QueryCoverage=99%, HitCoverage=100%, E-value=0.0, Identity=75%"; Hit description=AAA ATPase
  Pfam annotation: Domain name=ABC2_membrane; Domain location=380-590; Score=188.3; E_value=1.8e-53; Accession=PF01061.14; Description=ABC -2 type transporter
  Pfam annotation: Domain name=ABC_tran; Domain location=97-289; Score =158.6; E_value=1.6e-44; Accession=PF00005.17; Description=ABC transporter
  Pfam module annotation: Pfam domain module=ABC2_membrane::ABC_tran; Domain location=380-590::97-289
MAACLNPPRLSSTEDDSVILYSTSNSPEESNSPSSSSFYHSPPPSLYQFRTENKLSVRNLCYTLHPHKTTPFSFCHLTQKPKPVNILKSVSFIARSSEIVAVVGPSGTGKSTLLRIIAGRVKDEGFNPKSVSINDQPMTTPVQLRKICGFVAQEDNLLPMLTVKETLLFSAKFRLKEMTPKDRELRVESLLQELGLFHVADSFVGDEENRGISGGERKRVSIGVDMIHNPPILLLDEPTSGLDSTSALQVIELLSSIVKAKQRTVVLSIHQPSYRILQYISKFLILSHGSVVHNGSLEQLEETISKLGFQIPTQLNALEFSMEIIRGLEDSSSKYDTCSIEEMEPIPNLMWPEEENCEVQIVQSQCNKGSFGSLFYANLIEILFLCSRFWKIIYRTKQLFLARTMQAIVGGFGLGSVYIKIRRDEGGVAERLGLFAFSLSFLLSSTVEALPIYLQERSVLMKEASRGAYRISSYMIANTFVFLPFLFVVSILFAVPVYWLVGLNPSLSAFTFFTFVVWLIVLMASSLVLFLSAVSPDFISGNSLICTVLGAFFLFSGYFIPKESIPKYWIFMYYVSLYRYPLDALLTNEYWNVRSECFSHQIEGSQCLITGFDVLKSRGLERDNRWMNVGIMLGFFVLYRVLCWIILARKASKTTL

SEQ ID NO: 150234 - protein, 503 aa, Glycine max
  Coding DNA Sequence Number=SeqID_33456
  Gene Ontology: Mol. function=hydrolase activity, acting on ester bonds; Cellular component=membrane; Biological process=metabolic process
  Homolog annotation: Hit_ID=O81020; Match level="QueryCoverage=97%, HitCoverage=96%, E-value=0.0, Identity=74%"; Hit description =Putative phospholipase C
  Pfam annotation: Domain name=Phosphoesterase; Domain location=10-372; Score=581.8; E_value=6.6e-172; Accession=PF04185.5; Description =Phosphoesterase family
CHHAIPNNPIKTVVVLVMENRSFDHMLGWMKRLNPAIDGVTGSESNPLSVSDPDSKRFFFRDRAHFVDPDPGHSFQAIREQIFGSNDSSLDPPPMNGFVQQAYSMDNTSHMSENVMNGFDPDLVAVYKTLVSEFAVFDRWFASVPASTQPNRLFVHSATSGGATSNVAAKLTAGYPQQTIFDSLHDAGHDFGIYYQNIPATLFYRNLRKLKYVLKFHIYDVSFKQHAKEGKLPSYTVVEQRYMDTKLLPANDDHPSHDVYEGQVFVKEVYETLRASPQWNETLFLITYDEHGGFYDHVPTPARGVPSPDGIVGPEPFNFTFNRLGVRVPTIAIFPWIEKGTVVHGPNGSPSPTSEYEHSSIPATVKKLFNLPSFLTNRDAWAGTFEGIVQTRTEPRTDCPEKLPTPEKIRKGEPNEDAKLSEFQQELIQLAAVIKGDNILTSFPGTIGKDMTVKQGKYYMDDAVRSFFEAGRYARKMGVNEEHIVQMKPSLTTRSSKSPNTNP

SEQ ID NO: 150235 - protein, 185 aa, Glycine max
  Coding DNA Sequence Number=SeqID_33457
  Gene Ontology: Mol. function=sequence-specific DNA binding; Cellular component=nucleus; Biological process=regulation of transcription, DNA-dependent
  Homolog annotation: Hit_ID=Q9ZRB8; Match level="QueryCoverage=60%, HitCoverage=37%, E-value=4e-45, Identity=78%"; Hit description =Homeobox 2 protein
  Pfam annotation: Domain name=KNOX1; Domain location=18-62; Score =72.1; E_value=1.8e-18; Accession=PF03790.4; Description=KNOX1 domain
  Pfam annotation: Domain name=KNOX2; Domain location=73-128; Score =83.1; E_value=8.9e-22; Accession=PF03791.4; Description=KNOX2 domain
  Pfam module annotation: Pfam domain module=KNOX1::KNOX2; Domain location=18-62::73-128
MQEPSLGLMGEVSGDHHRQLKAEITTHPLYEQLLAAHVACLRVATPIDQLPLIDAQLSQSHHLLRSYVSHNTHSLSPHHRQELDNFLAQYLIVLCTFKEQLQQHVRVHAVEAVMACRDIENALQALTVFLVELIRLRNGVVGSTNVILWSVHKWQWEELVSLVRNGRPSRPTMALPTTYNAITDL

SEQ ID NO: 150236 - protein, 377 aa, Glycine max
  Coding DNA Sequence Number=SeqID_33458
  Gene Ontology: Mol. function=methyltransferase activity; Biological process=metabolic process
  Homolog annotation: Hit_ID=Q00TN0; Match level="QueryCoverage=81%, HitCoverage=31%, E-value=4e-64, Identity=41%"; Hit description =Homology to unknown gene
MIVRKNKPSARSLLMLFVMVLAFLFVTYNLVFIIKHHMGGTWVAEELRFLDPVISMPGKVMALANSNSKFHVAVTATDAAYSQWQCRIMYYWYKKVKDMPGSDMGKFTRIVHSGRQDQLMDEIPTFVVDPLPEGLDRLSGRIHRKEEIKYSDRPWAFVQWLEKADIEEEYILMAEPDHIFVNPLPNLTNGNQPAGYPFFYIKPVKHEKILRKFYPKANGPITAIDPIGNSPVIIQKSLLEEIAPTWVNISLQMKDDPATDETFGWVLEMYAYAVASALHGVRHILHDNFMLQPPWDFDVENNFIIHYTYACDYNLKGELTYGKIGEWRFNKRFYLSGPPPKNLSLPPPGVPESVVQLVKMINEATANIPKWDSLNRS

SEQ ID NO: 150237 - protein, 1034 aa, Glycine max
  Coding DNA Sequence Number=SeqID_33459
  Gene Ontology: Mol. function=protein phosphatase 2A binding; Cellular component=cytoplasm; Biological process=mRNA catabolic process, nonsense-mediated decay
  Homolog annotation: Hit_ID=Q8W417; Match level="QueryCoverage=79%, HitCoverage=98%, E-value=0.0, Identity=47%"; Hit description=Cig3
MDKMSAPSSRERAQRLYDKNLELESKRRRSAKARVPSDPNAWQQIRENYEAIILEDHAFSEQHNIEYALWQLHYKRIEEFRAYFSAALSSTNANSSQGGKGPARPDRITKIRLQFKTFLSEATGFYHDLITKIRAKYGLPLGYFEDSEKDGKKSAEMKKGLVACHRCLIYLGDLARYKGMYGEGDSINREFTAASSYYLQAASLWPSSGNPHHQLALLASYSGDELVAIYRYFRSLAVDSPFTTARENLIVAFEKLSGDVKALAVKESSVRSTGKGRGKGEAKLATRGTGVDASPRTGASSIQETYKYFCTRFVRLNGILFTRTSIETFAEVLAVVSTGLRELLSSGQDEELNFGTDTPENALVIVRIVCILVFTVYNVNKESEGQTYSEIVQRAVLLQNAFTAAFELMGYLIERCAQLRDPSSSYLLPGILVFVEWLAFYPDLAAGNDVDENQANLRSEFWNRCVSFLNKLLSVGPMSIDDDEEETCFNNMSRYEEGETENRHALWEDSELRGFIPLLPAQTILDFSRKHSIVSDGDKERKARIKRILAAGKALANVVKVDKQMIYFDSKVKKFVIGVEPQTADDFGFSTYSGMSNAKELVQENPAQKSKMEIVQSNQHQHMEGDDDDEVIVFKPVVAETRADVIASSWAPHVGLEPFPKASGGDLIFHVNSTSNPLSNLSHQTLSVPGGGMVPQHLQPVQPHTSRWLEEEISLANNLKGLGLFENGHVMKPGLQEAVGFSNHVSLPFPIQQSIGADTNGMFYGFSKALESAVPSKVDTIASSGVVTDNLAVKTSALPVGSRKAPVSRPTRHLGPPPGFSHVPPKQGIESTVSDSISGNPIMDDYSWLDGYHLHSSTKGLGSNGPLNYSQSNSQQVSNNGLSPTASFPFPGKQVPPVPLQVEKQNGWQDYQTYDLLKSHHGQQLQPQQLTTGNQQFSPLPEQFQGQSMWTGPCRHIANVLHPFATQSNSSLAASSLNVVGVSLALACCRHLLLQKLAWLGIRRFEWMKGECDELMLEVGMGTDHALVMIIYCQ

SEQ ID NO: 150238 - protein, 98 aa, Glycine max
  Coding DNA Sequence Number=SeqID_33460
  Subcellular localization annotation: CTP_CleavageSite=52; ConfidenceScore=5.36e-01
MPRLQNKTTWGQNRARQQMSWMTGNSERFTGKWSQRSGMTRRSETMENKGCRAGEGWMFFRKENSRCRFITESMQVTEKVRVSFCPTPATILSGYHSH

SEQ ID NO: 150239 - protein, 100 aa, Glycine max
  Coding DNA Sequence Number=SeqID_33461
  Subcellular localization annotation: CTP_CleavageSite=41; ConfidenceScore=5.04e-01
MARRNSGGNSGGMVVVWNGGGDNGGGSSIGVVGAITGPMVVMQKLQSSDPERRSRITLTIKEPKAKPLLSLLGHFSDLTMDTKLFQQQLFQAHTNTQSTL

SEQ ID NO: 150240 - protein, 86 aa, Glycine max
  Coding DNA Sequence Number=SeqID_33462
  Homolog annotation: Hit_ID=Q5Z800; Match level="QueryCoverage=72%, HitCoverage=8%, E-value=3e-20, Identity=77%"; Hit description =Putative NF-E2 inducible protein
  Pfam annotation: Domain name=DUF544; Domain location=12-86; Score =23.5; E_value=2.8e-07; Accession=PF04424.4; Description=Protein of unknown function (DUF544)
MKLNKELKGTHCNVLLLRNNLNLSPDIAEVSQEKLLSLVAERLIDSNSNVNNKDAGYVENQQQNIADAIDLLPRLATGIDVNIKFR

SEQ ID NO: 150241 - protein, 229 aa, Glycine max
  Coding DNA Sequence Number=SeqID_33463
  Gene Ontology: Mol. function=enzyme activator activity; Cellular component=anaphase-promoting complex; Biological process=cell division
  Homolog annotation: Hit_ID=Q4TU48; Match level="QueryCoverage=99%, HitCoverage=54%, E-value=1e-117, Identity=63%"; Hit description=Cell cycle switch protein CCS52A
  Pfam annotation: Domain name=WD40; Domain location=166-204; Score =38.1; E_value=3.1e-08; Accession=PF00400.22; Description=WD domain, G-beta repeat
  Pfam annotation: Domain name=WD40; Domain location=36-74; Score=34.9; E_value=2.7e-07; Accession=PF00400.22; Description=WD domain, G-beta repeat
  Pfam annotation: Domain name=WD40; Domain location=78-119; Score =19.7; E_value=0.01; Accession=PF00400.22; Description=WD domain, G -beta repeat
  Pfam module annotation: Pfam domain module=WD40::WD40::WD40; Domain location=166-204::36-74::78-119
MEGHRLRVGALAWSSSLLSSGGRDKSIYQRDIRAQEDFVSKLSGHKSEVCGLKWSYDNRELASGGNDNRLLVWNQKSTQPVLKFCEHTAAVKAIAWSPHVNGLLASGGGTVDRNIRFWNTTTNSQLNCIDTGSQVCNLVWSKNVNELVSTHGYSQNQIIVWKYPTMSKLATLTGHTYRVLYLAISPDGQTIVTGAGDETLRFWNVFPSRKSQNTESEIGASSFGRTIIR

SEQ ID NO: 150242 - protein, 87 aa, Glycine max
  Coding DNA Sequence Number=SeqID_33464
MSPKDMEQLSQKIRDQLEEWITEKTRCNPSFNRRCNHRYSHYLLSLRMVVQLLMSAQRKMLSSGFDDTPQSKSKATARWIVVKVNLR

SEQ ID NO: 150243 - protein, 219 aa, Glycine max
  Coding DNA Sequence Number=SeqID_33465
  Gene Ontology: Mol. function=sequence-specific DNA binding; Cellular component=nucleus; Biological process=regulation of transcription, DNA-dependent
  Homolog annotation: Hit_ID=Q1SHP5; Match level="QueryCoverage=90%, HitCoverage=21%, E-value=2e-72, Identity=67%"; Hit description =Homeodomain-related
MCQIDMEKLVGSLPLHLTTLLMSAVRDEALFRYLLCGIRLLHSLCELASRNSKFEQIVLDDVKMMEQLTDLVFYMQIVLGGYRQEYCAFSYMHLMHSTLVACNLHLLTAFISTQWQDIVHVLLAHPKVNIFMDAAFGSVRMVVSFLENTLVAYHEDISVESNLTAEQMVYYLCQQCEASLQFLQSLCQQFFFKERLLKNKVPKPILHSYFINLERGLCP

SEQ ID NO: 150244 - protein, 35 aa, Glycine max
  Coding DNA Sequence Number=SeqID_33466
MGVAAVKVKFPASSFAVVGGQWRQTRWMKMSECMK

SEQ ID NO: 150245 - protein, 43 aa, Glycine max
  Coding DNA Sequence Number=SeqID_33467
MRKRKWRKESAFPESQNVIGFGSKNPFASLMEQGHVVIDYSIW

SEQ ID NO: 150246 - protein, 255 aa, Glycine max
  Coding DNA Sequence Number=SeqID_33468
  Gene Ontology: Mol. function=sequence-specific DNA binding; Cellular component=chloroplast thylakoid membrane
  Homolog annotation: Hit_ID=Q00ZC0; Match level="QueryCoverage=79%, HitCoverage=35%, E-value=8e-12, Identity=27%"; Hit description=[K] KOG1657 CCAAT-binding factor
MANRRDPRGHTLDAVHKTYKVEEDAAVVDSKILQYCSIDKKEKKSVGEMEQEFLQALQAFYYEGKAIMSNEEFDNLKEELMWEGSTVVMLSSDEQKFLEASMAYVSGKPILSDKEFDELKLRLKMEGSEIVAEGPRCSLRSRKVYSDLSVDYLKMFLLNVPATVVALGLFFFLDDVTGFEISYLIKIPEPFSFILTWFAAIPFILWLAQSITRAIVQDFLILKGPCPNCGTENTSFFGTILSVSSGDSTNKVKCE

SEQ ID NO: 150247 - protein, 673 aa, Glycine max
  Coding DNA Sequence Number=SeqID_33469
  Gene Ontology: Mol. function=transition metal ion binding; Biological process=proteolysis
MDDSLDITPSEGESNPQSTKKRGRGPTRLKKLRLKRVRDQKISIEFDQSTGNAKGPNRTEFNNYVSFLARSKLNYDIPNSEFLKKKLISYAGTRWRGFKTQLSSLYIYGKYQDKSPCDKYAFLEEETWQRFVQSRLDPAFQEKRKKAQEAQANNLYPHTLSCGGYQKLEENMMQEKVKQIQEASQLDPSLAVVEPPSPLKRHEKWKRARQKKSGDYINEDARIIAEKIDSLVEQSTQGSFVPLGREDILTTAIGQPEHPGRVRGAGRGVGIRQYFGPPSRNPLSMEDLEVITQRIQEQVTKKLSEQLEHKLKADLSQQFQEQVRQELASLGLLQQNTNIEPTPSSPINVSTKGNYATPDPSVEDNHTNIRDQCELYVDVDPPHLVAIGKVYNLGSTIHHKTIEDDNVRVVVEEVRDAEARVPLPTNEVQTVGQAPNQFIQWPRRLVKSISVKTIVESSKDVRHKRLEPQLGPLERLLIIVSKIRKDHVQLPWDPDVLSKPSTMSFHIYRRDIFELCMGSEMLNISVIQLWLMYLHSLCTDKGNAHIYGFMDPQSIQSVGNNATEVQGYLQSRLHERKKQCYLAPYLHSAMDEYQRLVGSQSRSRRKKPTWILPRCQTQSKGYECGYYVMKQMFTVVTVDIVDSWKQLFNNSGPFPEEDIADIQQRWAAFLLQI

SEQ ID NO: 150248 - protein, 108 aa, Glycine max
  Coding DNA Sequence Number=SeqID_33470
  Subcellular localization annotation: CTP_CleavageSite=36; ConfidenceScore=5.71e-01
MVLKTVNDNKLSSPIVSSPSIPLCVAQRSLSFTLVSPNARFGRIISTESLRRILRILLRLQPSSWCGGLAVNNGGSWWPLMVVGGGEGCVRVWVAFGEEERGKIVFSR

SEQ ID NO: 150249 - protein, 84 aa, Glycine max
  Coding DNA Sequence Number=SeqID_33471
MAKNISQNTVATIEQLDMTRTSVRFDRELTKEEDFGLGMASTSGDAPPPSSNTARLMAKMFKLGDQIRRMSYENEERMERMRRV

SEQ ID NO: 150250 - protein, 502 aa, Glycine max
  Coding DNA Sequence Number=SeqID_33472
  Gene Ontology: Mol. function=transferase activity, transferring nitrogenous groups; Cellular component=cytoplasm; Biological process= ethylene biosynthetic process
  Homolog annotation: Hit_ID=Q6U5H3; Match level="QueryCoverage=84%, HitCoverage=88%, E-value=1e-167, Identity=68%"; Hit description=1 -aminocyclopropane-1-carboxylate synthase
  Pfam annotation: Domain name=Aminotran_1_2; Domain location=113-491; Score=267.8; E_value=2.1e-77; Accession=PF00155.11; Description =Aminotransferase class I and II
MRVIVPLQGLVQGTGGLFWGSVIPCALLYFLQLYLRTKPCHHPQPPPSHKDQDQDSTSFHRSLSSNHRHSTSSASAYVSPRANSLTAANSPYYLGLHKVAVDPYHQTHNPHGVIQLALHQNTLSLDLIQDWIHLNGSAAVLGTPLGISRIVPYQPLHGLMDLKVAVAGFMYQVLENLIFFNTSRMVLTAGATSAIEILSFCLADNGNAFLVPTPLSPGFDGVVKWRTGVEIVPVPCRSTDDFNLSITSLERTFKQAKMRGQKVRGIIINNPSNPAGKLFDRETLLDLLDFAREKNIHIISNEMFAGSSYGNEEFVSMAEIMEAEDHDRDRVHIVFGLSNELSVPGLKVGVIYSYNDNVVAASSKLARFSTVSAPTQRLLISMLSDTSFVQKFIEVNRLRLRKMYNTFVAGLKQLGIECTRSSGGFCCWADMSRLIGSYSEKGELELWDRLLNVAKINVTPGSSCHCIEPGWFRFCFATSTEKDVSVVMERIRRTVDATNGHG

SEQ ID NO: 150251 - protein, 505 aa, Glycine max
  Coding DNA Sequence Number=SeqID_33473
MAGEEEEMMMMEESEMEIESQVFVAHEIDLDYEFDAVRFFDFGAQETPAQARQAELWFHSAGSYPPSPFVAKLVAREDDVRECATTVHAANSNVPSGIGFSRTVFHHDGSWLVAYFTDAFVLAGSKGGGGSGNISALLSGVPRDVNMQLLHVTSGMTFSSKTIGGNLNSKVSNPWMPRKLFFLVYLQLNYSIVLRFQKLQDHNKKMNSSTSSGIECQAAKRQKLEGGSLHKVGDVKQQVNFVHKAPKKVATVDQNSGHSKLKITIPREPDLETAHRAQRIRPKIAAEAEVVTVAAPIFRARPLNRKILNAPSLPLPKRSTPRLPEFQEFHLKTQERAMQHTSATSTSSLHCNDSDKIYMISDLRGTEVCWLQDLDKHRAVSAQENRIRDLRRPSAMGAPKHDGLDFAHSFKARPLNKKILSSKGDIGVFRNRKQETTVPMEFNFHTEKRVQHNPPIELFSKMSLTSEVQSNNGSQLKLLRHSRVFREELGNSMIAIQTRANVQHS

SEQ ID NO: 150252 - protein, 747 aa, Glycine max
  Coding DNA Sequence Number=SeqID_33474
  Gene Ontology: Mol. function=identical protein binding; Cellular component=cytoplasm; Biological process=negative regulation of enzyme activity
  Homolog annotation: Hit_ID=O04678; Match level="QueryCoverage=98%, HitCoverage=99%, E-value=0.0, Identity=53%"; Hit description =Subtilisin-like protease
  Pfam annotation: Domain name=PA; Domain location=357-456; Score=88.9; E_value=1.5e-23; Accession=PF02225.12; Description=PA domain
  Pfam annotation: Domain name=Peptidase_S8; Domain location=122-574; Score=53.7; E_value=6.3e-13; Accession=PF00082.12; Description =Subtilase family
  Pfam annotation: Domain name=Subtilisin_N; Domain location=37-115; Score=62.2; E_value=1.6e-15; Accession=PF05922.7; Description =Subtilisin N-terminal Region
  Pfam module annotation: Pfam domain module=PA::Peptidase _S8::Subtilisin_N; Domain location=357-456::122-574::37-115
MEKSKYVMELALLLGLIFMLSANPTSMAEEHGNNNLKTYIVHVKKPETIPFLQSEELHNWYRSFLPETTHKNRMIFSYRNVASGFAVKLTPEEAEALEEKDEIVSARPERTLSLHTTHTPSFLGLQQGVGLWNSSNLGEGVIIGVIDTGIYPFHPSFNDEGMPPPPAKWNGHCEFTGQRTCNNKLIGARNLLKSAIEEPPFENFFHGTHTAAEAAGRFVENASVFGMARGTASGIAPNAHVAMYKVCNDKVGCTESAILAAMDIAIDDGVDVLSLSLGLGSLPFFEDPIAIGAFAAIQSGVFVSCSAANSGPNYSTLSNEAPWILTVGASTIDRKIAASAVLGNGAEYEGESLFQPQDYSPSLLPLVYPGANGNNNSEFCLPGSLNNIDVKGKVVVCDIGGGFPSVEKGQEVLKAGGAAMILANPESFGFSTFAVAYVLPTVEVSYVAGLAIKSYINSTYSPTATISFKGTVIGDALAPTVVSFSSRGPSQASPGILKPDIIGPGVNILAAWAVSVDNKIPAYNIVSGTSMSCPHLSGVAALLKSAHPDWSPAAIKSAIMTTANTVNLGGTPIVDQRNLPADIFATGAGHVNPNKANDPGLVYDIQPEDYVPYLCGLGYDDREIAILVQSRVRCSSVKAIPEAQLNYPSFSILMGSSSQYYSRTLTNVGPAQSTYTVELDVPLALGMSVNPSQITFTEANQKVTFSVEFIPQRKENRGNHTFAQGSLTWVRVSDKHAVRIPISVIFK

SEQ ID NO: 150253 - protein, 691 aa, Glycine max
  Coding DNA Sequence Number=SeqID_33475
  Gene Ontology: Mol. function=identical protein binding; Cellular component=cytoplasm; Biological process=negative regulation of enzyme activity
  Homolog annotation: Hit_ID=O65836; Match level="QueryCoverage=95%, HitCoverage=95%, E-value=1e-173, Identity=48%"; Hit description=P69F protein
  Pfam annotation: Domain name=PA; Domain location=312-411; Score=97.3; E_value=4.6e-26; Accession=PF02225.12; Description=PA domain
  Pfam annotation: Domain name=Peptidase_S8; Domain location=111-542; Score=-32.6; E_value=4.9e-05; Accession=PF00082.12; Description =Subtilase family
  Pfam annotation: Domain name=Subtilisin_N; Domain location=26-108; Score=53.3; E_value=8.3e-13; Accession=PF05922.7; Description =Subtilisin N-terminal Region
  Pfam module annotation: Pfam domain module=PA::Peptidase _S8::Subtilisin_N; Domain location=312-411::111-542::26-108
MTITKQVLSTKLEPALPLALALIYLLTYIVRVKKLQDGNSLQAKDLHGWYHSLLPDSTKTDQNQQRITFSYRNVVDGFAVKLTPEEAKALQEKEEVVSARPERTFSLHTTHTPSFLGLQQGLGLWTNSNFGKGIIIGILDTGITPDHLSFNDEGMPLPPAKWNGRCEFTGEKTCNNKLIGARNFVKNPNSTLPLDDVGHGTHTASTAAGRLVQGASVFGNAKGSAVGMAPDAHFVIYKCNTSWNGHCNTSLGGPSVPFFDDPIALGAFSAIQKGIFAPWIITVGASTIRRIVAIPKLGNGETFNGESIFQPNNFTSTLLPLVYAGANGNDSSTICAPGSLKNVDVKGKVVLCDIGGFVRRVDKGQEVKNAGGAAMILMNSHIEDFNPFADVHVLPATHVSYKAGLAIKNYINSTSTPTATILFEGTVIGNPHAPAVTSFSSRGPSFANPGILKPDIIGPGQNILAAWPVSLDKNLPPFNIISGTSMSCLHLSGIAALLKNSHPDWSPAAIKSSIMTSANTVNLGGKPILDQRLLPADVFATGAGHVNPLKANDPGLVYDLQPTDYIPYLCGLNYTDKKSRTHLEPKSEVLRDFFLLIFSFHHKFQYRTLTNVGPANINYSVEVDVPLAVGISINPAEIEFTEVKQKVSYSVGFYPEGKNNRRKHPLAPGSIKWVSSNGKYSVSIPIAVVFL

SEQ ID NO: 150254 - protein, 64 aa, Glycine max
  Coding DNA Sequence Number=SeqID_33476
MSFEYSTPIKLFFSVWWSNDKQRRLVVVTSGQWWWRRRLGVLGEGLGEEMQLARLAQVKFGLPG

SEQ ID NO: 150255 - protein, 399 aa, Glycine max
  Coding DNA Sequence Number=SeqID_33477
  Gene Ontology: Mol. function=bile acid:sodium symporter activity; Cellular component=membrane; Biological process=sodium ion transport
  Homolog annotation: Hit_ID=Q9SZ68; Match level="QueryCoverage=74%, HitCoverage=77%, E-value=3e-97, Identity=58%"; Hit description =Putative transport protein
  Pfam annotation: Domain name=SBF; Domain location=123-308; Score =167.8; E_value=2.8e-47; Accession=PF01758.7; Description=Sodium Bile acid symporter family
  Subcellular localization annotation: CTP_CleavageSite=57; ConfidenceScore=5.32e-01
MISSGLKLKHFRNVDSLFHFPKSKPPILLPCCPTISSPCSIRFNSHFPYRSTKVPLKCAPLPSSDSLPPDLSDAPTQTEQNSMSILEILKQSNSYLPHVLIASILLALIYPPSLTWFTSRYYAPALGFLMFAVGVNSNENDFLEAFKRPAEIVTGYFGQFAVKPLLGYLFCMIAVTVLSLPTTVGAGIVLVACVSGAQLSSYATFLTDPQMAPLSIVMTSLSTASAVFVTPLLLLLLIGKKLPIDVRGMVYSITQIVVVPIAAGLLLNRFYPRICNVIRPFLPPLSVLVASICAGAPLAFNVETMKSPLGVAILLLVVAFHLSSFIAGYILSGFVFRDSLDVKALQRTISFETGMQSSLLALALANKFFEDPKVAIPPAISCGDCILSVIQRGGFALGA

SEQ ID NO: 150256 - protein, 325 aa, Glycine max
  Coding DNA Sequence Number=SeqID_33478
  Gene Ontology: Mol. function=RNA-directed DNA polymerase activity; Cellular component=intracellular; Biological process=RNA-dependent DNA replication
QAMLKYGEVFKCIGEWNWGTCAIGIQAALESKAKILKVYGDFVLVIHQLNGEGESRDSKLIPYHAYIKELAKKFGKITFHRIPHEDNQLVDALAMLSSMFKIIPDRHMSLIRMQSQDHLAYCQVIGEELDGKPWYHDIKCYIKNKEYPSDVLYKKNNDTVLLKCVDSTEAKKILKEIHEESYGTHANGHAMAQKILRAGYYWLTMDNDCCEHVRKCHKCQTYANNIHAPLISLIAPWPFSMWGIDVIGPIELRASNGHRFILVTISPRATPFSLVNGMEAVLPIKVEIPSLRVLMERKLEKVEWVQTRYDQLNLIKEKRLITLCH

SEQ ID NO: 150257 - protein, 234 aa, Glycine max
  Coding DNA Sequence Number=SeqID_33479
  Gene Ontology: Mol. function=protein binding
  Homolog annotation: Hit_ID=Q9ZVQ5; Match level="QueryCoverage=90%, HitCoverage=68%, E-value=6e-46, Identity=39%"; Hit description =Expressed protein
  Pfam annotation: Domain name=SNARE_assoc; Domain location=116-234; Score=96.7; E_value=6.8e-26; Accession=PF09335.1; Description=SNARE associated Golgi protein
MTYFEEDAINDDGDRVRDVERNHDGGGEYVKLVWDPQPEAVPTHRGGSSRLWYWVKLVLCFLCLGLLALVAFEWVAPLFIEKVIIPIIKWETNTFSSPVLAVLLFASIALFPTLILPSSPSMWVAGLKFGYGFGFLLIISAAAVGVSLPFLIGSIFHSKIEGWLEKYPKRASVLRSAGGGNWFHQFRAVALIRVSPFPYIIFNYCAVATNVKYWPYLLGSLVGMVPEIFVSIYT

SEQ ID NO: 150258 - protein, 914 aa, Glycine max
  Coding DNA Sequence Number=SeqID_33480
  Gene Ontology: Mol. function=protein kinase activity; Cellular component=integral to membrane; Biological process=protein amino acid phosphorylation
  Homolog annotation: Hit_ID=Q8L4U4; Match level="QueryCoverage=93%, HitCoverage=95%, E-value=1e-155, Identity=44%"; Hit description =Putative receptor-like protein kinase
  Pfam annotation: Domain name=LRRNT_2; Domain location=68-109; Score =46.5; E_value=9.3e-11; Accession=PF08263.3; Description=Leucine rich repeat N-terminal domain
  Pfam annotation: Domain name=LRR_1; Domain location=113-135; Score =1.6; E_value=1.4e+02; Accession=PF00560.23; Description=Leucine Rich Repeat
  Pfam annotation: Domain name=LRR_1; Domain location=137-159; Score =8.3; E_value=8.1; Accession=PF00560.23; Description=Leucine Rich Repeat
  Pfam annotation: Domain name=LRR_1; Domain location=161-183; Score =9.7; E_value=4.4; Accession=PF00560.23; Description=Leucine Rich Repeat
  Pfam annotation: Domain name=LRR_1; Domain location=185-208; Score =15.2; E_value=0.24; Accession=PF00560.23; Description=Leucine Rich Repeat
  Pfam annotation: Domain name=LRR_1; Domain location=210-232; Score =11.7; E_value=1.8; Accession=PF00560.23; Description=Leucine Rich Repeat
  Pfam annotation: Domain name=LRR_1; Domain location=234-256; Score =8.2; E_value=8.2; Accession=PF00560.23; Description=Leucine Rich Repeat
  Pfam annotation: Domain name=LRR_1; Domain location=258-280; Score =7.5; E_value=11; Accession=PF00560.23; Description=Leucine Rich Repeat
  Pfam annotation: Domain name=LRR_1; Domain location=282-302; Score =12.2; E_value=1.5; Accession=PF00560.23; Description=Leucine Rich Repeat
  Pfam annotation: Domain name=LRR_1; Domain location=306-327; Score =13.9; E_value=0.59; Accession=PF00560.23; Description=Leucine Rich Repeat
  Pfam annotation: Domain name=LRR_1; Domain location=330-352; Score =9.1; E_value=5.6; Accession=PF00560.23; Description=Leucine Rich Repeat
  Pfam annotation: Domain name=LRR_1; Domain location=354-376; Score =8.7; E_value=6.6; Accession=PF00560.23; Description=Leucine Rich Repeat
  Pfam annotation: Domain name=LRR_1; Domain location=378-400; Score =7.6; E_value=11; Accession=PF00560.23; Description=Leucine Rich Repeat
  Pfam annotation: Domain name=LRR_1; Domain location=402-424; Score =9.1; E_value=5.6; Accession=PF00560.23; Description=Leucine Rich Repeat
  Pfam annotation: Domain name=LRR_1; Domain location=426-448; Score =11.0; E_value=2.5; Accession=PF00560.23; Description=Leucine Rich Repeat
  Pfam annotation: Domain name=LRR_1; Domain location=450-472; Score =21.5; E_value=0.0029; Accession=PF00560.23; Description=Leucine Rich Repeat
  Pfam annotation: Domain name=LRR_1; Domain location=474-496; Score =22.1; E_value=0.002; Accession=PF00560.23; Description=Leucine Rich Repeat
  Pfam annotation: Domain name=LRR_1; Domain location=498-519; Score =12.7; E_value=1.2; Accession=PF00560.23; Description=Leucine Rich Repeat
  Pfam annotation: Domain name=Pkinase; Domain location=638-897; Score =58.0; E_value=3.2e-14; Accession=PF00069.15; Description=Protein kinase domain
  Pfam annotation: Domain name=Pkinase_Tyr; Domain location=638-914; Score=27.4; E_value=3.7e-14; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =68-109::...
  Pfam module annotation: Domain location=113-135::137-159::161 -183::185-208::210-232::234-256::258-280::282-302::306-327::330 -352::354-376::378-400::402-424::426-448::450-472::474-496::498 -519::638-897::638-914
MALVIATGVVVAWLVGKNKCRAENSEGKGRERLNGGDHIVSSMRRHREIHLSHALLSTVFCLFVTASAATEKEILLEFKGNITDDPRASLSSWVSSGNPCNDYNGVSCNSEGFVERIVLWNTSLGGVLSSSLSGLKRLRILALFGNRFSGGIPEGYGELHSLWKINLSSNALSGSIPEFIGDFPSIRFLDLSKNGFTGEIPSALFRYCYKTKFVSLSHNNLAGSIPASLVNCSNLEGFDFSFNNLSGVVPPRLCGIPRLSYVSLRNNALSGSVQELISTCQSLVHLDFGSNRFTDFAPFRVLEMQNLTYLNLSYNGFGGHIPEISACSGRLEIFDASGNSLDGEIPPSITKCKSLKLLALELNRLEGNIPVDIQELRGLIVIKLGNNFIGGMIPSGFGNVELLELLDLHNLNLVGQIPDDISNCKFLLGLDVSGNKLEGEIPQTLYNLTNLESLNLHHNQLNGSIPPSLGNLSRIQYLDLSHNSLSGPIPPSLGNLNNLTHFDLSFNNLSGRIPDVATIQHFGASAFSNNPFLCGPPLDTPCNRARSSSAPGKAKVLSTSAIVAIVAAAVILTGVCLVTIMNMRARGRRRKDDDQIMIVESTPLGSTESNVIIGKLVLFSKSLPSKYEDWEAGTKALLDKESLIGGGSIGTVYRTDFEGGVSIAVKKLETLGRIRNQEEFEHELGRLGNLQHPHLVAFQGYYWSSSMQLILSEFIPNGNLYDNLHGFGFPGTSTSTGNRELYWSRRFQIAVGTARALAYLHHDCRPPILHLNIKSSNILLDDKYEAKLSDYGLGKLLPILDNYGLTKFHNSVGYVAPELAQGLRQSEKCDVYSFGVILLELVTGRKPVESPTTNEVVVLCEYVRGLLETGSASDCFDRNILGFAENELIQVMRLGLICTSEDPLRRPSMAEVVQ

SEQ ID NO: 150259 - protein, 155 aa, Glycine max
  Coding DNA Sequence Number=SeqID_33481
  Homolog annotation: Hit_ID=Q015H1; Match level="QueryCoverage=48%, HitCoverage=18%, E-value=8e-21, Identity=56%"; Hit description=[YU] KOG2445 Nuclear pore complex component
  Subcellular localization annotation: CTP_CleavageSite=26; ConfidenceScore=5.04e-01
MAAATLYLAKPSWSYTPKIPSLPRVRDSGIGTVKTKVKAKAGILGLGLFHFLNFVEPGSCLQLQFHEPPNALSLPTWAIHVSSVAEWIIAMALVWQYGEKSGYPAWKGLSWGMVPLLGGAFCACTWHFFYNSDSLEARLLTMPLHPSYVWIHRKD

SEQ ID NO: 150260 - protein, 51 aa, Glycine max
  Coding DNA Sequence Number=SeqID_33482
SASGHGTFKCFMVLALGYVLIRCLLGNVRSASSGDASFLNLDRLTFLADVG

SEQ ID NO: 150261 - protein, 133 aa, Glycine max
  Coding DNA Sequence Number=SeqID_33483
MAAQLIHDRVEMECLEGSLGDPQRQHEVPISGHHSDSRLLSLRTVEWILPTPTPYRLVEPSPSDRGNVIRGRPEEDLEELPPEPAVDALDYLEGDEDPLLEVDSPDEVMMASEADSTEDSGPREMAISGGSSS

SEQ ID NO: 150262 - protein, 161 aa, Glycine max
  Coding DNA Sequence Number=SeqID_33484
LERIDGDPLLRETRIWATWEYVSSDGGGQQGMVGLCALCGCGKLVVHHRPTATYGTWRYVAGVRRPWGRQVGRAPGSQQIKGTKTTKQGGLWLKNEDRRLRWSLVIDYHGKGDWNLVEASGNRLPACVIDYTEGWVTGNRLPDMCNRLHSAFLHISCPEAM

SEQ ID NO: 150263 - protein, 300 aa, Glycine max
  Coding DNA Sequence Number=SeqID_33485
  Gene Ontology: Mol. function=DNA binding; Cellular component =chromatin; Biological process=chromosome organization and biogenesis (sensu Eukaryota)
  Homolog annotation: Hit_ID=Q6EQU6; Match level="QueryCoverage=96%, HitCoverage=94%, E-value=2e-55, Identity=45%"; Hit description =Putative DNA-binding protein AT-hook 2
  Pfam annotation: Domain name=DUF296; Domain location=106-223; Score =206.5; E_value=6.1e-59; Accession=PF03479.5; Description=Domain of unknown function (DUF296)
MDPITAHGHSLPPPFHAGRDLHLHQQQHQFHSLQEDEQSGSSGGLNLAHKREHEENNNNNSSDGKEGGGAGSGETEISRRPRGRPAGSKNKPKPPIIITRDSANALKTHVMEVADGCDIVDSVSAFARRRQRGVCIMSGTGTVTNVTLRQPASSGAVVTLHGRFEILSLAGSFLPPPAPPAASGLTIYLAGGQGQVVGGSVVGALIASGPVVIMSASFSNAAYERLPLEDEDPSMALQGGGSIGSPGGGGGGGGGVGQQQPSQQLMGDSTAPLFHGLNPNLLNSVQMPSETFWATGRSPY

SEQ ID NO: 150264 - protein, 94 aa, Glycine max
  Coding DNA Sequence Number=SeqID_33486
MAGVSSPAFLGIYICELVLEREVTIERFRLWERVACCWKCDEIENGKEGTCIWVVSWEGADRGSDPHAPHFGTIGGLKPFKESGVNLDRFNLIT

SEQ ID NO: 150265 - protein, 617 aa, Glycine max
  Coding DNA Sequence Number=SeqID_33487
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=85%, HitCoverage=58%, E-value=0.0, Identity=74%"; Hit description=Kinesin- like protein
  Pfam annotation: Domain name=Kinesin; Domain location=53-391; Score =446.4; E_value=3.8e-131; Accession=PF00225.13; Description=Kinesin motor domain
  Subcellular localization annotation: CTP_CleavageSite=57; ConfidenceScore=5.70e-01
MATSQGANSYRNARTSLKPHVKSKPTQQRRNSTGSVNGKEHAAVPGRVRVAVRLRPRNAEESVADADFADCVELQPELKRLKLRKNNWDADTYEFDEVLTEFSSQKRVYEVVARPVVESVLDGYNGTIMAYGQTGTGKTYTLGRLGEEDNAARGIMVRAMEDILADVSLETDSVSVSYLQLYMETIQDLLDPANDNITIVEDPKTGDVSLPGASLVDIRDKQSFVELLRLGEAHRFAANTKLNTESSRSHAILMVHVKRSVKGIDAALSSENGNHPHMVKSIKPPLVRKGKLVVVDLAGSERIDKSGSEGHTLEEAKSINLSLSALGKCINALAENSAHVPFRDSKLTRLLRDSFGGTARTSLVITIGPSPRHRGETASTIMFGQRAMKVENMVKLKEEFDYKSLSRRLDIELDKLIVEHERQQKAFEDEIERLSTEAQHRISEAERNYVDSLEKERSKYQKDYMESIKKLEEQFVMNQQKNEESHMKLSGEIPRVSAEELADLKKMLRKETHLRKAAEGEVNNLKIQVAELKKSEASRKSEILKLHTMLEDKERQKEKLEGEIAILQSQLLQLSLEADEVYFCLEIIFLPLGLWELSTGNMYIDIAEVDTAECECN

SEQ ID NO: 150266 - protein, 614 aa, Glycine max
  Coding DNA Sequence Number=SeqID_33488
  Gene Ontology: Mol. function=binding; Cellular component =intracellular; Biological process=metabolic process
  Homolog annotation: Hit_ID=Q10PG4; Match level="QueryCoverage=87%, HitCoverage=85%, E-value=1e-155, Identity=49%"; Hit description =Pentatricopeptide, putative, expressed
  Pfam annotation: Domain name=PPR; Domain location=123-157; Score =11.1; E_value=0.36; Accession=PF01535.11; Description=PPR repeat
  Pfam annotation: Domain name=PPR; Domain location=185-219; Score =26.0; E_value=0.00013; Accession=PF01535.11; Description=PPR repeat
  Pfam annotation: Domain name=PPR; Domain location=287-321; Score =33.1; E_value=9.6e-07; Accession=PF01535.11; Description=PPR repeat
  Pfam annotation: Domain name=PPR; Domain location=388-422; Score =42.5; E_value=1.4e-09; Accession=PF01535.11; Description=PPR repeat
  Pfam annotation: Domain name=PPR; Domain location=423-457; Score =16.0; E_value=0.095; Accession=PF01535.11; Description=PPR repeat
  Pfam annotation: Domain name=PPR; Domain location=459-493; Score=8.6; E_value=0.71; Accession=PF01535.11; Description=PPR repeat
  Pfam annotation: Domain name=PPR; Domain location=525-559; Score =14.6; E_value=0.14; Accession=PF01535.11; Description=PPR repeat
  Pfam annotation: Domain name=PPR; Domain location=88-122; Score=11.4; E_value=0.34; Accession=PF01535.11; Description=PPR repeat
  Pfam module annotation: Pfam domain module=PPR::PPR::PPR::PPR::PPR::PP R::PPR::PPR; Domain location=123-157::185-219::287-321::388-422::423 -457::459-493::525-559::88-122
MKTITKAREFRCIEYLSSLRRSFSFSSSSSSHSRHFQFRNDKRNHLNPKDLVSEDNKFEEAVDVLCQQKRVKEAVELLHRTDHRPSARVYSTLIAACVRHRALELGRRVHAHTKASNFVPGVFISNRLLDMYAKCGSLVDAQMLFDEMGHRDLCSWNTMIVGYAKLGRLEQARKLFDEMPQRDNFSWNAAISGYVTHNQPREALELFRVMQRHERSSSNKFTLSSALAASAAIPCLRLGKEIHGYLIRTELNLDEVVWSALLDLYGKCGSLDEARGIFDQMKDRDVVSWTTMIHRCFEDGRREEGFLLFRDLMQSGVRPNEYTFAGVLNACADHAAEHLGKEVHGYMMHAGYDPGSFAISALVHMYSKCGNTRVARRVFNEMHQPDLVSWTSLIVGYAQNGQPDEALHFFELLLQSGTKPDQVTYVGVLSACTHAGLVDKGLEYFHSIKEKHGLMHTADHYACVIDLLARSGRFKEAENIIDNMPVKPDKFLWASLLGGCRIHGNLELAKRAAKALYEIEPENPATYITLANIYANAGLWSEVANVRKDMDNMGIVKKPGELSKKIKEEGYVPDTNFVLHDVEEEQKEQNLVYHSEKLAVVFGIISTPPGTPIK

SEQ ID NO: 150267 - protein, 352 aa, Glycine max
  Coding DNA Sequence Number=SeqID_33489
  Gene Ontology: Mol. function=3'-phosphoadenosine 5'-phosphosulfate transporter activity; Cellular component=integral to membrane; Biological process=positive regulation of I-kappaB kinase/NF-kappaB cascade
  Homolog annotation: Hit_ID=Q9FN90; Match level="QueryCoverage=89%, HitCoverage=92%, E-value=1e-135, Identity=75%"; Hit description=UDP -galactose transporter related protein-like
  Pfam annotation: Domain name=DUF6; Domain location=194-325; Score =9.4; E_value=0.019; Accession=PF00892.11; Description=Integral membrane protein DUF6
  Pfam annotation: Domain name=TPT; Domain location=185-323; Score= -5.4; E_value=0.0011; Accession=PF03151.7; Description=Triose -phosphate Transporter family
  Pfam annotation: Domain name=UAA; Domain location=25-331; Score =395.1; E_value=1e-115; Accession=PF08449.2; Description=UAA transporter family
  Pfam module annotation: Pfam domain module=DUF6::TPT::UAA; Domain location=194-325::185-323::25-331
MAESSTSSPVSVDSIPRDNDKFWKGSFTVAGIMVTLVTYGLLQEKIMRVPYGTEKEYFKHSLFLVFCNRITTSAVSAGSLLASKKVLDPVAPIYKYCLISVSNILTTTCQYEALKYVSFPVQTLAKCAKMIPVMVWGALIMQKRYQGPDYLLAFLVTLGCSAFILYPAGTDMSPYSRGRENTVWGILLMVGYLGFDGFTSTFQDKLFRGYDMEIHNQIFYTTLCSCVLSLTGLILQGHLIPAIEFVYHHHDCFFDIALLSTVATISQFFISYTIRTFGALTFATIMTTRQLVSIMLSCVWFAHPLSWEQWIGAVIVFGSLYGKSFSRKMPQKTTPSIALVQNGDPNNLKDNL

SEQ ID NO: 150268 - protein, 176 aa, Glycine max
  Coding DNA Sequence Number=SeqID_33490
  Gene Ontology: Mol. function=structural constituent of ribosome; Cellular component=ribonucleoprotein complex; Biological process =translation
  Homolog annotation: Hit_ID=O22644; Match level="QueryCoverage=90%, HitCoverage=90%, E-value=7e-54, Identity=70%"; Hit description=60S ribosomal protein L23A
  Pfam annotation: Domain name=Ribosomal_L23; Domain location=71-173; Score=75.4; E_value=1.9e-19; Accession=PF00276.10; Description =Ribosomal protein L23
  Pfam annotation: Domain name=Ribosomal_L23eN; Domain location=11-65; Score=85.7; E_value=1.4e-22; Accession=PF03939.4; Description =Ribosomal protein L23, N-terminal domain
  Pfam module annotation: Pfam domain module=Ribosomal_L23::Ribosomal _L23eN; Domain location=71-173::11-65
  Subcellular localization annotation: CTP_CleavageSite=59; ConfidenceScore=5.46e-01
MAPKADSSKKADPKAQALKTAKAVKSGANFKKKTKKIRTSVTFHRPRTLKKDRNPKYPRISAPPRNKLDHYQILKFPLTTESAMKKIEDNNTLVFIVDLRADKKKIKDAVKKMYDIQAKKVNTLISEFDIAVFLPNIYYTETYMFCAFWPDGTKKAYVRLTPDYDALDVANKIGII

SEQ ID NO: 150269 - protein, 57 aa, Glycine max
  Coding DNA Sequence Number=SeqID_33491
MGEGGTSFVEDADCFVESSMVQEVESLCSAKEGDFATWEVAPQHGVSEAQDPRPSQP

SEQ ID NO: 150270 - protein, 139 aa, Glycine max
  Coding DNA Sequence Number=SeqID_33492
  Gene Ontology: Mol. function=metal ion binding; Cellular component =integral to membrane; Biological process=ubiquitin cycle
  Homolog annotation: Hit_ID=Q9LX93; Match level="QueryCoverage=88%, HitCoverage=40%, E-value=3e-19, Identity=39%"; Hit description=RING -H2 finger protein ATL5F
  Pfam annotation: Domain name=zf-C3HC4; Domain location=95-136; Score =37.5; E_value=4.6e-08; Accession=PF00097.15; Description=Zinc finger, C3HC4 type (RING finger)
MSESVGSLARDAGIFFALCMLFIMVSEWKKLMLFLCSNSGRNRVEGQFVEETIPNEYSIQFPSVNLESCVINSLPVSQFKKDEVEGEHMPVNADCAICLGEFEEGEWLKLLPNCTHGFHASCIDTWFRSHSNCPLCRAY

SEQ ID NO: 150271 - protein, 123 aa, Glycine max
  Coding DNA Sequence Number=SeqID_33493
  Homolog annotation: Hit_ID=Q9AYP0; Match level="QueryCoverage=25%, HitCoverage=53%, E-value=5e-10, Identity=83%"; Hit description =Mitochondrial ATP synthase 6 KD subunit
MELRKTRKMNWEGFKLLSREIRLRTKIQFWRLAKKEEEKDVSRETKRKFGDESSGDGESNQEGPVTLPFSLEEYRPWIEQSHFFFSFHPFLSSSPPPVPVRSAIPSPSNPMGPVRPNLFFIAL

SEQ ID NO: 150272 - protein, 50 aa, Glycine max
  Coding DNA Sequence Number=SeqID_33494
MAKLKRPHLHQGQQEKDKAGWRLHRSFYQKRENTPDNFDVIFLLHLRCDY

SEQ ID NO: 150273 - protein, 266 aa, Glycine max
  Coding DNA Sequence Number=SeqID_33495
  Gene Ontology: Mol. function=DNA binding; Cellular component=nucleus; Biological process=regulation of transcription
  Homolog annotation: Hit_ID=Q0PJI3; Match level="QueryCoverage=99%, HitCoverage=100%, E-value=1e-121, Identity=81%"; Hit description=MYB transcription factor MYB139
  Pfam annotation: Domain name=Myb_DNA-binding; Domain location=63-108; Score=57.3; E_value=5.2e-14; Accession=PF00249.21; Description=Myb -like DNA-binding domain
  Pfam annotation: Domain name=Myb_DNA-binding; Domain location=8-57; Score=39.9; E_value=8.7e-09; Accession=PF00249.21; Description=Myb -like DNA-binding domain
  Pfam module annotation: Pfam domain module=Myb_DNA-binding::Myb_DNA -binding; Domain location=63-108::8-57
MVQQEVRKGPWTEQEDFKLVSFVGLFGDRRWDFIAKVSGLKVAGESKSCRLRWVNYLHPGLKRGKMTPQEERLVLELHSKWGNRWSRIARKLPGRTDNEIKNYWRTLMRKKAQEKKRGEAASSSPTPSSVDSSISSNNHAVDPHASKKAGEESFYDTGGDNGVIAATQDQGQKGDQQGLFSMDDIWKDIDNMSEENNTTLQPVSVYDGHSEEGCNFSCPPQVPSPSSWEYSSSDPLWVMDEESLFCPLSEEPYFSCYAQGTVFLTG

SEQ ID NO: 150274 - protein, 111 aa, Glycine max
  Coding DNA Sequence Number=SeqID_33496
MGEVEEVQEQMATMMEAMMSMKKIMEANAVTVAATSTVAKVNPMPSSGLNQMNHPTLNMVGKDLGSRDGPHDVQIPNKYTFPPYGSPPKEDANNFVPILIESQQPQTSHAH

SEQ ID NO: 150275 - protein, 85 aa, Glycine max
  Coding DNA Sequence Number=SeqID_33497
MGPVRGFKKKRKPEKKHDKNGSGSGSPEGEGPVDWWDDLSKRMNVHYACMRNSKEECYFLHGAGMVVQHVCFHIFTDFLCIHQKQ

SEQ ID NO: 150276 - protein, 67 aa, Glycine max
  Coding DNA Sequence Number=SeqID_33498
MVATSYESRNNNACKKGVKREERGHKTRKYAKVKVKVRERASITNSPCYVMSIQMPDSLPAFPQKNL

SEQ ID NO: 150277 - protein, 282 aa, Glycine max
  Coding DNA Sequence Number=SeqID_33499
  Gene Ontology: Mol. function=DNA binding
  Homolog annotation: Hit_ID=Q2HU60; Match level="QueryCoverage=79%, HitCoverage=97%, E-value=1e-44, Identity=44%"; Hit description =Methyl-CpG binding
  Pfam annotation: Domain name=MBD; Domain location=57-122; Score=5.3; E_value=0.011; Accession=PF01429.10; Description=Methyl-CpG binding domain
MLLASNHHHQQQQQYHGPALPMMPTPLQVRRRPVFEFDDEHLQNQKPTIPMELQIVSSQQHFRLPDGWVVEKKPRPSHESRFDKYYYEPGTGRKFRSLLSVQRHLAGETRDYVVANTMMSKNENTNFIESGSGQKFGSLRALDNFLSEENACTTTPKSAVKSGTGEQRACGVRSGQKAVHKGSSVGEEVQITPKSLKHTIQSALSEKSDSRKKTKSEKDNRASMHNLTVPPPAKVSWVLSGSGGFWSPFLDDSIVPEPEKMKWSKAFVLSIHDDGDINGLNS

SEQ ID NO: 150278 - protein, 74 aa, Glycine max
  Coding DNA Sequence Number=SeqID_33500
MASGAFRTSSIFEAGLLLEEATQGELGGNLLPLFPINRRKRVVLWVPDHSGYAFKLFWVKKMVSMKKIQAEMLP

SEQ ID NO: 150279 - protein, 63 aa, Glycine max
  Coding DNA Sequence Number=SeqID_33501
MNAKRRKYMVDVLPKRRTLMRHRESYRNRNTLVYTTIINHNIQSTTQGMTQRAGEHLHHLIVV

SEQ ID NO: 150280 - protein, 221 aa, Glycine max
  Coding DNA Sequence Number=SeqID_33502
  Gene Ontology: Mol. function=protein binding; Cellular component =chloroplast; Biological process=protein metabolic process
  Homolog annotation: Hit_ID=Q10P51; Match level="QueryCoverage=71%, HitCoverage=68%, E-value=5e-51, Identity=59%"; Hit description=Clp amino terminal domain containing protein, expressed
  Pfam annotation: Domain name=Clp_N; Domain location=162-214; Score =1.0; E_value=0.82; Accession=PF02861.11; Description=Clp amino terminal domain
  Pfam annotation: Domain name=Clp_N; Domain location=85-137; Score =32.1; E_value=2e-06; Accession=PF02861.11; Description=Clp amino terminal domain
  Pfam module annotation: Pfam domain module=Clp_N::Clp_N; Domain location=162-214::85-137
  Subcellular localization annotation: CTP_CleavageSite=64; ConfidenceScore=5.52e-01
MAVSRCHCPASLTLTLKSFENSWIGTKVGVSPCSLNLRPVVSVSRRRPLAATVSFSLPTAKPERASTGQEIPKWFSKAIKSFAMSELEARKLKYLTTGTEALLMGVLIESTNLTAKFLRAHGITILKVRDETVKLLGKADLFFFSPEHPPLTDEAQRALDWAVDQKIKYGDGGEITTSHILLGIWSEVDSPGHKILFTLGFNDEKAKELEPSISKPGCTDD

SEQ ID NO: 150281 - protein, 120 aa, Glycine max
  Coding DNA Sequence Number=SeqID_33503
  Homolog annotation: Hit_ID=Q1S0U5; Match level="QueryCoverage=24%, HitCoverage=8%, E-value=3e-07, Identity=73%"; Hit description =Transposase, IS4
MDTLIKDVASVKVDMNDVYRPSLDGIGVDVEEDSGDSEDTSVGIGSQRSRKKMKSINHPKKLNKKKTTTSSRITNVVSVIVDAYKYYLVYVGYPTPMKYIGPYKCEHYHLHDFRQIWVCK

SEQ ID NO: 150282 - protein, 511 aa, Glycine max
  Coding DNA Sequence Number=SeqID_33504
  Gene Ontology: Mol. function=drug transporter activity; Cellular component=membrane; Biological process=multidrug transport
  Homolog annotation: Hit_ID=Q84M81; Match level="QueryCoverage=87%, HitCoverage=92%, E-value=1e-120, Identity=50%"; Hit description =Putative MatE efflux family protein
  Pfam annotation: Domain name=DUF368; Domain location=219-444; Score= -128.1; E_value=0.045; Accession=PF04018.4; Description=Domain of unknown function (DUF368)
  Pfam annotation: Domain name=MatE; Domain location=276-439; Score =120.4; E_value=5.3e-33; Accession=PF01554.9; Description=MatE
  Pfam annotation: Domain name=MatE; Domain location=54-214; Score =128.0; E_value=2.6e-35; Accession=PF01554.9; Description=MatE
  Pfam module annotation: Pfam domain module=DUF368::MatE::MatE; Domain location=219-444::276-439::54-214
  Subcellular localization annotation: CTP_CleavageSite=38; ConfidenceScore=5.26e-01
MSATLTCKLGDNNLSLNDKNDQPPSPPQPLQKCPANMVSMVVSELRIQRGIALPMVAMNLAWFAKTAITTAFLGRLGELSLAGGALGFTFANVTGFSVLNGLCGAMEPICGQAHGAKNFRLLHKTLLMAISLLLLVSLPITFLWLNVDKILILFGQQQDISTVARTYVSCLIPDLFVASLFCPLKAYLSCQSITLPTMFSSAVALAFHIPINIVLSRTMGLRGVSMAVWITDLIVVVLLAIYVLILENKKESMWKEGGWWDQSIEDWIRLLKLCGSCCLNTCLEWWCYEILVLLTGHLTNAKQAVGVLAIVLNFDYLLFSVMLSLATCVSTRVSNELGANQAGLAYRSACVSLALGFISGCIGSLVMVAARGIWGPLFSHDMAIIKGVKKTMLLMALVEVFNFPLAVCGGIVRGTARPWLGMYANLGGFYFLALPLGVVFAFKLCLGLVGLLIGLLTGIVTCLTLLLVFIARLNWVEEAAKAQTLTGQEQVKELSKYDAEERIDAHEKDVV

SEQ ID NO: 150283 - protein, 86 aa, Glycine max
  Coding DNA Sequence Number=SeqID_33505
MACTHFWIYTRFSSNFSQHQSDLAPYASKPYNAQWNAPGLLRDKHTLRSNRILREMEVDEPWLGLWLPLNYQVDMGASQHRILELG

SEQ ID NO: 150284 - protein, 111 aa, Glycine max
  Coding DNA Sequence Number=SeqID_33506
MWGIPFILEPNQALTCIMSSHSTSFEPKSRLTINLDPGRRRREKKENSPIKEWEKAKRKERKFPIKEWEKLKKEEEEGKKAPDQGSKEKQKKCAERSLDRTISEQYRIVTK

SEQ ID NO: 150285 - protein, 447 aa, Glycine max
  Coding DNA Sequence Number=SeqID_33507
  Gene Ontology: Mol. function=amino acid binding; Biological process =metabolic process
  Homolog annotation: Hit_ID=Q1RVD0; Match level="QueryCoverage=90%, HitCoverage=91%, E-value=0.0, Identity=78%"; Hit description=Amino acid-binding ACT
  Pfam annotation: Domain name=ACT; Domain location=12-75; Score=22.0; E_value=0.0021; Accession=PF01842.15; Description=ACT domain
  Pfam annotation: Domain name=ACT; Domain location=224-295; Score =21.0; E_value=0.0042; Accession=PF01842.15; Description=ACT domain
  Pfam annotation: Domain name=ACT; Domain location=302-365; Score =40.0; E_value=8.1e-09; Accession=PF01842.15; Description=ACT domain
  Pfam annotation: Domain name=ACT; Domain location=93-165; Score=29.3; E_value=1.4e-05; Accession=PF01842.15; Description=ACT domain
  Pfam module annotation: Pfam domain module=ACT::ACT::ACT::ACT; Domain location=12-75::224-295::302-365::93-165
VVIDNSVFSSATLVKVDSARRHGILLDAVEVLADLNLSIKKAYISADGKWFMDVFHVTDQNGNKIIDESVLKYIEQSLGNIHYGRTNLSNGLTALELTGTDRVGLLSEVFAVLADLQCDVVESKVWTHNGRIASLIYVKDSSSGSAIEDSQKINKIELRLRNVLKGDNDIRSAKISFSMAVMHTERRLHQLMFVDRDYERAPILKLTSDNASVTVQNWEGRGYSVVNVQCKDRTKLLFDIVCNLTDMEYVVFHATINTDGDRAYLEFYIRHKDGTPISSEPERQRVIQCLKAAVERRASEGVRLELCTEDRQGLLAEVVRTFRENGLNVTRAEISTIGNMAKNIFYVTDAIGNPADSKIIESVRQKIGLSNLEVKELPLINHQEAEREDQAVGMGGAVLLSIGSLKDVHVGGKVVRLNSMELDSCWQRHKCLGGAYGLIAKWEELGV

SEQ ID NO: 150286 - protein, 84 aa, Glycine max
  Coding DNA Sequence Number=SeqID_33508
  Gene Ontology: Mol. function=hydrolase activity, hydrolyzing O -glycosyl compounds; Biological process=carbohydrate metabolic process
  Homolog annotation: Hit_ID=Q1RSR9; Match level="QueryCoverage=60%, HitCoverage=10%, E-value=2e-18, Identity=82%"; Hit description =Glycoside hydrolase, family 1
MEPETSLNFTLMLTFLLYLNLVMGVLSVDHYRRVDFPDEFVFGSGTSAYQVEGASNEDGRTPSIWDTFAHAGYMLNFEKLVFVN

SEQ ID NO: 150287 - protein, 84 aa, Glycine max
  Coding DNA Sequence Number=SeqID_33509
PIGSVNGCPLPGTWLLTCYWYRQGRHLVDVTEIFNLLSWEKKQRLVKLFYLVFTLFLSDDLHIIGLVTAVLACIMECCKLPDVC

SEQ ID NO: 150288 - protein, 77 aa, Glycine max
  Coding DNA Sequence Number=SeqID_33510
MVTFILQLDSMNLFVKARAWFNPITQGIAILIANTSSTFHRDERLGNTHAMHGKLKWVYDPNMVGSWYRIYATKNAV

SEQ ID NO: 150289 - protein, 169 aa, Glycine max
  Coding DNA Sequence Number=SeqID_33511
  Gene Ontology: Mol. function=identical protein binding
  Homolog annotation: Hit_ID=Q24B89; Match level="QueryCoverage=78%, HitCoverage=4%, E-value=2e-34, Identity=53%"; Hit description=PRP38 family protein
  Pfam annotation: Domain name=PRP38; Domain location=1-165; Score =75.0; E_value=2.3e-19; Accession=PF03371.5; Description=PRP38 family
MEIQTCGRPIDSLLEKVLCMNILSSDYFKELYRLKTYHEVIDEIYNQVDHVEPWMTGNCRGPSTAFCLLYKFFTMKLTVKQMHGLLKHPDSPYIRAVGFLYLRYCADPKTLWNWFESYVKDDEEFSPGSNGRMTTMGVYVRDLLLGQSSPTRIQMHHKIADADMSLIIP

SEQ ID NO: 150290 - protein, 289 aa, Glycine max
  Coding DNA Sequence Number=SeqID_33512
LSVEEKDLVDRSAKKITGEGDHAFTEDEEDMDHDYVFTEDEEEDGDEFCGLGIEERKLGEYESIEKVEVWVHLSKLPIDYYDVKVLHVVGDRIGRTLRVDKNVFSQERRDVLRKMSSIHGIGNMKLLMIMTRRHRKGKKRDNGDLNSMHNQGSSYGILSRHQDEDNQTGAGKQPMGMSGHGQSKANFVYEKKTKVGSKEKVIVLRSAMINLEKNNGNIIPRKKKVNHGGIVGGVIKENNKVIIVNQDMEVQRAHAYEEVSPHQMMQEGHHGSLGGDINGGYGLCDGDTT

SEQ ID NO: 150291 - protein, 193 aa, Glycine max
  Coding DNA Sequence Number=SeqID_33513
  Gene Ontology: Mol. function=transcription factor binding; Cellular component=intracellular; Biological process=regulation of transcription, DNA-dependent
  Homolog annotation: Hit_ID=Q40219; Match level="QueryCoverage=92%, HitCoverage=93%, E-value=6e-70, Identity=72%"; Hit description=RAB8E
  Pfam annotation: Domain name=Arf; Domain location=1-155; Score=-92.6; E_value=0.013; Accession=PF00025.11; Description=ADP-ribosylation factor family
  Pfam annotation: Domain name=MMR_HSR1; Domain location=16-109; Score=- 11.0; E_value=0.01; Accession=PF01926.13; Description=GTPase of unknown function
  Pfam annotation: Domain name=Miro; Domain location=17-109; Score =36.8; E_value=7.7e-08; Accession=PF08477.3; Description=Miro-like protein
  Pfam annotation: Domain name=Ras; Domain location=17-157; Score =264.9; E_value=1.6e-76; Accession=PF00071.12; Description=Ras family
  Pfam module annotation: Pfam domain module=Arf::MMR_HSR1::Miro::Ras; Domain location=1-155::16-109::17-109::17-157
MAAPPARARADYDYLIKLLLIGDSGVGKSCLLLRFSDGSFTTSFITTIGIDFKIRTIEQDGKRIKLQIWDTAGQERFRTITTDIRNWIRNIEQHASDNVNKVLVGNKADMDESKRVVPTSKGQALADEYGIKFFETSAKTNLNVEEVFFSIARDIKQRLADTDSKAEPAGIKINNQLDHATAGEVAQKSACCG

SEQ ID NO: 150292 - protein, 171 aa, Glycine max
  Coding DNA Sequence Number=SeqID_33514
  Gene Ontology: Mol. function=nucleic acid binding; Cellular component= intracellular; Biological process=regulation of transcription
  Homolog annotation: Hit_ID=Q4FH86; Match level="QueryCoverage=99%, HitCoverage=100%, E-value=9e-85, Identity=90%"; Hit description=C2H2 transcription factor
  Pfam annotation: Domain name=zf-C2H2; Domain location=40-62; Score =19.3; E_value=0.014; Accession=PF00096.16; Description=Zinc finger, C2H2 type
  Pfam annotation: Domain name=zf-C2H2; Domain location=90-112; Score =17.1; E_value=0.063; Accession=PF00096.16; Description=Zinc finger, C2H2 type
  Pfam module annotation: Pfam domain module=zf-C2H2::zf-C2H2; Domain location=40-62::90-112
MKRGREEGELDMANCLMLLTKVGESETNYPISKGRDDGDFKCKTCNRRFSSFQALGGHRASHKKPKLMVTDLSWHHELPNNPTMKQPRMHPCPICGLEFAIGQALGGHMRKHRSAINDGLLCGKPSSLSILKNSSKDAHERLNLRLDLNLTPMEEDDLKLNLRTPVLNCFI

SEQ ID NO: 150293 - protein, 101 aa, Glycine max
  Coding DNA Sequence Number=SeqID_33515
MTVKFTSKMRQISRKELQKEKEEQRRQEQEKGLERKESVGSPGAGFDYIARIVFNVLPYHTILVLISILPQRLLDRRIASRLDCILEGVGTKSGGISPILF

SEQ ID NO: 150294 - protein, 223 aa, Glycine max
  Coding DNA Sequence Number=SeqID_33516
  Gene Ontology: Mol. function=transferase activity, transferring glycosyl groups; Cellular component=membrane; Biological process =cellulose biosynthetic process
  Homolog annotation: Hit_ID=Q6J8X1; Match level="QueryCoverage=73%, HitCoverage=15%, E-value=6e-84, Identity=85%"; Hit description =Cellulose synthase
  Pfam annotation: Domain name=HMG_CoA_synt_C; Domain location=1-172; Score=-121.2; E_value=1.5e-05; Accession=PF08540.1; Description =Hydroxymethylglutaryl-coenzyme A synth
MEPDVVVDGKLSQTCYLMALDSCYNHLSHKYEKQEGKQFCISDAEYFVFHYPYNKFEKKFGQSSVFIASTLLEDGGVPKAASSATLLKEAIHVISCGYEDKTEWGKEVGWIYGSVTEDILTGFKMHCHGWRSVYCMPKRPAFKGSTPINLSDRLHQVLRWALGSVEIFFSRHCPIWYGYISYINSVIYPLTSIPLIAYCALPTVCLLTGKFIVPEVGLIFLYF

SEQ ID NO: 150295 - protein, 113 aa, Glycine max
  Coding DNA Sequence Number=SeqID_33517
  Homolog annotation: Hit_ID=Q2HVT9; Match level="QueryCoverage=58%, HitCoverage=58%, E-value=5e-13, Identity=54%"; Hit description =Thioredoxin-related
  Subcellular localization annotation: CTP_CleavageSite=95; ConfidenceScore=5.49e-01
MSLVCFHSFFRRVASTVPSPLLNAVTWTLLLIVTVVLVSLATGVAFVLAISPSSSFSKPCNGVRIPLDFPREMVCLPEHAVMSSSRLDFFLPTLFAALVVAASTCLLRSVACA

SEQ ID NO: 150296 - protein, 150 aa, Glycine max
  Coding DNA Sequence Number=SeqID_33518
  Homolog annotation: Hit_ID=O65510; Match level="QueryCoverage=53%, HitCoverage=8%, E-value=3e-08, Identity=48%"; Hit description =Putative receptor protein kinase
MLTVGLDFIYGLGLLAWRSVLFENWPMGRAKIADGMTPISAFPSMLRCKSAKQLASVEGSVPPRRLWSDKREFTGDATRDMVLYDVENLKAGEVGNLRWKSLNEGLFYAHAQLKDTFTEFKIRQTQLRDSIVGGGEAYSKWKTYVSPQSG

SEQ ID NO: 150297 - protein, 55 aa, Glycine max
  Coding DNA Sequence Number=SeqID_33519
ANNYLKGIINNALKGLDDTPQSKSKVVAKWIVVKTIRSREIEGVSHPLGNLLFES

SEQ ID NO: 150298 - protein, 750 aa, Glycine max
  Coding DNA Sequence Number=SeqID_33520
  Gene Ontology: Mol. function=protein dimerization activity
  Homolog annotation: Hit_ID=Q1RVB7; Match level="QueryCoverage=97%, HitCoverage=97%, E-value=0.0, Identity=71%"; Hit description=Zinc finger, BED-type predicted
MASTTPSADSASADEVTAKAVHKRYQGLLTVRTKAIKGKGAWYWPHLEPMLLHNTETGLPKAVKLRCSLCDAVFSASNPSRTASEHLKRGTCPNFNSAAKPVSSVSPSPAAAMAVSPPSSPTNHNHHHRKRNSASSYDAPPPPVVDPSRFFGELTYAPPRQQPHLVLSGGKDDLGALAMLEDSVKKLKSPKTSPGPTLTKTQIDSAFDYLADWVYESCGSVSFSALEHPKFRAFLNQVGLPTVSIRELTGSRLEAKFEEAKADSESRIRDALFFQVASVGWKRKVKKYCEEKLVNMSVNLPNGTSLHRRTVLVTGSAPSNYAEEVLWETVTGICGNVVQQCVGIVADKFKNKALRNLENRNPWMVNLFCQYQGFNSLITDFNKELSIFSTVTQNCVKLVSFINFKSKVRSSFDKCQQLEYGHARLLRMPLPSLEFESFDTVYAMMEDVLSSFRALQLVLLDENFKMATIEDLNAREVGDMIRDVGFWNDLEAVHSLVKLVEEMVQEIETERPLVGQCLPLWGELRARVKDWCSKFHVAEGAVEKVIEKRFKKNYHPAWAAAYILDPLYLVRDTSGKYLPPFNYLTLEQEKDVDKLITRLVSRDEAHIVLMELMKWRTQGLDPVYARAVQMKERDPVTGKIRIVNPQSSRLVWETYLTEFKSLGRVAVRLIFLHATSRGFKCNWSSWRWECSQGNSRAALDRAHKLIFIAAHSKLERKDFSGDEEKDAELLSLANGEDDVLNEVFVETSTA

SEQ ID NO: 150299 - protein, 41 aa, Glycine max
  Coding DNA Sequence Number=SeqID_33521
MASTASSPMTVQAGLVRTLKEGLGGEAGSGPVVYWMFRDQR

SEQ ID NO: 150300 - protein, 196 aa, Glycine max
  Coding DNA Sequence Number=SeqID_33522
  Gene Ontology: Mol. function=nucleic acid binding; Cellular component= beta-galactosidase complex; Biological process=DNA integration
MWYMRFDEYTIKIGFSRSKYECCVYFKGHGVEKPIYLLLYVDDMLLASQSMEEIARLKEFLNSKFEMKDLKQAKKILGMEIIRKRDRNELYLSQESYIRKVLNRFLVNLGKPHWEAAKWVLRYLCGTIGRGLNYVNRGGFPTIESFVDLDFVGSIDIRRFIIDNVFKVFGNTINWKANLEAVVALSSTEAEYTVAC

SEQ ID NO: 150301 - protein, 302 aa, Glycine max
  Coding DNA Sequence Number=SeqID_33523
  Gene Ontology: Mol. function=nucleic acid binding; Cellular component= intracellular; Biological process=DNA integration
  Homolog annotation: Hit_ID=Q1RXN8; Match level="QueryCoverage=68%, HitCoverage=19%, E-value=1e-52, Identity=48%"; Hit description =Peptidase S8 and S53, subtilisin, kexin, sedolisin; Integrase, catalytic region; Zinc finger, CCHC-type
  Pfam annotation: Domain name=rve; Domain location=58-208; Score=15.4; E_value=0.00031; Accession=PF00665.16; Description=Integrase core domain
MEIERFTGSNDFSLWQVKMNVLLVHQGLDIALSKEVIVKCNLVNLEDEVLREVVEEKIAMKIWEKLETLCLKKSLTIGKATRLKFSTSVHSSGGALGYVHSNLWGHQGLNLMVEQVFKKFKEWKVLVEAQIGNKRKWSGKAQNREKHTTPNGLAEKFNRTILERVRCMLNHAGLPKSFLIEALSSTLYCINPCPSTTIGFKTPQEAWSSKKVDYSELKVFGCIAYAHIKQDKLEPRALKCIFIGYLEGVKGYKLWCLEPGHKKCLISRDVRQETPEKSKNQVIQIEVEPVVTTELETTTRRQ

SEQ ID NO: 150302 - protein, 185 aa, Glycine max
  Coding DNA Sequence Number=SeqID_33524
  Gene Ontology: Mol. function=deoxyribodipyrimidine photo-lyase activity; Biological process=DNA repair
  Homolog annotation: Hit_ID=Q9AVI6; Match level="QueryCoverage=61%, HitCoverage=23%, E-value=1e-52, Identity=80%"; Hit description=CPD photolyase
  Pfam annotation: Domain name=FAD_binding_7; Domain location=3-160; Score=24.9; E_value=9.5e-11; Accession=PF03441.4; Description=FAD binding domain of DNA photolyase
MCFRSSITSLLLTCGLKAIDAFLEELIVRRELADNYCFYQPHYDSLKGAWAWAQNTLIEHATDKREHIYTREQLEKTLTADPLWNASQLETVHYGKMHGFTRMYWAKKILEWTRGPEEALEISLYLNDKFVSSKRGRLKTCYLNRRKYFAVVILKIEEAYIYFYVSRHSMHLVRSANDDITTYMP

SEQ ID NO: 150303 - protein, 329 aa, Glycine max
  Coding DNA Sequence Number=SeqID_33525
  Gene Ontology: Mol. function=protein binding; Cellular component =mitochondrion; Biological process=vesicle docking during exocytosis
  Homolog annotation: Hit_ID=Q1RVB0; Match level="QueryCoverage=91%, HitCoverage=41%, E-value=1e-130, Identity=77%"; Hit description=Sec1- like protein
MSGRTPLYRKFVVVIIISLLPVIHHGFSNLFVFTAFVFFSSAISKELVMDIKKDMEVLTRLGALREMNLEYFPIDSQGFITNNERALEELFGDEENNHKGVTCLNVMAKRIATVFASLREFPSVRFRAAKSLDATTMTTFQDLIPTKLAAGIWDCLVKYKKSIPNFPQTETCELLILDRSIDQIAPVIHEWTYDAMCHDLLNMEGNKYVHEVPGKSGGPAERKEVLLEDHDPVWLELRHAHIADASERLHEKMTNFISKNKAAQIQHGSNSSSEMSTRDIQTIVQALPQYSEQIDKLSLHVELCLSCITTSLFNDAILLLPFMILADRR

SEQ ID NO: 150304 - protein, 125 aa, Glycine max
  Coding DNA Sequence Number=SeqID_33526
  Pfam annotation: Domain name=DUF1442; Domain location=1-125; Score =51.2; E_value=3.6e-12; Accession=PF07279.2; Description=Protein of unknown function (DUF1442)
MGEAGVTAEIVVGEPEEVMEGLVGVDFLVVDSRRKDFTRVLRLAKLSNKGAVLLCKNANSNSKGFIWRSLVAKGSSRRVVRSAFLPVGKGLDMAHVSASGGNNSSGHRWIKHVDQHSGDVHFIRR

SEQ ID NO: 150305 - protein, 121 aa, Glycine max
  Coding DNA Sequence Number=SeqID_33527
MSMSDSDSSSYAGADYKSFKQISRELVDDWSRFSTNSFSVLCAKDNNKLSVEVYYLLRMPHGFFYFWTFIISYMTIMVSEVLGIDFGLWSVVFGAAQWLERSDRVFRMILLPLPIPWVLSE

SEQ ID NO: 150306 - protein, 166 aa, Glycine max
  Coding DNA Sequence Number=SeqID_33528
  Gene Ontology: Mol. function=sequence-specific DNA binding; Cellular component=nucleus; Biological process=regulation of transcription, DNA-dependent
  Homolog annotation: Hit_ID=Q9FKK2; Match level="QueryCoverage=64%, HitCoverage=49%, E-value=1e-18, Identity=41%"; Hit description=MADS -box protein-like
  Pfam annotation: Domain name=SRF-TF; Domain location=16-75; Score =29.4; E_value=1.2e-05; Accession=PF00319.9; Description=SRF-type transcription factor (DNA-binding and dimerisation domain)
MSSNLRTRKDRRKIEMKMTNKSNLQVPFSKRRSGVLKKASELCTLCGAERLPPHDTQFMGVNLHELNAQLTKFTTQLETEKKRASELKRLHQVVQIQWWWAAPVNEMSISQLNDSSNLAPPMNNHGLGEIMNQMNHRDFTNKRGHGPKGDDEMLDKNSTPKGGDVI

SEQ ID NO: 150307 - protein, 415 aa, Glycine max
  Coding DNA Sequence Number=SeqID_33529
  Gene Ontology: Mol. function=aminomethyltransferase activity; Cellular component=cytoplasm; Biological process=glycine catabolic process
  Homolog annotation: Hit_ID=Q5VNV1; Match level="QueryCoverage=90%, HitCoverage=94%, E-value=1e-101, Identity=51%"; Hit description =Glycine cleavage T protein-like
  Pfam annotation: Domain name=GCV_T; Domain location=45-293; Score= -52.4; E_value=0.0031; Accession=PF01571.11; Description=Glycine cleavage T-protein (aminomethyl transferase)
  Pfam annotation: Domain name=GCV_T_C; Domain location=301-397; Score =34.0; E_value=5.3e-07; Accession=PF08669.1; Description=Glycine cleavage T-protein C-terminal barrel
  Pfam module annotation: Pfam domain module=GCV_T::GCV_T_C; Domain location=45-293::301-397
  Subcellular localization annotation: CTP_CleavageSite=41; ConfidenceScore=5.15e-01
MNRVALPKSIAQRFRGIHHSPRNQWCNNNRCETQVQSAGPVASLLKSRSVIRFRGPDTLKFLQGLLTNDVRRLGEPVGDRTENLPTPNVPATSFPPIYAALLTPQGRFLYDLFLYKPPTCDTKLDDTGTGPDSQPHEPFHLFADVDSSVYRLRSKVEIDDVSSDFSCWQRYGAGLLEKTSQVEEPEAASVGWGAGVDRTAMSSSQGSDQGWQWFKDPRLVCLGFRGIFPSNITHFSLKESPTSLPVSAPLIEVDKETDEQNFLLWRIEKGVAEGSTEIPKGEAVPLEYNLAGLNAISFDKGCYVGQELIARTHHRGVIRKRIVPLRFLDNDGKELVNKVIPGSEVMNTASGKQAGTVTTALGCRGLGLLRLEEEALKGSSALSVQGQEDVKVVASRPDWWPSEWLQDHGQHAAFA

SEQ ID NO: 150308 - protein, 45 aa, Glycine max
  Coding DNA Sequence Number=SeqID_33530
MDTSKPYTGTMRGTVHEPQVNLGVMTKDNNWYLKALHWGNEGHRA

SEQ ID NO: 150309 - protein, 83 aa, Glycine max
  Coding DNA Sequence Number=SeqID_33531
  Gene Ontology: Mol. function=oxidoreductase activity; Cellular component=chloroplast
  Homolog annotation: Hit_ID=O23939; Match level="QueryCoverage=98%, HitCoverage=24%, E-value=3e-21, Identity=71%"; Hit description =Ripening-induced protein
MKVLSMLVFLLANLSLFWEELVELETVIQLAKQVYKASKIVATASTEKLQLLRELGVDLPIDYTKENFEGLPEKYNLVYDALG

SEQ ID NO: 150310 - protein, 147 aa, Glycine max
  Coding DNA Sequence Number=SeqID_33532
  Subcellular localization annotation: CTP_CleavageSite=60; ConfidenceScore=5.38e-01
MRYGETSAWQWRFRRQSVKLHLSSRESFTSPRGASTRRGCRRRRCGRCDLTQQRRRHGLRMASGGELIDSTWRQGLSSRHCLYSKKPLGCGKTLIAKAIANETGADFIHIKIRDGKIKVLTPREARYAVQLSNKPLLDVCPSNGHKK

SEQ ID NO: 150311 - protein, 102 aa, Glycine max
  Coding DNA Sequence Number=SeqID_33533
MSDESSIERSVDGKRGVCWKGVKNFPLYDDWKSFVSWVSLIRSNSRLFESEKNHWYPCICALMRLYWYEWGFVGTSKFLVEISMYTYVETWNLGLIVVYPKQ

SEQ ID NO: 150312 - protein, 131 aa, Glycine max
  Coding DNA Sequence Number=SeqID_33534
  Gene Ontology: Mol. function=RNA-directed DNA polymerase activity; Cellular component=chromatin; Biological process=RNA-dependent DNA replication
MLPWHHPSLNTYAMHIFTGPLKPTAFQNLKDTITVAPILALPNFTNPFIVETDASGTGMGAVLMQERHPIAFFSKQFCPKLLKSSTYVRKLAPIITAVKKWRQYLLGHHFVILVDHRSLRELMNQAVQTPV

SEQ ID NO: 150313 - protein, 64 aa, Glycine max
  Coding DNA Sequence Number=SeqID_33535
  Gene Ontology: Mol. function=DNA binding; Cellular component=nucleus; Biological process=regulation of transcription, DNA-dependent
  Homolog annotation: Hit_ID=Q40173; Match level="QueryCoverage=56%, HitCoverage=13%, E-value=2e-13, Identity=89%"; Hit description=Myb -related transcription factor
MPKKKWALLYKGGCGRFECVGPWTAEEDKKLINFILSNDQCCWRAVPQLAGLPRCGKKLSSSLD

SEQ ID NO: 150314 - protein, 89 aa, Glycine max
  Coding DNA Sequence Number=SeqID_33536
MMIYGCTIIPWRVILNSLGLHARSFGKSVATVVSKTCYDERNDFHTEVQDMLSYQHELCMKKGHASNASIKCINGLKTSDKEQSEESNS

SEQ ID NO: 150315 - protein, 64 aa, Glycine max
  Coding DNA Sequence Number=SeqID_33537
MEYEKEVGEWRMEMVHCSKSSFIVAGAGEAVGKDRWRRSSGCVRGRWRHGFDKRKTSVGEEERL

SEQ ID NO: 150316 - protein, 76 aa, Glycine max
  Coding DNA Sequence Number=SeqID_33538
  Gene Ontology: Mol. function=oxidoreductase activity; Biological process=electron transport
  Homolog annotation: Hit_ID=Q10CG2; Match level="QueryCoverage=85%, HitCoverage=17%, E-value=3e-14, Identity=51%"; Hit description=Amine oxidase, putative, expressed
MNSICKALCNESGVESKFGASIGRIEWLHDEKLWSLIRVDGQNLGQYKGLVASDNNIVFPRVAGVTGRLPPLGGPL

SEQ ID NO: 150317 - protein, 215 aa, Glycine max
  Coding DNA Sequence Number=SeqID_33539
  Subcellular localization annotation: CTP_CleavageSite=25; ConfidenceScore=5.41e-01
MVDVDRRPTGPNPAHAAGLRRLSARAASVSTPTVRNRNSLHSFSALSEKVITHLSSSGIQLHPSHGAEFARSADSDPILRKQRSVSAARFPVPGFSRHSLDAAVDLRRRSKWVEGYVGMMGSVLREGGWSESDISEMVSGSGSVLLDNEEVLDALVSKAERFSDSLRKSGWSSEEVKDALGLDLRPEKKGGRPPKKVATQLVGRIGKLVESVSRS

SEQ ID NO: 150318 - protein, 297 aa, Glycine max
  Coding DNA Sequence Number=SeqID_33540
  Gene Ontology: Mol. function=oxidoreductase activity; Cellular component=chloroplast; Biological process=electron transport
  Homolog annotation: Hit_ID=Q9FS22; Match level="QueryCoverage=92%, HitCoverage=44%, E-value=1e-131, Identity=84%"; Hit description =CpABA1 protein
  Pfam annotation: Domain name=FHA; Domain location=186-262; Score =55.5; E_value=1.8e-13; Accession=PF00498.16; Description=FHA domain
MEIIDVKLSQLLLEARKGLDSYQLAWELENAWEQSIKSGSPIDIDSSLRSYERERRLRVAIIHGMARMAALMASTYKAYLGVGLGPLEFLTKFRIPHPGRVGGRFFVDIMMPSMLSWVLGGNSDKLEGRPLSCRLTDKANDQLRRWFEDDEALERAINGEWILLPHGDGTGLSKPISLSRNEMKPFIIGSAPMQDNSGSSVTISSPQVSPTHARINYKDGAFFLIDLRSEHGTWIIDNEGKQYRVPPNYPARIRPSDVIQFGSEKQPSYVQVSFRVKVTSSVPRVSENESTLALQGV

SEQ ID NO: 150319 - protein, 93 aa, Glycine max
  Coding DNA Sequence Number=SeqID_33541
MESQTPLAVGKRMKFPTSEGSIELINHPFTIAFSVRHLQNVESISDDKGNDPSIYHSLSLPEIFAKMESVAEAFDGYFVESPIAEESTIFGSQ

SEQ ID NO: 150320 - protein, 193 aa, Glycine max
  Coding DNA Sequence Number=SeqID_33542
  Homolog annotation: Hit_ID=Q01GV2; Match level="QueryCoverage=77%, HitCoverage=35%, E-value=6e-10, Identity=30%"; Hit description =Homology to unknown gene
MATLSFGIATTSLSAAAGYRRRRPTIVCIGWSRDVPDTPQYLIEYFLDTEAQEIEFEIARMRPRLNEEFFAQLKFELTKHRFLHMEDRQIELEALEKAIQEGLGLLEYKLTPCSYLLIQKPMTRCKLLEMVEKNEINRSLLALQDENIASAQKGNQKQAAEYMEKLRGAVLSLILYKLEGWMNQVYLVSVKWV

SEQ ID NO: 150321 - protein, 359 aa, Glycine max
  Coding DNA Sequence Number=SeqID_33543
  Gene Ontology: Mol. function=DNA binding; Cellular component=beta -galactosidase complex; Biological process=DNA integration
  Homolog annotation: Hit_ID=Q1SS89; Match level="QueryCoverage=99%, HitCoverage=72%, E-value=4e-85, Identity=52%"; Hit description =Integrase, catalytic region
MVSNSALQGESMNRELNWYLVAPSPAIEKKQIGEHESEVEGVIHDEPIEMQHLNITEVECKEDPSTNEGTASEEVPVNEDYIDQGSQEPPLFIIPDPLTWNNPEVDVKNAFLHGDLEEDVYIDIPSSYMPSSGTKVHLQGNVTTVIIYVDDMIIIGDDIEEISRLQEQLTTEFEMKNLGGLQVGLLDCKPTDTPTIQNHKLSQYTDQVHMNKGRYQKLVGKLIYLSHTHLDIAYANNHLSVEGYTDANWARNVIDRKSTSRYFTFVEGNLVTQRSKKQKVVALSSAEAKFRGMTKGLCELLWLKRLLMEIGFGPSMEMNLFSDNKDTIDISQNSIQHDQTKHLEVDRHFIKQNLDKKII

SEQ ID NO: 150322 - protein, 188 aa, Glycine max
  Coding DNA Sequence Number=SeqID_33544
  Homolog annotation: Hit_ID=Q6H667; Match level="QueryCoverage=73%, HitCoverage=51%, E-value=1e-53, Identity=80%"; Hit description =Thylakoid lumenal protein-like
  Pfam annotation: Domain name=Pentapeptide; Domain location=100-139; Score=32.4; E_value=1.6e-06; Accession=PF00805.12; Description =Pentapeptide repeats (8 copies)
  Pfam annotation: Domain name=Pentapeptide; Domain location=145-184; Score=33.4; E_value=7.7e-07; Accession=PF00805.12; Description =Pentapeptide repeats (8 copies)
  Pfam module annotation: Pfam domain module=Pentapeptide::Pentapeptide; Domain location=100-139::145-184
  Subcellular localization annotation: CTP_CleavageSite=51; ConfidenceScore=5.83e-01
MALNSFSPLSVNSLHVSSISSSKISRSLSKSFPVVCQTNSNRDHRQGNVVSATLAAAIIAFSSDMSALADLNKFEAEMRGEFGIGSAAQKAVHVNENFRANFTAADMRESDFSGSTFNGAYLEKAVAYKANFPGVDLSDTLTDRMVLNEANLSNAILLRTVLTRSDLGGAIIEGADFSDAVLDLPQKH

SEQ ID NO: 150323 - protein, 86 aa, Glycine max
  Coding DNA Sequence Number=SeqID_33545
  Homolog annotation: Hit_ID=Q6H667; Match level="QueryCoverage=54%, HitCoverage=15%, E-value=8e-10, Identity=76%"; Hit description =Thylakoid lumenal protein-like
MKETSLRSAEPNCAADPIPNSPLISASNLLRSARADMSELKAIIAAANVAETTFPHFVDSALEIWHTTGKDFEREREILELEIEDT

SEQ ID NO: 150324 - protein, 217 aa, Glycine max
  Coding DNA Sequence Number=SeqID_33546
  Homolog annotation: Hit_ID=A0FIZ7; Match level="QueryCoverage=40%, HitCoverage=19%, E-value=1e-27, Identity=65%"; Hit description=FMO -like protein
  Pfam annotation: Domain name=PLATZ; Domain location=61-149; Score =29.3; E_value=1.9e-08; Accession=PF04640.4; Description=PLATZ transcription factor
MGGVGSQSPAKAAVDGAACNGITFNTELHYGLKLRKVPHVGFNSVPNWLLILKEEKFFTRCLIHDSVKKNILCLDCCTSICLHCLPFHRSHVLLQIRRRMYNDVLRLGDAQTLLNCSPVQFTDFKFSSEILQSISTPLCGSGTFENLSLSPPSSRRGNLGNPCTPEADWFGATRRGSSGLCSASGPNLAVPNPTPECTPRCHPLARKPPRHALLAGD

SEQ ID NO: 150325 - protein, 652 aa, Glycine max
  Coding DNA Sequence Number=SeqID_33547
  Gene Ontology: Mol. function=hydrolase activity, hydrolyzing O -glycosyl compounds; Cellular component=vacuole; Biological process =carbohydrate metabolic process
  Homolog annotation: Hit_ID=Q43857; Match level="QueryCoverage=97%, HitCoverage=96%, E-value=0.0, Identity=74%"; Hit description=Acid beta-fructofuranosidase precursor
  Pfam annotation: Domain name=Glyco_hydro_32C; Domain location=502 -616; Score=170.0; E_value=6.2e-48; Accession=PF08244.2; Description =Glycosyl hydrolases family 32 C termi
  Pfam annotation: Domain name=Glyco_hydro_32N; Domain location=146 -461; Score=660.7; E_value=1.1e-195; Accession=PF00251.10; Description=Glycosyl hydrolases family 32 N termi
  Pfam module annotation: Pfam domain module=Glyco_hydro_32C::Glyco _hydro_32N; Domain location=502-616::146-461
MGSPNTRTSSSSDSELPCSNYIPVPDGPHSPAEPARREVIVIFCGLLVLVSLVAFNGYSWAHSNGHDGDHHHASSSLPTTLLTVTPNELELSPDTVPWSTWQTTLSRGVSAGVSEKSSWLFNSNNGNGESYPWNNSMLSWQRTAYHFQPEKNWMNGPMYYKGWYHFFYQYNPNGAVWGDIVWGHAVSRDMIHWFHLPLAMVADQWYDKNGVWTGSATILPDGQVIMLYTGSTNESMQVQNLAYPADPSDPLLVDWIKYPANPVLFPPPGIDAKDFRDPTTAWITSEGKWRISIGSKLNKTGIALVYDTNDFKTFERVEGVLHVVPGTGMWECVDFFPVSSKGENGLDTSINGENVKHVVKVSLDDDRHDYYALGTYDEKNVKFTPDDFNNDVGIGLRYDYGIFYASKTFYDQSKGRRVLWGWIGESDSEYADVAKGWASVQGIPRTVALDKKTGSNLIQWPVAEVESLRLRSDEFQNLKVKPGSVVPLEIGTAAQLDIVAEFEIDKKALEKTGQSNKEYKCSTSGGSTERGTIGPFGLLVLADDDLSEYTPTYFYVVKGSHGQLKTSFCSDQSRSSLATDVSKKIFGSFVPVLKDEKLSVRILVDHSIVESFAQGGRTCVTSRVYPTKAIYGAARLFLFNNATEATVTASVK

SEQ ID NO: 150326 - protein, 109 aa, Glycine max
  Coding DNA Sequence Number=SeqID_33548
  Gene Ontology: Mol. function=protein binding
  Homolog annotation: Hit_ID=Q5ZEI8; Match level="QueryCoverage=82%, HitCoverage=49%, E-value=7e-33, Identity=69%"; Hit description =Putative tyrosine phosphatase
  Pfam annotation: Domain name=PTPLA; Domain location=2-109; Score =47.0; E_value=6.6e-11; Accession=PF04387.5; Description=Protein tyrosine phosphatase-like protein, PTPLA
MEMVHLKIGHIIRYSFFGFKETFGFTPSWLLWLRYSSFLVLYPTGISSEVGLIYIALPFIKASGKYCIRMPNKWNSSFDYFYAAIVAMGIYVPGMSKTSFSLLTMMSLG

SEQ ID NO: 150327 - protein, 45 aa, Glycine max
  Coding DNA Sequence Number=SeqID_33549
MKKRKTLMAMMTTTMGGTNDGRTANQVASGGASTENEGEPQKDLI

SEQ ID NO: 150328 - protein, 1028 aa, Glycine max
  Coding DNA Sequence Number=SeqID_33550
  Gene Ontology: Mol. function=structural constituent of ribosome; Cellular component=intracellular; Biological process=translation
  Homolog annotation: Hit_ID=Q949K0; Match level="QueryCoverage=96%, HitCoverage=96%, E-value=1e-157, Identity=31%"; Hit description =Putative centromere protein
  Pfam annotation: Domain name=Pox_A_type_inc; Domain location=129-151; Score=0.7; E_value=64; Accession=PF04508.3; Description=Viral A-type inclusion protein repeat
  Pfam annotation: Domain name=Pox_A_type_inc; Domain location=6-28; Score=21.1; E_value=0.0039; Accession=PF04508.3; Description=Viral A- type inclusion protein repeat
  Pfam annotation: Domain name=Pox_A_type_inc; Domain location=62-84; Score=0.2; E_value=76; Accession=PF04508.3; Description=Viral A-type inclusion protein repeat
  Pfam annotation: Domain name=Pox_A_type_inc; Domain location=706-728; Score=3.9; E_value=22; Accession=PF04508.3; Description=Viral A-type inclusion protein repeat
  Pfam annotation: Domain name=Pox_A_type_inc; Domain location=894-916; Score=0.8; E_value=62; Accession=PF04508.3; Description=Viral A-type inclusion protein repeat
  Pfam module annotation: Pfam domain module=Pox_A_type_inc::Pox_A_type_ inc::Pox_A_type_inc::Pox_A_type_inc::Pox_A_type_inc; Domain location =129-151::6-28::62-84::706-728::894-916
MDKVYEELDEAKAKIEELKEELRAKTDSLENWKKSHNAQINQIQEAKFKAEKLDQTLLQQADEISEAKLVCEDLKGKLTKKESIIKHLRAANDKLRVDCDAKFKKWEEEKRELVLALEEGNEKTQDHEQQIHQYKQEIERLKGCLSVSKEKCVETEKKFKASKELRERDDMFQKLEEECRKAEDQLKWKKEQFKHLEEAHEKLRDQFKASKKEAEVEKSTLLDGISSLQTRLDSQIRVSEDLQHQLHTCHQALAHVESQKKCLEVEVSNLKVQLDNASNEYQDARLQLDCLNTHCDKDIADLRYLLKTKEAYNKESKYRIEKLEQENQELRMSLKELQEAQIQEAGTSYSQSKLRSKLRNLEQTHKECASTLKTKEAEWNFKIKQLTENLNRCQSDLETKIEAVEDLQMELERSHSLAIEMMLLNEEISVMLLVLKQGTSEAQLKLAGHKDEMDLISKASEEKIFQLMRQLEMKDAALISAQKSINEEREIAARLMKQVESSVSNNELHSLQNELDRHKEMLEESIRSQLILKENVLQMECNFKEQLEMKDVVVISAQKSINEEREVEACLRRQVESYASNNDELQQSLQNEVDRHKEMQEESTSQPILKEKVLQLECNFKEQLKEIHDAFDSVIIELDETICERNEMEFELQIWKSIVEHLKNDLEENHVVRRELESSLLAQVDFGESLKHEKDSLVYKLEEKERSLDYLQRHVVLLERELIERGESAVSSESDNVRYLQIIAEKDKILEELQKEVVWLEQESFRKEFESAVIEKGTMERTFEHEKDNLIQIVKGKDRRIDELMQQVTSLEQQFTNSLTTFSSQLAEKQAEINLIQEACYKITTSQILAALEIEEKKFMVVELEDDIHAIQQKLKLQEEKWSPSEQLALDTEVELGAKQLKAMELNDQMESKLRKSDALLHKLKMENRNLLESATRLSSERESLLANVQGFSDKICEFSTADTILMDKLRSMVQSFENGCPVMKLKKDDGFLVKENNMLIQSPTRIKKLEANSDTRSPFKELNLLEE

SEQ ID NO: 150329 - protein, 268 aa, Glycine max
  Coding DNA Sequence Number=SeqID_33551
  Homolog annotation: Hit_ID=Q00V20; Match level="QueryCoverage=40%, HitCoverage=60%, E-value=3e-08, Identity=36%"; Hit description=[S] KOG4032 Uncharacterized conserved protein
MEGSRRLRGHSIGVFSEGIGLVLFRWSTLLTAVENEWGGHESRVKADQLASDILSWFTQSKEPLYIDDLEDILDQGMLSLNVEVEDGSIEEVAEKLMVMHEEFLEDNFSSFENLRKANLEHAARPPVPQIVNDDEDDTDEDVGNDENMIVDDNSSNMNPETSTSVANTNSVNRSVNGPLPKVSGEADDGWVVVSNRRNKGHMRRSKRCRGDCGVQLMVSWLGGARFDLEKGGGDVIRREEGVSGGPWWLHRDGAPSKKMGCFCFVYKV

SEQ ID NO: 150330 - protein, 169 aa, Glycine max
  Coding DNA Sequence Number=SeqID_33552
MAAEWRRKRERRCHFKEKMSLEEAHHHRRPWIRAWRKKEMNEGRGREEHEILCSKRALKSEVPEGTGVAGVGAGGVGGAEEEGAEVEAFDGHRALALWVPRKVIVGSSGAQGLEDDALLRKNVPGVNILCISLPGALRYESSGIIGLPGSGGISFPLPRGHLHQKNHKN

SEQ ID NO: 150331 - protein, 101 aa, Glycine max
  Coding DNA Sequence Number=SeqID_33553
  Gene Ontology: Mol. function=RNA-directed DNA polymerase activity; Biological process=DNA integration
MTDPLLGFPNTLSELLQIKQTNLGVYIQQTKSVKELLKKFNMHDAKEMKTLMHPTIWLGLDKESNNVDNHKYRIMFGSLLYLTTSRPCWTSGLNNLRGRVN

SEQ ID NO: 150332 - protein, 64 aa, Glycine max
  Coding DNA Sequence Number=SeqID_33554
MRNGVGKLEGVRVEMLAGFVVTPAKSIGKCVHLLRGDSNDLTNDREKTMSWDRPLLPVGQKIDL

SEQ ID NO: 150333 - protein, 121 aa, Glycine max
  Coding DNA Sequence Number=SeqID_33555
  Subcellular localization annotation: CTP_CleavageSite=69; ConfidenceScore=5.89e-01
MSSMLRFPFSFLQPQRPQFPRPFTAFAAAAAVSSSDRSFLRNALNSFFSVNPSMPLLGSLSLADSGVCVVEAKTGTSFPSILDSSQKLCGIGLRKKNVLGLKNIDVYAFGMTFYFPQPSLV

SEQ ID NO: 150334 - protein, 44 aa, Glycine max
  Coding DNA Sequence Number=SeqID_33556
MAELCLVPDVIIPPKFKVPDFDNALDDRERDDYRDGGYIANVLL

SEQ ID NO: 150335 - protein, 59 aa, Glycine max
  Coding DNA Sequence Number=SeqID_33557
MMPMMKLSCGWICESNCHIGKWKGGLVSSLEEFESRSKGPTTLNRTKKLSKLSETPQGE

SEQ ID NO: 150336 - protein, 34 aa, Glycine max
  Coding DNA Sequence Number=SeqID_33558
MFMEVGIAFSWQLYHDGNDKQYTLEDLLVAKVAG

SEQ ID NO: 150337 - protein, 87 aa, Glycine max
  Coding DNA Sequence Number=SeqID_33559
MSLHVLYLYAFSRFPPRDFRSVVSLVTIFQRDEHGFEAFSPHGQDHLELPSGGYLRMNASGGWGHDRPIVAPFLCETKQGMSLQGSP

SEQ ID NO: 150338 - protein, 124 aa, Glycine max
  Coding DNA Sequence Number=SeqID_33560
METQTTGRKWLTSTMSRAEEEEDEHTMGRVASTTNGDEEQRRTGSPRTQRLKKLRKKGAAEDEAKKKLKKKVRREKKEVGCTKGVVKVKVPVLSVVVVVNDIQGTQKVVPLLETYGSVMDQVDS

SEQ ID NO: 150339 - protein, 192 aa, Glycine max
  Coding DNA Sequence Number=SeqID_33561
  Gene Ontology: Mol. function=DNA-directed DNA polymerase activity; Cellular component=mitochondrion; Biological process=DNA replication
  Homolog annotation: Hit_ID=Q6QZN8; Match level="QueryCoverage=82%, HitCoverage=20%, E-value=4e-38, Identity=51%"; Hit description=DNA -directed DNA polymerase
MVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRIPFFNEKEITEAGTGKRYNSPAESRRRK

SEQ ID NO: 150340 - protein, 179 aa, Glycine max
  Coding DNA Sequence Number=SeqID_33562
  Pfam annotation: Domain name=zf-CCHC; Domain location=107-124; Score =20.1; E_value=0.00048; Accession=PF00098.13; Description=Zinc knuckle
MQIFIEAINLNIWEAIEIGPYIPTVVDEHEMKLQRLNHNEETDKKKRSIALKASSSMQEENEEEDSDDEKDFSFFVKKFQKFIKKRRIDRCQNFNNGRKSQEDSQVVRCCKCNQLGHTKANCPSNEEWPEKSDKKRYDERRTKKAYIAWDDNDSSDGSEKEINLLTKDDESDENIYQED

SEQ ID NO: 150341 - protein, 96 aa, Glycine max
  Coding DNA Sequence Number=SeqID_33563
MCVVPGQCAADYMNWFFVISHPFKTTAQPSDPPRDPPAMHDASFVEPHIPQVLEPVATSTHARSEVDEPIHAVEAYHVIAERLERHLNLRIVMPGT

SEQ ID NO: 150342 - protein, 265 aa, Glycine max
  Coding DNA Sequence Number=SeqID_33564
  Gene Ontology: Mol. function=nucleic acid binding
  Homolog annotation: Hit_ID=Q67WF0; Match level="QueryCoverage=80%, HitCoverage=10%, E-value=3e-50, Identity=47%"; Hit description=Zinc finger (CCCH-type) protein-like
  Pfam annotation: Domain name=zf-CCCH; Domain location=12-36; Score =1.1; E_value=0.95; Accession=PF00642.15; Description=Zinc finger C -x8-C-x5-C-x3-H type (and similar)
  Pfam annotation: Domain name=zf-CCCH; Domain location=39-63; Score =9.8; E_value=0.068; Accession=PF00642.15; Description=Zinc finger C -x8-C-x5-C-x3-H type (and similar)
  Pfam annotation: Domain name=zf-CCCH; Domain location=66-91; Score =16.0; E_value=0.01; Accession=PF00642.15; Description=Zinc finger C -x8-C-x5-C-x3-H type (and similar)
  Pfam annotation: Domain name=zf-CCCH; Domain location=92-114; Score =11.3; E_value=0.043; Accession=PF00642.15; Description=Zinc finger C- x8-C-x5-C-x3-H type (and similar)
  Pfam module annotation: Pfam domain module=zf-CCCH::zf-CCCH::zf -CCCH::zf-CCCH; Domain location=12-36::39-63::66-91::92-114
DGGKCPYIHDPSKIAVCTKFLNGLCSTPNCKLTHKVIPERMPDCSYFLQGLCSNRNCPYRHVNVNPKASICEGFLKGYCADGNECRKKHSYVCPTFEATGTCTQGTGCKLHHPKKQSKGKKRKRTADQNNSRGRYFGFIPADVSKSGMMVAPKRHRQNGELEEELSDYISLDVVNEEVADVVDQSFEPAAFCDNDSLDLQLDDFDGLIKPVLLLKTKFTLQSPQSSSLQAFRQVKGSMCNVAMVGSTSAANKISIVGGCVGGGGS

SEQ ID NO: 150343 - protein, 1732 aa, Glycine max
  Coding DNA Sequence Number=SeqID_33565
  Gene Ontology: Mol. function=nucleic acid binding; Cellular component= membrane; Biological process=homophilic cell adhesion
  Homolog annotation: Hit_ID=Q67WF0; Match level="QueryCoverage=29%, HitCoverage=24%, E-value=1e-36, Identity=28%"; Hit description=Zinc finger (CCCH-type) protein-like
MDQHHFLHHHHYHHPQEHRNRYTSLTPQSHLHSHHHNNLPPPPPNPSPPLSYHRTPQPYTPPTPQPQHQQQQFPYTPLPDRPLEEEPQPQRHIPYDLLPRRTTTLPWNPNPNPNPRIPDDFDRDYHHKHHRPLPPPPLPIESHRYDPDRHHHPVDPYEQNPREPLAWGGGGYHAPGQGDVDPTSYVRVYTVESDADVAGRTTSKRWVMSDRDRGREMHESSSGLVSSNGNSEKYYHGSENNMMGRYSRGNSRECGHTHEFERTPPKKQVQKKSALLRIQTVKPNNNHRNRENREVEQLRYPGYGSENGNGFYRGKEQYFGHGVKGEEREESPVEIDISFESNSLVAKAKAVVAPLPPPSSSVSVPDLNVMPVSDSDLVYGERSKRVSGSEGDYSGMQLPQPVRMSSVVVDLNRSPCKGNDSSGSRKEVIRSNKKNVDDGSSRSRTREADGSRGKKEVPNFVKVGNVVSGKLTSKIVKKKKIVKRVVKKGTASSKSSASNSLPAKTLPGTVKAESVARISLTASGPEKIEANLDEKSNTVIQSNTVDEEAKPDCLPPLPKEGNVLKEDAEVGLLQLSLGPDSRSQECKSDKDSGIGKVSRFERDGNISNSLSCASISEDKKSDSDCLDANDSVHDIGNTISVHDNANTSDCLDANNSVLNTYKVTKSLSGSNISVVTNIDYDNKQLCQNEVSLSPGKYSNVGSPQNRNLEDVGDELLKSSDTFSCSGKTRIQDGLDCLQHASALKHSSDNGSSNLEDSTCVDCSGIMHCAGKQVSPGDVVISPENWDTEKAFPNSNISAGSGEGDTNKIKKRRARTLLNFLSSEMECLSSNHVNPDSLANNVDGGSSLLLKDPSPSEVLEQPVQSLDFNSLSGVNGVTALHGKGGVLEAQFCVGHIDNDDANEVSPASKRKKVTANPNFTKCQSELSAVIVPSTTSEAPMSFSDNQEHQKEVAFESMGMIILSSAQSMPYSEDITKMPENVLAGGSFESIDANKETMSSEHLELWHSDIVSFSPCEDLAFPNVQFSSLEGECKENTTPIVPTSNIQTDILAVGNIAGEKTDLQAVEENYQYREHVQRSPRADMEPNDHNMKNDLLAQWNLMSCPASGDEVTTNNSNDEVIEDAPGLSDMFSQGMVSEVPDRRVLEFTAINDENIFGVQENPDNISMVGHDSNLNTSSIQQTKKNMKSDHAIEHSNLITKKTMSEQSQVSSKVTTQALNSYCFGLSGTKNQSGSIIPKTFPGHSFTFSKTSASSPHVSKPRTWHRTGNNPPASLPRIKPSLGTVPPKKPILEMKGNFQNTSYVRKGNSLVRKPTPVSTLPHISSVNQTSLGIDEIPKSIKSGGRADVTDKQMYLRTGATNAPQQRTPPLPIDTKSEENTSSSLVEPPSGGCCENASDLRKFIETDNIAPNSSEDALKHYETLENQPGPSDNGDSQGEAIDGNVFPLNTKRIVYIKPKTNQLVATSNSCDVSVSTDDNLQTAFSDGYYKRRKNQLIRTTFESHINQTVAMSNNTAYSGGQGTSNALCNRRFSKRRTHKVGRSSCKRSRASLVWTLCSKNSSENDRDSQHYQRALPQLFPWKRPTFASSLNNSSLSAISKKLLQLRKRDTVYTRSIHGFSLQKSRVLGVGGCSLKWSKSIEKKSKLANEEATLAVAAVERKRREQKNAVCISSQSKSRKHSFHECSSYHNADNSLFLCYLILMLHESVYFALVQFATEWILPGGHFRGFQVVKFFI

SEQ ID NO: 150344 - protein, 372 aa, Glycine max
  Coding DNA Sequence Number=SeqID_33566
  Gene Ontology: Mol. function=nucleic acid binding; Cellular component= chromatin; Biological process=DNA integration
  Homolog annotation: Hit_ID=Q1RWN2; Match level="QueryCoverage=87%, HitCoverage=31%, E-value=6e-68, Identity=49%"; Hit description =Peptidase S8 and S53, subtilisin, kexin, sedolisin; Integrase, catalytic region; Zinc finger, CCHC-type
  Pfam annotation: Domain name=rve; Domain location=211-372; Score =129.4; E_value=1e-35; Accession=PF00665.16; Description=Integrase core domain
  Pfam annotation: Domain name=zf-CCHC; Domain location=58-75; Score =24.7; E_value=8.4e-05; Accession=PF00098.13; Description=Zinc knuckle
  Pfam module annotation: Pfam domain module=rve::zf-CCHC; Domain location=211-372::58-75
MEGLPILIPTTLEEGGRGRGRGRGHGDRGNRDFSNNSKDNNDQFQGNGRGRDHDKSKVQCYRCHKFGHYASNCYTRLPNLKEKGESSNFIKEKEVETLLMVVEDAKDSEAEIWYADIGCSNHMSGIIKMNSNRLFPLKIESIHSFLMAKDTISTWLWHYHYGHLSFSGLKTLEQKNKVIGLPQITAPSQVCEECVVSKQHRSQFPNGKSWREKCVLELIHSYICGPIYPSSNGGKKYFITFTDDFSRNTRVYFLQEKSEALSSFKSFKARVETESEKTIESLQTDCDGEYCSDEFSTFCVNHGIQKELTIVYTPQQNGVSERKNRTILNMVRCLLTKSGVSKEFWPEAVNWSVHILNRSPTFVVKNMTPEEA

SEQ ID NO: 150345 - protein, 67 aa, Glycine max
  Coding DNA Sequence Number=SeqID_33567
MGLQIRFDGGGRTNNARQSIRGAPDLMIRFDGGGCMNNAKKSIRGAPDSMVENARTTLGNQFVGLRT

SEQ ID NO: 150346 - protein, 115 aa, Glycine max
  Coding DNA Sequence Number=SeqID_33568
  Gene Ontology: Mol. function=nucleic acid binding; Cellular component= mitochondrion; Biological process=DNA integration
MGPAAISWSSWKQPIVTLSTTEAEFVAASACACQAIWLRNIFEEVHFKQQGPTLIYCDNSSTIKLSKNPIMHGRSKHIDCKSEEHIADIMSKLLKLSAFQKLRNLLGVCMVNESH

SEQ ID NO: 150347 - protein, 157 aa, Glycine max
  Coding DNA Sequence Number=SeqID_33569
  Gene Ontology: Mol. function=nucleic acid binding; Cellular component= endoplasmic reticulum membrane; Biological process=DNA integration
RFWENNIDETKQILANFDEDNEDEELQTKEIEEQRIPTITVEDERPQRARRRSAWMSDYEVTGIEDPITRFALFSYCDPTTFESVVKEEKWRKTMDDKIDSIERNDTWELSDLPNGHNTIGVKWVFKTKLKENGEVDKYKACLVAKGYKQQYGVDYT

SEQ ID NO: 150348 - protein, 80 aa, Glycine max
  Coding DNA Sequence Number=SeqID_33570
MEKSDKMNFKEKKEKKGYITWEDNVLNYSSDSEKKIISLGIMMKDYENGEEQSRYIDSNFSKHMACIKVYSYFSPRKVNM

SEQ ID NO: 150349 - protein, 35 aa, Glycine max
  Coding DNA Sequence Number=SeqID_33571
MEAHPLMPLGVGPSSTRSPQAHTALTDIQGTEREV

SEQ ID NO: 150350 - protein, 96 aa, Glycine max
  Coding DNA Sequence Number=SeqID_33572
MDGILISSVVLLADSRFTRPDMGFHPTKLNFVPSDADEAPLDVFHLPACLWYCGVLTIGSCVAYLPNGIRVASQTHSIQASLLGTLEDFKVPHVNH

SEQ ID NO: 150351 - protein, 417 aa, Glycine max
  Coding DNA Sequence Number=SeqID_33573
  Gene Ontology: Mol. function=transporter activity; Cellular component= integral to membrane; Biological process=sodium ion transport
  Homolog annotation: Hit_ID=P75763; Match level="QueryCoverage=83%, HitCoverage=77%, E-value=1e-146, Identity=71%"; Hit description =Inner membrane protein ybhI
  Pfam annotation: Domain name=CitMHS; Domain location=40-332; Score= -144.1; E_value=0.1; Accession=PF03600.6; Description=Citrate transporter
  Pfam annotation: Domain name=Na_sulph_symp; Domain location=1-400; Score=461.1; E_value=1.4e-135; Accession=PF00939.9; Description =Sodium:sulfate symporter transmembrane region
  Pfam module annotation: Pfam domain module=CitMHS::Na_sulph_symp; Domain location=40-332::1-400
MVIIGNLGDGSIKSSSVLSGYASGKRIAYILIGKIGSTTLGLGYVTAFLDLILSPATPSNTARAGGIVLPIINSVAVALGSEPEHTAKRVGHYLMMNVYMVTKTTSYMFFTAMAGNILALKMIEDICHIKLSWGGWALAGILPGLIMLLLTPLITYKLYPPELKKVDNKAIAKEGLESLGPMTLREKMLSCLFVMALAGWVFSTSLGVNESTVAICVMALMLILKIVTWDDVIKNKGGWNTLIWYGGIIGLSSLLSKVGFFLWLAELLKNNISFGSHSTLAFVVIVALSILVRYFFASGSAYIVAMVPVFAMLANVSGAPVMLTALALLFSNSYGGMVTHYGGAAGPNVILFVAMFVVGGALFETGVTDKIGGIVTRYARSEKQLIVIIMLVCGILSGFLSNTGTAAVLIPVVIGAA

SEQ ID NO: 150352 - protein, 234 aa, Glycine max
  Coding DNA Sequence Number=SeqID_33574
  Gene Ontology: Mol. function=transferase activity, transferring groups other than amino-acyl groups; Cellular component=cellular _component; Biological process=flavonoid biosynthetic process
  Homolog annotation: Hit_ID=P30081; Match level="QueryCoverage=99%, HitCoverage=74%, E-value=5e-81, Identity=57%"; Hit description =Chalcone synthase 7
  Pfam annotation: Domain name=Chal_sti_synt_C; Domain location=115 -233; Score=172.6; E_value=1e-48; Accession=PF02797.6; Description =Chalcone and stilbene synthases, C-te
  Pfam annotation: Domain name=Chal_sti_synt_N; Domain location=1-105; Score=34.5; E_value=7.1e-10; Accession=PF00195.10; Description =Chalcone and stilbene synthases, N-te
  Pfam module annotation: Pfam domain module=Chal_sti_synt_C::Chal_sti _synt_N; Domain location=115-233::1-105
MEVPKLGKKAAKKAVEEWGQPKSKIAHLIVCTTSGNDMPDADYQLTKVLNLNSNVKCYMVYQQGCFAGSTILRLAKDLVENNKDSLMGQAIFGDVVAAAIVGSNIIPNVEMPLFELVWTSQIIVPNSEGALSFHLREACLTFHLHKDVPELIPNNIEDVLDEAFKSFNIFYDYNYIFWIVHPGGLAILDLVEEKLGLKPEKMRGSKHVLSEYGVLFGFGPGVTLETIVLRSVAL

SEQ ID NO: 150353 - protein, 226 aa, Glycine max
  Coding DNA Sequence Number=SeqID_33575
  Homolog annotation: Hit_ID=Q1SN43; Match level="QueryCoverage=37%, HitCoverage=16%, E-value=8e-12, Identity=42%"; Hit description =Nucleic acid-binding, OB-fold, subgroup
MEPKPTTPLHYKAAWQGFLLRAEHSLVAHKNEITHKRDKSMKQIMTNKYNSVAEINAEKKSWRIMVRVVRLWMVLDVLTNKQTSSNKIPFSMEMVLVDSKYSTKVALVDNASVPYSAYDFVHIRDIVCGGYDTDYLVDKIHLQNCICGTRVVFNAKCEEVKELATRMMESPPQGLSQIIDSIALTMSEDFLHNTTRKTIGGLKDCFEVTCFPIFGTVKYVVDDEKW

SEQ ID NO: 150354 - protein, 148 aa, Glycine max
  Coding DNA Sequence Number=SeqID_33576
MVYCSIPHWWVNRKLGFSNRKVFLLWKGPLGASSTKISDRENHMGFVLASKLFLYRFSSHVLLLLLTALQLPFSSFSRLSLLLSHCDSTPRDDVPIVPPLHSRSLTLTQLLVTRRAHRVTITFSLCVSRSRSHSQLYTIWFSFPTMKG

SEQ ID NO: 150355 - protein, 209 aa, Glycine max
  Coding DNA Sequence Number=SeqID_33577
  Gene Ontology: Mol. function=hydrolase activity; Biological process =alanyl-tRNA aminoacylation
  Homolog annotation: Hit_ID=Q3K8I0; Match level="QueryCoverage=99%, HitCoverage=100%, E-value=9e-44, Identity=39%"; Hit description =Metal-dependent hydrolases
  Pfam annotation: Domain name=tRNA_SAD; Domain location=163-204; Score= 14.7; E_value=0.0046; Accession=PF07973.4; Description=Threonyl and Alanyl tRNA synthetase s
MTERVYYASDATEGRAQIIGCRAEADGRYAIELDRTLFHPQGGGQPSDSGWIDEQVVTAVATRGDSVLHIVEQPLPLGEVKIRIDASARQLHARLHSAGHLLGLAGEQLGWRPVKAHHWPGEGRITFAAGAGAALPEASTLLTQVSAWQQQDLPRRITFANGLRAVGFGDLPAYPCGGTHVASLAALGNIVISQLKMKKGQMIVSYNLE

SEQ ID NO: 150356 - protein, 38 aa, Glycine max
  Coding DNA Sequence Number=SeqID_33578
MAALPSAVLDSGKYFLRNFSTTSSHVAKCAYGSSLGKP

SEQ ID NO: 150357 - protein, 483 aa, Glycine max
  Coding DNA Sequence Number=SeqID_33579
  Gene Ontology: Mol. function=transferase activity, transferring phosphorus-containing groups; Cellular component=integral to membrane; Biological process=two-component signal transduction system (phosphorelay)
  Homolog annotation: Hit_ID=P52687; Match level="QueryCoverage=68%, HitCoverage=62%, E-value=1e-134, Identity=81%"; Hit description =Sensor kinase citA
  Pfam annotation: Domain name=OAD_beta; Domain location=1-143; Score =70.1; E_value=2.1e-21; Accession=PF03977.4; Description=Na+ -transporting methylmalonyl-CoAox
MFCFGNLMRESGVVDRLSDTVQNALINIVTIFLGLSVGAKLVADKFLQPQTLGILLLGVIAFCVGTAAGVIMAKLMNVFSKHKINPLIGSAGVSAVPMAARVSNKVGLEADGQNFLLMHAMGPNVAGVIGSAIAAGVMLKYVLAMPPNEETNYLMSIGPMSTRKITHWFARRSFQNRIFLLILFTSTVVMLAMSWYLTDITEERLHYQVGQRALIQAMQISAMPELVEAVQKRDLARIKELIDPMRSFSDATYITVGDAQGRRLYHVNPDEIGKSMEGGDSDEALYNAKSYVSVRKGSLGSSLRGKSPIQDASGKVIGIVSVGYTIEQLENWLSLQISSLLIPMAIILLLLLYCARRFSLHIKKQMLNMEPQQLSQLLIQQSVLFESVFEGLIAIDSNYKITAINQTARRLLNLSQPEPTLIGKGISSVISQEAFFYDAPHENKKDAIVTFNQIKVIASRMAVILNNAPQGWPAAQPGAAVRR

SEQ ID NO: 150358 - protein, 177 aa, Glycine max
  Coding DNA Sequence Number=SeqID_33580
  Gene Ontology: Mol. function=N-acetyltransferase activity; Biological process=metabolic process
  Homolog annotation: Hit_ID=Q1D939; Match level="QueryCoverage=97%, HitCoverage=63%, E-value=6e-13, Identity=33%"; Hit description =Acetyltransferase, GNAT family
MTSLIADLRAQGVQRMWLEVIRDNHRAVALYQSLGFTVRHGLCGYLSAGQAEPRESSLDEYDLLSLLRHASLELEGQLPWLLDPLTFITLPCRALTLQQQAFAVLATTASKPQLQFLWLTPAARGRGLGREMLLALAQQFPGLSTSVTIPETFTPLFKSAGYAPLALQQYEMCLRLN

SEQ ID NO: 150359 - protein, 118 aa, Glycine max
  Coding DNA Sequence Number=SeqID_33581
  Gene Ontology: Mol. function=ribonuclease H activity
  Homolog annotation: Hit_ID=Q1RYI2; Match level="QueryCoverage=88%, HitCoverage=16%, E-value=7e-09, Identity=32%"; Hit description =Ribonuclease H
MGIHGVVASCGVVIGNSQSIFLQAFSRRLNHCSILEAKLWAIFYGLTMATNLDVQNLIVESDCVEVIQLLDEGDVSSSQFKYLLIEILKVKGQFQLCYYKHIIREANMLVDSFSMVYL

SEQ ID NO: 150360 - protein, 75 aa, Glycine max
  Coding DNA Sequence Number=SeqID_33582
  Homolog annotation: Hit_ID=Q84JF4; Match level="QueryCoverage=63%, HitCoverage=7%, E-value=2e-11, Identity=66%"; Hit description =Putative amino acid acetyltransferase
MGPFLKDKGTETGDELKLGKRKRMFVRRGFSECSFDYIPEKKRKTINLSRKSKYYMKKLLPNKSGITVSSRFTSS

SEQ ID NO: 150361 - protein, 711 aa, Glycine max
  Coding DNA Sequence Number=SeqID_33583
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=56%, E-value=6e-98, Identity=45%"; Hit description=Chromo
  Pfam annotation: Domain name=RnaseH; Domain location=534-653; Score= -25.0; E_value=0.012; Accession=PF00075.14; Description=RNase H
MAELFKLQQSGSVSDYYLKFMSLANRSEGLTEEAILNCFISGLNVDIKRDVVAMSPLNLLRAVALAKLYEEKYCPTLKSTTTYSTRYNNSSFIGTSVNQPPKNTPKTTLTYPKPNLPPFLPTPSSPPLKNSNIKRISPAEMQLRREKGLFYFCDEKFSFNHKCPNRQCFVLQLGDEDAEKSVNESKVIIEEREPVIDDHHLSLNALKGGLGVGTIKFMAYVGTMLVKVLIDGGSSDNFLQPIVAKFLKLPIEQAPMFRVMVGNGNYMESKVLIQNLTLQAQGNIFTLPVFLLPTSGADLILGASWLKTIGPHLADYETLMVHTDAIAGIYSMHAVQEDTHSFPLLELPEDMELELSLLLHTYGIVFSTPSGLPPLRTHVHSIPLLEGSNPVKVKPYRYPHSQKEEIEKLVEGMLKEGIIQPNNSPFSSPIILVKKMVHGGRFVLVFFDDILVYNSSWKDHLNHLEVIGYLGHTLSGDGVAMDTEKLESVKDWPQPTNLKQLRGFLGLTADKAFEALKLALTTAPVLAIPNFAAPFVLETDASGSSIGVVLSQNKHPIAYFSKKLSLRMQKQSAYAREFYAITESLSKFRHYLLGQKFIIKTDQKSLKELLDQTLQTPEQQQWLPKFIGYDFIIQYSPGKENIPADALSRSFAMAWSEPSNTWLQTVAAATKNDESLMKIYQLCSNNAGKSGDYVLHQDVIIWKGRIMLPND

SEQ ID NO: 150362 - protein, 66 aa, Glycine max
  Coding DNA Sequence Number=SeqID_33584
MTLTIKSVEPEVYIYMFDLKEVMSFEDLCGLTVLLNVVCGHGELTIPMNRVLVKFVGYTVHNPLKL

SEQ ID NO: 150363 - protein, 94 aa, Glycine max
  Coding DNA Sequence Number=SeqID_33585
MEGGEGWWRLILNRLPLRDKLLQRNIITNATDAFCPQCNTTQETRTHVILSCSKISQLWMDWYRQENVQQLCQTRWRLTFGSTCSQQVQSRRQD

SEQ ID NO: 150364 - protein, 117 aa, Glycine max
  Coding DNA Sequence Number=SeqID_33586
MADNNTRKAATNRLEEVVLHFTQGQTTLTTNHQDLSVKVDAILKCLSAMTIPSLTPTCTLMSPTFPHPHITLDVPRFDSHNPLGWIFKISQFFNYQGTPNEERITVPLFYMDDATLS

SEQ ID NO: 150365 - protein, 102 aa, Glycine max
  Coding DNA Sequence Number=SeqID_33587
MVVLRAKYFLHGKPLKASPSPTQSSIWSIIVAALPLDMRGFIWSIGDRSKVHVFYDRWILNLARHSLDPPNGSTMDPILKVKDLIEPGSKSWNNTSINSLFL

SEQ ID NO: 150366 - protein, 63 aa, Glycine max
  Coding DNA Sequence Number=SeqID_33588
  Gene Ontology: Mol. function=chromatin binding; Cellular component =chromatin; Biological process=chromatin assembly or disassembly
  Homolog annotation: Hit_ID=Q1SAV4; Match level="QueryCoverage=95%, HitCoverage=15%, E-value=3e-15, Identity=65%"; Hit description =Integrase, catalytic region
MADEYGIPIIKKAMREAMKLIDHVHKQGSNLKGCLVGRKGAEMSLFGETIHHCKCHSVPLGGQ

SEQ ID NO: 150367 - protein, 363 aa, Glycine max
  Coding DNA Sequence Number=SeqID_33589
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-48, Identity=30%"; Hit description= UPI00006A17C9 related cluster
MRGLHVLAFRGQHALAFRGLHVLAIRGVHALTFKGLHVLSFRGLNVLSFRGLHALTFRGLHVLAFRGLHALTFRGLHVLAFRWHHALTFRGLQVLAFRGLHALTFNGLHVLAFRGLHVLAFRGLHGLTFRGLHVLTLIGLDALAFTGLHAVTFRGLHVLAFRGLHVLAFKGLLALPIRGLDALTFRGLHILAFRGLHMLAFRGLHVLAFRGLHVLAFRGLHVLPSKDYTSSRLEGYTSLPLEGLHVLAFRGLHALAFRGLHVLAIRGVHALTFIGLHVLSFRGLHVLSFRGLDALTFKGLHVLAFRGLHALTIRGLHVLAYRGLHVLTFRGLHALAFRGLHVLAYRGHHTLTFRGLHVLAFRG

SEQ ID NO: 150368 - protein, 271 aa, Glycine max
  Coding DNA Sequence Number=SeqID_33590
  Gene Ontology: Mol. function=nuclease activity; Biological process =response to DNA damage stimulus
  Homolog annotation: Hit_ID=Q00ZI2; Match level="QueryCoverage=71%, HitCoverage=75%, E-value=2e-27, Identity=33%"; Hit description=[P] KOG4408 Putative Mg2+ and Co2+ transporter CorD
  Pfam annotation: Domain name=DUF525; Domain location=142-265; Score =168.2; E_value=2.1e-47; Accession=PF04379.5; Description=Protein of unknown function (DUF525)
  Pfam annotation: Domain name=UVR; Domain location=104-134; Score =13.5; E_value=0.015; Accession=PF02151.9; Description=UvrBuvrC motif
  Pfam annotation: Domain name=UVR; Domain location=64-99; Score=12.3; E_value=0.02; Accession=PF02151.9; Description=UvrBuvrC motif
  Pfam module annotation: Pfam domain module=DUF525::UVR::UVR; Domain location=142-265::104-134::64-99
  Subcellular localization annotation: CTP_CleavageSite=45; ConfidenceScore=5.29e-01
MMQSLMSMKACVGTRLPVLTNSEASTRKQRVNYPNRRYGRNVIVSCGLERNGNEGMGSNEGSFSHNYAILKHRMEKVAKSEYYEEAARIRDSLKCFEDEVPVLRLRRLLKEAVADERFQDAARYRDELKAIAPHSLLKCSSDATTLGIRVQVKSAYIEARSQPSEEVYFYEYRIRITNNTNRPVQLLRRHWIISDANGKIENIRGIGVVGEQPAIFPRSSFEFSSTCPLSTQNGRMEGDFEMIYVDRVGSRAFNVAVAPFSLSLLGDGETT

SEQ ID NO: 150369 - protein, 50 aa, Glycine max
  Coding DNA Sequence Number=SeqID_33591
MSSAHYNDRGDAEQGTATVAFTATPIGTHSMWRLLTRPSEANRHHRSSVT

SEQ ID NO: 150370 - protein, 112 aa, Glycine max
  Coding DNA Sequence Number=SeqID_33592
  Homolog annotation: Hit_ID=Q1SCR3; Match level="QueryCoverage=41%, HitCoverage=10%, E-value=6e-11, Identity=63%"; Hit description=Pre -mRNA cleavage complex II Clp1
MAYDGAGPIGGSGSTLTIKQVFTWYGATIEMDGATETDYTANERISLMRRLQLFECRLQCNNVELYKVLLKDLAVMIDMQFTGNAKSRASSMVINTTGWIKGICYDVFGLCI

SEQ ID NO: 150371 - protein, 88 aa, Glycine max
  Coding DNA Sequence Number=SeqID_33593
  Gene Ontology: Mol. function=growth factor activity; Cellular component=extracellular region; Biological process=cell proliferation
  Homolog annotation: Hit_ID=Q7PCB5; Match level="QueryCoverage=94%, HitCoverage=96%, E-value=7e-14, Identity=51%"; Hit description =Putative phytosulfokine peptide precursor
  Pfam annotation: Domain name=PSK; Domain location=10-87; Score=96.8; E_value=6.4e-26; Accession=PF06404.3; Description=Phytosulfokine precursor protein (PSK
MTKVTALFFTLLLCSMLVHAMSIRLEPAFHQESLAKPHQQVNNNQYPKQQSVEAVDESCEGVGEDECLMRRTLAAHVDYIYTQKHNNP

SEQ ID NO: 150372 - protein, 83 aa, Glycine max
  Coding DNA Sequence Number=SeqID_33594
MRIDPQEFIAHLCIPGKGFVLNTEGHPWKLLRKDLTTLAQTWSVLSYSNLTPTSHTSNLNMERARLVYGLVIGMYMNIGAIIS

SEQ ID NO: 150373 - protein, 348 aa, Glycine max
  Coding DNA Sequence Number=SeqID_33595
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=89%, HitCoverage=95%, E-value=2e-68, Identity=44%"; Hit description=MRNA, complete cds, clone: RAFL21-92-C23
MGFLTDSHKDSWKPIMTAKTDTQSYWLNWRVLLCAIWIVVSVILASLLVWKYERLRKPARNGSRETQQETSATLYEDETWRPCLKGIHPAWLMALRIVAFIALLVLLIINAIVDGGSIFYYYTQWTFTSITIYFGLGSLLSIYGCYQHHKKATGDKVGNVDGDAEQGMYDASALPQSSNPFDPEKSLGDPEEVLVRQHAGIWGYTFQIIFQINAGAVMLTDCVFWFIIVPFLTIKDYNLNFLIVIMHSINAVFLIGDTALNCLRFPWFRIGYFCLWTITYVLFQWIVHACIYLWWPYPFLDLSSSYAPLWYFAVALLHVPCYGIFALLMKLKHHVLSTRYPDSYQCDR

SEQ ID NO: 150374 - protein, 215 aa, Glycine max
  Coding DNA Sequence Number=SeqID_33596
  Gene Ontology: Mol. function=calpain activity; Cellular component =intracellular; Biological process=proteolysis
  Homolog annotation: Hit_ID=Q1S668; Match level="QueryCoverage=96%, HitCoverage=56%, E-value=6e-28, Identity=36%"; Hit description =Cyclin-like F-box; F-box protein interaction domain
  Pfam annotation: Domain name=FBA_1; Domain location=58-208; Score= -44.1; E_value=0.014; Accession=PF07734.3; Description=F-box associated
MGFGYDESSDTYKVVAIVGNRKSRKMELRVHCLGDNCWKRKIECGNDILPSDTFHGKGQFLSGTLNWVANLATLESYVVFSFDLRNETYRYLLPPVRVRFGLPEVRVLRGCLCFSHNEDGTHLAIWQMKKFGVQKSWTLLIKVSYKHFEFCRSYFPHPLCMSANNDVLLLGNNSKYQLVLCNLKNNTISNIELPLREVFFISFDYVQSLVLPYRN

SEQ ID NO: 150375 - protein, 167 aa, Glycine max
  Coding DNA Sequence Number=SeqID_33597
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=95%, HitCoverage=58%, E-value=2e-33, Identity=35%"; Hit description =Putative receptor protein kinase
  Pfam annotation: Domain name=LRR_1; Domain location=117-136; Score =11.5; E_value=2; Accession=PF00560.23; Description=Leucine Rich Repeat
  Pfam annotation: Domain name=LRR_1; Domain location=21-43; Score=4.9; E_value=34; Accession=PF00560.23; Description=Leucine Rich Repeat
  Pfam annotation: Domain name=LRR_1; Domain location=45-67; Score =17.7; E_value=0.042; Accession=PF00560.23; Description=Leucine Rich Repeat
  Pfam annotation: Domain name=LRR_1; Domain location=93-115; Score =8.6; E_value=6.9; Accession=PF00560.23; Description=Leucine Rich Repeat
  Pfam module annotation: Pfam domain module=LRR_1::LRR_1::LRR_1::LRR _1; Domain location=117-136::21-43::45-67::93-115
MALQENCLSGDVPKGFSSIVSLRYLNLSSIEFAGNIPITYGFLSSLTVLSLSHNGVSGEIPPEIGGCWQLEVLQPRSNFLEGNILGDISRLSCLKELNLGHNRLKGKILVELSSISGLEYLNVSSNNLEGEIPYMLGATFNEPSVFAMNQGLCGNPLHRECANDPSA

SEQ ID NO: 150376 - protein, 153 aa, Glycine max
  Coding DNA Sequence Number=SeqID_33598
  Homolog annotation: Hit_ID=Q1STZ2; Match level="QueryCoverage=59%, HitCoverage=19%, E-value=4e-09, Identity=34%"; Hit description=IMP dehydrogenase/GMP reductase
MGLSQKPSFKKRFYQVKIKSLEVTSLRKLGQLMGQLQRQAFCKAYGKIWDLARVEVSTESIASLAQYYDHPLRCFTFGDFQLSPMVEEFEEILGCPLGGRKPYLFSGFYPSLARISKKSPNLGAGIRPPKASRKWGGRNTEKIFGGKSKNLGR

SEQ ID NO: 150377 - protein, 63 aa, Glycine max
  Coding DNA Sequence Number=SeqID_33599
MGVKYLEVVKRGSHPNNGWSPDEIRLSGSNKLNRAKFHYHTFHAILAYNTEEYGSRFQGSDLG

SEQ ID NO: 150378 - protein, 287 aa, Glycine max
  Coding DNA Sequence Number=SeqID_33600
  Gene Ontology: Mol. function=tRNA-pseudouridine synthase activity; Biological process=tRNA pseudouridine synthesis
  Homolog annotation: Hit_ID=Q6D9A3; Match level="QueryCoverage=60%, HitCoverage=64%, E-value=6e-46, Identity=60%"; Hit description=tRNA pseudouridine synthase B
  Pfam annotation: Domain name=Ribosomal_S15; Domain location=177-243; Score=59.0; E_value=1.6e-14; Accession=PF00312.12; Description =Ribosomal protein S15
  Pfam annotation: Domain name=TruB-C_2; Domain location=116-173; Score= 94.1; E_value=4.2e-25; Accession=PF09157.1; Description=Pseudouridine synthase II TruB, C-termi
  Pfam module annotation: Pfam domain module=Ribosomal_S15::TruB-C_2; Domain location=177-243::116-173
GCGAGELSRRDAAVAHHVLGAQVSGPQAGDELELEIHVSKGTYIRTIIDDLGEKLGCGAHVIMLRRLQVARYPIARMMTLEQLQALAAQVNAAETPDYAPLDALLLPMDSPAEDFPAVNLPTPIAAWFKQGMPVQAENAPASGLVRVTEGEQQKFIGMAEIADDGRVAPRRLIVDVEAKAEIVAKYGRGANDSGSTEVQVALLTAQINHLQGHFFEHKKDHHSRRGLLRMPDRKPGSASLSLKNLINDVAHAQSGPNSCIVAESDLCLQRFARLMRGFTAGAVKGCH

SEQ ID NO: 150379 - protein, 325 aa, Glycine max
  Coding DNA Sequence Number=SeqID_33601
  Gene Ontology: Mol. function=protein serine/threonine kinase activity; Cellular component=cytoplasm; Biological process=protein amino acid phosphorylation
  Homolog annotation: Hit_ID=Q9LSM2; Match level="QueryCoverage=95%, HitCoverage=73%, E-value=1e-121, Identity=68%"; Hit description =Similarity to lectin-like protein kinase
  Pfam annotation: Domain name=Pkinase; Domain location=11-278; Score =118.1; E_value=2.5e-32; Accession=PF00069.15; Description=Protein kinase domain
  Pfam annotation: Domain name=Pkinase_Tyr; Domain location=12-278; Score=83.4; E_value=7.2e-22; Accession=PF07714.7; Description =Protein tyrosine kinase
  Pfam module annotation: Pfam domain module=Pkinase::Pkinase_Tyr; Domain location=11-278::12-278
MMNEHLFKIIPRMMNLLGKGGHAEVYKGCLADGQVVAVKRLMRNEKEIEGKAGDFLTELGIIAHINHPNATRLIGFGIDNGLYFVLQLAPHGSLSSLLFGSECLEWKIRFKVAVGVAKGLQYLHHDCPRRIIHRDIKASNILLNQNNEAEISDFGLAKWLPDKWAHHVVFPIEGTFGYLAPEYFMHGIVDEKTDVFAFGVLLLELITGRRAVDSNSRESLVIWAKPLLEAKLIEQMVDPRLELKYDLAEMKCAMVTASMCIHHMSSKRPYMNQVVQLLKGEEVPIELTQNSSAPRSHLIDACDLEDYTCSNYLTDLNRHKQLLME

SEQ ID NO: 150380 - protein, 159 aa, Glycine max
  Coding DNA Sequence Number=SeqID_33602
  Subcellular localization annotation: CTP_CleavageSite=41; ConfidenceScore=5.35e-01
MFLFNTYFVKKSSLGKNLCYSIIFLSSILTKSFSRDLLLVTVFKRRSSWLQTLNIRDQRSLGSLQEVGFASWLITGHKRPTSFGFIARSGYNFLVVITGHKGPTFLGEKETSIDQIPEPSPIPIPDDSMPSALASELEQPIPQDSPAAQVLDLNEHAQE

SEQ ID NO: 150381 - protein, 139 aa, Glycine max
  Coding DNA Sequence Number=SeqID_33603
MKTIVQRGDENKECSDSNKDEDNSPESKHRHFEAELLPYSRLRVVLKLSYSPHLVPLFEFCFESPHSHRHHWPSVAILVVAGPLSSVIVAASLVFTCAPSFASRHDAKLEISISLVKNGSVTLSSLAAKVNLIIKSRFI

SEQ ID NO: 150382 - protein, 154 aa, Glycine max
  Coding DNA Sequence Number=SeqID_33604
  Subcellular localization annotation: CTP_CleavageSite=25; ConfidenceScore=5.30e-01
FQSSFRAQNFMLFSSSPFIHLLLPPSSYPWPPMVWRLLSLPFSIPLPFIFQEAKESIDEEDPRPTSSNGAYIRLVMSFKTKKGNIGSKGLSKELIQGRLIWLEAYKNKMPKSSPNMHVKQEVSTRVKPRLLCKQSMGQNTPNKIDDDGSNSHQG

SEQ ID NO: 150383 - protein, 55 aa, Glycine max
  Coding DNA Sequence Number=SeqID_33605
  Homolog annotation: Hit_ID=Q08891; Match level="QueryCoverage=88%, HitCoverage=8%, E-value=7e-19, Identity=86%"; Hit description=Male sterility protein 2
  Pfam annotation: Domain name=Sterile; Domain location=1-49; Score= -0.1; E_value=0.00069; Accession=PF03015.9; Description=Male sterility protein
FDNSNTQRLMESMSEEEKREFDFDVKSIDWNDYITNVHIPGLRRHVMKGRGMGSQ

SEQ ID NO: 150384 - protein, 186 aa, Glycine max
  Coding DNA Sequence Number=SeqID_33606
MPAGPHGEPQNKDGAKNTPTTGSGDEEQGKVRGREAGEYFPPQPRVGSMPTPSPLAPNTFQKTPMKDIPFSSNVIIEWSCPTYGLERMLPRCIGTQASSLLLTYLQCQMCICHQSNKDIFVSIRFPPPPIILPSHEELRILPVVHVAPFHGTFCQLPPMQFAHVLVVPDFAVPEVDPIVEPPLVQR

SEQ ID NO: 150385 - protein, 833 aa, Glycine max
  Coding DNA Sequence Number=SeqID_33607
  Gene Ontology: Mol. function=phosphoinositide binding; Biological process=cell communication
  Homolog annotation: Hit_ID=Q1T3A0; Match level="QueryCoverage=98%, HitCoverage=84%, E-value=0.0, Identity=60%"; Hit description=Phox -like
  Pfam annotation: Domain name=PX; Domain location=538-648; Score=45.4; E_value=1.9e-10; Accession=PF00787.14; Description=PX domain
MNARGEVGSPDSLGSFPPLRVRGSDGASDDSEFERYCSANSVMGTPNTSMSLCSAVTLFQDFSDCDFASVATGEGFENFSPGKGAAPEVNRGGGDRRSFLYGSTGLEMYGDCSEELSITTLDSLEIIGFNHRIEESKGSGEVSGGNGFELEIEKREEVEEEEEEEEEELSEGDDSMYDYGSDGGNEMYLSKNIGYYEEPKVRNENSLFMNSSVAFGSRDLDDFLLQSGDISVMSDLFHNQRKKNNGVNKGSGRKEEGKDEKDMVRGNEVEETKDIGYSDAVEEVRDREISADCRRVRDSDMLANTVESSPSIDCQNCIETQVQGPESSYVGKVDEVDLDLLAKEVPRNMGLDVNDGGCMEKGNANSEEAIGTGDAHGVKLELDTSKFEFDHIGDSQFDKSYSNPSNHIGNVNTKSVESLEQIEPVLDNGMRKTLEKSFTSTNLLETSPVASKTEDFELNEFYDEVVQEMEEILLESVDSPGARLSMRNRLTEPQFSMPSRDGGLTASTSSTDDAYLLVQRQRKIDRIEVVGARQKKGDVSFSERLVGVKEYTVYKIKVWSGKDQWEVERRYRDFLTLYRCMKTLFNEQGWKLPLPWSSVEKETQIFRSASPDIIVKRSVLIQDCLQSIIRSRFSSSPPRALIWFISHQDSYPISPVSHSFTRGENIRSISNLGKTISLIVEIPPNKSVKQLLESQHHTCAGCHKHFDDGKTLIWDFVQTFGWGKPRLCEYTGQLFCSSCHTNQTAVLPARVLHNWDFTYYPVSQLAKSYLDSIYEQDLCFGDLLVMGSNPETASLHMQGSINRGLGSRRYLLESNDFFALRDLIDLSRGVFAG

SEQ ID NO: 150386 - protein, 122 aa, Glycine max
  Coding DNA Sequence Number=SeqID_33608
  Gene Ontology: Mol. function=hydrolase activity, hydrolyzing O -glycosyl compounds; Biological process=carbohydrate metabolic process
  Homolog annotation: Hit_ID=Q1M320; Match level="QueryCoverage=82%, HitCoverage=15%, E-value=2e-39, Identity=78%"; Hit description =Putative beta-glycosidase
MEVVLGAGLKLVENVEYNESGRGEWADGYGPKFGLVAVDRANNLARIPRPSYHLFSKIVNTGKVTHEDRERAWDELQRAAKEKKTRPFYRAVDKHRLMYAVLYEGYMDKCLTSLLGSHHTWT

SEQ ID NO: 150387 - protein, 102 aa, Glycine max
  Coding DNA Sequence Number=SeqID_33609
MGKVFRFWARVVDGFIPAKRSKGGQRVDKTLRPTQGNHLVLGGATRMGGCRGERRYADVVRKNDRWGRRIWNGWTNDMWTRVDDNNYNIIRKGSNMLLRPME

SEQ ID NO: 150388 - protein, 160 aa, Glycine max
  Coding DNA Sequence Number=SeqID_33610
EIVEDVCLMGCGELVLGQNVTGISLERRILRVGRKKVFVRPLLNLAQESVGCTKDQLGVVFEDASPSQMTGQVDKASILGTNVASGLSKEDLEGKAKGSVVKVERDHKYLTMLKVTRDPMVNMADRVLGGCLWVIGLSARGGSRCVGGSSGSHRDIIRKE

SEQ ID NO: 150389 - protein, 214 aa, Glycine max
  Coding DNA Sequence Number=SeqID_33611
  Gene Ontology: Mol. function=RNA-directed DNA polymerase activity; Biological process=RNA-dependent DNA replication
MEEFKHLREPRLCVEEELKALKVRIKEWRRVHSNEEEGYRRECVQHIVQLSHMRCSKMRLRWNMMLCVKIKGKRVQEAQSMKDSICGNAYKSFEYRLISLIGCMYKVLAKLLANRLGKLVEEARVSGMEMIMFKVDFEKAYDSMDWDFLMMKMEEMGFLKKWHGLDKQISHLQFVDDTMIFGVGLLPMKYLGLPIGAYPRRLGTWDPVVEVVDK

SEQ ID NO: 150390 - protein, 165 aa, Glycine max
  Coding DNA Sequence Number=SeqID_33612
MEGTGFGAAAPTPLVRLWRTAFLTLRDETLTVPPRNSTAQLLDNLIFSHSDALLSAAAELPSHEVLSDILFIMELVAATSSDEEDFTRIYAQTSRLIHDICRCVSFELNFSSFSSVLNCFGKMLNLLLRKVATSDDISGICSTTTIIPAIEFLQAVRFAHSLGKN

SEQ ID NO: 150391 - protein, 215 aa, Glycine max
  Coding DNA Sequence Number=SeqID_33613
MDVLALKTPVVEDSVMSRFYESFLCCLHLILIDPKCSVSDHKYAIPLTVVTSTPQVSVFVAVLRMFLVYGVSGRTSGLLVGHEEKEPNSMNPKANREQLNKSDRGTYRPPHLRKRDSLNVKLNRARHSQYMSDSESSTVNVTSSDSEFSDGDGSAKESGRVQNSRVRVASITCIQPLYNLPYRVLWRCLPFPIWCPLLMLRPWHVQQLWWKLRVC

SEQ ID NO: 150392 - protein, 109 aa, Glycine max
  Coding DNA Sequence Number=SeqID_33614
MDIENNRGYNCNGSSKTREEEIQKEDESEVEEDYSLSNKVNKHCMGGSCNERAEQNTVSHEQTRDRLQKSTQQPLIQNLIQTQGRRPPKIMKEEESRVQVLDHLDQTSI

SEQ ID NO: 150393 - protein, 221 aa, Glycine max
  Coding DNA Sequence Number=SeqID_33615
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=6e-34, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPFEGCTPFAFRGLHALTFRGLHVLPFIGQLILAFRGLHVLTFRGLHVLTFRGLHVLSLRGLHALAFRGLHVLTFRGQHILAFRGLHILAYRGLHSLAFRRLQVLAFRELHILTLRGLHALAFRGLHILAFRGLHILTFRGLQVLAFRGLHVLTYRGLNVLAFRGLHVLTFRGLHVLAFRGMHALAFTGLHVLTLRGLHLLAFRGLHVLTFIGLHLLAF

SEQ ID NO: 150394 - protein, 137 aa, Glycine max
  Coding DNA Sequence Number=SeqID_33616
KNGCAVLVTGKAIQWLTNQNEENVTEGSFMTNGIELFGYCESLEGLMGTRLVEVGELICAIARSPLSTTYDKVVPGDMSRGSGDLGDVRWGAIAQKQAWPIPTQPVHSQSVRTCDYDRALVIDYQLCVIDYMVLPAT

SEQ ID NO: 150395 - protein, 52 aa, Glycine max
  Coding DNA Sequence Number=SeqID_33617
MVHDIFVMVQLEVTRTSTVLNVFGSRRSSDVTRCTFCPNFLQDEEKARIMHE

SEQ ID NO: 150396 - protein, 79 aa, Glycine max
  Coding DNA Sequence Number=SeqID_33618
MDKSLKVGEDEWREKEKRSTKILCLKRAHGPEIYPKAYENPRAFSRISGSIFLESSIQCSWGVGLHHPTRRDPLVALVQ

SEQ ID NO: 150397 - protein, 114 aa, Glycine max
  Coding DNA Sequence Number=SeqID_33619
MGTHTNAGWKWNFIWRRPLFDNEINMADNFLRDIKGNLVQPHTRDDWVWKADPNGQYSAQSAYNLRMGESTYENQDGVFDELWKLKISRAFPQNPRQHFLQHAHGQDDGIMGNR

SEQ ID NO: 150398 - protein, 205 aa, Glycine max
  Coding DNA Sequence Number=SeqID_33620
MRGRERVTHRDREGERKQDRHERSANTERTGAYGRGRERLRVRHERSAREHSLFRDYNLYQRNVGGRQHRRWRSRGERGISEQRGWHNRNEKEDSYDKDGNWTKVTSKRSAKERKKKISEKRSPDKHVTWREPTYHQPNWRNKDDITSFYFTHFADDVTEVRLWKNFKKWEDVREVYIAKRRNKDGRRYGFVRFKGVSDAKRLEV

SEQ ID NO: 150399 - protein, 122 aa, Glycine max
  Coding DNA Sequence Number=SeqID_33621
GQRPTAFVRRQREVAPIAEDDPVLHEDVYAHAAEAIHDVEGFPSGPRDPSVLTNYGDHVAVIVWNGEERLELKLSSHGRKVQKFGRPALEIEGLVAAIGLSPLIACSVDTGDWGLISAFVER

SEQ ID NO: 150400 - protein, 217 aa, Glycine max
  Coding DNA Sequence Number=SeqID_33622
  Gene Ontology: Mol. function=RNA-directed DNA polymerase activity; Biological process=RNA-dependent DNA replication
MCGRYEPTRRDLVPLEGLMGCGIHLFVYANTAPEVPLRKVLWEDLIDLVSSTSGEWMVAEDFNSFIFPHEKNGGSWSPLAKNSLVFKSTIQIGGLKSPGDDGLQPIFYQNQWEVIRLALCELICSFSKTLRMWQTLMVLATKFRHIMGKLVNPVQCSFLPNRQSRDNIIIAQEVLHSMRFRKGNKGWMVVKLDIEKAIVVFEEATIEQAIVVSFKIV

SEQ ID NO: 150401 - protein, 256 aa, Glycine max
  Coding DNA Sequence Number=SeqID_33623
MGLTLLSQASLPIPYKWFEKLAVWRICEGNHVTFGRIIVGGSINRCGTLGGGEGGSNENWRKEIINPYPFAQWATSPGNCFYEPTSTCYLIFAYGTPVVFGVLLQLLRNSSNFKIRIQAAAALAVPMSMQASILEDWFKGLCSSGEGMLDVQDKCIADRKRVLISGALQSLIEVYKEKQQDAIAQKFEELKNNIVVSLSPPQSITTPITVISLQSQEAIDAVVAMTFRDTNLPDIDEGSTRFKPCMMKEVPTLNLA

SEQ ID NO: 150402 - protein, 293 aa, Glycine max
  Coding DNA Sequence Number=SeqID_33624
  Gene Ontology: Mol. function=DNA binding
  Homolog annotation: Hit_ID=Q1STZ2; Match level="QueryCoverage=86%, HitCoverage=64%, E-value=8e-25, Identity=28%"; Hit description=IMP dehydrogenase/GMP reductase
MGSSQKPSLKKRFYQVKIKSLEVTSLRELGQLMGQLQQQAFRKAYGKIWDLARVEVSMELIASLSQYYDQPLRCFTFEDFQLVPTVKEFEEILGCPLGGRKPYLFSGSIPPRQELPRPWKIKANGLSFIDILALLIFGVVLFPNMEGLVDLAVIDAFLAFHHGKESPVVAILAMYDTFDRGCEKSDARIFCCALALYVWLVSHPFLQEGRPVYLLQGHRSCVEKGKANWDQLLASMEGRLGCINYNPVLAIRQLGYPMRGVPSDESITPFIARGFGDHNARVLQGVHKAWDAA

SEQ ID NO: 150403 - protein, 124 aa, Glycine max
  Coding DNA Sequence Number=SeqID_33625
MKMHKTIKRPSKGPLIMLISLNTNTNRMKNEERPKNDVEIDYSRDSSLAQASCYFILQQPCSPRRASYFNMKLFGGPNEPEASLGKPRSMAAECKRRKGDWRHHFKEKMSQEQAHHHKKPWIRA

SEQ ID NO: 150404 - protein, 120 aa, Glycine max
  Coding DNA Sequence Number=SeqID_33626
MDWFFRISHLFMTPTQAADPPKHPLVPQHDTYVEPDITEVLVAPEAGPSHAPFDVEQPRHAVDGCQAIAERLERLLNLRIVTTDTKIHEVMEDCIRIARGVTTDGNVYVKSRRRWCMHQP

SEQ ID NO: 150405 - protein, 71 aa, Glycine max
  Coding DNA Sequence Number=SeqID_33627
MNQCRPGGSHALPEGIIFDTSDLEMRNLWDLSMTKTIENKENASTNLFAMAVGIKQKDLVNKMVKKWIVDS

SEQ ID NO: 150406 - protein, 99 aa, Glycine max
  Coding DNA Sequence Number=SeqID_33628
MCKFPTCGVSWYKMKDDKCSDDATTTNDRPAKKKVMDCSDIWLILPNGRQLIICTINDFPAYENLSGYSVKGHHACPIREKETSFIQLKHGKNTIYTRH

SEQ ID NO: 150407 - protein, 177 aa, Glycine max
  Coding DNA Sequence Number=SeqID_33629
  Homolog annotation: Hit_ID=Q651E0; Match level="QueryCoverage=23%, HitCoverage=10%, E-value=2e-12, Identity=70%"; Hit description =Putative WD-40 repeat protein
MFGPAGHENIVEDVSWNLKDENMFGSSGDDCKLIIWDLRTNKAQQSVKPHEKEGEKIKEKVKKVDENEVVKLIKEQEDKNLEISALKVELETTKRTYEVQFSQMEEEANNFKATLTRKVQEYEHQLEELRNEVLYCHHQKGGDCRCKCLWCFDDDHDEEKQMMQMIQEYKPQHQDDH

SEQ ID NO: 150408 - protein, 267 aa, Glycine max
  Coding DNA Sequence Number=SeqID_33630
  Pfam annotation: Domain name=zf-CCHC; Domain location=73-90; Score =12.0; E_value=0.01; Accession=PF00098.13; Description=Zinc knuckle
MLQPCGIGTGLKEHSNRMTPKAYTPKSPLGPLPPDSDSEHGIATLTKGNIHITLCSVGGNCSLNKRNICKDTFTCGRCGQTNHNIRSCKNIGVPIRPKKYVAPPTSNQDEDLLAQDGQALNEAEEVAAHVQEGPLEINLSQPNLSQDSDMEFMVPASVVDVPPVARNKLNITRPTQKNISDTPTTPLLFMPTPRLTRRKATNKDPLDLSILVYGVKALYGVKACPAKRLLVTSMLCLMTREQQQGKYGNYSVVPHLTAVDTLMNMFR

SEQ ID NO: 150409 - protein, 338 aa, Glycine max
  Coding DNA Sequence Number=SeqID_33631
  Gene Ontology: Mol. function=kinase activity; Cellular component =proton-transporting two-sector ATPase complex; Biological process =ATP synthesis coupled proton transport
  Homolog annotation: Hit_ID=Q94CG5; Match level="QueryCoverage=100%, HitCoverage=32%, E-value=1e-68, Identity=42%"; Hit description =Kinase interacting protein 1
  Pfam annotation: Domain name=KIP1; Domain location=1-52; Score=79.8; E_value=8.7e-21; Accession=PF07765.3; Description=KIP1-like protein
MEEKVHAVLKLLEEEGDSFAKRAEMYYKRRPELINFVEESFRAYRSLADRYDHISTELQNANNTIASVCPDQVPYMDDDDEDSPRPKTPRKMPEGHKPNIPNVPKVPKPPLRDLKSVITTATKKLNPKKVVASAAVAPKVQKSGLSRKEALAEVDKLQKEILALQTVKEFVKSSYDNAIARYWDTDQQIQGLQEKVSNLQDELGEGVAIDDEEARCLMAAAALKSCQETLSQLELKQAISLDETKIETKRVKEAREKLSSLMNEFNYDQINSKEPRAKGGVKEIAGTKDLDVDVDKMNQQRQELQQLQEKIKEHFEAGSYSTLTVKDMAEKIDSLVNK

SEQ ID NO: 150410 - protein, 521 aa, Glycine max
  Coding DNA Sequence Number=SeqID_33632
  Gene Ontology: Mol. function=kinase activity
  Homolog annotation: Hit_ID=Q94CG5; Match level="QueryCoverage=98%, HitCoverage=58%, E-value=1e-88, Identity=37%"; Hit description =Kinase interacting protein 1
MDDKLREVQDLNQVVEDQNTNLQTHFTEAHCNLDHLSEKVQKVKPDLVAEISLTQRKSSREAESEHVPKGLDALNQDSVLLNEGHKVNATIEDTVNSDKELMVAEVAKDGVIPENKPNNVTGSPEMNEETPVENKSPIELKEREKSPDSNYSDVTESTDALKTSSGNRMTKEDESDWQQLLNGMQDREKALLSEYTNALQNYDDMKIRLAEIEKKNQDALFESSLQLKELKTANALKDEEIRLLRQKLGVLQKSLEGMEDLGELTSVQPAPPEQHDIEEFLKVEEPESTTSAIEEKFRMSIDELLEENLDFWMKFSTSFTGIQKFETTIKDLLIEVSRIEEKCKSSEGSSSVKYSLKSDARPLYKHLAEILNELTMWLENSALLKEELQCRFSSLCEIQEEITTALKASAEDDDFKFTSYQAAKFQGEVLNMKQENNRVADELQAGLDLVTSLQLDGEKALAKMNERFGLSNSNKSQRSSDSQNSVPLRSFIFGVKPKKQKQSIFSCMTPGMHRKYRGHRG

SEQ ID NO: 150411 - protein, 110 aa, Glycine max
  Coding DNA Sequence Number=SeqID_33633
  Homolog annotation: Hit_ID=Q9C523; Match level="QueryCoverage=78%, HitCoverage=45%, E-value=5e-25, Identity=65%"; Hit description =Dirigent protein, putative
  Pfam annotation: Domain name=Dirigent; Domain location=1-110; Score =41.1; E_value=1.8e-09; Accession=PF03018.5; Description=Dirigent -like protein
  Subcellular localization annotation: CTP_CleavageSite=36; ConfidenceScore=5.11e-01
MAQVFKSFPHSQNTTRPLRLVNLVRILDNPLTLGPELSSKQVGRAKGLYASVLRTELSLLMVMNFALTEGKYNGSAITIMGRNRPLMTKVREMPVIGGSGIFWVARGYAL

SEQ ID NO: 150412 - protein, 62 aa, Glycine max
  Coding DNA Sequence Number=SeqID_33634
MDKLICLPPKIQYYSIHENNGGKHGKGVDGQPQRNEEEGFGSCSRMGKVSAPHAFVTRDSSL

SEQ ID NO: 150413 - protein, 204 aa, Glycine max
  Coding DNA Sequence Number=SeqID_33635
  Gene Ontology: Mol. function=transporter activity; Cellular component= membrane; Biological process=transport
  Homolog annotation: Hit_ID=Q949K6; Match level="QueryCoverage=84%, HitCoverage=42%, E-value=4e-18, Identity=35%"; Hit description =Putative permease
METGSSSEFLDKGKAMRGGTGKRHDVVSDTKVEPFVARSDHNPKELKSWAKRTGFVSNYSGEVGTSASENFDSREGRSSPKIEIDPVLGLVRPNRDNEIEPIFVTKHGDMRGENERVLRKIGDEAALVLVGDGDKKIGLRVNGDAYGMTVSTNRNINSHGVSAVAPLPEQKKEKEGIVEDVKVNHFPEGEEPASRGWQGASGLK

SEQ ID NO: 150414 - protein, 108 aa, Glycine max
  Coding DNA Sequence Number=SeqID_33636
MFGFSLAELRCSTPVAEQDERSFSVLIKNARGTSLPEQADMVPSALFSINRREGELRKGFQGSEVERIERKEKEEEEKRGNEAKALPNRDCDQSLLRSLFGVLRVTVD

SEQ ID NO: 150415 - protein, 134 aa, Glycine max
  Coding DNA Sequence Number=SeqID_33637
YIYLGCNTENKIWYISCGSVQVEGTSTWLFKENKGGYIPCGYLLVKDFTRLLEISRTGGCLGIGPDNGNGWIKKPKDSTTGDVEEKQMTPFEEMLAKMDELMRVHKEDCNELKECLKTISKKLDAKGAPDLDDI

SEQ ID NO: 150416 - protein, 284 aa, Glycine max
  Coding DNA Sequence Number=SeqID_33638
  Gene Ontology: Mol. function=transporter activity; Cellular component= integral to membrane; Biological process=transport
  Homolog annotation: Hit_ID=Q6SZ87; Match level="QueryCoverage=84%, HitCoverage=34%, E-value=4e-80, Identity=62%"; Hit description =Nucleobase-ascorbate transporter 11
  Pfam annotation: Domain name=Xan_ur_permease; Domain location=1-264; Score=-48.9; E_value=2.8e-06; Accession=PF00860.11; Description =Permease family
MTCVIKLVNIYGASLYRSLILKSYVPLTVTLTWIYASFLTAGGGYNYKGCNPNIPSSNILIGACRKHAYTMKHCRTDISNALLTSAWLRILYPLQWGFPIFHFRTCIMMAIVSLAASVDSVGTYYSASLRVNLRPLSPGVVSRGIALEGLYSILAGLWGSGTGSTTLTENVQTIDTTKVASRRVVELGAAFMILFSFMGKVGALIASIPQALAASVLCFIWALIAALGLSNLQYGKCASFRNMKIVGVSLFLGPWSINPCLFSTIQASNQSDTTCLPVTLWGCI

SEQ ID NO: 150417 - protein, 185 aa, Glycine max
  Coding DNA Sequence Number=SeqID_33639
MKKNRKKVDGSSSVKGKSTEHSHSPKFTLWGKSIVMTLDLGMEIAGLSGEGMIANEKGIKDIGVKFNKLATYKSLMKNPIEAPKEKTKERFRSGALQMEARLLAYVQPVEAMLSKIILTMPKTQVKNQESSKFQESKIRSIKASFKNQRVVQSKQVSKNQRVVQSRIKIQEKNQEKTQDMQEPLR

SEQ ID NO: 150418 - protein, 444 aa, Glycine max
  Coding DNA Sequence Number=SeqID_33640
  Gene Ontology: Mol. function=transcription factor activity; Cellular component=nucleus; Biological process=regulation of transcription, DNA-dependent
  Homolog annotation: Hit_ID=Q52QU2; Match level="QueryCoverage=87%, HitCoverage=87%, E-value=1e-106, Identity=47%"; Hit description =AP2/EREBP transcription factor
  Pfam annotation: Domain name=AP2; Domain location=162-232; Score =112.9; E_value=9.2e-31; Accession=PF00847.10; Description=AP2 domain
  Pfam annotation: Domain name=AP2; Domain location=261-326; Score =121.3; E_value=2.8e-33; Accession=PF00847.10; Description=AP2 domain
  Pfam module annotation: Pfam domain module=AP2::AP2; Domain location =162-232::261-326
MAGATNWLTFSLTHMEMQQFGPYDTTTHSHCFNDSNFYGWTNSKSVMDSQSETQQLAVPKMEDFYFGDHQQDLKAMIVPGFKALSGTNSGSEVDDSTSNKTVTRVAPAALGGAHSGESNCKGSALTLCDVAANGSDDSNNKAVVAVGFDTRKKVAHTFGQRTSIYRGVTRHRWTGRYEAHLWDNSCRREGQARKGRQGGYDKEDKAARAYDLAALKYWGPTATTNFPISNYTKELEEMEHAGRQEFIASLRRKSSGFSRGASAYRGVTRHHQQGRWQARIGRVAGNKDLYLGTFSTEEEAAEAYDIAAIKFRGSSAVTNFEMSRYDVDTILNNSLPVGGVAKRLKVSPATENKALISTIIQPPQNTNASSSINFSAIQPVSSIPYDSAITCYPHNFFHHHFNPTNGGTSSSDSAAAAAVTDAIALNTLPPPAVPGFFIWPHQSY

SEQ ID NO: 150419 - protein, 54 aa, Glycine max
  Coding DNA Sequence Number=SeqID_33641
MAQPLILRTYQMNTRLVGSKAMIVILTPLPGPKEVICLHPTKQYSNGIVVDMLT

SEQ ID NO: 150420 - protein, 100 aa, Glycine max
  Coding DNA Sequence Number=SeqID_33642
MMSSPIMPTLDLNGRTILYDSCSNSLGMMLMGDLLDLPFLSIRPFKYKKMCEISAAMRISRHSRSLSTGMSAVKRYLRKRWFCPMRNEIPQETRTTLPRI

SEQ ID NO: 150421 - protein, 68 aa, Glycine max
  Coding DNA Sequence Number=SeqID_33643
MVVVARQRWWGWNSGSNDDEGDNNSGDHDGGGTVIVVVTMVVTVVVKFAIAKMGVVVVVIVVAVVIVE

SEQ ID NO: 150422 - protein, 52 aa, Glycine max
  Coding DNA Sequence Number=SeqID_33644
MVSRASMASVKFLKTLGQGAVSKIFMTPKLCILAILGKKHVFVKKNRVEVLR

SEQ ID NO: 150423 - protein, 214 aa, Glycine max
  Coding DNA Sequence Number=SeqID_33645
  Gene Ontology: Mol. function=transcription factor activity; Biological process=regulation of transcription, DNA-dependent
  Homolog annotation: Hit_ID=Q13NZ9; Match level="QueryCoverage=54%, HitCoverage=45%, E-value=1e-23, Identity=47%"; Hit description =Transcriptional regulator, TetR family
  Pfam annotation: Domain name=TetR_N; Domain location=36-82; Score =56.8; E_value=7e-14; Accession=PF00440.13; Description=Bacterial regulatory proteins, tetR family
MTAQKVMESKTAPSDKPRRPGRPRGGAINAQQREHLLDITLALYAQNGIAETSLNAIARKAGVSPAMLNYYFQSRESLLDTVVAERFVPLRQRLEAHFVEESSDPVAAISGFIKEFADIVLSHDWFAPLWLQEVASGQGLGGTLKQRHGHAGRERIRALLIQWQQQGLLNNQLNVDVLMTSILSMVLVPFTRFAHEPGFDTEMILQHTLSMVCH

SEQ ID NO: 150424 - protein, 243 aa, Glycine max
  Coding DNA Sequence Number=SeqID_33646
  Gene Ontology: Mol. function=tetracycline:hydrogen antiporter activity; Cellular component=integral to membrane; Biological process=tetracycline transport
  Homolog annotation: Hit_ID=Q397U0; Match level="QueryCoverage=88%, HitCoverage=42%, E-value=6e-49, Identity=48%"; Hit description=Drug resistance transporter EmrB/QacA subfamily
MGLVGVLGFIYEERRAWEPIIPLDLFRNRSFSLASLMAFIIGMALFGSVTFLPLYLQVVKNATPTEAGLQLLPLMGGLLVTSIISGRMISRSGKYRLFPIAGTLLATTGMALMTTLTLDAPLWHIYLFSSVLGMGMGMTMQVLVLAVQNAVTADRIGVATSSVTLFRSVGGSIGVALFGAVFSHVLKSGATRLIEQGNVLPPSLDPVAVNHLPAALHGRRRYAIGFYTFAAAAGVALRDNVRK

SEQ ID NO: 150425 - protein, 204 aa, Glycine max
  Coding DNA Sequence Number=SeqID_33647
  Gene Ontology: Mol. function=tetracycline:hydrogen antiporter activity; Cellular component=integral to membrane; Biological process=tetracycline transport
  Homolog annotation: Hit_ID=Q13P00; Match level="QueryCoverage=94%, HitCoverage=37%, E-value=1e-69, Identity=67%"; Hit description=Major facilitator superfamily (MFS) multidrug efflux pump, EmrB/QacA subfamily
  Pfam annotation: Domain name=MFS_1; Domain location=4-204; Score =60.5; E_value=5.4e-15; Accession=PF07690.6; Description=Major Facilitator Superfamily
MGALMLVMLLSALDQTIVSTALPTIVGELGGLDRLSWIVTAYMLASTLVVPLYGKFGDLFGRRTVLQISVVLFLLGSALCGLAQNMPQLIFTRALQGLGGGGLMVVSMAAVADVIPPAERGRYQGLFGGVFGLATVIGPLLGGFIVQHMSWRWIFYINLPLGLLALLIINAVFKADSRRKPHEIDYPGAVFLSLALVGRDAVYQ

SEQ ID NO: 150426 - protein, 143 aa, Glycine max
  Coding DNA Sequence Number=SeqID_33648
  Homolog annotation: Hit_ID=Q1RXW3; Match level="QueryCoverage=95%, HitCoverage=24%, E-value=4e-07, Identity=28%"; Hit description=Zinc finger, CCHC-type
MALKNLDSISLEELVGTLMVDEQELQQDEGLNKKKSLALNIQKTQKASSSKESSSKSTFGGLSRALRVDNSSSNEEFEDKSHEDELAFISQKIHKIWKNKKVLGQEEVLKSNEKKGLMSTWDDLDDTSSNEDEEEANLCLMGI

SEQ ID NO: 150427 - protein, 62 aa, Glycine max
  Coding DNA Sequence Number=SeqID_33649
MEEEFPQYQTSLTNVYGCSQNQSQGIELDVNKEYVCDEAKGMDLAEMIMVDDCVERMPWKEV

SEQ ID NO: 150428 - protein, 98 aa, Glycine max
  Coding DNA Sequence Number=SeqID_33650
MKTVEKRKLEMMLVWLLDLELFVSRQNEWHHSLDDWTEMEIKLCRQILDEKFCNFNINNQQNISKLEIGLEIQDVCGVTGKKRVVVIVILVNYMLQLW

SEQ ID NO: 150429 - protein, 130 aa, Glycine max
  Coding DNA Sequence Number=SeqID_33651
MESNFHVDVADSGSRGDTVGQLSINNFHCGNSLPSLVLEVGNHADEKVPCDTTEELVLLGTSELSPKVPHLSMTQVAAQALLLSSQPVSASKFSSKLPPLVTKQVAAQAVLSKFYRGLVTGDSSPTLDNN

SEQ ID NO: 150430 - protein, 64 aa, Glycine max
  Coding DNA Sequence Number=SeqID_33652
MAFVANQPQGLCVTSSSRHLPWSKRLKLKQCLTKHHMIGRTDWHCLVKRNACLRCRNVNSGDGN

SEQ ID NO: 150431 - protein, 293 aa, Glycine max
  Coding DNA Sequence Number=SeqID_33653
  Subcellular localization annotation: CTP_CleavageSite=46; ConfidenceScore=5.44e-01
MTCSPASHNRFIVSSVGPPFFCVAKLKPLRISGFKGSTQNDDSGIRANQLKAPKTSVRLGESGEANNVPLSYASETNDSIETSSAIHRLFNKWLTMLRTQPSSQEVEKIFEEPASEGILPKTQQETQIKERRAILKVAWSHFLALDATIKIPLLVFIPLYLAVNVKYGAEVSKELTPLWILGPLIVATQILAIRWLCALYVFSFNQTVKLLKNSPYYCILAYSYVFRGKLKEDISTYVLQPILRVKNRDYKQLIRKKLKELQEWIVEMYLDYVESIWPYYCRTIRFLKRANLI

SEQ ID NO: 150432 - protein, 387 aa, Glycine max
  Coding DNA Sequence Number=SeqID_33654
  Gene Ontology: Mol. function=hydrolase activity; Cellular component =integral to membrane; Biological process=aromatic compound metabolic process
  Homolog annotation: Hit_ID=Q13RJ2; Match level="QueryCoverage=99%, HitCoverage=100%, E-value=1e-135, Identity=61%"; Hit description =Putative hydrolase
  Pfam annotation: Domain name=Abhydrolase_1; Domain location=46-253; Score=79.2; E_value=1.3e-20; Accession=PF00561.10; Description =alphabeta hydrolase fold
  Pfam annotation: Domain name=Thioesterase; Domain location=20-255; Score=-39.5; E_value=0.019; Accession=PF00975.10; Description =Thioesterase domain
  Pfam module annotation: Pfam domain module=Abhydrolase_1::Thioesterase ; Domain location=46-253::20-255
MKITVNNTGINVQQHGRGELALVFLHYYGGSSRTWQSVISQLPDHYRTVAIDHRGWGLSDAPKSGYRIADLASDAEGVIAALKLKRYILIGHSMGGKVAQLMASRRPQGLEGLMLIAPSPPSPMMLSKEDRDRLTSAYSSRESVEFVIDNVLTSRPLSPALREQVIEDSLSAGTEAKAAWPDIAMREDITSAVASINVPVRVISGELDRVDTPETLQRELLPRIPHAAMMIVHGTGHLSPLESPQEIAGYISNFAASVERSDTVHRSPAETIAAFDEAFNAGNIDALMSVFSNRASMRMPSNVVIETDPYALRMAFTTLIASRPIIRNQIHTLIPSGDLILAIIKWSLTTTLEDGTQRDDCGVATQVMEQGADKGWRIRISNPTGIN

SEQ ID NO: 150433 - protein, 147 aa, Glycine max
  Coding DNA Sequence Number=SeqID_33655
  Homolog annotation: Hit_ID=UPI00005F9696; Match level="QueryCoverage =30%, HitCoverage=24%, E-value=8e-10, Identity=64%"; Hit description =COG3040: Bacterial lipocalin
YALVAGPNRGYLWILSRQPTIPAEVKQRYLAYAQRLGFATDQLIWGGAGGQGGNGGYAGESGADGGNGSDGGNTDGSAGRPGCPGGTDPDADGKFYLPGTTQECNPGKHDSMKVKCMFGPGCQLLPRHVRFKSLSKRQQQAGAAKGQ

SEQ ID NO: 150434 - protein, 259 aa, Glycine max
  Coding DNA Sequence Number=SeqID_33656
  Gene Ontology: Mol. function=sequence-specific DNA binding; Cellular component=intracellular; Biological process=regulation of transcription, DNA-dependent
  Homolog annotation: Hit_ID=Q9I5E7; Match level="QueryCoverage=96%, HitCoverage=95%, E-value=7e-72, Identity=55%"; Hit description =Probable transcriptional regulator
  Pfam annotation: Domain name=AraC_binding; Domain location=17-151; Score=13.0; E_value=0.0032; Accession=PF02311.9; Description=AraC -like ligand binding domain
  Pfam annotation: Domain name=HTH_AraC; Domain location=166-209; Score= 17.6; E_value=0.024; Accession=PF00165.13; Description=Bacterial regulatory helix-turn-helix proteins, araC family
  Pfam annotation: Domain name=HTH_AraC; Domain location=215-257; Score= 14.8; E_value=0.052; Accession=PF00165.13; Description=Bacterial regulatory helix-turn-helix proteins, araC family
  Pfam module annotation: Pfam domain module=AraC_binding::HTH _AraC::HTH_AraC; Domain location=17-151::166-209::215-257
MGTDMRNEKIDGFDRLNRDVVALGNDYAQGFFLPQHQHRRAQLLYGATGLMHVSTRDGEWVVPPQHAVWIPPEILHAVKFTGVTTRSLYIEPACASRLRNISRCEVIAVSPLLRQLLLEAVDLPPCYDSVRDRALIDLMLLEVAAMPVCALEIPLPQQPALLRLCQAFLLAPAIHDPAERWASALFMSGSTFRRHFQQQTGMSFSAWRQRACVVSALAMLLTGTPVNEVALSLGYDNGSSFATMFRRITGQPPSFYHPT

SEQ ID NO: 150435 - protein, 267 aa, Glycine max
  Coding DNA Sequence Number=SeqID_33657
  Gene Ontology: Mol. function=transcription factor activity; Biological process=regulation of transcription, DNA-dependent
  Homolog annotation: Hit_ID=Q13FA1; Match level="QueryCoverage=99%, HitCoverage=82%, E-value=4e-94, Identity=62%"; Hit description =Transcriptional regulator, LysR family
  Pfam annotation: Domain name=HTH_1; Domain location=1-32; Score=24.4; E_value=0.0004; Accession=PF00126.17; Description=Bacterial regulatory helix-turn-helix protein, lysR family
  Pfam annotation: Domain name=LysR_substrate; Domain location=56-263; Score=150.9; E_value=3.3e-42; Accession=PF03466.10; Description=LysR substrate binding domain
  Pfam module annotation: Pfam domain module=HTH_1::LysR_substrate; Domain location=1-32::56-263
MAGKHVSALESDLHVRLIQRSTRRLSLTDVGQRYYDRCKVIIEALDDADREASDIQATPRGLLRIAAPLAFGEMHLGKIVSRYLEQFPEVSAGVVLEDKYIDLLEERIDVAIRIGHLDDPTLVTRRLAPCKMVLCASTDFLKKYGMPETPDDLSRMPRMAFSQAISAGDWTIYDTDNRPHTIESRCRLTSNNIHLLMEAALGGTGIVYGPCFVFREHIRQGQLIELLPDYRTSELTIQAVYPSAMRIPFKVRTFVDFIADALKAKPL

SEQ ID NO: 150436 - protein, 241 aa, Glycine max
  Coding DNA Sequence Number=SeqID_33658
  Gene Ontology: Cellular component=integral to membrane
  Homolog annotation: Hit_ID=Q3K867; Match level="QueryCoverage=85%, HitCoverage=78%, E-value=6e-33, Identity=43%"; Hit description =Hypothetical protein precursor
  Pfam annotation: Domain name=DUF81; Domain location=11-239; Score= -45.6; E_value=0.0031; Accession=PF01925.9; Description=Domain of unknown function DUF81
  Subcellular localization annotation: CTP_CleavageSite=31; ConfidenceScore=5.06e-01
MGSGPLARYAAASLLLMRQPLLAGNAMHIAVATSTAVMIFNAGWVSYQNWQAGRLSSTVLFPLLWFIATGAVVGSWLAGMISEALIRALFILYMLSTIGDCLLRKGFFSGSAPRRLSLLTVAGGGMLIGMIAALLGVGGSVMTVPLLRRHGHAMRACISAANPLSLPVALCGAMTYAISGWHKIQAGGFLGFISLKILGLLLVTGWAGIAFSRRAIPAVPDVWHARIYVMLLCMVLVVIVL

SEQ ID NO: 150437 - protein, 51 aa, Glycine max
  Coding DNA Sequence Number=SeqID_33659
EVANEAGLGLLLKVEFVAANAEADVAREGQHVKEVIRNQSVKEITTSNVEK

SEQ ID NO: 150438 - protein, 439 aa, Glycine max
  Coding DNA Sequence Number=SeqID_33660
  Homolog annotation: Hit_ID=Q46036; Match level="QueryCoverage=38%, HitCoverage=96%, E-value=2e-62, Identity=64%"; Hit description=Outer membrane lipoprotein blc precursor
  Pfam annotation: Domain name=Lipocalin_2; Domain location=302-439; Score=221.0; E_value=2.6e-63; Accession=PF08212.2; Description =Lipocalin-like domain
MPMSGEWTDITDLSCYVGTAALPLYPVRVDGGKMRSRCTGRPADQPFIHRLLGEEIASIDSPSDEQLRLQQALQDARLQRNHEAELDWKRNALYLLLFVFLYGALGCSLTLDLSAVAQASSHKSIAYALEAVPVLIAFSGLFLSLLFLFAARGSARRLHNWDHTIVLLEKYSGCNLSLQINEMGARTTHYSQSAITVALAMFICLTWVVMYNYFTFTTSGVIGSVISLFITTMTYVILDIQLLKSGKSIAIDEPVIPPEDEVEKRRVAMKIWPLVAITALSVTLVACKSPTPPKGVQPITHFNADRYLGTWYEIARLDHRFERGKDHVTATYGKRSDGGISVLNRGYDPEKKAWSESEGKAYFTGKPDVAALKVSFFGPFYGGYNVIALDKDYQYALVAGPNRGYLWILSRQPTIPAEVKQRYLAYAQQLGFATDQLIW

SEQ ID NO: 150439 - protein, 107 aa, Glycine max
  Coding DNA Sequence Number=SeqID_33661
MLNATRILRAFMYRSEDEKLADIVMGDAVLQLLKQAGPVTTLALLEKLRAMAASETDPARQRAFRYAIAEVQNSKSAPLGEAVALKGSDNVTHIFRNRDNTGKNTRH

SEQ ID NO: 150440 - protein, 770 aa, Glycine max
  Coding DNA Sequence Number=SeqID_33662
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=Q125H9; Match level="QueryCoverage=56%, HitCoverage=93%, E-value=3e-93, Identity=42%"; Hit description=Alpha, alpha-trehalose-phosphate synthase
  Pfam annotation: Domain name=Glyco_transf_20; Domain location=286 -745; Score=324.5; E_value=1.8e-94; Accession=PF00982.11; Description= Glycosyltransferase family 20
MHMLKEVTRQLSARDRLPVLLCAATREDFQAALRNAASLPLGGLLFLSSPCQDAQEIAAHLLPSLRAVHLCPNDSAGADVVVADGYHAGQQLGALLLSQGHQRLGAMQVQASDTPPRQVQGFIASLQAEDKTLHAALHAGALHREQAYQTMMAYLKKTRAAERINALMCEYDELAFGALQAVRDFGQGAHIAVVGFDDADEARGSTWHLSSWAPRRDLLVTEALNRLLDQRPDHSRAWQQGELQVRHSHHGKYVPGEMSQCGCAIRFLYAFFILPAVKSAQQAALWRALTLKGNIMPGTILVTHNQHQSSTLAAIYDRLMARRGGLWVCWDGQRIVAAQEAARTLSFQQGNEYDRLQFALTRAEYEEGYHGYVHQGLWPVFHQRPDLARFTSASFQAYRQLNAVYAHAIAEYAMPDDVIWLQDYHFIPTVKMLRDTGLTNRIGLFLHQPFPSGQLFEAIPDWRSLAESLLCCDLIGFQTGQDMNNFLLWLESEFRAERLGRNRLRVHGHIITTGVFPVGIDLAEVQALLESNSCQYMEQQSREHLPANTVLSGGHLDDSAGLPYRISALEVLLRHHPDYAGNMMLLQLASSASGHPHRQQAISHNLENLCGEVNGVHGMLNWYPVSYLNHDYRREELAGLYRAARVALVTPLMAGMSLMAKMYAALQDPANPGVLILSQFAGAAEQMDGALIVNPYDPDAMADAIHTALRLPLSDRQNRHARLMNNLHRYDCHWWADSFLALLMDEPQPESVQLCSRHLSGAGISGRLRY

SEQ ID NO: 150441 - protein, 1073 aa, Glycine max
  Coding DNA Sequence Number=SeqID_33663
  Homolog annotation: Hit_ID=Q5WJS8; Match level="QueryCoverage=33%, HitCoverage=91%, E-value=1e-121, Identity=58%"; Hit description =Oxalate decarboxylase
  Pfam annotation: Domain name=Cupin_1; Domain location=747-888; Score =55.3; E_value=2e-13; Accession=PF00190.13; Description=Cupin
  Pfam annotation: Domain name=Cupin_1; Domain location=924-1065; Score= 62.8; E_value=1.1e-15; Accession=PF00190.13; Description=Cupin
  Pfam annotation: Domain name=Cupin_2; Domain location=777-851; Score =42.0; E_value=2e-09; Accession=PF07883.2; Description=Cupin domain
  Pfam annotation: Domain name=Cupin_2; Domain location=956-1031; Score= 53.6; E_value=6.5e-13; Accession=PF07883.2; Description=Cupin domain
  Pfam annotation: Domain name=DAO; Domain location=234-485; Score= -27.8; E_value=0.00037; Accession=PF01266.14; Description=FAD dependent oxidoreductase
  Pfam annotation: Domain name=FAD_binding_3; Domain location=232-572; Score=134.3; E_value=3.4e-37; Accession=PF01494.9; Description=FAD binding domain
  Pfam module annotation: Pfam domain module=Cupin_1::Cupin_1::Cupin _2::Cupin_2::DAO::FAD_binding_3; Domain location=747-888::924 -1065::777-851::956-1031::234-485::232-572
VKRVVLTSAFGAVGIGHPADYPRPFTERDWSDVSGDVWPYQKSKTLAERAAWQFIAEQGNGLELATVNPVSVLGPVLGADYSHSIRIVKELLEGQPGCPDINSCFVDVRDVASLHVLAMTHAAAQGQRFLASSGHSLPLIEVARTLKTHLAAEAEKVSLQPMSDAMVRAAAAQNPLMTGMVKLLGVDMNVSAAKAGWLLNWHPRSPQEAILATARSLIALGLDIMPSPQVINADCCIVGGGPAGLMLAYLLTRAGLRAVVIEKHADFLRDFRGDTIHPSTLEIMHQLGLLDALLALPHQRAEKLQAEVGGQEITMADFSRLPLRCRFIAFMPQWDFLTFLAAQAAHYPGFTLLQSTGFDDFLHQDGVIAGVKTLQGHEIHAPLVIGADGRRSAVRQKAGLVGKSFGAPRDVVWFRLDKQPDDPELGMGHKGPKQNFIVIDRGEYWQCGFTIQKGEFEALKQAGLDALKNRMAEVAPFSVARMAQLQEWQQLSLLSIRIDRLDKWMKPGVLCIGDAAHAMSPIGGVGVNLAIQDAVASANYLTRPLQNGTLTLRDLENVQRRRQFPTVATQFLQIKMSSGKRPRTTPSKVPQLISRYPFLRHLFGRLIGMGFRPERPRLAGEKNVAGYNLNVNAISTKRKWREAGEERDYAMIKGRDTNHKKLRKTAGMKLENLSRRSFMAFAAGGTVALAAGKVHAHDGKVATYPANDPNHPRDPGPHDPVREALNPDLVDPPATDSGTLPNLRFSFSDAHVRKGSGGWTRQVTQRELGISTTIAGVDMRLDKGGIRELHWHKEGEWAYMLYGNARITALDTAGGWFVDDVGVGDLWYFPPGVPHSIQGLGPDGCEFLLAFDNGNFDEDSTFLLSDWFKHIPPEVLAKNFGVPAEVFNTLPSPEEEYIFAGQAPDGAAASAVSGGVKSKQVFSHKMLAQKPLTLPGGTVRITDSSNFTVSKTIAAALVELAPGAMRELHWHPNNDEWQYYLEGQGRMGVFASSGQARTFDFRAGDVGYVPFAMGHYIENTGDKPLRFLELFKSDYYADISLNQWLASTPPALVRQHLHLSDTFMNALQQEKHP

SEQ ID NO: 150442 - protein, 288 aa, Glycine max
  Coding DNA Sequence Number=SeqID_33664
  Homolog annotation: Hit_ID=Q93X76; Match level="QueryCoverage=53%, HitCoverage=30%, E-value=2e-43, Identity=59%"; Hit description =Putative carboxyl-terminal proteinase
MGIMKRHSQHSSNDPFCEAHNRTRQQHQCMMMIQQPNNDVVVVPEHTCAQQHQNQSPKLASSSFTSQNATPVLPAFVALLLLVTSIAPTALCHPLQGTNHTFRPNHELLKLRRVRAHLKKINKPPVKTIQASSFYFFLSLQPMSPDGDLIDCVLSHQQPAFDNPKLRGHKILDPPERPKGNHTNGEAERVIESFQLWSDSGEACPEGTVPIRRTTEEDILRASSIQRFGRKPRPVRRDSTGSGHEVSFISRYFPPHKEKRETLLFRIYLQFQHEFQKQQGQTVNGHHS

SEQ ID NO: 150443 - protein, 193 aa, Glycine max
  Coding DNA Sequence Number=SeqID_33665
  Gene Ontology: Biological process=multicellular organismal development
  Homolog annotation: Hit_ID=Q6VG98; Match level="QueryCoverage=51%, HitCoverage=58%, E-value=3e-42, Identity=79%"; Hit description=TFL1a
  Pfam annotation: Domain name=PBP; Domain location=20-175; Score=72.0; E_value=1.8e-18; Accession=PF01161.10; Description=Phosphatidylethanol amine-binding protein
MAKMWTDPLFIGRVIGDVLDSFTPTIKMTVTYKKQVYNGHEFFPSTITTRPKVEIGGGDMRSFYTLIMTDPDVPGPSDPYLREHLHWMVTDIPGTTNASFESTCRHASLALAVVLQRRDWENPGVTQLNRLAAHPPFASWRNSEEARTDRPSQQLRSLNGEWRLMRYFLLTHLCGIHTAYGALSVQSALMPHS

SEQ ID NO: 150444 - protein, 546 aa, Glycine max
  Coding DNA Sequence Number=SeqID_33666
  Gene Ontology: Mol. function=protein transporter activity; Cellular component=membrane; Biological process=protein secretion
  Homolog annotation: Hit_ID=Q35ED6; Match level="QueryCoverage=57%, HitCoverage=86%, E-value=8e-50, Identity=35%"; Hit description =Secretion protein HlyD precursor
  Pfam annotation: Domain name=HATPase_c; Domain location=65-177; Score= 102.3; E_value=1.4e-27; Accession=PF02518.16; Description=Histidine kinase-, DNA gyrase B-, and HSP90-like ATPase
  Pfam annotation: Domain name=HlyD; Domain location=237-522; Score =14.9; E_value=0.0007; Accession=PF00529.10; Description=HlyD family secretion protein
  Pfam module annotation: Pfam domain module=HATPase_c::HlyD; Domain location=65-177::237-522
LSCLHRLIDELHLLSLADAGQLTLEKVRCNPADILRERLQWIKPQLDEARIRTGTELAEETLLPVDPFRLGQVFTILLENALRYAGSGSQLQLRTRNTVDHYEIIVQDSGPGVPAAFLALMFERFARGEASRARHSGGSGLGLSIARAICQAHGGTINATLPAAGGLQGVRHLLNPRHLVSLLPLLPCLLLTALLLTGCDRKRSPTPPPPRPVKFITVGPPTPAGQQTLTGEIRAHDETSLSFRLEGRILTRSADVGSRFRQGETLAVLDSPGALNQLASAQAELNSSRAAEKVAALNLHRMRLLMPSGAIARAQLDSASADWQAALARRQSSEAALKNAQDSLRWTHLTAPEDGVVTGVSAAAGQVVSAGQTVFTVATGTGRDVVFDVATPETLDRRASARFRVALLQNPSVMAEAHLRDVSPQADAQTRSWRVRITLDNPPAEMVLGASVAVTLPLADTTADAVMAIPATALTRQAGQPAVFILDPVKNCVIRRTVAIAGYTADAVWIRAGIMPGDRVITAGVRSLRDGERVAGSQEDQHETGV

SEQ ID NO: 150445 - protein, 94 aa, Glycine max
  Coding DNA Sequence Number=SeqID_33667
MEGSQQNTHYPKEKLPKIITHKWKFGNLLEAPNTLPTKGLFVTKLESNEVLLSPIALKVVGPFLLDSNSSRDGTNPPSNSLYGNPQTRKQRDKQ

SEQ ID NO: 150446 - protein, 54 aa, Glycine max
  Coding DNA Sequence Number=SeqID_33668
MTGSTLYLDNFRDSSDAHQPNEEICCSDYQFVFMGVKGPIASKQMSVERIDGFF

SEQ ID NO: 150447 - protein, 157 aa, Glycine max
  Coding DNA Sequence Number=SeqID_33669
MASFSLHENAPPVILMIHAGAISHAYVGSASVLVGDIDDALDSEKVVEELLSHFVEELLSAEHRVMKIEPHRGEYKIEIYLKEKTAWRNSHLVEDKNRRKLIFSNLLNYGLESEFHIGSVFSAHLIYGSQVNGSVIHAPSEFDAALVAFEIPILTYG

SEQ ID NO: 150448 - protein, 88 aa, Glycine max
  Coding DNA Sequence Number=SeqID_33670
MVKVVRRYGVEDFEPSSAKEEKVKTTDDSLSEVDPLSEMHPLSEASSSFSGWEILEEDKSEICTPSAQPARLARTLSLLALSASTLAK

SEQ ID NO: 150449 - protein, 83 aa, Glycine max
  Coding DNA Sequence Number=SeqID_33671
MPDLDTKKKLLKVKNEGNTRSGQWRCWKGGDDVDDVEAEVGLKEGGMLKGCLCGGGGTRESKRGRGCCSLTASAPIRTSSIKR

SEQ ID NO: 150450 - protein, 116 aa, Glycine max
  Coding DNA Sequence Number=SeqID_33672
MSKVKATYHMPSEDDNATVTMGGVRFFDGQSVDLDEGEHAHLISKLRTNQHFKVSGGEKAEKKPAKPVEGLKAVHIAGGRFKIVDGDKTIKEGLNKADADQFNAFSDEDKAAYVAD

SEQ ID NO: 150451 - protein, 60 aa, Glycine max
  Coding DNA Sequence Number=SeqID_33673
  Subcellular localization annotation: CTP_CleavageSite=35; ConfidenceScore=5.02e-01
MAISGLTVSCFTAPADSQVKRQSIIGKPVWSEEPSSNTATTNVAKGFNPIFRVYSSADVW

SEQ ID NO: 150452 - protein, 235 aa, Glycine max
  Coding DNA Sequence Number=SeqID_33674
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q2NZQ8; Match level="QueryCoverage=99%, HitCoverage=55%, E-value=1e-94, Identity=75%"; Hit description=Two -component system sensor protein
VDSRGSHGDTVETFGQARQVGGRNAVAGIAHCQHGAVAFAAEFHGDAATGRRIAHRVGDQVGEGAVQFLGRALQVNAGKIVDADLVAALAVRFGFAAQGGQHRLHGHGLFLAVFLRLEARQRQQVFHQLGHALALLAHFFQHRTGSREILRVHHVQIAVDHGERRAQLAQQLADIAGDQQPVIGGIGNQAQVQADRRVDRRGHVQDRLGVAAPGQPGASGIGCRRSTRASPRSPG

SEQ ID NO: 150453 - protein, 523 aa, Glycine max
  Coding DNA Sequence Number=SeqID_33675
  Homolog annotation: Hit_ID=Q66BA0; Match level="QueryCoverage=85%, HitCoverage=81%, E-value=1e-150, Identity=59%"; Hit description =Similar to hypothetical bacteriophage P27 protein
MELFLVVVLLLALLAPVLSVVLFKKSKKYREEIALLISGKNTLGEELGETQKKLAQAVRDHAELEGKATPLWQYQELHDAVLDAEKKIKTADAIAREKLDDAQKQAARAVSEAHDQAALTISNANSEAVAITQDARDARLKAKERLDNANSKADELISNANDNAMKIIADAEIRAMEIAGSAYEAKEFAETYQAVARSMKNKIEGYGDEWIVPNRSVLDELAENYEFTDAGKELQKARELTKSLIKTNKAASCDYVEPNRRNTAIKFVLDAFNGKVDSTLSKIKHNNYGKLSQEIKDAFELVNFNGSAFRSARITDICLQARLNELKWGVAVNEIMLEEREEQRRIKEQLREEEKARREYEKAIKEAEKEEKTIQQAIDKATKELMLAGEEQRIALEQRLAELQIKYEEAEAKNQRAISMAQQTRSGHVYVISNIGSFGENVYKIGMTRRLEPLDRVRELGDASVPFSFDVHAMIYSDDAPSLENHLHKVFNDKQAPAVSADQVAKLRKDLPKAAEADKDKSQ

SEQ ID NO: 150454 - protein, 259 aa, Glycine max
  Coding DNA Sequence Number=SeqID_33676
  Gene Ontology: Mol. function=electron carrier activity; Cellular component=integral to membrane; Biological process=electron transport
  Homolog annotation: Hit_ID=Q4ZRV8; Match level="QueryCoverage=88%, HitCoverage=81%, E-value=4e-41, Identity=37%"; Hit description=MltA -interacting MipA precursor
  Pfam annotation: Domain name=MipA; Domain location=30-259; Score =150.2; E_value=5.6e-42; Accession=PF06629.2; Description=MltA -interacting protein MipA
MITRKTLMYMTHLLLMISAAARADGDAQTSLTLGAGAQFAPRYSGSNKTRVQPVPIFQARDGAFFADAQKGIGYDLQSDSGFYLEHTLGYGLGRSDKDSTWRDGASRLQGMGNISATVNTALALGWQLTPWLSAEGKAVLPLSDDQGVNYQASVTLVPLQRDSDTVALQTAALFGDARYMNTWYGVSDVQSSRSRFSRYDAGGGFYGVATTLTWSHQFDAHWGTLVSAGYSWLGDRAADSPIVSRRDQVTGTVGFSYTF

SEQ ID NO: 150455 - protein, 540 aa, Glycine max
  Coding DNA Sequence Number=SeqID_33677
  Gene Ontology: Mol. function=transferase activity, transferring phosphorus-containing groups; Cellular component=membrane; Biological process=peptidyl-histidine phosphorylation
  Homolog annotation: Hit_ID=Q4ZRV5; Match level="QueryCoverage=68%, HitCoverage=94%, E-value=9e-78, Identity=43%"; Hit description=ATP -binding region, ATPase-like:Histidine kinase, HAMP region:Histidine kinase A, N-terminal precursor
  Pfam annotation: Domain name=HAMP; Domain location=253-324; Score =31.9; E_value=2.3e-06; Accession=PF00672.15; Description=HAMP domain
  Pfam annotation: Domain name=HATPase_c; Domain location=437-536; Score=100.1; E_value=6.7e-27; Accession=PF02518.16; Description =Histidine kinase-, DNA gyrase B-, and HSP90-like ATPase
  Pfam annotation: Domain name=HisKA; Domain location=329-392; Score =31.3; E_value=3.3e-06; Accession=PF00512.15; Description=His Kinase A (phosphoacceptor) domain
  Pfam annotation: Domain name=Response_reg; Domain location=4-95; Score=65.8; E_value=1.4e-16; Accession=PF00072.14; Description =Response regulator receiver domain
  Pfam module annotation: Pfam domain module=HAMP::HATPase _c::HisKA::Response_reg; Domain location=253-324::437-536::329-392::4- 95
MQTKNILIIEDDADAAEVLEAYLLRENYAVRVAADGLSGLELALRWQPDLILLDVMLPGLNGTEVLAKLRRSSEVPVIMVTAMGDTPDRIGSAAAQRGKNAAGRDPALAGAGGEQQRDDGYRHTGLGQLYAGQRRAGAGGRYGGRAAQRARRRLPLPPAMTEKSPQTLWRWLCLRILTLAIGTVVLIALCMWLRFTVQYLWITHHMPPAVLREFLALRAHPERDPARFHQIIDSWWGIRYSDPSIASSDWITVGILVLVTIPFIAYFGLRHARPLSAQFSQLRRAADQVTAGDFGAQAALTPAAPAELAQFAHNFNAMTRQLARYDKELRTSHVAMAHELRSPLNAAMVRLQALLDGVFSADSRQLALIMAQLSCLHRLIDELHLLSLADAGQLTLEKVRCNPADILRERLQWIKPQLDEARISTGVALAEETLLPVDPFRLGQVFTILLENALRYAGSGSQLQLRTRNTVDHYEIIVQDSGPGVPAAFLALMFERFARGEASRARHSGGSGLGLSIARAICQAHGGTINATLPATGGLQ

SEQ ID NO: 150456 - protein, 268 aa, Glycine max
  Coding DNA Sequence Number=SeqID_33678
  Gene Ontology: Mol. function=hydrogen ion transporting ATP synthase activity, rotational mechanism; Cellular component=membrane; Biological process=ATP synthesis coupled proton transport
  Homolog annotation: Hit_ID=UPI000068D67A; Match level="QueryCoverage =89%, HitCoverage=66%, E-value=5e-62, Identity=49%"; Hit description =membrane protein
  Pfam annotation: Domain name=MS_channel; Domain location=52-252; Score=54.5; E_value=3.6e-13; Accession=PF00924.9; Description =Mechanosensitive ion channel
MGACCIARHTLATAGFSGPLSSSQDMLFIRYDINLSNNLRARKIRTQLIYVKKVAIVILVLFCLSLILLNFPGVRKFGTTILAGAGVAGIIIGFALQKSLVNLFAGIQIAFTQPIKIDDAVVVEKEWGWIEEINLTYVVVRIWDLRRLVLPITYFTENAFQNWTRNNAQILGSVFLYVDYSMPLAPLREHFEKILNETRLWDRETQVLQVTDTTEKTMTIRLLMTAQNSPTAWDLRCYVREKMIEFIQQNYPQSLPQVRATLTDADKA

SEQ ID NO: 150457 - protein, 325 aa, Glycine max
  Coding DNA Sequence Number=SeqID_33679
  Gene Ontology: Mol. function=electron carrier activity; Cellular component=periplasmic space; Biological process=electron transport
  Homolog annotation: Hit_ID=Q7WFZ7; Match level="QueryCoverage=53%, HitCoverage=88%, E-value=6e-38, Identity=43%"; Hit description =Putative exported protein
  Pfam annotation: Domain name=DUF24; Domain location=21-111; Score =84.2; E_value=4e-22; Accession=PF01638.8; Description=Transcriptional regulator
  Pfam annotation: Domain name=MarR; Domain location=23-92; Score=-2.0; E_value=0.055; Accession=PF01047.13; Description=MarR family
  Pfam annotation: Domain name=PadR; Domain location=22-96; Score= -16.9; E_value=0.085; Accession=PF03551.5; Description=Transcriptional regulator PadR-like family
  Pfam annotation: Domain name=YceI; Domain location=141-309; Score =190.9; E_value=3.1e-54; Accession=PF04264.3; Description=YceI like family
  Pfam module annotation: Pfam domain module=DUF24::MarR::PadR::YceI; Domain location=21-111::23-92::22-96::141-309
MPTDIAALLAEINSTRPILEQVANKWSVLILTVLCTEPARFNAIKRRLDPITHKALTEALRRLERNGLISRRVIASSPVAVEYAITPLGQTLQDPFVALVKWAREQGDAIEKAQDVSMKFLKKTALLSLVALYVPLSHAAATEYNLDPQHTSVVIAWNHFGFSHPTADISDVSGQLAFDKENPEKSQVNVTLPLKTIDTHVPALTKEFLGNEYFDVKKYPQATFHSTHVESKGDNKYDVQGNLTIKGITKPVVLHATLNKQDMHPMVKKQAIGFDATGVIKRSDFKIDKYVPAVGDERELAQQVVCTSSLGAASLPASAFLVSTL

SEQ ID NO: 150458 - protein, 241 aa, Glycine max
  Coding DNA Sequence Number=SeqID_33680
  Gene Ontology: Mol. function=oxidoreductase activity; Cellular component=membrane; Biological process=metabolic process
  Homolog annotation: Hit_ID=Q3ZV39; Match level="QueryCoverage=99%, HitCoverage=99%, E-value=1e-101, Identity=77%"; Hit description =Similar to 3-oxoacyl-[acyl-carrier protein] reductase
  Pfam annotation: Domain name=Epimerase; Domain location=8-236; Score=- 22.8; E_value=0.00011; Accession=PF01370.11; Description=NAD dependent epimerasedehydratase family
  Pfam annotation: Domain name=KR; Domain location=7-172; Score=11.6; E_ value=5.1e-08; Accession=PF08659.1; Description=KR domain
  Pfam annotation: Domain name=Shikimate_DH; Domain location=5-125; Score=-18.6; E_value=0.014; Accession=PF01488.10; Description =Shikimate  quinate 5-dehydrogenase
  Pfam annotation: Domain name=adh_short; Domain location=6-168; Score =141.9; E_value=1.8e-39; Accession=PF00106.15; Description=short chain dehydrogenase
  Pfam module annotation: Pfam domain module=Epimerase::KR::Shikimate _DH::adh_short; Domain location=8-236::7-172::5-125::6-168
MKLEGKVALVTGGGSGIGLAIARRFVQEGAHVFITGRREALLAEAVTLTGGRIEAIAGDLTSADDVARLFDTVQARAGRLDILVNSSGVAEPASLEETSAEHFDRTFGLNVRAMVFTVQHAVKHMTEGGAIVLVGSIAGSMATPGYGAYSASKAAVRAYARTWSSELAPRGIRVNTLSPGPTDTPMFDQVSDEVRQTFSAQIPAKRLGHPGEVAAAALFLASDESVYVTGSELVIDGGMSA

SEQ ID NO: 150459 - protein, 70 aa, Glycine max
  Coding DNA Sequence Number=SeqID_33681
MAQDIVCLCLKSYSYSNCISYDERILFYLQIIRPTFSAIRHFSSVAKKMIVRKALNSALNEEMSIHPKFE

SEQ ID NO: 150460 - protein, 141 aa, Glycine max
  Coding DNA Sequence Number=SeqID_33682
MASICDTDIPLRLQNIDALTASYRNSLQSLRTTALETARSQSELTEIQAKLREAEDDLCFGLVLCFTFRAVKTRREAKRMALKAAIDSVKGRIEDLKTSIPQQRTKNKECATVVSQHRLVILWMDLCRQPQHAIGALPGSL

SEQ ID NO: 150461 - protein, 802 aa, Glycine max
  Coding DNA Sequence Number=SeqID_33683
  Gene Ontology: Mol. function=nucleoside-triphosphatase activity; Cellular component=nucleus; Biological process=protein transport
  Homolog annotation: Hit_ID=Q9LZF6; Match level="QueryCoverage=98%, HitCoverage=98%, E-value=0.0, Identity=85%"; Hit description=Cell division control protein 48 homolog E
  Pfam annotation: Domain name=AAA; Domain location=240-424; Score =322.3; E_value=8.5e-94; Accession=PF00004.19; Description=ATPase family associated with various cellular activities (AAA)
  Pfam annotation: Domain name=AAA; Domain location=513-700; Score =341.9; E_value=1.1e-99; Accession=PF00004.19; Description=ATPase family associated with various cellular activities (AAA)
  Pfam annotation: Domain name=AAA_2; Domain location=236-365; Score= -29.5; E_value=0.0016; Accession=PF07724.4; Description=ATPase family associated with various
  Pfam annotation: Domain name=AAA_5; Domain location=240-372; Score =11.1; E_value=0.00025; Accession=PF07728.4; Description=ATPase family associated with various
  Pfam annotation: Domain name=Arch_ATPase; Domain location=217-382; Score=-92.4; E_value=0.032; Accession=PF01637.9; Description =Archaeal ATPase
  Pfam annotation: Domain name=CDC48_N; Domain location=23-109; Score =133.4; E_value=6.4e-37; Accession=PF02359.8; Description=Cell division protein 48 (CDC48), N-t
  Pfam annotation: Domain name=NACHT; Domain location=512-664; Score= -40.9; E_value=0.09; Accession=PF05729.3; Description=NACHT domain
  Pfam annotation: Domain name=ResIII; Domain location=221-352; Score= -35.6; E_value=0.045; Accession=PF04851.6; Description=Type III restriction enzyme, res subunit
  Pfam annotation: Domain name=Sigma54_activat; Domain location=206 -368; Score=-183.2; E_value=0.028; Accession=PF00158.16; Description =Sigma-54 interaction domain
  Pfam module annotation: Pfam domain module=AAA::AAA::AAA_2::AAA _5::Arch_ATPase::CDC48_N::NACHT::ResIII::Sigma54_activat; Domain location=240-424::513-700::236-365::240-372::217-382::23-109::512 -664::221-352::206-368
MYAWFRKCEKKDYSTSILERKKSPNRLVVDEAINDDNSVVTLHPETMEKLHFFRGDTVLIKGKKRRDTICVVLADEQCDEPKIRMNKVVRANLRVRLGDVVSVHQCPDVKYGKRVHILPIDDTIEGVTGNLFDAYLKPYFMESYRPVRKGDLFLVRGGMRSVEFKVIETDPGEYCVVAPDAEIFCEGEPIKREDEERLNEIGYDDVGGVRKQMAQIRELVELPLRHPQLFKSIGVKPPKGILLYGPPGSGKTLIARAVANETGAFFFLINGPEIMSKLAGESESNLRKAFEEAEKNSPSIIFIDELDSIAPKREKTHGEVERRIVSQLLTLMDGLKSRSHVVVIGATNRPNSIDPALRRFGRFDREIDIGVPDEVGRLEVLRIHTKNMKLSDNVDLEKVGRDTHGYVGSDLAALCTEAALQCIREKMDVIDLEDETIDAEVLNSMAVTNEHFQTALSSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLAALARFTHGFSGADITEICQRACKYAIREDIEKDIEKERRKRENPEAMEEDDTDEVPEIKPAHFEESMKFARRSVSDADIRKYQLFAQTLQQSRGFGSEFRFPDRNENTAADASDPFSSVTAEGDDDLYS

SEQ ID NO: 150462 - protein, 78 aa, Glycine max
  Coding DNA Sequence Number=SeqID_33684
MTTNEHQESAFMSASAPVLSISTITEGNENQDEPIKGNAHLQKQVNRRRVKSPGSASSVCQSPRLKAICEGRPAMVAP

SEQ ID NO: 150463 - protein, 171 aa, Glycine max
  Coding DNA Sequence Number=SeqID_33685
  Gene Ontology: Mol. function=DNA binding; Biological process=DNA integration
MELTSSYSLPPSTSGQVEVSNRELKKILEKIVSAFRKDWSLKLDDTLLAYKTTFKTPIGMSPFRLVYGNNCHLPIELEHKAMWALKFLNFYPRLASSNRLKEEKVLTAGVSLSEALSSLSMLGNPRRGSVIDVFAQRAASSLSKSFVSSRAQRAQLVKPNFTNSRLASQSC

SEQ ID NO: 150464 - protein, 44 aa, Glycine max
  Coding DNA Sequence Number=SeqID_33686
MAGDLENEGECWKKPPKLWLPLDRGVLEVPYGRYLERGHVEVPH

SEQ ID NO: 150465 - protein, 39 aa, Glycine max
  Coding DNA Sequence Number=SeqID_33687
MRKKFQEAVAQGLNQLVFVKLSSRLCQGKGSNLALSSWL

SEQ ID NO: 150466 - protein, 302 aa, Glycine max
  Coding DNA Sequence Number=SeqID_33688
  Gene Ontology: Mol. function=RNA-directed DNA polymerase activity; Biological process=RNA-dependent DNA replication
  Homolog annotation: Hit_ID=Q1SLB1; Match level="QueryCoverage=41%, HitCoverage=22%, E-value=5e-17, Identity=34%"; Hit description=RNA -directed DNA polymerase
MKELEEYHLIVLQPTCIKSIMRSLELLLELKVNFLKSCLGGGIGVDSHLVHRYAHLLNCSVMSMPFTYLGIPIGANQRRVSVWENISVEVAHKITRLQRDFLWGEEEGRRKIAWGNWEVVSTRPRESRGLGIKNIERFNVALIGNGDGEGVFVESFTLGFHMVEGFGGILWGKRGNLHGLEELVSDAGVWEDGNWCWRLSWRRQWFTWELPFGGGIHEGFRRIGVTSTKNKMWKSVWCAWVWALWCHRNNIIFKQQIIDLDSVVGNIKYKSWIWLKANVKEFHFSFMEWYSNPATCLQCLRL

SEQ ID NO: 150467 - protein, 226 aa, Glycine max
  Coding DNA Sequence Number=SeqID_33689
  Gene Ontology: Mol. function=nutrient reservoir activity; Cellular component=apoplast; Biological process=auxin mediated signaling pathway
  Homolog annotation: Hit_ID=Q9SR72; Match level="QueryCoverage=96%, HitCoverage=96%, E-value=2e-81, Identity=68%"; Hit description =Germin-like protein subfamily 3 member 2 precursor
  Pfam annotation: Domain name=Cupin_1; Domain location=68-214; Score =147.9; E_value=2.7e-41; Accession=PF00190.13; Description=Cupin
  Pfam annotation: Domain name=Cupin_2; Domain location=103-178; Score =45.7; E_value=1.5e-10; Accession=PF07883.2; Description=Cupin domain
  Pfam module annotation: Pfam domain module=Cupin_1::Cupin_2; Domain location=68-214::103-178
MFSENTLWLMLAIFSLSASITLASDPDPVQDFCISNPIFGAIKTAHDMHYILPCKNSSEATTEDFVFSGLKKATGNFSDTGLAVVSASPTNFPGLNTLGLSFARADIEVGGINPPHFHPRATELVHVVQGKVYSGFVDSNNRVFARVLEQGEIMVLPKGLVHFMMNVGDEPATLFGSFNSQNPGIQKIPSAVFGSGIDEELLQKAFGLSSKQIGTLRKKFDPKTAR

SEQ ID NO: 150468 - protein, 115 aa, Glycine max
  Coding DNA Sequence Number=SeqID_33690
MDKSLKVGEDEWREKERRSMKFCASKELWFSPLIQDQVQDSPLSVLRCHEASHGLEIYPKAQENPRAFSYISGPIYLESIQCPCGVGLPHSLPLEKDLTSNPEILETLSFFPQHM

SEQ ID NO: 150469 - protein, 124 aa, Glycine max
  Coding DNA Sequence Number=SeqID_33691
  Subcellular localization annotation: CTP_CleavageSite=58; ConfidenceScore=5.21e-01
MKGRRHKYGFNNNKREKSGKIMGSQPASPPPPPPSPPPPPPAPSDASALPFATKRTHKASRLRSLSTRPPGVERPVVHVDPATGKTDGPHRKKLRIYLGIVARDKVDVTYENWKKVPTSQKDLI

SEQ ID NO: 150470 - protein, 62 aa, Glycine max
  Coding DNA Sequence Number=SeqID_33692
MPTYKKPLHSHCLFSSGLHVTLFGQKEYEVKHKKASSVQVSKRFPHGNIGRTKVIFFIIIRG

SEQ ID NO: 150471 - protein, 408 aa, Glycine max
  Coding DNA Sequence Number=SeqID_33693
  Gene Ontology: Mol. function=nucleic acid binding; Cellular component= intracellular
  Pfam annotation: Domain name=G-patch; Domain location=320-362; Score =4.3; E_value=0.054; Accession=PF01585.13; Description=G-patch domain
MVSTLHILIPLMIFTFKVNPCKLVIDLYLSGYKNVEVSEADAVTVPFETDDRYNSLAADAYSKTYEVEGEWIPEPGDENGLADDIRSTVDEGIPYSNTYELEEAILLDEEKWRAQYGQVAESGKDLVSEVPVVDLWDWEMVTGSKRDGKDKVARLVGRLAKPSAKQLPSIPSRGGKLRSAPICEAHLDLDECTDCEILAQNVTSLSTYDSSNPTEHWDFPQLSPYRKITHHSKSSESSASASVETPIEKDLSASPSQLSASKKIKHQYRDRTAERRILHGGFGMGPGQKNLPDIYNTPSSPVDDCLQEATAEALEVSFGAGSCARKLLKSMGWKEGEGLGGTYSTSWKRWYFWFGMVSLNLAVASHCQIGLPRSDNCQFFNAFIQRKPCSIVNIVRKYTLSNHAHELY

SEQ ID NO: 150472 - protein, 207 aa, Glycine max
  Coding DNA Sequence Number=SeqID_33694
  Homolog annotation: Hit_ID=Q1SKF0; Match level="QueryCoverage=45%, HitCoverage=34%, E-value=4e-31, Identity=75%"; Hit description =FKBP12-like protein
MRIMTTILLHRRSLQNCKETLATYQFFFMKETELLLLKNPSSIGLNQWPNTEKPIKVCTRRPKHPDINSRLRQEVEWEGKNELEAAKSEIQSWHSTLKNEPSKSAGITPEPKMLINYLQTLKFSEESLREQLEKAKKKEAAFIVTFAKREQEIAELKSAVRDLKVQLKPPSMQNPTGFPASFEALYRLLLIPFSLACTASSLKYMYM

SEQ ID NO: 150473 - protein, 34 aa, Glycine max
  Coding DNA Sequence Number=SeqID_33695
MAIRGNLAFAMLVLAGIVVLGNMPLASAQCGDEK

SEQ ID NO: 150474 - protein, 213 aa, Glycine max
  Coding DNA Sequence Number=SeqID_33696
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q9XI05; Match level="QueryCoverage=81%, HitCoverage=51%, E-value=2e-39, Identity=60%"; Hit description =Proteasome subunit beta type 3-A
MVEGYPLWLSFGLVLIPSILMVEGLPAWFGPYFCQPVIAGLGDEDKPFICTMDCLGAKLYVALMVPFMQDYASLIVNNLELAKDFVVSGTASESLYGACEAMFKPDMTCMKLILIVIDLQKCSISAMSNKWGLNLDGNRYPMEPEELFETISQALLSSVDRDCLSGWGGHVYVVTFNYDSMPIHIIVSHANRSEGKDFEGKDGLTCKPPEFSV

SEQ ID NO: 150475 - protein, 384 aa, Glycine max
  Coding DNA Sequence Number=SeqID_33697
MSSFLSDSAIGLGGNDFGGSIEQPMMDREVISIGGSSSNDTHRSASDSESYSLERVRASCLTSGGTSHLCRNAQCSVAAREPVLVTMILPPSASRGVRRGSSGGDVKASPRVQRSHRVGSSSSTPAVAGCGWVRDDVLKYKSSLTLVVSVDALQCQVKLASPEDSCKIFIQTCGSDDFLFLRVTSGWGARFPFYWQFHPTRFKSFDEDLLTLVEREGGQPADEFDLIATTCAHAVLPPSSLAPMNAIDSAKVFLLRSLEILEEKGQWHQEALRNVASLEAEHPKVANATIAFAKAVRSNHQLSSKVGGVLAKLLCTRLHSDELFKRCKDLQVDKKDLVVKLEGLAMERDELVKVVDDLEARLKESESKLEEFKLRAVKEMEARK

SEQ ID NO: 150476 - protein, 203 aa, Glycine max
  Coding DNA Sequence Number=SeqID_33698
  Homolog annotation: Hit_ID=Q9SD55; Match level="QueryCoverage=44%, HitCoverage=43%, E-value=1e-25, Identity=57%"; Hit description=Zinc -finger-like protein
  Pfam annotation: Domain name=PHD; Domain location=151-195; Score=7.5; E_value=0.01; Accession=PF00628.19; Description=PHD-finger
  Pfam annotation: Domain name=zf-C3HC4; Domain location=152-192; Score= 33.1; E_value=9.6e-07; Accession=PF00097.15; Description=Zinc finger, C3HC4 type (RING finger)
  Pfam module annotation: Pfam domain module=PHD::zf-C3HC4; Domain location=151-195::152-192
MEREEGKQPPQKTPLHNQHEQANSNNFVLEHNLQEQSGTFTTFASFESETEGESSFDDNDYDGDADFFLSQEFESELQFLESEGSNYNNDDDNDEDMEEDDIDVDELTYEELIELGDFIGQEKRGLSAHEICSCLHIHIFHSAENKSGIDRCVICQVEYEEGEPLVAIQCEHPYHTDCISKWLQIKKVCPICNTEISAPKMVS

SEQ ID NO: 150477 - protein, 98 aa, Glycine max
  Coding DNA Sequence Number=SeqID_33699
MGVDEAESCAKEVNGDEPLKEARVKFLIVIDLLWGLNIHKTLATSTFSIVPISLSEVTYIPKGFTKLEKHSSPHVYSGIPVKQIHANMFPNVTSTLHF

SEQ ID NO: 150478 - protein, 88 aa, Glycine max
  Coding DNA Sequence Number=SeqID_33700
MSSGWLDGSTKECHFMYSIVVHMLPRTKVRDHHSLSVSIRYSHLGKLDSKCQGYPVVHRQLPSPMVINLSLKGVPNRMTCPKYKCSPS

SEQ ID NO: 150479 - protein, 55 aa, Glycine max
  Coding DNA Sequence Number=SeqID_33701
MASSKRHCSPSQGTVSSNTDSEKLNFDVEIEDKHAETQVVNWPLDEEKSEEEEEE

SEQ ID NO: 150480 - protein, 107 aa, Glycine max
  Coding DNA Sequence Number=SeqID_33702
  Gene Ontology: Mol. function=RNA-directed DNA polymerase activity; Biological process=RNA-dependent DNA replication
MLAFYSNLFAVGHPGRMALEDTYKKYWEVVKQDVFEATSHFFRKGQLIPNTNSSVIALIPKFPNANRIEHYCLIALANFQFKIKKILTFRLASIVPKIISSPQRGFI

SEQ ID NO: 150481 - protein, 45 aa, Glycine max
  Coding DNA Sequence Number=SeqID_33703
MPSQHRVPVTPNKVIRPCINRAFIKKYCAPRQAQGVTLQQHWDGR

SEQ ID NO: 150482 - protein, 331 aa, Glycine max
  Coding DNA Sequence Number=SeqID_33704
MGDTISIKSAAPIKTSELREWLLKLWHPVCQWKVTSIISDDHRKEDLALVRQNVPLDEVVTEKDKPEGSDPGEPIANKDNEHIVVVDDVSDSGSDSPSKVGVEVQQDFKLKSNFWADEVDDDIEEGPTTEEEPFTEVVSKASKEKKKGTNKTTTPKKPANNCRSVAFKLSLGSKTSFFAAVYASTAYVKRRDLWSELTDLQQKHLGSWPFIGDFNSNVGAQEKRGGKMSCSIACEEFQAWMDVNNLIHLNINERISPGPIIEKAELVLIFSLIDRAIGNDICLLDWCDISVCILPRSKSEHHPLLMMLEQQDHTNLVLLNFSKFDLLIVTT

SEQ ID NO: 150483 - protein, 71 aa, Glycine max
  Coding DNA Sequence Number=SeqID_33705
MSCRCLPPHGEELLNQSGILRIHLKDLMENKLSSWGQETQLWECMFVPVYVGFQEKQCLRLMGCDTSIIDK

SEQ ID NO: 150484 - protein, 186 aa, Glycine max
  Coding DNA Sequence Number=SeqID_33706
  Homolog annotation: Hit_ID=Q8H5X6; Match level="QueryCoverage=21%, HitCoverage=7%, E-value=2e-09, Identity=75%"; Hit description =Putative NADH dehydrogenase
MTVEWRRRKGDWRRHFKEKMSQEQAHHHRKSCLKVGKDEWMERERRGMKLMRLATSSWFQLSSLGLIQSMFVISVEGPSYVGCSEDGASQKDNFEIGVDDWLHVPSMEDAFSLGDCAGFLEHIGRLVLLALAQLASIYVYSGARNDINLFLSVLLVVAQEAYCGCVWIYFKTTLNEKITLSKAIML

SEQ ID NO: 150485 - protein, 408 aa, Glycine max
  Coding DNA Sequence Number=SeqID_33707
  Gene Ontology: Mol. function=methyltransferase activity; Biological process=metabolic process
  Homolog annotation: Hit_ID=Q00TN0; Match level="QueryCoverage=86%, HitCoverage=32%, E-value=8e-67, Identity=40%"; Hit description =Homology to unknown gene
MGRASSLLIIFLVLGSSFATYNVVTMIRHYGSSEGVAVNDGALFFDPITEMPDHVKNRKTSKVPFHVALTATDAPYNKWQCRVMYYWYKQQKKLPGSEMGGFTRILHSGNPDNLMDEIPTVVVDPLPAGLDRPIGFIVYNVSVAVRIELIGYIVLNRPWAFVQWLEKTKIEEEYVLMAEPDHIFVRPLPNLAYGGHPAAFPFFYIRPDENEKIIRKFYPEELGPVTNVDPIGNSPVIIRKLVDFIIIVLKDPNDLIAKIAPTWMNISLKMKEDPETDKAFGWVLEMYVLPKNLIDIFVLEEPRYAYAVASALHGVRHILRKDFMLQPPWDLETNKKYIIHYTYGCDYNMKGELTYGKVGEWRFDKRSHLRGPPPKNLPLPPPGVPESVVTLVKMVNEASANIPNWDTS

SEQ ID NO: 150486 - protein, 169 aa, Glycine max
  Coding DNA Sequence Number=SeqID_33708
  Gene Ontology: Mol. function=NAD(P)H dehydrogenase (quinone) activity; Cellular component=membrane; Biological process=electron transport
  Homolog annotation: Hit_ID=Q9LK88; Match level="QueryCoverage=98%, HitCoverage=85%, E-value=2e-58, Identity=67%"; Hit description =NADPH:quinone oxidoreductase
  Pfam annotation: Domain name=FMN_red; Domain location=1-156; Score =76.7; E_value=7.4e-20; Accession=PF03358.6; Description=NADPH -dependent FMN reductase
MAAAIELSKGAIEGIEIEFIEISELPMLNTDLENNGTYPPIVEAFRCKILQAHSVLFASPEYNYSLTAPLKNAIDWASRPPNVWAGKAAAIISAGYDDFGGGRAQYHLRQIGVYLDLHFINKPEFFLNSFQPPRKFNRGGDLIDEEAKNKLKQVLLSLQEFTLGLISKG

SEQ ID NO: 150487 - protein, 42 aa, Glycine max
  Coding DNA Sequence Number=SeqID_33709
MELYFSCGGALQRFGKAPRFWTNVDPHNVLVDGVGVMRGRNL

SEQ ID NO: 150488 - protein, 112 aa, Glycine max
  Coding DNA Sequence Number=SeqID_33710
  Gene Ontology: Mol. function=transferase activity, transferring glycosyl groups; Biological process=metabolic process
  Homolog annotation: Hit_ID=Q589Y1; Match level="QueryCoverage=91%, HitCoverage=21%, E-value=4e-37, Identity=71%"; Hit description =Glycosyltransferase NTGT5b
MEKLHAVCIPYPAQGHINPMLKLAKLLHVRGFHVTFVNTEYNHKRFLKSRGPNSLNSVTSFQFETIPDGLSDNPNVDATQDTVSLCDSTRKTCLSPFEYLLSKLNSEPSLHM

SEQ ID NO: 150489 - protein, 39 aa, Glycine max
  Coding DNA Sequence Number=SeqID_33711
MRGHYEDGCALFRKRLFQVGGKLLERAIEETGCRIKYEV

SEQ ID NO: 150490 - protein, 86 aa, Glycine max
  Coding DNA Sequence Number=SeqID_33712
MGEGCCTQPYPCICKEAVSGFEPMTNKSPRHNFTAAPGLALSSGGRAKAMIRAETTSEICRGFAICREGGHQVQWKRRKDRSQKRK

SEQ ID NO: 150491 - protein, 821 aa, Glycine max
  Coding DNA Sequence Number=SeqID_33713
  Gene Ontology: Mol. function=sugar porter activity; Cellular component=intracellular; Biological process=protein amino acid phosphorylation
  Homolog annotation: Hit_ID=Q1S4J6; Match level="QueryCoverage=60%, HitCoverage=95%, E-value=0.0, Identity=60%"; Hit description =Ribosomal protein L11; Sugar transporter superfamily; Tetratricopepti de-like helical
  Pfam annotation: Domain name=Alliinase_C; Domain location=1-363; Score=506.5; E_value=3e-149; Accession=PF04864.4; Description =Allinase, C-terminal domain
  Pfam annotation: Domain name=Aminotran_1_2; Domain location=13-381; Score=-80.3; E_value=0.0024; Accession=PF00155.11; Description =Aminotransferase class I and II
  Pfam annotation: Domain name=PPR; Domain location=340-374; Score =31.9; E_value=2.2e-06; Accession=PF01535.11; Description=PPR repeat
  Pfam annotation: Domain name=PPR; Domain location=375-409; Score=1.6; E_value=4.9; Accession=PF01535.11; Description=PPR repeat
  Pfam annotation: Domain name=PPR; Domain location=441-475; Score =37.7; E_value=4.1e-08; Accession=PF01535.11; Description=PPR repeat
  Pfam annotation: Domain name=PPR; Domain location=542-576; Score =30.1; E_value=8e-06; Accession=PF01535.11; Description=PPR repeat
  Pfam annotation: Domain name=PPR; Domain location=643-677; Score =45.6; E_value=1.7e-10; Accession=PF01535.11; Description=PPR repeat
  Pfam annotation: Domain name=PPR; Domain location=678-712; Score =18.1; E_value=0.033; Accession=PF01535.11; Description=PPR repeat
  Pfam module annotation: Pfam domain module=Alliinase_C::Aminotran_1 _2::PPR::PPR::PPR::PPR::PPR::PPR; Domain location=1-363::13-381::340 -374::375-409::441-475::542-576::643-677::678-712
GDPTAYERFWRQTGDKSTITIPGWQSLSYFSDVTNICWFLEAEFAREVVRLHNVVGNAVTEGRHIVVGTGSSQLFLAALYALSPIDSPEPISVVCASPYYSSYPSMTNHLKSGLYKWGGDAESYEKEGPYIELVTSPNNPDGHVRRSKVNRSQGFLVHDLAYYWPQYTPISAPADHDLTLFTVSKSTGHAGMRIGWALVKDQEVAKKMTKFIELNTIGVSKDSQLRAAKVLRAVSDSWEQGNSKESESFFKFSHKLMANRWKQLRLVVERSELFSLPKFSPAFCTFFNQVLEPQPGKRGRLRKLPSRIQHLNEKWNTLWANNDINSAHHLFDKTPNRSVYLWNSMIRAFAQSQRFFNAISLFRTMLGADISPDGHTYACVIRACANNFDFGMLRRVHGGAVAAGLGRDPVCCSALVAAYSKLGLVHEARRVFDGIAEPDLVLWNSLISGYGGFGLWDVGMQMFSMMRLFGMKPDGYTLAGLLVGIADSGMLSIGQGLHCLSQKSGLDSDSHVGSLLLSMYSRCKHMASAYRVFCSILNPDLVTWSALIVGYSQSGEYEKVLLFFRKLNMESKKPDSVLIASVLASIAQMANVGLGCEVHGYALRHGLELDVRVSSALVDMYSKCGFLHLGICVFRVMPERNIVSFNSVILGFGLHGCASEAFRMFDKMLEKGLVPDEATFSSLLCACCHAGLVKDGREIFQRMKHEFNIRARPEHYVYMVKLLGSAGELEEAYNLTQSLPEPVDKAILGALLSCCNICGNSELAETVAHQLFESSPADNVYRVMLSNIYAGDGRWDDVKKLRDNMTGGPRKMPGLSWIDGS

SEQ ID NO: 150492 - protein, 237 aa, Glycine max
  Coding DNA Sequence Number=SeqID_33714
  Gene Ontology: Mol. function=histone deacetylase activity; Cellular component=nucleus; Biological process=histone deacetylation
  Homolog annotation: Hit_ID=Q1S4J3; Match level="QueryCoverage=78%, HitCoverage=39%, E-value=4e-87, Identity=81%"; Hit description =Histone deacetylase superfamily
MNFEKFKNAENNVVNIAKPGGLGLLGVVQAAGPINGDIGVAAVEADGGADGAAGEGAAEVEEAVEDGAILADVEALELAVVGVGILGEDLRRDGGEEVDVVVGVEAADVGLRGGEGAVDLHAAVEAVVHDEVVGHAKAVRLHRVPLPVEVVADARLVEVRHSPLLRVRAHRRQRDATHCLSSLPSRHNTPNPSFSLFFFFPLHNLATLPTTTTELSNLYATHHFVILLSFQNSLKSS

SEQ ID NO: 150493 - protein, 179 aa, Glycine max
  Coding DNA Sequence Number=SeqID_33715
  Homolog annotation: Hit_ID=Q1S4J3; Match level="QueryCoverage=25%, HitCoverage=9%, E-value=5e-11, Identity=66%"; Hit description =Histone deacetylase superfamily
MALPVVGLVWFEDMLYCICSSCQISKATIASCLSYVPEARGQGLNISRIRASDFSCCHAYGAHISLSLCVCVGELVYTGNYDLYPNAFSCLPADLTWSFPTSDYNIYAKNTLLEQLSRLPHAPNAPFQTTPSVIEVPEEEEEDMDVRPKPCIWSCEDFDSDHDDDMGSSKNSDLTAQTM

SEQ ID NO: 150494 - protein, 289 aa, Glycine max
  Coding DNA Sequence Number=SeqID_33716
  Gene Ontology: Mol. function=nucleic acid binding; Biological process= DNA integration
MSHKDEYGDGDNKNNNDDEDDGDGDDNGGHHDGDNNNNNDNEDDGNGDDDNGDHHVLQQQQTITRCLYPNAYKSGDCGGSCGAYGRGAFTNCGASRGDGGSGSDLGVRISNTWVNPNSNNPGPSHSQPSVMLTSSTSQGMGKLTCPHTHHQNGVVKRKHRHIIDLGLNIVASSSLPLKFWDYAFATSLVNSESTTLASSSSEFISIPNFVPVNTYPMQTRSKSGIHNPRLHPSMFLTHFESKTIKQALANTDRLTAMQQEYNALLKNRTWDLVPLAPNRQAIGCKWVLR

SEQ ID NO: 150495 - protein, 160 aa, Glycine max
  Coding DNA Sequence Number=SeqID_33717
  Gene Ontology: Mol. function=histone deacetylase activity; Cellular component=nucleus; Biological process=histone deacetylation
  Homolog annotation: Hit_ID=Q1S4J3; Match level="QueryCoverage=93%, HitCoverage=31%, E-value=4e-75, Identity=86%"; Hit description =Histone deacetylase superfamily
  Pfam annotation: Domain name=Hist_deacetyl; Domain location=1-128; Score=-44.7; E_value=1.3e-07; Accession=PF00850.10; Description =Histone deacetylase family
MTVSFHKFRDFFPGTGHSKDIGVGAGKNYSLNVPLNDGLDDETFCGLFRPIIQKVMDIYQPDAVVLQCGADSLSGDQLGCFNLTVKGHADCLRFLRSFSVPLMVLGGGGYTVQNVARCWTYETAVAVGVEPSPKLPYNEYYEYFGPDYIIFTSSYPQWKT

SEQ ID NO: 150496 - protein, 110 aa, Glycine max
  Coding DNA Sequence Number=SeqID_33718
MSSTNIIFLSKFLLLLILLLNPHEANNTRGCSTFVCVAGARPLEHNVPKYINLKPHGKSNGKRGFAQGGGVEACLPKGFRRSSAPSRYINYQPLGSTCSSSKVVNNGPRA

SEQ ID NO: 150497 - protein, 60 aa, Glycine max
  Coding DNA Sequence Number=SeqID_33719
  Gene Ontology: Mol. function=receptor activity; Biological process =DNA integration
  Homolog annotation: Hit_ID=Q1SF74; Match level="QueryCoverage=98%, HitCoverage=50%, E-value=4e-09, Identity=39%"; Hit description =Lectin receptor kinase-related
MARCILKAKSMPKEFWVEAISFDHLKVFGSITYAHVSNQGRFKLDDKSVMHVFIGYDASS

SEQ ID NO: 150498 - protein, 182 aa, Glycine max
  Coding DNA Sequence Number=SeqID_33720
  Gene Ontology: Mol. function=nucleic acid binding; Cellular component= chromatin; Biological process=DNA integration
MEEEINVIKKNDTWELSKLPKGHEAIGVKYVFKIKKNAKGEVERYKARLIAKGYKQYHRLIMRKFFYRLLTILSLPTITQICLKAMSFEFEMTDIGLMSYYLGQEVMQMENDIFVFQESYEKKVLEKFQMFDCNSVNTPMEGNLKLPKLDGGEQENPTLFKSFVGSLRYLSTRLDIMYVVGV

SEQ ID NO: 150499 - protein, 164 aa, Glycine max
  Coding DNA Sequence Number=SeqID_33721
  Homolog annotation: Hit_ID=Q9FGQ7; Match level="QueryCoverage=51%, HitCoverage=22%, E-value=3e-08, Identity=42%"; Hit description =Cyclin D3-like protein
MALGDDAQHHSPLFLDALLCEERETFKEDFDENGYERETENNEPSVIKSQSLPLVLHDNDLFWEDEELVSLIAREGETHLCFYGVVANGALEGPRVENLADMDITFKGYGIGLRARVRGNWVDGTMKDGVDLIPISSRNSKPPGVELWAVLDVPDIRLALLGKI

SEQ ID NO: 150500 - protein, 61 aa, Glycine max
  Coding DNA Sequence Number=SeqID_33722
MPPPPKKREILRTSLKGVDKVKKVCLQTLRREFESLDVRAVEKVLHSLTIKIDFVVCAIEE

SEQ ID NO: 150501 - protein, 125 aa, Glycine max
  Coding DNA Sequence Number=SeqID_33723
MEEKKFKEYMVVEEDVDMAKEEKEEEMMTMLIIMKEVINPLAVVKEEEIEAILEEQMKGGMINQILNVIIVIGMNDDKCLWYLDNGASNQICSYKEKFVELKEKVKGNVSFGDSSKVQILGKCSI

SEQ ID NO: 150502 - protein, 209 aa, Glycine max
  Coding DNA Sequence Number=SeqID_33724
  Homolog annotation: Hit_ID=Q1SYE0; Match level="QueryCoverage=84%, HitCoverage=15%, E-value=4e-70, Identity=74%"; Hit description=HASTY
IQQQQDVLRWLLEPLSVQWTQLEWQDKYLSGPHGLVQLCSDVPVMWSIFHTVTFFERALKRSGLKKANWNSENSSTPNSIPLNPMASRISWMVTPLLKLLRCIHSLWSPSVSQALPGEVRAAMVMGDVERFSLLGEGNSKLPKGVTDGSKIDMNKEGYTEPNESDIRNWFKGIRDSGLLQDGRAMVPDAHGILSGSDLKVEVMEETIPG

SEQ ID NO: 150503 - protein, 62 aa, Glycine max
  Coding DNA Sequence Number=SeqID_33725
MDRRLLPLCYLRKGGGLRFLDLRKGRVVVSPPLAWKRVVVVAVSSLSLASLACWLHVLWLLA

SEQ ID NO: 150504 - protein, 150 aa, Glycine max
  Coding DNA Sequence Number=SeqID_33726
  Homolog annotation: Hit_ID=Q9AVI1; Match level="QueryCoverage=94%, HitCoverage=63%, E-value=3e-32, Identity=53%"; Hit description =Putative senescence-associated protein
MMKKSGFEKMVSQKNKNKGGYDDHQKPRNNRFLVNINIMGSAGPIRFVVNEKELVSGVIDTALKSYAGEGRLPVLGFDATNFLLYCANAGFDALSPLEPIGSLGSRNFVLCKKQVQSSKAAPQSELVSQKSNGGWKAWLNKSFSLKILSH

SEQ ID NO: 150505 - protein, 154 aa, Glycine max
  Coding DNA Sequence Number=SeqID_33727
  Subcellular localization annotation: CTP_CleavageSite=73; ConfidenceScore=5.45e-01
MMHLSHHIPCHHSLIPRPSSIFSYPPPSNPLLSSHLPRPSPRSSLLLPPPSTLIDAYHNNLSLTPSPSPRNLYGNHSFSLNFEFMSNPIGDLTTQTKLSPHHSNAFLSSIICEVEIMGAMVVGGDWLPVTMEELLQIASNNDMQDNVEVHKEES

SEQ ID NO: 150506 - protein, 532 aa, Glycine max
  Coding DNA Sequence Number=SeqID_33728
  Gene Ontology: Mol. function=kinase activity; Cellular component =nucleus; Biological process=regulation of progression through cell cycle
  Homolog annotation: Hit_ID=Q39879; Match level="QueryCoverage=80%, HitCoverage=89%, E-value=1e-151, Identity=65%"; Hit description =Mitotic cyclin a2-type
  Pfam annotation: Domain name=Cyclin_C; Domain location=356-484; Score= 151.0; E_value=3.1e-42; Accession=PF02984.9; Description=Cyclin, C -terminal domain
  Pfam annotation: Domain name=Cyclin_N; Domain location=240-354; Score= 170.4; E_value=4.6e-48; Accession=PF00134.13; Description=Cyclin, N -terminal domain
  Pfam module annotation: Pfam domain module=Cyclin_C::Cyclin_N; Domain location=356-484::240-354
  Subcellular localization annotation: CTP_CleavageSite=78; ConfidenceScore=5.84e-01
MSSTTQNRRSSFTSSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRFVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQSKYEEICAPQVEEFRYITDNTYLKEEVLQMESAVLNYLEFEMTAPTVKCFLRRFVRAAAHDVQEIPSLQLECLTNFIAELSLLEYSMLCYPPSQIAASAIFLARFILFPSKKPWNSTLQHYTLYRPSDLCACVKDLHRLCCSSHDSNLPAIRDKYSQHKFAYFLLILHLRTVQMCGQEVHPSFNTSRSFPELNKMHSWNLEDDADGDVLMELVFFSMASIK

SEQ ID NO: 150507 - protein, 159 aa, Glycine max
  Coding DNA Sequence Number=SeqID_33729
MENCQWEQELQPYNQHEEERSSNLDNLLMQFKESTESTQQAFKSLEIQVGKLAKEVAKFMSTREENFVEVEAQEESLVEEHDSREKDEEKINTPPHQLIIKEERHGEHDKSLSVILSLNTNTSLAMIWKVFLEYMSFMESIAKRRKCKEDEFYVTFMPP

SEQ ID NO: 150508 - protein, 55 aa, Glycine max
  Coding DNA Sequence Number=SeqID_33730
MWAERFEEPREISECDYSAFGALIWHRELMGLTLLLLTRFKTILFGVLELGELGC

SEQ ID NO: 150509 - protein, 77 aa, Glycine max
  Coding DNA Sequence Number=SeqID_33731
MSSGSPPLDDNRCRMTIICLCVPPDWIVSGWQKCVWMTKICLRMSSGSMPLDDKRCTMNHHLSLRATRLYRHWIAKQ

SEQ ID NO: 150510 - protein, 284 aa, Glycine max
  Coding DNA Sequence Number=SeqID_33732
MDMNIGALTSGQISSIAQSNSSRLGFPTLITALYRAIGVTSDSLTYKSLIPTINLAYIKKSCWNVDDLTTNFRGARKARARPADVPSSSAPPAPSTFATPTPAPPGPSAQESQRFEAMLHSLHQGQILLMQSLQVVAPPGSIMLVEQFMEKVSWPEILPSIVREGGGPSAQVPQQVHNASSEAIIPGAFDFSGGGLEMRLNEATSPKLVPVPADPPSIVVDPSSPAPEAPLPSTPLIISKDPTIPVPGLATTPPATPVIYFSDEKEGWTTTPPGTPVLHLDDEE

SEQ ID NO: 150511 - protein, 579 aa, Glycine max
  Coding DNA Sequence Number=SeqID_33733
  Gene Ontology: Mol. function=binding
  Homolog annotation: Hit_ID=Q2R9P0; Match level="QueryCoverage=94%, HitCoverage=24%, E-value=0.0, Identity=65%"; Hit description =Armadillo/beta-catenin-like repeat family protein, expressed
  Pfam annotation: Domain name=Arm; Domain location=124-164; Score =19.8; E_value=0.01; Accession=PF00514.13; Description=Armadillobeta -catenin-like repeat
  Pfam annotation: Domain name=Arm; Domain location=171-213; Score=3.4; E_value=4.6; Accession=PF00514.13; Description=Armadillobeta-catenin -like repeat
  Pfam annotation: Domain name=Arm; Domain location=215-255; Score =20.2; E_value=0.0076; Accession=PF00514.13; Description =Armadillobeta-catenin-like repeat
  Pfam annotation: Domain name=Arm; Domain location=257-298; Score =25.1; E_value=0.00025; Accession=PF00514.13; Description =Armadillobeta-catenin-like repeat
  Pfam annotation: Domain name=Arm; Domain location=300-349; Score =15.5; E_value=0.14; Accession=PF00514.13; Description=Armadillobeta -catenin-like repeat
  Pfam annotation: Domain name=Arm; Domain location=473-513; Score=3.3; E_value=4.8; Accession=PF00514.13; Description=Armadillobeta-catenin -like repeat
  Pfam annotation: Domain name=Arm; Domain location=515-555; Score =35.9; E_value=1.4e-07; Accession=PF00514.13; Description =Armadillobeta-catenin-like repeat
  Pfam annotation: Domain name=Arm; Domain location=82-123; Score=11.4; E_value=0.46; Accession=PF00514.13; Description=Armadillobeta-catenin- like repeat
  Pfam annotation: Domain name=HEAT; Domain location=130-166; Score =19.1; E_value=0.016; Accession=PF02985.12; Description=HEAT repeat
  Pfam annotation: Domain name=HEAT; Domain location=221-257; Score =1.9; E_value=25; Accession=PF02985.12; Description=HEAT repeat
  Pfam annotation: Domain name=HEAT; Domain location=263-300; Score =11.7; E_value=1.6; Accession=PF02985.12; Description=HEAT repeat
  Pfam annotation: Domain name=HEAT; Domain location=90-125; Score=2.9; E_value=19; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT; Domain location=124-164::171 -213::215-255::257-298::300-349::473-513::515-555::82-123::130 -166::221-257::263-300::90-125
MVGYDLAEFDCTSFTYKCESSKSTNKWKLNVCREFNEATGMDDPESTMAKVANFVEQLHANLSSPVEKETITARLLGIARRRKDARAIIGSHAQAMPLFISILRNGTPLAKVNVASTLSVLCKDEDLRLKVLLGGCIPPLLSLLNYESTDARKAAAEAIYEVSSGGLSDDHVGMKIFVTEGVVPTLWNQLNPKNKEDKIVEGFITGALRNLCGDKDGYWKATLEAGGVDIIVGLLSSDNAVSQSNAASLLARLMLAFSDSIPKVIDSGAVKALLQLVGQENDISVRASAADALEVLSSKSTKAKKVIVNADGIPILIGAIVAPSNECMQGDGGQALQEHATRALANICGGMSALILYLGELSRSPRPDAPVGDIIGALAYTLMVFEEKVDVDEKHFDATQIEDILVTLLKPQDNKLIQERVLEAMASLYGNVCLSKCLIQADSKKVLIGLITMAATDVQEYLILSLTSLCCDKIGVWEAIKKREGIQLLISLLGLSSEQHQEYSVQLLAILTDQVDDSKWAITAAGGIPPLVQLLETGSQKAREEAANVLWSLCCHSEDIRACVESAGAIPAFLWLLKS

SEQ ID NO: 150512 - protein, 1402 aa, Glycine max
  Coding DNA Sequence Number=SeqID_33734
  Gene Ontology: Mol. function=binding
  Homolog annotation: Hit_ID=Q2R9P0; Match level="QueryCoverage=99%, HitCoverage=63%, E-value=0.0, Identity=59%"; Hit description =Armadillo/beta-catenin-like repeat family protein, expressed
  Pfam annotation: Domain name=Arm; Domain location=1058-1099; Score =9.4; E_value=0.82; Accession=PF00514.13; Description=Armadillobeta -catenin-like repeat
  Pfam annotation: Domain name=Arm; Domain location=1101-1141; Score =13.4; E_value=0.26; Accession=PF00514.13; Description=Armadillobeta -catenin-like repeat
  Pfam annotation: Domain name=Arm; Domain location=126-167; Score=3.4; E_value=4.6; Accession=PF00514.13; Description=Armadillobeta-catenin -like repeat
  Pfam annotation: Domain name=Arm; Domain location=31-71; Score=1.0; E_ value=9.1; Accession=PF00514.13; Description=Armadillobeta-catenin -like repeat
  Pfam annotation: Domain name=Arm; Domain location=486-526; Score=6.1; E_value=2.1; Accession=PF00514.13; Description=Armadillobeta-catenin -like repeat
  Pfam annotation: Domain name=Arm; Domain location=528-568; Score=3.7; E_value=4.2; Accession=PF00514.13; Description=Armadillobeta-catenin -like repeat
  Pfam annotation: Domain name=Arm; Domain location=569-609; Score=2.8; E_value=5.4; Accession=PF00514.13; Description=Armadillobeta-catenin -like repeat
  Pfam annotation: Domain name=Arm; Domain location=811-851; Score=4.0; E_value=3.8; Accession=PF00514.13; Description=Armadillobeta-catenin -like repeat
  Pfam annotation: Domain name=Arm; Domain location=852-892; Score=5.5; E_value=2.5; Accession=PF00514.13; Description=Armadillobeta-catenin -like repeat
  Pfam annotation: Domain name=Arm; Domain location=975-1016; Score =9.6; E_value=0.78; Accession=PF00514.13; Description=Armadillobeta -catenin-like repeat
  Pfam annotation: Domain name=C2; Domain location=1276-1356; Score =72.9; E_value=1e-18; Accession=PF00168.20; Description=C2 domain
  Pfam annotation: Domain name=HEAT_PBS; Domain location=1044-1080; Score=3.3; E_value=35; Accession=PF03130.6; Description=PBS lyase HEAT-like repeat
  Pfam annotation: Domain name=HEAT_PBS; Domain location=154-182; Score= 1.3; E_value=66; Accession=PF03130.6; Description=PBS lyase HEAT-like repeat
  Pfam annotation: Domain name=HEAT_PBS; Domain location=555-591; Score= 10.9; E_value=3; Accession=PF03130.6; Description=PBS lyase HEAT-like repeat
  Pfam annotation: Domain name=HEAT_PBS; Domain location=795-833; Score= 3.6; E_value=32; Accession=PF03130.6; Description=PBS lyase HEAT-like repeat
  Pfam module annotation: Pfam domain module=Arm::Arm::Arm::Arm::Arm::Ar m::Arm::Arm::Arm::Arm::C2::HEAT_PBS::HEAT_PBS::HEAT_PBS::HEAT_PBS; Domain location=1058-1099::1101-1141::126-167::31-71::486-526::528 -568::569-609::...
  Pfam module annotation: Domain location=811-851::852-892::975 -1016::1276-1356::1044-1080::154-182::555-591::795-833
GDVKPLIKLAKTSSVDAAETAVAALANLLFDPFIAAEALAEDVVSALARVLAEGTLEGKQNASRALHQLLKHFPVGDVLKGNTQCRFTVLALVDSLRAMDMDGTDAADALEVIALLARTKQGVNYTYPPWSALAEMPSSLELLVCCLAEGHSLVQEKAIKILSRLCGDQPVVLGDLLSASSKSIGSLANRIMNSSSLEVKIGGSALLICAAKEKKKLSMDSLDASGFLKPLIYSLVEMIKQSCSYSLLEIEVVASKGFMERSSFQEVDEFDIPDPATALGSTIAMWLLSVIASFHIKSKLTIMEAGGLEALSDKLSRHTSNPQAEYEDTEGTWINALLLAILFQDANVILSPVTMRIIPSIALLLRSDEVIDKYFAAQSMASLVCNGNKGIDLAIANSGAVAGLITIIGHVESDMPNLMALSEEFSLVQNPDQVVLDHLFEIEDVKVGSTARKSIPLLVDLLRPIPERPTAPPVAVRLLICIADGSDSNKLILAEAGALEALNKYLSLSPQDSTEAAISELLRILFSNSDLIKHEASTNSLNQLIAVLRLGSRNARYSAARALHELFDADNIRDSELAKQGIQPLVDMLNTTSGNEQEAALMALIKLTSGNSSKVSLLLDVEGNPLKCLYKILSSASSLELKSHAAQLCFALFGNSKIRADPVASECLEPFISVMQSDSETRIESGVELAAAYNVVYLLVSLVSGTNYQLIEAAISTLIKLGKDRTPIKLDMVKAGIIDNCLKLLQLAPSSLCSTIAELFRILTNSSAIARSSDAAKIVEPLFHVLLRRDFNLWGQHSALQALVNILEKPQSLATLKLTPSQVIEPLISFLESPSQAIQQLGTELLSHLLAQEHFQQDITTKNAVVPLVQLAGIGILNLQQTAIKALEKISTSWPKAVADAGGIFELAKVIIQEDPQPPHALWESAALVLSNVLHSNADYYFKVPVVVLVKLLHSTLESTISIALNALIVHDRSDASSAEQMMEAGVIDALLDLLRSHHCEEASGRLLEALFNNVRVREMKVSKYAIAPLSQYLLDPQTRSQSGKLLAALALGDLSQHEGHARSSASVSACRALISLLEDQPTEEMKVVAICALQNFVMNSRTNRRAVAEAGGILVIQELLLSPNTEVAAQAALLIKFLFSTHTLQEYVSNELIRSLTAALERELWSTATINEEVLRTLHVIFMNFPKLHTSEAATLCIPHLVGALKSGGEAAQDSVLDTFCLLRQSWSTMPIDIAKSQAMIAAEAIPILQMLMKTCPPSFHERADTLLHCLPGCLTVTIKRGNNLKQTMGSTNAFCRLTIGNGPPKQTKVVNHNTSPEWKEGFTWAFDVPPKGQKLHIICKSKNTFGKTTLGRVTIQIDKVVSEGVYSGLFSLNHDGNKDGSSRTLEIEIIWSNRISNDDI

SEQ ID NO: 150513 - protein, 70 aa, Glycine max
  Coding DNA Sequence Number=SeqID_33735
MTLPMFATTPSLPEPPRNNTCHNGVKENPLAIKTLGVSNDDRACGTLSRCTFNNKLKGSSHVQQGMHLRK

SEQ ID NO: 150514 - protein, 287 aa, Glycine max
  Coding DNA Sequence Number=SeqID_33736
MSLIPGLTVKLSEICYEKKNSFSPSLLFFARNPFLSPPPPSSPSHHLTYPLPHHSGYPPSKPPPKMTPPPPNPKLIPFPHCQNHLHPHRCHRLTHAFPPHPAIIVALLTPPAPDTGTALTEDEVERVLEDRLSTNPHDTDTRHAQAFLVPFFSSLNFNMRDHTMKDPAMQIDRQLQVVVVCFRCGGDGSAGGLGRNRTVTVTFSFALLTSGAAAVVTGETDAFDEGLDAAEEDGLEAVEDDDGVVGLPAGLTAPAGDFLERSGETEALREERAAEDIDGEREVRGGR

SEQ ID NO: 150515 - protein, 95 aa, Glycine max
  Coding DNA Sequence Number=SeqID_33737
  Gene Ontology: Mol. function=microtubule motor activity; Cellular component=microtubule associated complex; Biological process =microtubule-based movement
  Homolog annotation: Hit_ID=Q6YZ52; Match level="QueryCoverage=83%, HitCoverage=14%, E-value=1e-24, Identity=72%"; Hit description =Kinesin motor protein 1-like
MMSKFQDDPTGTYVEGIKEEVVLSPAHALSLIATGEEHRHVGSNNFNLVSSRSHTIFTLTVESSSRDENIGEEDVTLSHLVILIRPGLFITILLQ

SEQ ID NO: 150516 - protein, 71 aa, Glycine max
  Coding DNA Sequence Number=SeqID_33738
MGRRNPNSPSWGCGELELGEVRAEFGKRREERKKGETRFYYCQPPVKPCNTLPHLTFLFTPHRASLALASC

SEQ ID NO: 150517 - protein, 153 aa, Glycine max
  Coding DNA Sequence Number=SeqID_33739
  Gene Ontology: Mol. function=RNA-directed DNA polymerase activity; Cellular component=chromatin; Biological process=RNA-dependent DNA replication
MPFGLTNAPTTFQVLMHNVFHPSLRRFIVIFFDDILVYNPTIEDYATHLELVFQINKEHKIFLKKDKCCIAISKVEYLGHFITKEGVSTDPSKDRHPIAYISKSLGPKQQAWMSKLMGFDFEIPYKEGVENKAANALSRKSRPELLPMMLDNA

SEQ ID NO: 150518 - protein, 164 aa, Glycine max
  Coding DNA Sequence Number=SeqID_33740
  Gene Ontology: Mol. function=RNA-directed DNA polymerase activity; Cellular component=chromatin; Biological process=chromatin assembly or disassembly
MNKDIQQSCHRSKPDLVASPGLFQPLPIPSKVWNHINMDFIEAKWWYNTNFHLAIQTTPYEVVYGPLPSIHLPYLLRESSIVDRTLNAREVVIKILQFHLPRAQNHMSQQVEKHMGDRSFTIGDFVYLKLKPYRQHSIYHDIFHKLLPKFYGPFKVIDSIGKVV

SEQ ID NO: 150519 - protein, 79 aa, Glycine max
  Coding DNA Sequence Number=SeqID_33741
MAAHWGLLRDLVARHNGLWVAMVDGLRFLMMLKKICLIIILIIKKGENVNNADFDDVEKNSLANDCHHQKGRDCECMNT

SEQ ID NO: 150520 - protein, 83 aa, Glycine max
  Coding DNA Sequence Number=SeqID_33742
MEGGVGLLEWGEGSLYGGDRFQLWNESDLRNKRYLDTCGTACQRRLTLAEYLRLLTIYSYLNILYTCTLNSNVPLLHTSVVHA

SEQ ID NO: 150521 - protein, 63 aa, Glycine max
  Coding DNA Sequence Number=SeqID_33743
  Subcellular localization annotation: CTP_CleavageSite=43; ConfidenceScore=5.03e-01
MKRIRIWGSHGHVAPHATGLLGHGNKRWGGRQKQHFVSKRPFRGNTGFNKNRRKSLKVYQPYT

SEQ ID NO: 150522 - protein, 175 aa, Glycine max
  Coding DNA Sequence Number=SeqID_33744
  Gene Ontology: Mol. function=molecular_function; Cellular component =chloroplast thylakoid lumen; Biological process=biological_process
  Homolog annotation: Hit_ID=O22160; Match level="QueryCoverage=90%, HitCoverage=72%, E-value=7e-48, Identity=63%"; Hit description =Thylakoid lumenal 15 kDa protein, chloroplast precursor
  Pfam annotation: Domain name=Pentapeptide; Domain location=114-153; Score=51.2; E_value=3.5e-12; Accession=PF00805.12; Description =Pentapeptide repeats (8 copies)
  Subcellular localization annotation: CTP_CleavageSite=78; ConfidenceScore=5.72e-01
MALVLNVSLCSISKPHLSLSTSNPNKASSTLPLPILGLKTKQSLQPSQKLTFSLGESVAGATLVALLSASFIFVDPALAFKGGGPYGQEVTRGQDLTGKDFSGKTLIKQDFKTSILRQANFKGAKLIGASFFDADLTGADLSDADLRNADFSLANVTKINPKFCIIAVTKYRAIV

SEQ ID NO: 150523 - protein, 333 aa, Glycine max
  Coding DNA Sequence Number=SeqID_33745
  Gene Ontology: Mol. function=nucleic acid binding; Cellular component= beta-galactosidase complex; Biological process=DNA integration
  Homolog annotation: Hit_ID=Q1ST43; Match level="QueryCoverage=79%, HitCoverage=21%, E-value=7e-57, Identity=40%"; Hit description =Integrase, catalytic region; Peptidase aspartic, catalytic
  Pfam annotation: Domain name=zf-CCHC; Domain location=227-244; Score =4.6; E_value=0.17; Accession=PF00098.13; Description=Zinc knuckle
  Pfam annotation: Domain name=zf-CCHC; Domain location=251-268; Score =7.3; E_value=0.062; Accession=PF00098.13; Description=Zinc knuckle
  Pfam module annotation: Pfam domain module=zf-CCHC::zf-CCHC; Domain location=227-244::251-268
  Subcellular localization annotation: CTP_CleavageSite=57; ConfidenceScore=5.12e-01
MSINSDSDHEETPPPFIDPSQQPSSPFHIHPSESRTSIIVTPPLTGNNYQSWSRSIRMALISKNKMSFLTGTISMPTSTDPLFPRWERCNTLLMSWLIHSVSPFIAQSIIFFENAAAIWIDLRKRFSQGDLLCVAKLQEEIYSLKQGSASVIDYYTTLKSLWEELDNFRPLTPCTCSVKDFHYQDFIIRFLKGLDERFTMVRSKILLLDPLPSANKSGGGKSNFFNCKYDHCGRLGHTSDVCYQKQGNTIPKCEHCTRYGHTMDICYTKFGYPPGHSKYPGRPRLPNKTGASEGGAAGGAAVNNTTREGNRTLHGEENKDGSTTIPDPNITQA

SEQ ID NO: 150524 - protein, 48 aa, Glycine max
  Coding DNA Sequence Number=SeqID_33746
  Gene Ontology: Mol. function=molecular_function; Cellular component =chloroplast thylakoid lumen; Biological process=biological_process
  Homolog annotation: Hit_ID=O22160; Match level="QueryCoverage=75%, HitCoverage=16%, E-value=2e-12, Identity=89%"; Hit description =Thylakoid lumenal 15 kDa protein, chloroplast precursor
MVCALLSYLEPDFTDVPLREDQREYLCKVADGVNPTTGNATRDTLFCN

SEQ ID NO: 150525 - protein, 104 aa, Glycine max
  Coding DNA Sequence Number=SeqID_33747
MTAGKGKPIFEVVLPLGLPFKVAPDWRWKKKTGGPFGPANKSYSEPHELLVIHASSTIESGAPRIDCLALFIYPPPSNLIRSPMNCLSFMHPPPSSSKPHELIA

SEQ ID NO: 150526 - protein, 217 aa, Glycine max
  Coding DNA Sequence Number=SeqID_33748
  Gene Ontology: Mol. function=hydrolase activity, acting on glycosyl bonds; Cellular component=cellular_component; Biological process =carbohydrate metabolic process
  Homolog annotation: Hit_ID=Q68UW1; Match level="QueryCoverage=100%, HitCoverage=48%, E-value=2e-58, Identity=52%"; Hit description =Polygalacturonase
MTNPTPKPSPSLLITLRVILGCWLCSSVAFGATYNVVNFGAKSDGKTDSTKAFLNAWSKACASTNPASIYVPQGKFLLKSVTFNGKCNNKGISITIDGTLVAPSDYSVTGSAGTWLEFERVDGVSIRGGVLDGQGTALWDCKNSGRGNCPSGATVMVASQKKLKQISNEELVTVYAIQTLAFTNSNNIAIGGLTSMNSQMFHIVFNGCQNVKLQGVK

SEQ ID NO: 150527 - protein, 123 aa, Glycine max
  Coding DNA Sequence Number=SeqID_33749
  Subcellular localization annotation: CTP_CleavageSite=74; ConfidenceScore=5.07e-01
EVLNKGISMLVDHGDFQLITGPSGTQVPSCILSTNDIVVSKKGTKCSLDSFMNLFKGYSVVSVPRLLVMRNTLRFAMGNLPFSYLGVPHFCDKSSWRFGDGTSISFWTQLGQPLVEMLNIPEA

SEQ ID NO: 150528 - protein, 498 aa, Glycine max
  Coding DNA Sequence Number=SeqID_33750
  Gene Ontology: Mol. function=microtubule motor activity; Cellular component=microtubule associated complex; Biological process =microtubule-based movement
  Homolog annotation: Hit_ID=Q8W5R6; Match level="QueryCoverage=84%, HitCoverage=41%, E-value=1e-111, Identity=53%"; Hit description =Kinesin-related protein
  Subcellular localization annotation: CTP_CleavageSite=43; ConfidenceScore=5.06e-01
MVIAKLTDGKATHIPYRDSKLTRLLQSSLSGHGRISLICTVTPASSSSEETHNTLKFAHRSKHVEIKASQNKIMDEKSLIKKYQKEISELKQELQQLKRGMVENPNMAASSQEDLVTLKLQLEAGQSKLKSRLQEEEQAKAALMGRIQRLTKLILVSTKNAMSSSIAERPSHRRRHSFGEDELAYLPDRKRETWINDDTGSHASVPSPEEKDDITNLDELGKDYKRSKRRGMLGWLKLRKPDNIDGLSPNVDSEGSGNGSPASASKLTPNRVMLHDMKDSRRSSVRRKDNASSLNSFPGRTQAGDLFSVTVGGHQLPPVRSQILVIHIAGKAHDTCILKPTGTTVTDQMDLLREQIKMLAGEVAFCISSLKRLSEQAANKPEDIQLQEGMHKLKGEISQKKNQIRILEQRMIGSIGHAPNNSEMSQCATTHGEQMTKITFLKCPSNHSLDFGHRQHSDAIMPINAAIAATTTATAKCNGSALCTSTPLLHTIDNPDIN

SEQ ID NO: 150529 - protein, 50 aa, Glycine max
  Coding DNA Sequence Number=SeqID_33751
MVDASSSIRNVGLLLLRSRTYNHLLLKSEFCKRCGAALKLRDLLDAPSTL

SEQ ID NO: 150530 - protein, 140 aa, Glycine max
  Coding DNA Sequence Number=SeqID_33752
  Gene Ontology: Mol. function=aldehyde dehydrogenase [NAD(P)+] activity; Cellular component=chloroplast; Biological process =aldehyde metabolic process
  Homolog annotation: Hit_ID=Q70DU8; Match level="QueryCoverage=89%, HitCoverage=26%, E-value=2e-44, Identity=69%"; Hit description =Aldehyde dehydrogenase 3H1
MIAMLKNSCRIALKELKHWMTPEKVKTSIATFPSSAEIVSEPLGVVLVISAWNYPFLLSLDPVVGAIAAGNAVVLKPSEIAPATSSLLAKLIGDYLDNSCIRVVEGAVDETSALLQQKWDKIFYTGSCLSLFCFLGGSES

SEQ ID NO: 150531 - protein, 74 aa, Glycine max
  Coding DNA Sequence Number=SeqID_33753
MRINLNTLADQPIYSGTKVPEREMVLTSTVDDGEALHDNLLNAPHENLFTTIVVGEEEEETQALVKKKKKWQHG

SEQ ID NO: 150532 - protein, 117 aa, Glycine max
  Coding DNA Sequence Number=SeqID_33754
MLSESSNTKPHAKYRIMVKTRGLGRALGRVGARGLGRGGDGDDTDGAPQCQRPTASARRRRVLVILDDDVPVVPADSPAVPEAEVAIAGDESMVDVAAQATGAETDAQDTGAETDED

SEQ ID NO: 150533 - protein, 85 aa, Glycine max
  Coding DNA Sequence Number=SeqID_33755
  Gene Ontology: Mol. function=aldehyde dehydrogenase [NAD(P)+] activity; Cellular component=chloroplast; Biological process =aldehyde metabolic process
  Homolog annotation: Hit_ID=Q70DU8; Match level="QueryCoverage=81%, HitCoverage=14%, E-value=2e-11, Identity=52%"; Hit description =Aldehyde dehydrogenase 3H1
  Subcellular localization annotation: CTP_CleavageSite=58; ConfidenceScore=5.30e-01
MSSTPQDSVKTTASAKNTAFDAEAASRLVNELRRNFASNKTRSYEWRLSQLNALEKLVVVHEQEIVDALRNDLGKPPLETVAYEC

SEQ ID NO: 150534 - protein, 211 aa, Glycine max
  Coding DNA Sequence Number=SeqID_33756
MGDIDEVQEQMKDDMVALKDQMASMMEAMLSMKRLIESNAATTAATEADPNLSFATNQAYQPAPNMGGQGGEILGSTGGPHLGYNINAYPYGLPLNFTPPTMHENVDHAVPITFEAFHAMPQPNTVGASQPRSIQPLHFYVGGPPPIVEGKGKLNLTEERLRAVEASDSLAGAANTWYTSLEPSQIHSWKDRMVSFVRQYQYNADMAPDRM

SEQ ID NO: 150535 - protein, 127 aa, Glycine max
  Coding DNA Sequence Number=SeqID_33757
  Gene Ontology: Mol. function=RNA-directed DNA polymerase activity; Cellular component=intracellular; Biological process=RNA-dependent DNA replication
  Homolog annotation: Hit_ID=Q94HP1; Match level="QueryCoverage=97%, HitCoverage=16%, E-value=9e-33, Identity=52%"; Hit description =Putative retroelement
MKPEMSLRIKEEVKKQFDVGFLAVARYPEWVAKIVPVPKKDGKVMSFRLKNAGATYQRVMVALFHDMMHKEIEVYVDDMITKSRTEEEHLVNLRKLFERLCKYQLKLNPGKCTFWVKLGKLLGFIVS

SEQ ID NO: 150536 - protein, 146 aa, Glycine max
  Coding DNA Sequence Number=SeqID_33758
MGPDHAHQHDHPHTYMDEVSVHVAQLISDALYQFAGIAPKRHPMDSEKSNRALGPSSRNTAPPGRLRAKHHDSLGTANSRQLRMHHHHLLRLERCIRHVADQQVASHRGQAAVAWPGDWPDFSTGASGEGDRAQEDEDMADMLDFL

SEQ ID NO: 150537 - protein, 252 aa, Glycine max
  Coding DNA Sequence Number=SeqID_33759
  Gene Ontology: Mol. function=porin activity; Cellular component =integral to membrane; Biological process=transport
  Homolog annotation: Hit_ID=O24779; Match level="QueryCoverage=63%, HitCoverage=37%, E-value=3e-55, Identity=66%"; Hit description=OprE3
  Pfam annotation: Domain name=OprD; Domain location=90-252; Score= -94.0; E_value=1.4e-09; Accession=PF03573.4; Description=outer membrane porin, OprD family
AAASAGGIVGSLSQSQLGDVGEKLVNSQFSQRQESEADDYSYDLLRKRGINPSGLATSFEKLAKLEAGRQSSMFDDHPASEERAQHIRDRLFAALPAAASQQSDSQGFIDDSHLDLFLRNAYISRDYHQGQQDKAEWGQGIIATFTSGYTEGLVGFGVDGIAQYGVRLDGGRGKSGAGGIDFFKQEDDGRAKSDLAKFGATAKMRISNTVLSYGNQRPELPIVNADNSRLLFESYTGTLLTSKEIDGLEVNA

SEQ ID NO: 150538 - protein, 124 aa, Glycine max
  Coding DNA Sequence Number=SeqID_33760
  Subcellular localization annotation: CTP_CleavageSite=12; ConfidenceScore=5.02e-01
MQLSEDKVVNPQASASSATHGSGTRPRENRIEPAPTLTDKNRVDRVRGRVRVFPDNPKRGRGRVWDYSRYSYCSSQPLSQGEVVENVRPLKRGRNEEEVLLENVELILDAFDYLQLPFALKQGI

SEQ ID NO: 150539 - protein, 85 aa, Glycine max
  Coding DNA Sequence Number=SeqID_33761
MDKSLKVREYEWREKEREKRENERAFTKGDTQWLSTRKNPEEDELSGSLSAPLQVIKHTTLAHLLMRTKRSRFALSARARTNPPI

SEQ ID NO: 150540 - protein, 110 aa, Glycine max
  Coding DNA Sequence Number=SeqID_33762
  Gene Ontology: Mol. function=peptidase activity; Biological process =DNA integration
  Homolog annotation: Hit_ID=Q1SDG1; Match level="QueryCoverage=85%, HitCoverage=7%, E-value=1e-14, Identity=40%"; Hit description =Integrase, catalytic region; Zinc finger, CCHC-type
MASSNFLFPEGNSINRPPIFNGEGYHYWKIRMQIFIEAIDLNIWEAIEIGSLNPTTVVGNETIEKPRDQRDEDERKRVQYNLQAKNIITSALGMDEYFRVSNCKCGIHYK

SEQ ID NO: 150541 - protein, 85 aa, Glycine max
  Coding DNA Sequence Number=SeqID_33763
MVDERREEEGCALAQALEDQSYPKKEDIKWHLISDFFYKKAIGYVSPLSPPPSPIHLPCDSNSKDSSDEFFRKLDEDFVAAKQKG

SEQ ID NO: 150542 - protein, 367 aa, Glycine max
  Coding DNA Sequence Number=SeqID_33764
  Gene Ontology: Mol. function=transferase activity, transferring glycosyl groups; Cellular component=membrane
  Homolog annotation: Hit_ID=O80941; Match level="QueryCoverage=78%, HitCoverage=76%, E-value=1e-71, Identity=52%"; Hit description =Putative zinc finger protein
  Pfam annotation: Domain name=DUF604; Domain location=214-362; Score =98.0; E_value=2.9e-26; Accession=PF04646.3; Description=Protein of unknown function, DUF604
EKKMNHTRLESCHESPLKVYKFCFVPEKLGDMVILLIRFGILVCLVASISLALHSAFSKPDRWFPLPEHIRAVQNTSVIDNRPTNISHLQFGIAGSANTWHGRSNYTKLWWDPNTTRGYVWLDKKPKILHSDILVPPYQISRGWTRFKHVHSASAVRIARIVYESFKLGLPNVRWFVMGDDDTVFFTENLVTVLGKYDHNEMYYIGGNSESVEQDVMHSYNMAFGGGGFAISYALAAQLAKIMDGCLSRYFYFYGSDQRVWACIHEIGVPLTRENGFHQDGPFIFNTRPMSSDPCQQPARFFLDQATKVGKSGSITIYKRHEGKEAKCNREGTNNEEVQRIRVSALKLDPEYWKNNFLACHDSNVLE

SEQ ID NO: 150543 - protein, 99 aa, Glycine max
  Coding DNA Sequence Number=SeqID_33765
  Subcellular localization annotation: CTP_CleavageSite=52; ConfidenceScore=5.23e-01
MTTDSPSLLMFPWTRWSRQLSQPTLRREGDARLTSTSSKEGKRAESPPKFIRGKRRKNRKRGDLRTLSAKGSGVVFMHGEGCFPFSYVFLNCDKEIRPT

SEQ ID NO: 150544 - protein, 393 aa, Glycine max
  Coding DNA Sequence Number=SeqID_33766
  Gene Ontology: Mol. function=RNA-directed DNA polymerase activity; Cellular component=chromatin; Biological process=chromatin assembly or disassembly
MGDVQATLQSLAQQMQQQSLIMSELSKQIAQKGVNQESENSVGESSQEESRLSGKKVKLPLFEGDDLVAWITRVEIYFDVQNTTDKMRVKLARLSMEGSTIHWFNLLMETEDELSWEKLKRALIARYGGRRLENPFEELSTIRQKGSVEEFVEAFELLSSQVGRLPEEQYLGYFMSGLKPQIRRRVRTLNPLNRMQMMRIAKDVEEELKEEDEDGERSDSKKGVQDRMGRNNWAGSFQKSRSGLNPRDPIRSPNLGWSNPTQKTGSSGSNTISTLSLASTGRKGETDTRTGVSEKWKGVRSIRNNEMAERRAKGLCFKCGGKYHPTLHKCPERALRVLILGEGEALNDEGEIMAMEAVQPDSEEEIEVECKSMGVLGSMGEHRTMKIEGKIEN

SEQ ID NO: 150545 - protein, 272 aa, Glycine max
  Coding DNA Sequence Number=SeqID_33767
MELAKREQVNRFTKIAAPSGLLNDLNPGIINHVRNRKQVLSIIENLVRSEKHESTSVGSKHAAHCIQGNVEVSKRDQENVADVSEHQHDFACEEGALHSTSGSRQARKFPVTTNDSSSLILEGRVCDCDIGSLDKGSLKSCMTQSTNVVEDDALALKLSSEMRASMSSTAATVASQWLELLQHDIKGRLSALRRSRRKVQSVITTELPFLLSKEFGNNQDYDPCTMKMSAGLPTGKIADMHRARWTSLFDHMDEALSEEEKKLVSAKKTALF

SEQ ID NO: 150546 - protein, 90 aa, Glycine max
  Coding DNA Sequence Number=SeqID_33768
MNASESGGEKVKEKENEFERNKRIWIENLKKEVARAMLQPENEEWCLKIAVNMASRSNTERGARTCARVNQQNNATDLATQPSQEKQEGG

SEQ ID NO: 150547 - protein, 161 aa, Glycine max
  Coding DNA Sequence Number=SeqID_33769
  Homolog annotation: Hit_ID=Q1S6A6; Match level="QueryCoverage=51%, HitCoverage=14%, E-value=8e-09, Identity=40%"; Hit description=FAR1
MMSIKVDLDGDQIKNPVFDSEEKAFDSYTRYATSHGHVVRKDGVSRDVHGKAIKHKAHSLHSFDVRTCYIMGCLLAQKGSYGSVCFEKSDLYNHLHRKKCLLITEGDVRVALSYLKGQYVVSTSPFLKSALFLNLHTHQQEAYQNICLGFGTFLTLKQLPS

SEQ ID NO: 150548 - protein, 134 aa, Glycine max
  Coding DNA Sequence Number=SeqID_33770
  Gene Ontology: Mol. function=oxidoreductase activity; Cellular component=cytoplasm; Biological process=metabolic process
  Homolog annotation: Hit_ID=Q10NH5; Match level="QueryCoverage=96%, HitCoverage=53%, E-value=5e-44, Identity=62%"; Hit description =Tropinone reductase, putative, expressed
MATNLDSAYHLSQLAYPLLKASGNGSIVFISSVEAAIDQLTKYLACEWAKDNIRSNSVAPWYTLTSLEEPLLANKQLVNEITSQTPIKRMAETHEVSSLVTFLCLPAASYITGQIVSVDGGFTANGFQPSMRIS

SEQ ID NO: 150549 - protein, 177 aa, Glycine max
  Coding DNA Sequence Number=SeqID_33771
  Homolog annotation: Hit_ID=Q851B2; Match level="QueryCoverage=60%, HitCoverage=29%, E-value=6e-20, Identity=43%"; Hit description =Putative ATP synthase subunit
MLLVYVDEVKEYAMKQIKSQYKNKLYHLHQAYLKEKDRSKFVSREDWNWLIKNKWSGSKFQERSLTNKANRSKQEIKSIIGTKSIVQKAFEMKEDSKYGKWPYALEVWKATHMRSNGTWCIPKGEEIMKALENVGDIYQEEISKAPIPLVENFAMLSSQTNCHAMHINHCTICIWFM

SEQ ID NO: 150550 - protein, 63 aa, Glycine max
  Coding DNA Sequence Number=SeqID_33772
MLVKNLVGRLGVYDKTNYTLTSQVTLTRLKGAIKPSVFTPNAYTLKSPSGPLPPDSSPTQKIF

SEQ ID NO: 150551 - protein, 236 aa, Glycine max
  Coding DNA Sequence Number=SeqID_33773
MPLKGKHLMMCPSLTPRGGPQYHPQPQPLPFAMGRVPLAMVEREKFNHIEERLRAIEGGRYNAFADMAELCLVPDVIISPKFKVSDFDKYKGTTCPKNHLKMYCRKMGAYAKDEKLLMHFFQESLIGAAVTWNLATQVAPPMMEMEMITMIIDTLPVFYYEKIEVAMIRDKFDYLALMNGKPGENGENENEGGTHAVIVVPTWPNCPPAQQYQYSANISPSHYPPSYQPRTLNHPQ

SEQ ID NO: 150552 - protein, 52 aa, Glycine max
  Coding DNA Sequence Number=SeqID_33774
MERSNRKRISYEGTYSAGTSGGLQTHGDNGDNARRIEEAGIELMMSCVSNAW

SEQ ID NO: 150553 - protein, 82 aa, Glycine max
  Coding DNA Sequence Number=SeqID_33775
MGKMAMITYHRGRLPYQDSFKALEADIQHTNALVCEVLCKTCDRNANGGKSNLRILQQDELLVHSNKQWQSNLQTPTKANQF

SEQ ID NO: 150554 - protein, 145 aa, Glycine max
  Coding DNA Sequence Number=SeqID_33776
  Gene Ontology: Mol. function=DNA binding; Biological process=DNA integration
  Homolog annotation: Hit_ID=Q1T010; Match level="QueryCoverage=69%, HitCoverage=7%, E-value=3e-19, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MANNSGIKNLNDSRNPRSRMGQGGGNLLENLPILDDKNWHWWYARMKVILGYQEVLEIVEKGYSSLAEDATKEQKVAYNENKKNDCKALCLIYQSVDNAHFEKIVGAKTSSEAWKILEKGNEGAVEEGVSSNDAHTIQIDADGEK

SEQ ID NO: 150555 - protein, 71 aa, Glycine max
  Coding DNA Sequence Number=SeqID_33777
MSPIIDELTSELRTKRGDAPTNVSDQCPCDTPALASHLKEVSLAIRELLKEAFSKKLLKEVFSRKLLKEAT

SEQ ID NO: 150556 - protein, 111 aa, Glycine max
  Coding DNA Sequence Number=SeqID_33778
MIESTGSLMRIMKLAKYRLKAQVEKDEGLSGEGQSPRVEKDEGPSSLLNQYQTYQGNPCGVYPDLSSFIGSGVYPDLSSFTGSGIIQISIACIKRFAPTQVHIIWYQSFGS

SEQ ID NO: 150557 - protein, 329 aa, Glycine max
  Coding DNA Sequence Number=SeqID_33779
  Gene Ontology: Mol. function=transmembrane receptor activity; Cellular component=membrane; Biological process=defense response
  Homolog annotation: Hit_ID=Q2HUN2; Match level="QueryCoverage=56%, HitCoverage=30%, E-value=2e-11, Identity=33%"; Hit description=TIR; Disease resistance protein
  Pfam annotation: Domain name=LRR_1; Domain location=124-145; Score =16.6; E_value=0.09; Accession=PF00560.23; Description=Leucine Rich Repeat
  Pfam annotation: Domain name=LRR_1; Domain location=147-172; Score =5.5; E_value=27; Accession=PF00560.23; Description=Leucine Rich Repeat
  Pfam module annotation: Pfam domain module=LRR_1::LRR_1; Domain location=124-145::147-172
MDMKINQEEQFPIAKGTDAVEGITLDLSELTWDLYLSSNSLAKLSNMRFLKIHDWCCTFGFNVYLSNGLDSWDGFSLESLPYNFCRDFHNLDSVGNKLLSDDQHNASNLLFLKALLHNIGYLVSLRELDLRGTSVESLPANIQNLSMLTTLWLDDCRKLMSLPKLPPYLEQLRAFNCTLLETDTTQRLVLQHMLQSSIPSYMHKQRVYSGGGYFILAGDHVTNECGRHVGWNDKSTVHCANLISDLVLFLYHDVCKVYRESKVHSSSDMPFNFEFDYYDVKVGRDKRSIKGCGVFPVYFSTLGLKLVSSSSSSSKEVEPQIMKMNRTSS

SEQ ID NO: 150558 - protein, 241 aa, Glycine max
  Coding DNA Sequence Number=SeqID_33780
  Gene Ontology: Mol. function=nucleic acid binding; Cellular component= chromatin; Biological process=DNA integration
  Homolog annotation: Hit_ID=Q1T010; Match level="QueryCoverage=95%, HitCoverage=19%, E-value=1e-72, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=41-208; Score =108.2; E_value=2.4e-29; Accession=PF00665.16; Description=Integrase core domain
MLHTNNLVNGLPQIKNPQVVCEKCLVSKQPRSAFGSYVPSRASDLLNIIYSDVCGPFEVSSLGGNTYFVSFVDEFNKKLLTYPLKAKSEVFDTFKVFKILVEKQSGKSLKILRTDGGGEFTFEEFENFCRDNGIIHEITTSYTPHHNGVAERRNRTIMNMNSVSLVPEKVWSGRKPLVQHLRVFGTLCYTHVPDQKRRKLDDKSEAMIFIGYHPTSSYKLYNPKKKKVIYSRDVQFDELKY

SEQ ID NO: 150559 - protein, 155 aa, Glycine max
  Coding DNA Sequence Number=SeqID_33781
  Gene Ontology: Mol. function=nucleic acid binding; Cellular component= chromatin; Biological process=DNA integration
  Homolog annotation: Hit_ID=Q1T010; Match level="QueryCoverage=76%, HitCoverage=12%, E-value=4e-27, Identity=37%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MENSIRHQDEAIPHGEGNAKQITEQIRSGRMGRMLARLRDYHMFPDSAITDEGEFMNIALMTTIEPKFDGNIAKHKARLVVKGFMQKEGEGYLEIFAPMARFETIRFLVSLASWKNWKIWQLDVKFAFLNGPLDEEVYIQQPPGYEVIGSEDKMY

SEQ ID NO: 150560 - protein, 72 aa, Glycine max
  Coding DNA Sequence Number=SeqID_33782
  Homolog annotation: Hit_ID=Q9SJT1; Match level="QueryCoverage=42%, HitCoverage=4%, E-value=8e-08, Identity=70%"; Hit description =Putative ubiquitin activating enzyme
MTYCLEHPARNMLLMLVEPFEPNKSCYVCSEVCQISPPRQPSSSAIKDEMKYGATERENEVLLLLYHQSNTN

SEQ ID NO: 150561 - protein, 105 aa, Glycine max
  Coding DNA Sequence Number=SeqID_33783
  Homolog annotation: Hit_ID=Q5W7C9; Match level="QueryCoverage=51%, HitCoverage=20%, E-value=3e-20, Identity=83%"; Hit description =Unknow protein
LFLDGGKGYNSAVECHLDVVEARGITRGVGGLYFWERTPVEYEAPGYKLCLGMEENSESALSTNKEAISNATRNLMESSILAQDERWRHALHMQVGREVVFPVAD

SEQ ID NO: 150562 - protein, 285 aa, Glycine max
  Coding DNA Sequence Number=SeqID_33784
  Gene Ontology: Mol. function=RNA-directed DNA polymerase activity; Cellular component=chromatin; Biological process=chromatin assembly or disassembly
  Pfam annotation: Domain name=Chromo; Domain location=180-234; Score =38.7; E_value=2e-08; Accession=PF00385.14; Description='chromo' (CHRromatin Organisation MOdifier
QPKTWSNWISWAEYWYNTTYHVSIGKTPFEVVYGRQPPSILRFLTNETKVAAVAMELSERDEALNQLKLHLSRAQDQMASYVNKKRRDLSFVIGEWVFLKLRPHRQHSVVKRINQKLSARFYGPFKILAKIGEVAYRLQLPEQSRIHPVFHVSLLKKAIGEYQVQGELPKDLEITDAADAYPEQVMGSRVIMQGGVAVHQSLIKWKHNSLDDVTWEDDAFLRGQFPDFSLEDKAISKEQGVDRNIDPETSAFVFVTASTLLCELLFALFPELLVVEKGFTAIRTS

SEQ ID NO: 150563 - protein, 130 aa, Glycine max
  Coding DNA Sequence Number=SeqID_33785
MEEEVDPSIKREKHKENGVTNVGCEDDFLDSPITKFYQEGSPSSLDMELRQKGCTEPVKLIKVIWSPPLSLLPPKPLNLNLHARIVGRSQLSYKGFIVGSSALAMLQANSLGHEGECWKATSIAVTPNPS

SEQ ID NO: 150564 - protein, 60 aa, Glycine max
  Coding DNA Sequence Number=SeqID_33786
MVDTRHECWLNQVKEKQLLCDQGIQHVNWSSVFGLQQLGNSENNSRIWTSCLTQPLKTEL

SEQ ID NO: 150565 - protein, 175 aa, Glycine max
  Coding DNA Sequence Number=SeqID_33787
MIVTHLRSKGVALRSSERKSSMKKKKTRKKRRRSEYEVVKGRYIYLLEIKGYGWYILYIYLLEIKWIGFFDIHELVYARLVKDFFVALVVDNTNFTLKAILKSTKVLIIEKHLSNLLGVHVDSKRLYGDLFDITCLKKSKIMKKLLKENDDEFKSKFLTSFGRIVHWICMHSVLP

SEQ ID NO: 150566 - protein, 194 aa, Glycine max
  Coding DNA Sequence Number=SeqID_33788
  Homolog annotation: Hit_ID=Q1SUM5; Match level="QueryCoverage=33%, HitCoverage=61%, E-value=9e-10, Identity=45%"; Hit description =Polynucleotidyl transferase, Ribonuclease H fold
MEISLIIAQIEESQEATMTRWSNKRKQIYKKSVYDSSTWKDKETFKKEGGFSFKSHEKGLHCVPISYKSAMVVLDNGDITSASSSSSSSFSSESESKCDVQPLKVFGTEEMRRSGKGSTTLCNAKWIRPPTAYLKGNVDAALFMDLGIFGVSTCISDYLGEFASARTTWCFGNPSPREAEAIGLLSTKKWIEES

SEQ ID NO: 150567 - protein, 1432 aa, Glycine max
  Coding DNA Sequence Number=SeqID_33789
  Gene Ontology: Mol. function=phosphoribosylformylglycinamidine synthase activity; Cellular component=chloroplast; Biological process=purine nucleotide biosynthetic process
  Homolog annotation: Hit_ID=Q84XV9; Match level="QueryCoverage=90%, HitCoverage=99%, E-value=0.0, Identity=91%"; Hit description =Phosphoribosylformylglycinamidine synthase
  Pfam annotation: Domain name=AIRS; Domain location=346-521; Score =52.0; E_value=2.1e-12; Accession=PF00586.14; Description=AIR synthase related protein, N-terminal domain
  Pfam annotation: Domain name=AIRS_C; Domain location=531-675; Score =59.6; E_value=1e-14; Accession=PF02769.12; Description=AIR synthase related protein, C-terminal domain
  Pfam annotation: Domain name=AIRS_C; Domain location=913-1059; Score =89.0; E_value=1.4e-23; Accession=PF02769.12; Description=AIR synthase related protein, C-terminal domain
  Pfam module annotation: Pfam domain module=AIRS::AIRS_C::AIRS_C; Domain location=346-521::531-675::913-1059
  Subcellular localization annotation: CTP_CleavageSite=56; ConfidenceScore=5.63e-01
MATATEFGVSQFLKGTSRQTLFLKKKPQRQKSRMLWGALWNRNWGLGSTRRALPLRCQTQENPRAVVSGGVSSSVEEQPALFEKPASEVVHLYRVPFMQESAAAELLKEAQVKISSQIVEILTEQCYNVGLSSQLSGGKFSVLGWLLQETFEPENLGTESFLEKKRKEGLIPVIVEVGPRLSFTTAWSTNAVAICQACGLTEVNRLERSRRYLLFTTTELQDYQINDFASMVHDRMTECVYIQKLTSFETSVVPEEIHYIPVMERGRKALEEINLEMGFAFDDQDLEYYTKLFREDIKRNPTNVELFDIAQSNSEHSRHWFFTGKIFIDGQPVNRTLMQIVKSTLQANPNNSVIGFKDNSSAIRGFPVKQLRPVQPGSACPLEVAVHELDILFTAETHNFPCAVAPYPGAETGAGGRIRDTHATGRGSFVQAATAGYCVGNLNTPGFYAPWEDPSFTYPSNLAPPLQILIDSSNGASDYGNKFGEPLIQGFCRTFGMRLPGGERREWLKPIMFSAGIGQIDHLHISKGEPDIGMLVVKIGGPAYRIGMGGGAASSMVSGQNDAELDFNAVQRGDAEMAQKLYRLVRACIEMGDKTQLSAFMIRELGAEIDVRAIVVGDHTMSVLEIWGAEYQEQDAILVKPESRDLLESICNREKVSMAVIGTISGDGRVVLVDSVAAQKSISNGLPPPPPAVDLELEKVLGDMPKKTFKFNRVVYEREPLDIVPGIEVIDSLKRVLSLPSVCSKRFLTTKVDRCVTGLVAQQQTVGPLQIPIADVAVTAQTFADVTGGACAIGEQPIKGLLDPKAMARLAVGEALTNLVWAKVTSLSDVKASGNWMYAAKLDGEGADMYDAAISLSEAMIELGIAIDGGKDSLSMAAHAESEVVKAPGNLVISVYVTCPDITKTVTPDLKLKDDGILLHIDLSKGKRRLGGSALAQAFDQVGNECPDLDDVPYLKKVFEGVQDLLSDELISAGHDISDGGLLVCALEMAFAGNCGLSLDFASQGNSLFQTLYAEELGLVLEVSKKNLALVVNKLSNVGVSAEIIGQVTANPSIEVKVDGETYLTEKTSILRDMWEETSFQLEKFQRLASCVDMEKEGLKHRYEPSWELPFTPSFTDEKLMSATIKPKVAVIREEGSNGDREMAAAFYAAGFEPWDITMSDLLNGKISLLDFRGIVFVGGFSYADVLDSAKGWSASIRFNESVLQQFQEFYKRPDTFSLGVCNGCQLMALLGWVPGPQVGGVHGAGGDLSQPRFIHNESGRFECRFTSVTIKDSPAIMFKGMAGSTLGIWAAHGEGRAYFPDEGVLDRIVHSELAPIRYCDDAGNPTEAYPFNANGSPLGVAAICSPDGRHLAMMPHPERCFLMWQFPWYPKQWDVEKKGPSPWLRMFQNARECMKLEALQDEYIRYATEKCSSMPKEYYSVFETITGLVLL

SEQ ID NO: 150568 - protein, 114 aa, Glycine max
  Coding DNA Sequence Number=SeqID_33790
MEESNRENNKDHISQSRGSALDGEEHVGEWKNPIGKITKITFPSQEGPLLTVKNTLENGGFNRENNKSHINQSRGSALDGEEHIGEWRNPSGKLQRSHFPVMKSSLDREEHIGQ

SEQ ID NO: 150569 - protein, 69 aa, Glycine max
  Coding DNA Sequence Number=SeqID_33791
MLTAAEGSIWAPDWVFVKTKTQHHFPWSDNKGLRATMLVQVQQPLIFIKIDLTATVPLARWETNESFPP

SEQ ID NO: 150570 - protein, 175 aa, Glycine max
  Coding DNA Sequence Number=SeqID_33792
  Gene Ontology: Mol. function=molecular_function; Cellular component =cellular_component; Biological process=regulation of progression through cell cycle
  Homolog annotation: Hit_ID=Q9LZL8; Match level="QueryCoverage=97%, HitCoverage=68%, E-value=3e-52, Identity=59%"; Hit description =Thaumatin-like protein
  Pfam annotation: Domain name=Thaumatin; Domain location=8-173; Score =70.6; E_value=5e-18; Accession=PF00314.8; Description=Thaumatin family
MEDTLHLNMVDSTLEAAKRLLSKSLRVGDCGGLLQCNGIGGIPPATLVEITLGTSQSPLHFYDVSLVDGFNLPASVKPAGGGGAGCGIAACEVNLNVYCPSSLVVERNGKVVGCKSVCLAAKSDRYFCTGEFAGRCKPTVFAHLFKIICPNSYSYAYVVKTCVAPRYVIIFCPAH

SEQ ID NO: 150571 - protein, 666 aa, Glycine max
  Coding DNA Sequence Number=SeqID_33793
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=86%, HitCoverage=85%, E-value=0.0, Identity=62%"; Hit description=Lectin -like receptor kinase 7;3
  Pfam annotation: Domain name=Lectin_legB; Domain location=27-264; Score=357.3; E_value=2.4e-104; Accession=PF00139.10; Description =Legume lectin domain
  Pfam annotation: Domain name=Pkinase; Domain location=343-614; Score =165.1; E_value=1.8e-46; Accession=PF00069.15; Description=Protein kinase domain
  Pfam annotation: Domain name=Pkinase_Tyr; Domain location=343-614; Score=105.5; E_value=1.6e-28; Accession=PF07714.7; Description =Protein tyrosine kinase
  Pfam module annotation: Pfam domain module=Lectin_legB::Pkinase::Pkina se_Tyr; Domain location=27-264::343-614::343-614
MAKTKTPVLVLHLCVLTLMATNLGKCQQEEFFFNGFGGGGASNITLNGGAAIEHKGLLRLTNDNQRVIGHAFYPTPIQFKHKNAKVVSFSTAFAFAIIPQYPKLGGHGFAFTISRSTSLKDAYPSQYLGLLNPNDVGNFSNHLFAVEFDTVQDFEFGDINDNHVGINLNNMASNKSVEAAFFSRNNKQNLNLKSGEVTQAWVDYDSLKNNLEVRLSTTSSKPTSPILSYKVDLSPILQDSMYVGFSSSTGLLASSHYILGWSFKTNGDAKTLSLKNLPSLSASYKAQKRLMLALIIPITLAAIALACYYRKMRKTELIEAWEMEVVGPHRFPYKELHKATKGFKDQNLIGFGGFGRVYKGVLPKSHIEVAVKRVSHESKQGMQEFVSEISTIGRLRHRNLVQLLGWCRKQNELLLVYDFMRNGSLDKYLFFDQPRRILSWEQRFKIIKGVALGLVYLHEEWEQTVIHRDVKAGNVLLDNEMNGRLGDFGLAKLYEHGANPGTTRVVGTLGYLAPELTRTGKPTTSSDVYAFGALVLEVVCGRRPIEVKAQPEELVLVEWVWERWRVGNVLAVVDRRLGGVFDEVEALLVVKVGLLCSAEAPEERPSMRQVVRYMEREVAPPEVGDGKKEGGGGDGEFKGYVHSYSTASFFDVESASASSLSLSGGR

SEQ ID NO: 150572 - protein, 772 aa, Glycine max
  Coding DNA Sequence Number=SeqID_33794
  Gene Ontology: Mol. function=protein dimerization activity; Cellular component=chromatin; Biological process=electron transport
  Homolog annotation: Hit_ID=Q9LIE1; Match level="QueryCoverage=96%, HitCoverage=98%, E-value=0.0, Identity=49%"; Hit description =Transposase-like protein
  Pfam annotation: Domain name=DUF659; Domain location=224-376; Score =264.5; E_value=2.1e-76; Accession=PF04937.6; Description=Protein of unknown function (DUF 659)
  Pfam annotation: Domain name=hATC; Domain location=574-662; Score =32.1; E_value=2e-06; Accession=PF05699.5; Description=hAT family dimerisation domain
  Pfam annotation: Domain name=zf-C2HC_plant; Domain location=16-72; Score=100.1; E_value=6.7e-27; Accession=PF07567.3; Description =Protein of unknown function, DUF1544
  Pfam module annotation: Pfam domain module=DUF659::hATC::zf-C2HC _plant; Domain location=224-376::574-662::16-72
MGSNLEPVPITSQKHDPAWKHVQMFKNGDKVQLKCIYCLKMFKGGGIHRIKEHLACQKGNASTCSRVPHDVRLHMQQSLDGVVVKKRRKQRIEEEIMSVNPLTTVVNSLPNNNQVVDVNQGLQAIGVEHNSTLVVNPGEGMSRNMERRKKMRAAKNPAAVYANSEDVVAVEKNGLFPKKMDNHIYMAIGRFLYDIGAPFDAVNLVFFQEMVDAIASKGTGFERPSHHELRGWILKNSVEEVKNDIDRCKMTWGRTGCSILVDQWTTETSRILISFLAYCPEGLVFLKSLDATEILTSPDFLYDLIKQVVEEIGVGKVVQVITSGEEQYGIAGRRLMDTFPTLYWSPSAAHCIDLILEDFGNLEWISAVIEQAKSVTRFVYNYSAILNMVKRYTLGNDIVDPSFSRFATNFTTLKRMVDLKHNLQALVTSQEWADCPYSKQTAGLEMLDCLSNQTFWSSCDMIVCLTAPLLKVLRIAGSEMRPGMGYVYAGMYRVKEAIKKALGKREEYMVYWNIIHHRWERLWNHPLHAAGFYLNPKFFYSIQGDILGQIVSGMFDCIERLVPDTRIQDKIIKEINLYKSAAGDFGRKMAVRARDNLLPSEWWSTYGGGCPNLSRLAIRILSQTSSVMSCKRNQVPFEQIINTRNYIERQHLTDLVFVHCNLRLRQMFMSKEQNFSDPLSFDNVSNVEEWIRPRDLYVDDECGNSDWMALDPSSVNTMLLRPLNDETEDLGEGYDDYEIFSFGKDSEDENTGDKLCNINVFPLFSQVVVGRN

SEQ ID NO: 150573 - protein, 277 aa, Glycine max
  Coding DNA Sequence Number=SeqID_33795
  Gene Ontology: Mol. function=RNA-directed DNA polymerase activity; Cellular component=chromatin; Biological process=RNA-dependent DNA replication
  Pfam annotation: Domain name=RVP_2; Domain location=31-132; Score= -57.2; E_value=0.029; Accession=PF08284.2; Description=Retroviral aspartyl protease
MTKPSLGRWQRVQEQQQLQLSGHIVKDCWSTPKRSNNHGSGAKVEYKNNYESKVAKSDEVVVSTPTDKPITTSNACLDFSMMVNDKTFSVNLICWPLSHLDVVLGMDWLSSNHVLLNCKNKTLIFGACAQGIPRSSSLEISHMSESCIGEMPIVYEFPQVFPEDVTELPPKRELEFSIDLVSQSSLVSIAPYQMSPMELAEVKEQVEDLLNNQFVRPSVSSCGTQMLLVKKKKGSMKMCVDYRKLNKVTIINKYPLLSIHDLVDQLRGASVFSKIDL

SEQ ID NO: 150574 - protein, 67 aa, Glycine max
  Coding DNA Sequence Number=SeqID_33796
MVGRPNNTTAELLPHMTQVLETLVQDHDVEQIEYRGLPTFTKHNPPKFEGNFDPEGAYMHKDRNTFP

SEQ ID NO: 150575 - protein, 111 aa, Glycine max
  Coding DNA Sequence Number=SeqID_33797
MNHTTSEPNASDLYYPQPLLSNKPSTPKPPHLPYSSHTERAITADHHHQPPSNTQPLMTKKPQPESLFSVYETNPIFVTLSLCGGWGVRIAPLRLRLRRSLLRLSPLEQPW

SEQ ID NO: 150576 - protein, 99 aa, Glycine max
  Coding DNA Sequence Number=SeqID_33798
MTSWDAWFHSMIGGLAVWENILVPVQFHAPIGRNKTDMIKEVPMNTRREYVKVSFNPSCSLDKGLWDLRGIYIGSKTDVESDDVECIIINIGFQKPMLT

SEQ ID NO: 150577 - protein, 335 aa, Glycine max
  Coding DNA Sequence Number=SeqID_33799
  Homolog annotation: Hit_ID=Q1SMR0; Match level="QueryCoverage=32%, HitCoverage=34%, E-value=1e-42, Identity=75%"; Hit description=Short- chain dehydrogenase/reductase SDR
RINNVALREQLSDVESLSEELIDRTLPTFLQQVEDGTWTSGGWPQVYTDYSVSKLAVNAYTRLMARKLFERPEGQKIYINCYCPGWVKTALTDYVGNNTVEEGTDAGVNNLIEEESKWKVGNGIKIDVWRDEWIPNTIHNKVSCQPQNEVEDQMTETLIRSIFSEHDAQQFLGIPLRMFPDQDRVVLKYSEDGWGVHDILSVIVAPKRRNLVWRTRKGIVSVRKTLRRKIQVLDPISPAAERMKRQLNPASCIVKRSNKYETKDRGLCTADVWDVMNGIGIGMGVVCRDLEGNVLASATSQLPYVPFPKIAEVLVPEMDPSSNKGSSFPKFHLGN

SEQ ID NO: 150578 - protein, 112 aa, Glycine max
  Coding DNA Sequence Number=SeqID_33800
  Gene Ontology: Mol. function=serine carboxypeptidase activity; Cellular component=cellulose and pectin-containing cell wall; Biological process=proteolysis
  Homolog annotation: Hit_ID=Q1M2Z7; Match level="QueryCoverage=92%, HitCoverage=44%, E-value=3e-27, Identity=57%"; Hit description =Serine carboxypeptidase II
  Pfam annotation: Domain name=Peptidase_S10; Domain location=11-112; Score=-205.6; E_value=0.021; Accession=PF00450.12; Description =Serine carboxypeptidase
MGYGPFHCQEFGWGIVRSTWLVWEVANVLYLESPAGVGFSYSSNTLTDEITARDNLIFLQRWFTEFPEYSKNDIFITGESYAGHYAPQLAQLIVQTKTNFNLKGVALSIGKF

SEQ ID NO: 150579 - protein, 153 aa, Glycine max
  Coding DNA Sequence Number=SeqID_33801
  Homolog annotation: Hit_ID=Q9C9V9; Match level="QueryCoverage=47%, HitCoverage=9%, E-value=5e-09, Identity=43%"; Hit description =Putative golgi transport complex protein; 67058-70172
RGVGVKDAAAEDGERVTLVDEGVDVEGNGNILGPYPLPPKMVYISNTTVTLLWADDFGHKRSAPLRFRSENPPLPNDTKINDVFVAKAENPEEELSSLGKIEFFGVDGGHVVAELIREAEGMDAVLEELDGAMEVGELGSFGGDGAMTVGELE

SEQ ID NO: 150580 - protein, 128 aa, Glycine max
  Coding DNA Sequence Number=SeqID_33802
  Gene Ontology: Mol. function=zinc ion binding; Biological process =cell redox homeostasis
  Homolog annotation: Hit_ID=Q1SYU4; Match level="QueryCoverage=90%, HitCoverage=31%, E-value=1e-29, Identity=52%"; Hit description=Zinc finger, RING-type; Thioredoxin-related; RINGv
MAAFEAGGCSYRSEAGAGAVVVEEFKAATFILRGGCAAAEDDDGVEGGAVAAVAAGAAEGSGAGGVVRGRALADHVHGGGGEALAAAGVEVDGAGRVFDFFDEAAVAVGTDDGVVGPDANEAAAAVAP

SEQ ID NO: 150581 - protein, 154 aa, Glycine max
  Coding DNA Sequence Number=SeqID_33803
MSKREHESFKEYAQQWRDLAAQVAPPMVEREMITMIVDTLLLFYYEKLVGYMPASFADLVLARERIEVGLKRGKFDYVSPAGTNNRRTRTVGEKRKEGDAHAVTSTPAWPKPYQASHGTHQYAHHHSSFSARAGSSSCSALVQPRTRSVFLCFF

SEQ ID NO: 150582 - protein, 83 aa, Glycine max
  Coding DNA Sequence Number=SeqID_33804
  Subcellular localization annotation: CTP_CleavageSite=73; ConfidenceScore=5.24e-01
MGNEIERKRRPVTTTSSRTPHTTTSTRTPHFGHGGHPMSGTLGAHVSTTTSLRAHVDEASLVGANVDFSPSLRANDGSTPSFG

SEQ ID NO: 150583 - protein, 44 aa, Glycine max
  Coding DNA Sequence Number=SeqID_33805
MLDFSMAKRGLCVKPECYSIEAELSAPCCAKLQLSSVLKIVDLG

SEQ ID NO: 150584 - protein, 116 aa, Glycine max
  Coding DNA Sequence Number=SeqID_33806
  Subcellular localization annotation: CTP_CleavageSite=70; ConfidenceScore=5.22e-01
MMHEPHPNFFALTLNNCKNKWKKCFDYHFVQGQSTNSIANNTTPTLISNRRSSDSLVGVAINLLPPPDTRAVELLPHHLLVAYGCICRGRSRSVSNNSVTNAIVVQLMAAFEIEGW

SEQ ID NO: 150585 - protein, 144 aa, Glycine max
  Coding DNA Sequence Number=SeqID_33807
MDDKVGENTRPRLEGACGVVVPWGTFRQTFLEMYFSEDVNHRKDMEFLKLKQGSMTVEKHAARNANANHGKEKKPMTHSHVKSYSTLPGKYGNHFGGQRTNGFQLASGGFHSASGSSQPVKRVSQPTSRSCGGSGAPATLAMPS

SEQ ID NO: 150586 - protein, 66 aa, Glycine max
  Coding DNA Sequence Number=SeqID_33808
MEHETFLATWLAEIDSSPDGLRFSNLQPQPRLINHEKPMLCRWHKLNPLKIEGRRFALDSAKDYFP

SEQ ID NO: 150587 - protein, 287 aa, Glycine max
  Coding DNA Sequence Number=SeqID_33809
  Gene Ontology: Mol. function=metal ion binding
  Homolog annotation: Hit_ID=Q10NE1; Match level="QueryCoverage=95%, HitCoverage=96%, E-value=2e-74, Identity=55%"; Hit description=Zinc finger family protein, putative, expressed
  Pfam annotation: Domain name=zf-C3HC4; Domain location=226-266; Score= 37.2; E_value=5.6e-08; Accession=PF00097.15; Description=Zinc finger, C3HC4 type (RING finger)
MSFVFRGTRADIENGFPGFIPERRALRVHATRPSNSNSLTFLVTGPIYALLLICFSSSVIHDTELSPDVPKLSGKLWLVLGVFLMATMLRMYATCQQLQAQAQAHAAAASGILGHTELRLHMPPSIALASRGRLQGLRLQLALLDREFDDLDYETLRALDSDNVSTAPSMTEEEINALPVHKYKVSGPQCGGSSMQQASSSTPAEKKQDNSNAVGSMKASDDDLTCSVCLEQVNVGDVLRSLPCLHQFHANCIDPWLRQQGTCPVCKFRAGSGWSDNGHNDIIADMV

SEQ ID NO: 150588 - protein, 260 aa, Glycine max
  Coding DNA Sequence Number=SeqID_33810
  Gene Ontology: Mol. function=isomerase activity; Biological process =protein folding
  Homolog annotation: Hit_ID=Q1SYU9; Match level="QueryCoverage=89%, HitCoverage=98%, E-value=8e-63, Identity=57%"; Hit description =Peptidylprolyl isomerase, FKBP-type
  Pfam annotation: Domain name=FKBP_C; Domain location=23-167; Score =118.8; E_value=1.5e-32; Accession=PF00254.18; Description=FKBP-type peptidyl-prolyl cis-trans i
MGDAIDLTGDGGVIKTIVRKSKADAVGPTENFPLVDVHYEGTLADTGEVFDTTHEDNTIFSFEIGKGSVIKAWEIAVKTMKVGEVAKITCKPEYAYGSAGSPPDIPPEYCSHAIDFVWKHNYETKKFKYQPGIQILLPLANARLVPRVVRGFIAPFCATLVFEVELVACRPRKGSSLGSVSEERARLDELKKQRELAAAAKEEEKKKREEAKAAAAARVQAKLEAKKGQGKGKGHPNSSILNRATFSMNEGRDVVRCLVR

SEQ ID NO: 150589 - protein, 361 aa, Glycine max
  Coding DNA Sequence Number=SeqID_33811
  Homolog annotation: Hit_ID=Q1SKD7; Match level="QueryCoverage=94%, HitCoverage=89%, E-value=2e-09, Identity=24%"; Hit description =Ankyrin
MASKKRKAPATPSQVRYDQSKFTSPEAWERYTDIVEELERRKRDEELTSFAKGSIDAAIVKEFYTNLYDPEDKSPKQVQVRGHLIKFDEDTLNTFLKTPVIIKEGETLSTYSRFALLRPDPQELAAKLCIPGRGFELNADGQPLKILRKNMTTLAQTWSVLSYSNLVPTFHTSNITVDRAQYDSSRLGFPALITTLCKARGVTSDSRTLENLSPAINLAYLKKNCWNLDDTTVTFKEPRKARGKRSEAPPTSSTLPDPSAPSISTPHLPQFHVQLPASSAPALDFLFTPEMLHSMMQSLHRGQVILMQSFHSLGLPSIMPMEDFHAQVVWLGVPPSPSRGGGTSAAQEPDSAEPVEEHTEE

SEQ ID NO: 150590 - protein, 61 aa, Glycine max
  Coding DNA Sequence Number=SeqID_33812
MAQEEETSPDPMPEPFPAPISEDTMPLAPAIELEQPILQDVPAAPVLDLNEDQPQDENGCD

SEQ ID NO: 150591 - protein, 349 aa, Glycine max
  Coding DNA Sequence Number=SeqID_33813
  Gene Ontology: Mol. function=protein binding; Cellular component =integral to membrane; Biological process=defense response to fungus
  Homolog annotation: Hit_ID=Q1SL70; Match level="QueryCoverage=87%, HitCoverage=48%, E-value=2e-82, Identity=45%"; Hit description =Leucine-rich repeat; Leucine-rich repeat, cysteine-containing type
  Pfam annotation: Domain name=LRR_1; Domain location=116-138; Score =12.2; E_value=1.5; Accession=PF00560.23; Description=Leucine Rich Repeat
  Pfam annotation: Domain name=LRR_1; Domain location=144-167; Score =9.7; E_value=4.4; Accession=PF00560.23; Description=Leucine Rich Repeat
  Pfam annotation: Domain name=LRR_1; Domain location=169-191; Score =17.4; E_value=0.051; Accession=PF00560.23; Description=Leucine Rich Repeat
  Pfam annotation: Domain name=LRR_1; Domain location=193-214; Score =9.2; E_value=5.5; Accession=PF00560.23; Description=Leucine Rich Repeat
  Pfam annotation: Domain name=LRR_1; Domain location=217-239; Score =15.6; E_value=0.17; Accession=PF00560.23; Description=Leucine Rich Repeat
  Pfam annotation: Domain name=LRR_1; Domain location=241-263; Score =8.1; E_value=8.8; Accession=PF00560.23; Description=Leucine Rich Repeat
  Pfam annotation: Domain name=LRR_1; Domain location=265-287; Score =2.3; E_value=1.1e+02; Accession=PF00560.23; Description=Leucine Rich Repeat
  Pfam annotation: Domain name=LRR_1; Domain location=67-89; Score=4.3; E_value=45; Accession=PF00560.23; Description=Leucine Rich Repeat
  Pfam annotation: Domain name=LRR_1; Domain location=91-113; Score =7.6; E_value=11; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=116-138::144 -167::169-191::193-214::217-239::241-263::265-287::67-89::91-113
  Subcellular localization annotation: CTP_CleavageSite=87; ConfidenceScore=5.14e-01
MMNGKIPKSIGQLTQLNTLNLFQNNWDGTMTNIHFHNLTNLFSFSVSSKTNSFAFKATHDWIPPFKQLYYLKIHGCQVGPTFPNWLRNQTGLEYVILENAGISGEIPRWLYSMFSHIRELDLSHSKISGYLPKTLNFSIPLWCTITALDLRNNSLSGTVPANIGEEMSNMEYLDLSNNNLNGSIPQSINRMQLLLYLDLSNNYLTRVVPVFSMSIQHLSIIDLSNNSLSGGIPTSLCSLPSIFILELSNNNLSTNLSTVFQNCTSMGSLSLGNNKFFGSVPKKINKNFPILEELLLRDSTSGGFNPFSVSLTLGTPSEQSEEKLEESQGTARDIVVVVGRHVSPLRGKR

SEQ ID NO: 150592 - protein, 53 aa, Glycine max
  Coding DNA Sequence Number=SeqID_33814
MWMLNKELAELEQQSWESLNCFVAQYPKVLKICQIRFTVSLWILPNEFENQLK

SEQ ID NO: 150593 - protein, 158 aa, Glycine max
  Coding DNA Sequence Number=SeqID_33815
MLISPCERIARHPVDPDEPNRALGFPALVTGLCQSYRVLVPPARSCYHDIGIAPARHPVDPEKSNRVLGFPDLITGLYQFYGVPVAPSKVIRPPTNRAFIKKYCAPRQAQGKTPQQPGDRRQRATDTPSPPPKPLSSSTKAGVFPMTRPASDQVQSQR

SEQ ID NO: 150594 - protein, 252 aa, Glycine max
  Coding DNA Sequence Number=SeqID_33816
  Homolog annotation: Hit_ID=Q8TGM6; Match level="QueryCoverage=47%, HitCoverage=97%, E-value=5e-09, Identity=43%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 150595 - protein, 118 aa, Glycine max
  Coding DNA Sequence Number=SeqID_33817
MSSSKGPRTKLRYDRGEDYSFANLKELFPIPNIITPLKFKVLDFDKYKGITCPKNHLKMYCRKMGAYAKDEELLIQSFRESLTGVVVTWYTNLEPSRVHSWEDLMVAFVRQCRYNGFG

SEQ ID NO: 150596 - protein, 35 aa, Glycine max
  Coding DNA Sequence Number=SeqID_33818
METRNTYFSHEMRRVYCYSSRCDCDVEINISTMMI

SEQ ID NO: 150597 - protein, 114 aa, Glycine max
  Coding DNA Sequence Number=SeqID_33819
MPMLDQFQSFIHDFIDNIVDVQADGNCGYRSVVGLLVTIDKWMDIADMGYVIASSQPPGDSSVHRIICIGHIYDNHFVQIYLKDRCLLPSVALLWSTNCHPHARQWPTSYISRM

SEQ ID NO: 150598 - protein, 114 aa, Glycine max
  Coding DNA Sequence Number=SeqID_33820
MSTNIIFLSKFLLLLILLLNPDHDANNTRGCSTFVCVAGARPLLEYNVPKYINLKPHDEKGNGIKKGFVQGGGVEACLPKGFRRSSAPSRYINYQPLGSTCSSSKVVNNNGPRA

SEQ ID NO: 150599 - protein, 98 aa, Glycine max
  Coding DNA Sequence Number=SeqID_33821
  Homolog annotation: Hit_ID=Q6IM93; Match level="QueryCoverage=47%, HitCoverage=58%, E-value=3e-08, Identity=57%"; Hit description=DVL8
MILPANKHCDTASKDIEPGPMLLRQPGASSSEGFEGSTNLLVVAEAIVVVFLLHITPASMLLLLLLRERVMVVTVEGAGSKRMIMDFHKGNNKMVKRG

SEQ ID NO: 150600 - protein, 69 aa, Glycine max
  Coding DNA Sequence Number=SeqID_33822
MTLFCTCFPIEPKDHTHDHGSIGFSRRWGGISPVENDFEWQSQRKNHLKMGFPLPAVIFPAEKFIWSED

SEQ ID NO: 150601 - protein, 316 aa, Glycine max
  Coding DNA Sequence Number=SeqID_33823
  Gene Ontology: Mol. function=calcium-dependent phospholipid binding; Cellular component=plasma membrane; Biological process=cell differentiation
  Homolog annotation: Hit_ID=Q9ZR53; Match level="QueryCoverage=95%, HitCoverage=87%, E-value=1e-135, Identity=81%"; Hit description =Annexin-like protein
  Pfam annotation: Domain name=Annexin; Domain location=15-81; Score =70.4; E_value=5.9e-18; Accession=PF00191.10; Description=Annexin
  Pfam annotation: Domain name=Annexin; Domain location=180-246; Score =100.1; E_value=6.8e-27; Accession=PF00191.10; Description=Annexin
  Pfam annotation: Domain name=Annexin; Domain location=256-311; Score =64.7; E_value=3e-16; Accession=PF00191.10; Description=Annexin
  Pfam annotation: Domain name=Annexin; Domain location=96-162; Score =39.3; E_value=1.3e-08; Accession=PF00191.10; Description=Annexin
  Pfam module annotation: Pfam domain module=Annexin::Annexin::Annexin:: Annexin; Domain location=15-81::180-246::256-311::96-162
MATLTVPPVPPSPRDDAMQLYRAFKGFGCDTSAVINILAHRDATQRAYIQQEYRSMYSEELSKRLASELSGKLEVSTCLMLQLTAVLLWLHDPAGRDATIIRKSLTADNRSIEGATEVICSHTPSQLQYLKQIYHSMFGVYLEHDIQTNTSPGDHQKLLLAYISTPRHEGPEVNREIAQKDAKALYKAGEKKLGTDEKTFIHIFSERSAAHLAAVSSYYHDMYGHSLKKAVKNETSGAFEHALLTIIQCAVNPGKYFAKVLRKAMKGLGTDDSTLIRVIVTRTEVDMQYIKAAYLKKHKKTLNDESFVIDLADLTW

SEQ ID NO: 150602 - protein, 874 aa, Glycine max
  Coding DNA Sequence Number=SeqID_33824
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=92%, HitCoverage=97%, E-value=0.0, Identity=60%"; Hit description=Beta -galactosidase
  Pfam annotation: Domain name=Gal_Lectin; Domain location=757-835; Score=73.0; E_value=9.8e-19; Accession=PF02140.8; Description =Galactose binding lectin domain
  Pfam annotation: Domain name=Glyco_hydro_35; Domain location=34-340; Score=568.6; E_value=6.2e-168; Accession=PF01301.10; Description =Glycosyl hydrolases family 35
  Pfam annotation: Domain name=Glyco_hydro_42; Domain location=56-368; Score=-230.9; E_value=0.0042; Accession=PF02449.6; Description=Beta -galactosidase
  Pfam module annotation: Pfam domain module=Gal_Lectin::Glyco_hydro _35::Glyco_hydro_42; Domain location=757-835::34-340::56-368
MTGRKCSLSASFLLCLSLISIAINALEVSYDERALTIDGKRRILFSASIHYPRSTPEMWPYLIRKAKEGGLDVIETYVFWNAHEPQRRQYEFSENLDLVRFIRTIQKEGLYAMIRIGPYISSEWNYGGLPVWLHNIPNMEFRTHNRAFMEEMKTFTTKIVDMMQDETLFAVQGGPIIIAQIENEYGNVMHAYGNNGTQYLKWCAQLADSFETGVPWVMSQQSNAPQFMIDSCDGYYCDQFQPNDNHKPKIWTENWTGGYKNWGTQNPHRPAEDVAYAVARFFQFGGTFQNYYMYHGGTNFKRTAGGPYVTTSYDYDAPLDEYGNLNQPKWGHLRQLHNLLKSKENILTQGSSQNTDYGNMVTATVYTYDGKSTCFIGNAHQSKDATINFRNNEYTIPAWSVSILPNCSSEAYNTAKVNTQTTIMVKKDNEDLEYALRWQWRQEPFVQMKDGQITGIIDLTAPKLLDQKVVTNDFSDYLWYITSIDIKGDDDPSWTKEFRLRVHTSGHVLHVFVNGKHVGTQHAKNGQFKFVHESKIKLTTGKNEISLLSTTVGLPNYGPFFDNIEVGVLGPVQLVAAVGDYDYDDDEIVKDLSKNQWSYKVGLHGEHEMHYSYENSLKTWYTDAVPTDRILVWYKTTFKSPIGDDPVVVDLSGLGKGHAWVNGNSIGRYWSSYLADENGCSPKCDYRGPYTSNKCLSMCAQPSQRWYHVPRSFLRDNDQNTLVLFEELGGQPYYVNFLTVTVGKVCANAYEGNTLELACNKNQVISEIKFASFGLPKGECGSFQKGNCESSEALSAIKAQCIGKDKCSIQVSERTLGPTRCRVAEDRRLAVEAVCDIQLTIEKTTLALDDSDEKYSCIIVAPGFSQTKSSKSYD

SEQ ID NO: 150603 - protein, 376 aa, Glycine max
  Coding DNA Sequence Number=SeqID_33825
  Gene Ontology: Mol. function=hydrolase activity; Cellular component =mitochondrial outer membrane; Biological process=aromatic compound metabolic process
  Homolog annotation: Hit_ID=Q9FX41; Match level="QueryCoverage=93%, HitCoverage=90%, E-value=1e-123, Identity=61%"; Hit description =Lysophospholipase homolog, putative
  Pfam annotation: Domain name=Abhydrolase_1; Domain location=152-370; Score=21.1; E_value=0.00018; Accession=PF00561.10; Description =alphabeta hydrolase fold
MAREAFIFKESALLSLRALKSLLMLIFAVAMLLLLPFRGRRRVPPAEKPSGKEECHRKGAVVRMPAKMVPGKSGAGAVAARRELAIRRVVEDDDDQRCVREYWLLGTKRGDTIFTQCWKPVSDKIRGLVLLMHGLNEHRYSDFAKQLNANGYKVYGMDWIGHGGSDGLHAYVHSLDDAVSDMKVFLEKILNENHGLPCFCYGHSTGAAIILKALLDPKVEASIVGATFTSPAVGVEPSHPILVALAPILSFLLPTYQCNSAYKKGLPVSRDPEALTAKYSDPLVCTGSLRVRTGYEILRITSYLQQNLRKLRVPFQVLHGTADSITDPDASQKLYEQASSTDKTIKLYEGFAHDLLFEPEREDIIQDIIQWLNSRI

SEQ ID NO: 150604 - protein, 74 aa, Glycine max
  Coding DNA Sequence Number=SeqID_33826
  Homolog annotation: Hit_ID=Q6K5F5; Match level="QueryCoverage=76%, HitCoverage=21%, E-value=3e-14, Identity=61%"; Hit description =Mitochondrial transcription termination factor-like protein
MEPCILSADRKFDSGYPKSDLVKFPQYFGYSLEERIKPRFAIMKNSGVKLLPNQVLSLSSSNLDEALKKKMQNG

SEQ ID NO: 150605 - protein, 708 aa, Glycine max
  Coding DNA Sequence Number=SeqID_33827
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=98%, HitCoverage=83%, E-value=0.0, Identity=58%"; Hit description=Beta -galactosidase
  Pfam annotation: Domain name=Gal_Lectin; Domain location=619-697; Score=71.8; E_value=2.2e-18; Accession=PF02140.8; Description =Galactose binding lectin domain
  Pfam annotation: Domain name=Glyco_hydro_35; Domain location=1-202; Score=166.5; E_value=6.8e-47; Accession=PF01301.10; Description =Glycosyl hydrolases family 35
  Pfam module annotation: Pfam domain module=Gal_Lectin::Glyco_hydro _35; Domain location=619-697::1-202
MEFRTHNRAFMEEMKTFTRKIVDMMQDETLFAVQGGPIIIAQIENEYGNVMHAYGNNGTQYLKWCAQLADSFETGVPWVMSQQSNAPQFMIDSCDGYYCDQFQPNDNHKPKIWTENWTGGYKNWGTQNPHRPAEDVAYAVARFFQFGGTFQNYYMYHGGTNFKRTAGGPYVTTSYDYDAPLDEYGNLNQPKWGHLRQLHNLLKSKENILTQGSSQHTDYGNMVTATVYTYDGKSTCFIGNAHQSKDATINFRNNEYTIPAWSVSILPNCSSEAYNTAKVNTQTTIMVKKDNEDLEYALRWQWRQEPFVQMKDGQITGIIDLTAPKLLDQKVVTNDFSDYLWYITSIDIKGDDDPSWTKEFRLRVHTSGHVLHVFVNGKHVGTQHAKNGQFKFVHESKIKLTTGKNEISLLSTTVGLPNYGPFFDNIEVGVLGPVQLVAAVGDYDYDDDEIVKDLSKNQWSYKVGLHGEHEMHYSYENSLKTWYTDAVPTDRILVWYKTTFKSPIGDDPVVVDLSGLGKGHAWVNGNSIGRYWSSYLADENGCSPKCDYRGPYTSNKCLSMCAQPSQRWYHVPRSFLRDDDQNTLVLFEELGGQPYYVNFLTVTVGKVCANAYEGNTLELACNKNQVISEIKFASFGLPKGECGSFQKGNCESSEALSAIKAQCIGKDKCSIQVSERALGPTRCRVAEDRRLAVEAVCDIRVSGEGRKH

SEQ ID NO: 150606 - protein, 295 aa, Glycine max
  Coding DNA Sequence Number=SeqID_33828
  Gene Ontology: Mol. function=DNA binding; Biological process =regulation of transcription
  Homolog annotation: Hit_ID=Q1S588; Match level="QueryCoverage=99%, HitCoverage=73%, E-value=2e-28, Identity=32%"; Hit description=Myb -like DNA-binding domain, SHAQKYF class, putative
  Pfam annotation: Domain name=Myb_DNA-binding; Domain location=229 -280; Score=31.4; E_value=3.1e-06; Accession=PF00249.21; Description =Myb-like DNA-binding domain
MPQNKIFQDQQQSSNPIPDLSLHISLPNSAPSSICSEGDSPFDAEGLKSHSDGSIKGSSSPYYHIDTQLSLANHTSTISTPSEAESTWRKRNFVRLCHGVSHEGQIRLINGIPLYSNLSSLDNTSSTINIPSIERNQLPTNKFSFSSLYALPHPPSAPNYAVEPISRFREMTMESALRPQQVPYFDYPHQQQHQFGSSNIGASDFSNGFVRSRMFSRQQSNKRNMRAPRMRWTSSLHNRFLHAVELLGGHERATPKSVLELMDVKDLTLAHVKSHLQCVDFVQGLSKRHRNQGMQ

SEQ ID NO: 150607 - protein, 63 aa, Glycine max
  Coding DNA Sequence Number=SeqID_33829
MARSCPRPGRAFLGHSYKSRQVDCENQPRYIETDFVSEPHERYCQGLFMCPPLSSLELCFMIA

SEQ ID NO: 150608 - protein, 191 aa, Glycine max
  Coding DNA Sequence Number=SeqID_33830
  Gene Ontology: Mol. function=nucleic acid binding; Biological process= DNA integration
  Pfam annotation: Domain name=rve; Domain location=1-131; Score=66.9; E_value=6.4e-17; Accession=PF00665.16; Description=Integrase core domain
MSEKSLEGAYYFVTFIDDHSRRVQIYLLKTKDQVIQAFKEYHVMVERETRRKLKVNNGGEYHGPFEAYCKTYGIKLEKMTPKTPQLNGVVERMNRTIKERVWVNSDHDSFHVAHAVLRQQVVEANQNEVYYGSEHNETSMELSTETNNTEIVEPKVVEQPQLRCSARDRCPSKRYSLNEYVTLTNEGVLKL

SEQ ID NO: 150609 - protein, 257 aa, Glycine max
  Coding DNA Sequence Number=SeqID_33831
  Gene Ontology: Mol. function=nucleic acid binding; Biological process= DNA integration
MDIIINSLLNEEARRKEQGMVVQSEDNIVENRGRSENCETSARLPITIVASQVTRNLNVDISSKIKKIGTIKPDQINLKKKEDKSTMAMAVDGDDNVFLIGEDNYLNISCDDCLWIVDSGAFFHISPHGGFFSTYQSGDFGMVKMGNCVTSKIVGIGDITFMIDIWHKLVLKEVTHVRDMGLNLISVRKLDNVGLINHFGDCKWKLTKGNMIVAQGKKKDALYVLQGRICKGEAIVAHGDSSMELWNRRLGHMSEKG

SEQ ID NO: 150610 - protein, 143 aa, Glycine max
  Coding DNA Sequence Number=SeqID_33832
  Gene Ontology: Mol. function=nucleic acid binding; Biological process= DNA integration
MKDLRPGKKILGLKITRDRSKKLLWLSQEQYIEKVLKRFNMHKAKLVSIPLAVQFKLSKKQSPTSEGDKEEMKKVPYSSVVGSLIYAMISKLQKCVALSTTEAEYITTTEACKEMLWMKNFLHELCHEQQNYMVHCDNQVPYT

SEQ ID NO: 150611 - protein, 286 aa, Glycine max
  Coding DNA Sequence Number=SeqID_33833
  Gene Ontology: Mol. function=protein binding; Cellular component =nucleus; Biological process=ribosome biogenesis and assembly
  Homolog annotation: Hit_ID=Q1T0L2; Match level="QueryCoverage=91%, HitCoverage=37%, E-value=1e-129, Identity=88%"; Hit description=WD40- like
  Subcellular localization annotation: CTP_CleavageSite=67; ConfidenceScore=5.21e-01
MATRDGGMKSTSINGVKMYTIASQQPSLASWLPSNKKQNSHRNVKSYTQNLQLLEDLRFATAATKIKATPDGEYIIASGIYPPQVKVYEVRELGLKFERHLDSEIVDFQVLTDDYSKLAFLCADRSVYLHAKYGKHYSLRIPRMGRDIAYDCWSCDLLCAASSPDLYRINLEQGRFLSSLNTQSPALNVVSRSKIHGLVACGGEDGAVECFDMRVRSSVGRIDAVGPSGDVDQEVTALEFDEDGGFLLAVGSSAGKDFKERLSSSHNHRFVKVDVYTIKTRQAYFI

SEQ ID NO: 150612 - protein, 54 aa, Glycine max
  Coding DNA Sequence Number=SeqID_33834
MVTTMGIMFLNDNTQLHVSILNQVEVEIIDQENNKHMQFVQQDERPYLEGLIII

SEQ ID NO: 150613 - protein, 410 aa, Glycine max
  Coding DNA Sequence Number=SeqID_33835
  Gene Ontology: Mol. function=inositol or phosphatidylinositol phosphatase activity; Cellular component=intracellular; Biological process=abscisic acid mediated signaling
  Homolog annotation: Hit_ID=Q1RXP2; Match level="QueryCoverage=98%, HitCoverage=89%, E-value=1e-110, Identity=49%"; Hit description =Inositol polyphosphate related phosphatase
  Pfam annotation: Domain name=Exo_endo_phos; Domain location=53-399; Score=137.3; E_value=4.2e-38; Accession=PF03372.13; Description =EndonucleaseExonucleasephosphatase family
MQGFNLKENKIMRKIFSSDNFKGENQNSSEAKKESPSLNQASARCFYHQTKKIFVGSWNIGGITPPKNLDMEDWLDTQNNSADIYVLGFQEIVPLNAANVLGPQNRKVSMKWNSLIGAALNNRTPTKVVEENKTAEPQKIYPLKEHIYAEGEHGQDFQCIISRQMVGMFITIWVRCDLYQTIRHLSILSVGCGIMGCLGNKGSISIRFYLHETSFCFICSHLASGGKEVDRRHRNVNAAHILSRTIFPSGPLHDMPQKIIDHDRVVWLGDLNYRIYMPDSTTKSLIKRGEWETLLKHDQLKMELTEGHVFQGWHEGAIEFPPTYKYRLNSVDYLGCDQQHSLTSDALFEPLAAMATLSLTTRLYCRCDRIIWFGKGMKQIQYNRSESKLSDHRPVRAMFTADIRVAGTCK

SEQ ID NO: 150614 - protein, 210 aa, Glycine max
  Coding DNA Sequence Number=SeqID_33836
  Homolog annotation: Hit_ID=Q1SKD7; Match level="QueryCoverage=77%, HitCoverage=42%, E-value=7e-09, Identity=28%"; Hit description =Ankyrin
MVPRKLLTERNVVVYYTEFDEFKEELEKRKWDEELTSFPEGSIDVAIVKEFYANLYDSEDKSPKQVRVRGHLIKFDEDTLNTFLKTPMILEEGENLCAYSRFELLRPNPQELATKLCIPGRGFELNVEGQPLKILRKNMTTLAQTWSILSFPNLVPTSDTYDVRLDRAKLIYGIIMKMDVNAGYLISHQISIIAQHDSSKLGFLALIIAL

SEQ ID NO: 150615 - protein, 174 aa, Glycine max
  Coding DNA Sequence Number=SeqID_33837
  Gene Ontology: Mol. function=DNA binding; Cellular component =mitochondrion; Biological process=metabolic process
  Homolog annotation: Hit_ID=Q1SMD3; Match level="QueryCoverage=95%, HitCoverage=77%, E-value=7e-32, Identity=31%"; Hit description=TonB box, N-terminal; Tetratricopeptide-like helical
  Pfam annotation: Domain name=PPR; Domain location=117-151; Score =27.4; E_value=5.1e-05; Accession=PF01535.11; Description=PPR repeat
  Pfam annotation: Domain name=PPR; Domain location=21-55; Score=29.3; E_value=1.4e-05; Accession=PF01535.11; Description=PPR repeat
  Pfam annotation: Domain name=PPR; Domain location=82-116; Score=21.0; E_value=0.0041; Accession=PF01535.11; Description=PPR repeat
  Pfam module annotation: Pfam domain module=PPR::PPR::PPR; Domain location=117-151::21-55::82-116
VAIAWKVVKAMCESGVAPDVVTYSFLLDGLCQGQHLDLAVVLFNQLIKRGMALDVWSYSILIDGLLNELHNNGPPPDIVTYSTLLHALCKMCKSERIDEAVNLFKDMHLKNLVPDTITYISLVDALCRSGRISYAWKLVNEMHDNAPPLDVINYIDALYRNQHLGSKCLASAYC

SEQ ID NO: 150616 - protein, 81 aa, Glycine max
  Coding DNA Sequence Number=SeqID_33838
MEKPYGSEWPKEEKVKCREMVAPEAHYPRVPGKGLGRFLMQLVELMAQKIAEALPVRWTILKATPIKDELCPTKMNHARSL

SEQ ID NO: 150617 - protein, 274 aa, Glycine max
  Coding DNA Sequence Number=SeqID_33839
  Gene Ontology: Mol. function=glycerone kinase activity; Cellular component=cytoplasm; Biological process=glycerol metabolic process
  Homolog annotation: Hit_ID=O04059; Match level="QueryCoverage=91%, HitCoverage=42%, E-value=1e-110, Identity=80%"; Hit description =Putative 3,4-dihydroxy-2-butanone kinase
  Pfam annotation: Domain name=Dak1; Domain location=22-273; Score =346.8; E_value=3.5e-101; Accession=PF02733.7; Description=Dak1 domain
MAFPNKKLIDDPNDVVTEFIEGLVETYSGLQYLDGFPLVKVVLRADVSAATYDKVAIVSGGGSGHEPAHAGFVGEGMLTAAICGDIFSSPPVDSILAGIRAVTGPKGCLLIVKNYTGDRLNFGLAAEIAKSEGYKVETVIVGDDCALPPPRGIAGRRGLAGTILVHKVAGAAAAGGLSLADVAAEAKHASEIVGTMGVALTVCSIPGQVASDRLGPGKMELGLGIHGEPGAAVADIQPVNVVVSHVLQQILSTVCCMPQYCMKALDGCMLINWE

SEQ ID NO: 150618 - protein, 294 aa, Glycine max
  Coding DNA Sequence Number=SeqID_33840
  Gene Ontology: Mol. function=glycerone kinase activity; Cellular component=cytoplasm; Biological process=glycerol metabolic process
  Homolog annotation: Hit_ID=Q8L7L9; Match level="QueryCoverage=72%, HitCoverage=62%, E-value=1e-62, Identity=61%"; Hit description =Dihydroxyacetone kinase, putative
  Pfam annotation: Domain name=Dak2; Domain location=96-286; Score =165.4; E_value=1.4e-46; Accession=PF02734.7; Description=DAK2 domain
MFDRWMCWVDCMANMVASVENHQSSFTELSLASGESKINSQLLGSKERASSSKHFGGPRSQPLQLNEQGQILEVAIEAAANAIINLKDNLNEWDGKVGDGDCGSTMYRGAKAILEDIKNYPLNDAAETVGEIGSSIGRSMGGTSGIMYDAIPMPPLKYTIFFKAAHSVLKASSHSGVTSKQWAEALAVSIAAVSKYGGASAGYRTLLDALIPASLVLEEKLNSGVDPCIAFVLSSEAALAGAQSTVDMQAQHMQAGRSTYFSGEILSTVPDPGAMAAATWYRAAALAVKAKYQS

SEQ ID NO: 150619 - protein, 158 aa, Glycine max
  Coding DNA Sequence Number=SeqID_33841
  Gene Ontology: Mol. function=DNA binding; Cellular component=nucleus; Biological process=regulation of transcription
  Homolog annotation: Hit_ID=Q5IR72; Match level="QueryCoverage=94%, HitCoverage=85%, E-value=9e-61, Identity=78%"; Hit description=Zinc finger homeodomain protein SZF-HD1
  Pfam annotation: Domain name=ZF-HD_dimer; Domain location=6-65; Score= 99.4; E_value=1.1e-26; Accession=PF04770.3; Description=ZF-HD protein dimerisation region
MENSSSSNYLYRECLRNHAASLGSYATDGCGEFTLDADSVSSPSLQCMACGCHRNFHRKVTCPVVEGPQVVTGGSGDMMEYSGGEGRMEMGERSGGGSSKKRFRTKFSAEQKEKMLGFAEKLGWKLQRKEVDDEIERFCKSVGVTRQVFKELGKIQVA

SEQ ID NO: 150620 - protein, 102 aa, Glycine max
  Coding DNA Sequence Number=SeqID_33842
MGMFEQSEKGAVPVRVLGVYEWKMKRAKGETVGVSSYADATSRIGEIGVPPLSMARSFATWLHGECVASTTGEMHGDVGVSRGCAVSTTGEKPPPLCRHCFL

SEQ ID NO: 150621 - protein, 181 aa, Glycine max
  Coding DNA Sequence Number=SeqID_33843
MDGVRAAKGGGGCGRGAAVGVEGGDPKKLPSLNLSKRNIQLLLFSLPRKHSNFFSSLYRDEPPASSSSRAFSASPLLIFPLDPFAFEVGARNLPLVLLCTIVVAFRWNLRVEDAGKNGERVFTVAPSGRSVFRNFQKNVFWKIPGRRVLPKVLKGLPEEPVIRKASGTPLPETFWKKDSSG

SEQ ID NO: 150622 - protein, 274 aa, Glycine max
  Coding DNA Sequence Number=SeqID_33844
MGRLLPLVIESIAHNPFSPLFNPIEIIGLVWIDARRAFESVSSIASIGSAMQNTFGNFSTPMISVSDKKRKDTEIVNGPAVGKKPRGRPPGRKNQVQGQNTLPQSSNVVNNQVVSWQSSSSTLPPSGICAPNGSQVQGSNVAKGSFNHPLFFVPNHSQILETPPRTQSSHFMFDPEKQMAYKESSHCNSPIEADTGKASKKDDVRGKLNFDASNMPESLDKSLANEVSTSELDKGVVISDIDFSNLDWSLQGTSFEDFFDPIGLTDSKDNASSS

SEQ ID NO: 150623 - protein, 46 aa, Glycine max
  Coding DNA Sequence Number=SeqID_33845
MVGFIRPIVWKEGAKDSMLKVIIETGPTSFKCFRTDLHSNEAYIYS

SEQ ID NO: 150624 - protein, 471 aa, Glycine max
  Coding DNA Sequence Number=SeqID_33846
  Gene Ontology: Mol. function=nucleic acid binding; Cellular component= intracellular; Biological process=chromatin modification
  Homolog annotation: Hit_ID=Q9C9X7; Match level="QueryCoverage=96%, HitCoverage=89%, E-value=1e-101, Identity=50%"; Hit description =Putative C2H2-type zinc finger protein; 11906-10073
  Pfam annotation: Domain name=zf-C2H2; Domain location=122-144; Score =22.1; E_value=0.002; Accession=PF00096.16; Description=Zinc finger, C2H2 type
  Pfam annotation: Domain name=zf-C2H2; Domain location=149-170; Score =14.5; E_value=0.28; Accession=PF00096.16; Description=Zinc finger, C2H2 type
  Pfam annotation: Domain name=zf-C2H2; Domain location=45-67; Score =27.3; E_value=5.3e-05; Accession=PF00096.16; Description=Zinc finger, C2H2 type
  Pfam module annotation: Pfam domain module=zf-C2H2::zf-C2H2::zf-C2H2; Domain location=122-144::149-170::45-67
MALPPIKGREGPQEHQDCLQYLIPDDPDAEVVSLSPKTLLESDRYVCEICNQGFQRDQNLQMHRRRHKVPWKLLKRETPVVRKRVFVCPEPTCLHHDPCHALGDLVGIKKHFRRKHSNHKQWVCERCSKGYAVQSDYKAHLKTCGTRGHSCDCGRVFSRVESFIEHQDACNMGRLRPHESQPLQPSACLSRTASSPSPSSETNFSTAPWPTRMIIQKPSETPTIFMNNPITAITTAETSSKSNNKLLHPNLDLQLSTPTNNNNSNTSNTNTSNIANPIDNAAISAKRDHYHENHSTHLQLSIGSSDMSEKNDQSNRNSSEKSSNNSNNINDQNNKQQSNNMALLRVQEQAREHLRIAMAEKAYAEEARKQAKRQIELAEQEFTNAKRIRQQAQVELDKAYALKEHAMKQINSTMLQITCHFCKQQFQARNATTTSPDDNSLVLSYVSSAITTEGGEVENDNIAKDHAKDNN

SEQ ID NO: 150625 - protein, 77 aa, Glycine max
  Coding DNA Sequence Number=SeqID_33847
MATWEDIDSSSSEEDEEHATNLCLMVDSDKDELIGLGSSLSMDSFASWKMNGSGMEKEEREETPLQGEDESRRSSPP

SEQ ID NO: 150626 - protein, 95 aa, Glycine max
  Coding DNA Sequence Number=SeqID_33848
  Homolog annotation: Hit_ID=Q1SXQ3; Match level="QueryCoverage=60%, HitCoverage=6%, E-value=8e-08, Identity=51%"; Hit description =Integrase, catalytic region
MFFLTFPESIIGETTSRVNTRASLNREKGMLALLSTLELKTIDEALSEDSLETAMDEELSQFTKNKGIISRKDHHSCFFVHRGSSLDSICYFSND

SEQ ID NO: 150627 - protein, 142 aa, Glycine max
  Coding DNA Sequence Number=SeqID_33849
  Gene Ontology: Mol. function=nucleic acid binding
  Homolog annotation: Hit_ID=Q1RXW3; Match level="QueryCoverage=80%, HitCoverage=17%, E-value=1e-09, Identity=36%"; Hit description=Zinc finger, CCHC-type
MKLFLESQNVELWDIRKIGHIKIDYPLLKKDFKRGDPKKKATMATWEDTYSSSSNKDEEQAANLCIMAELYDFESVIDFSHQKELEQALDNLLNDSHILTKKCAILKEQLSNVQKENEKLIMDNELLFKEKPLSTKIPFLAL

SEQ ID NO: 150628 - protein, 93 aa, Glycine max
  Coding DNA Sequence Number=SeqID_33850
  Gene Ontology: Mol. function=RNA-directed DNA polymerase activity; Biological process=RNA-dependent DNA replication
MGWRILARPKHPNAPALCLFDFTFSFLPYLVYPVLSFGLQALAQAIWNQNVSGGMGEFHGLNRFQRKNPSMFRGRYDPDGVQNWLKEIENIGL

SEQ ID NO: 150629 - protein, 95 aa, Glycine max
  Coding DNA Sequence Number=SeqID_33851
  Gene Ontology: Mol. function=RNA-directed DNA polymerase activity; Biological process=RNA-dependent DNA replication
MVVKSLSPEHHACDLAEVFAELKKHNMKLNPKKCTFRVGGEKAKRFLKLLKKSQNDFHWDEECERMFTEFKSFLATLPILTRPTSGVELLLYLCF

SEQ ID NO: 150630 - protein, 110 aa, Glycine max
  Coding DNA Sequence Number=SeqID_33852
MKPIKEKDFKRQSCQPKFVTYNLLTESRAHILEKAFNEEILVEVAAEVILEEDMLEVGATIANNPPKKASKDNRKIPKGRGQPRGPQSIHNGQSFNVTFDHACGGFTSVV

SEQ ID NO: 150631 - protein, 111 aa, Glycine max
  Coding DNA Sequence Number=SeqID_33853
MMISPQRDRFLPQRNKMFDQLKLTEIHHNEVELRHWESTKIKTFEGMGRIKRILRLCRFEFFDKGEGRHKRIQAVSPLFFWKREKRYTKRIQRLVLGEFFLAKGEENEEDE

SEQ ID NO: 150632 - protein, 51 aa, Glycine max
  Coding DNA Sequence Number=SeqID_33854
MIIAVLYPEKFIALDEKQQAHSAHHLVLYVFHNQEVSGVGYHNSKHEVRVK

SEQ ID NO: 150633 - protein, 227 aa, Glycine max
  Coding DNA Sequence Number=SeqID_33855
  Gene Ontology: Mol. function=receptor activity; Cellular component =integral to membrane
  Homolog annotation: Hit_ID=Q6L517; Match level="QueryCoverage=59%, HitCoverage=37%, E-value=1e-16, Identity=34%"; Hit description =Putative lung seven transmembrane receptor 1
MPPHIKKRPARPYQNGDGEEQNDTDEMEEEENDVPTVKSSSELDVVLGHSGAKKEAIKRRKGTRGKESWCDGGEVVVGSITIEVKELRVNFHGDEALGDAVCKEEVVFIGDGNGVRTVKGSGRGRKIEEGEEVKGVRGIEDVEGRTLAARGSIVTMGPPQTLTTSRLPHDLGRLAITILMPLLTFNVVFLMNVLEVENKVDEKKVAEPADNGNSNSRHMLFLDVGHS

SEQ ID NO: 150634 - protein, 38 aa, Glycine max
  Coding DNA Sequence Number=SeqID_33856
MDDLQGILGYSGQRAWGTRKPHFASPGGLQDYVIHVVV

SEQ ID NO: 150635 - protein, 79 aa, Glycine max
  Coding DNA Sequence Number=SeqID_33857
MGCSILGKIYFECLEKVLVIGYVVDQMSSSTLTPPFFIDAIETRWKHNDTLNVNRFYGFLHCRCAPIDIPRYRPRIAYF

SEQ ID NO: 150636 - protein, 240 aa, Glycine max
  Coding DNA Sequence Number=SeqID_33858
EGRVGILFSCGGFPNVPLMGMRALAGVLQGVRKAWEMVQKKDKELRGSSNGAVGGYHRLKAAKEEEVEAPEESKEVQALKMELEKAQAVKEKFKSTAVRIRKENAELRDVNIATAKALEQETKRARKEEYGRNKFRGALWGSNSELKLRREERDQSQVEGMILKDELKTCLRSKRSLSQRLSETETNMLAIISKYKEELDLATAHEHKVVDEYAQVYTEKEARGRVIDSLHREAMMWMDL

SEQ ID NO: 150637 - protein, 125 aa, Glycine max
  Coding DNA Sequence Number=SeqID_33859
MATMMEAMMSMKKIMEANAVIVSATSTVAKVNPMPPSDLNQMNHPTSDMVGKDLGSTDSPMMCKFKTSTHSRHMACLPTIHYSMWRTLLMRMSITLPPYSLRADNLIMYMSLNPWGRHMKFPTTI

SEQ ID NO: 150638 - protein, 1258 aa, Glycine max
  Coding DNA Sequence Number=SeqID_33860
  Homolog annotation: Hit_ID=P76007; Match level="QueryCoverage=45%, HitCoverage=98%, E-value=0.0, Identity=71%"; Hit description=Cell volume regulation protein A
  Pfam annotation: Domain name=CorC_HlyC; Domain location=945-1025; Score=90.8; E_value=4.2e-24; Accession=PF03471.7; Description =Transporter associated domain
  Pfam annotation: Domain name=DUF1480; Domain location=1013-1088; Score=50.6; E_value=5.1e-12; Accession=PF07351.3; Description =Protein of unknown function (DUF1480)
  Pfam annotation: Domain name=DUF444; Domain location=1-423; Score =882.3; E_value=2.3e-262; Accession=PF04285.3; Description=Protein of unknown function (DUF444)
  Pfam annotation: Domain name=FtsX; Domain location=371-572; Score= -26.9; E_value=0.065; Accession=PF02687.11; Description=Predicted permease
  Pfam annotation: Domain name=Na_H_Exchanger; Domain location=467-842; Score=222.9; E_value=7e-64; Accession=PF00999.11; Description =Sodiumhydrogen exchanger family
  Pfam annotation: Domain name=TrkA_C; Domain location=869-937; Score =46.6; E_value=8.3e-11; Accession=PF02080.11; Description=TrkA-C domain
  Pfam module annotation: Pfam domain module=CorC_HlyC::DUF1480::DUF444: :FtsX::Na_H_Exchanger::TrkA_C; Domain location=945-1025::1013-1088::1- 423::371-572::467-842::869-937
MAYFIDRRLNGKNKSAVNRQRFLRRYKSQIKQSISEAINKRSVTDVESGESVSIPIDDINEPIFHQGRGGSRHRVHPGNDHFVQNDRIERPQGGGGGGSGQGNASQDGEGQDEYVFQISKDEYLDLLFEDLALPNLRKNQHRQLNEYKTHRAGFTSNGVPANISVVRSLQNSLARRTAMTAGKRRMLHELEATLSEVENSEPAQLLEEERLRKEIAELRARIERVPFIDTFDLRYKNFEKRPEPSSQAVMFCLMDVSGSMDQATKDMAKRFYILLYLFLSRTYKNVDVVYIRHHTQAKEVDEQEFFYSQETGGTIVSSALKLMDEVVKERYDPSQWNIYAAQASDGDNWADDSPLCHEILAKHILPVVRYYSYIEITRRAHQTLWREYEHLQAMFDNFAIQHIREPEDIYPPVTDRLFLYPARLNPSENPAVFLCGFNLLWDSAPQNEKMRTPLNASMIYSLFIIGSVLVAASILLSSFSSRLGIPILVIFLALGMLTGVDGIGGIAFDNYPVAYLVSNLALAIILLDGGMRTKASSFKVALGPALSLATVGVMITAGLTGLAAAWLFKLDLMQGFLIGAIIGSTDAAAVFSLLGDKGLNERVSSTLEIESGSNDPMAVFLTITLIDMIQQGQSGLSWMFVVHLVQQFGLGIVLGLGGGWALQQLINRISLAQGLYPLLALSGGIIVFALTTVMEGSGILAVYLCGFLLGNSPIRNRHGILQTFDGMAWLSQIGMFIVLGLLVTPSDLWHIALPAMILSLWLILVARPLSILVGLLPFKGFTGRERIFISWVGLRGAVPIILAVFPMMAGLENSKLYFNIAFFVVLVSLMLQGTSLGYAAKRAKVVVPPTASPISRVGLDIHPENPWEQFVYQLSADKWCVGAALRDLQMPRETRIAALFRDNALMHPNGNTRLKEGDVLCVIGRERDLPALGKMFSQTPPVALDQRFFGDFILDAEARLRDVAQIYGLELDEETNDQQSLGQLIMGLLGSTPVVGDQVEWNQLTWTVAEKEDNQIVKIGIGRYEIVDAVMDVEKLDTVGIPCHTNPGLSYQLDGWDHETSVPAWIDGEPVDLQIGHYDKQQDRWRTTPERVLDSGQAIFYLRKESRFYGKYIGNERCNPLGIWGELDSFIPPQQIEYRFVAQLGLSVLCTAWFWVRMRHYTYRKPFWFELKEIVKTLFVFSLLDLALIAFSKWDFSRMVWVFSWTYALLLLPLMRAGVKRAINRAGQWQKETIIIGSGKNAMEAYAALQSEEILGYN

SEQ ID NO: 150639 - protein, 44 aa, Glycine max
  Coding DNA Sequence Number=SeqID_33861
MYRGPRGSFGVEGRSKVGPSGCDHTSTNAPDPIRTPQLSVLGRE

SEQ ID NO: 150640 - protein, 194 aa, Glycine max
  Coding DNA Sequence Number=SeqID_33862
MGDQEEIQEQMKADMSFLKEQMASMMDAMLGMRQLMENNVAIAAAVSSAAEADPTLPATAHHPLPNMVGRERNTLGTSATPIWDTTEWLTLMDYHLITRHQSCMMMRVMSLPPSLKGSLLDSRMRFTRIVESMPKETSISTPRSSLRGWHPTHCLSPTSQENLETSQHSHYSFPQKDRPRQRKKKGNSISSKRD

SEQ ID NO: 150641 - protein, 303 aa, Glycine max
  Coding DNA Sequence Number=SeqID_33863
  Gene Ontology: Mol. function=hydrolase activity
  Homolog annotation: Hit_ID=Q3K7P3; Match level="QueryCoverage=87%, HitCoverage=91%, E-value=4e-96, Identity=63%"; Hit description=Beta -lactamase-like precursor
  Pfam annotation: Domain name=Lactamase_B; Domain location=52-237; Score=59.3; E_value=1.3e-14; Accession=PF00753.17; Description =Metallo-beta-lactamase superfamily
  Subcellular localization annotation: CTP_CleavageSite=54; ConfidenceScore=5.09e-01
MRTAALLLPLALDATFTSAPLLAAPATAAPATATKSQLHLQTFHPGPHAMFSVSSVLIEGRHDAILVNAHFGASDARKLVELIRASGKQLTTIYIIHGDPDYYFGVATLQDAFPQARIVATAQTVAHIQQTQAGKLAYWGPKMGSDVPARIVVPQVLDGDALQLEGQRLPLIGLDGPTPDRTVLWVPSLRAIVGGIPVVAGEHVWMADTQTPKSHADWLQTLQRLQALKPEVVVPGHYAPGAALDASALRFTADYIRAFDVEAAKAKDSAALVKAMQARYPTLDGVASLELSAKVAKGEMQWP

SEQ ID NO: 150642 - protein, 111 aa, Glycine max
  Coding DNA Sequence Number=SeqID_33864
  Subcellular localization annotation: CTP_CleavageSite=59; ConfidenceScore=5.14e-01
MPHYFRMHPRPKAIPYNPQFNKNKQQFKDKSLTFLSKYMQLRAPKYINGKLESPRMRCRGAHPGELTYTFFFRETILGCLAEALSICPKLGKGRRPIGHDPSLYLRPSLST

SEQ ID NO: 150643 - protein, 122 aa, Glycine max
  Coding DNA Sequence Number=SeqID_33865
  Homolog annotation: Hit_ID=UPI0000612705; Match level="QueryCoverage =69%, HitCoverage=92%, E-value=2e-10, Identity=31%"; Hit description =UPI0000612705 related cluster
MTGPLHESIFCFLIRVDPWVLVPITFRGLHVLAIRGLHTLAFRGLHVLAFRGLQALAFRGLHALAFRGLDILAFRGMHALTFKGRHVLNFRVLHALAFRGLRVVAFRGLHICTLREFKVLCP

SEQ ID NO: 150644 - protein, 93 aa, Glycine max
  Coding DNA Sequence Number=SeqID_33866
MTLRLVNIHNSSFFQILPRAQPRRVALSGWLAKPDDWLSEMKSKGSRLAQSVKFRDVAEIEKEGVQIAIWPTWAFQILPPEGCCFWRKQPCSP

SEQ ID NO: 150645 - protein, 82 aa, Glycine max
  Coding DNA Sequence Number=SeqID_33867
MRFRMLAFIPKRPFRGNTGPDRIEEYHSKCTNLTQGRVCGKLGFWLKACRTVGHDICQDVGLASGSGKKEKSHIISMIHMQH

SEQ ID NO: 150646 - protein, 54 aa, Glycine max
  Coding DNA Sequence Number=SeqID_33868
TWSHKHVGGLRDRDWRRLRSGGYDDVGRSIVGSRQGLLTAGNAASASYLVSTAR

SEQ ID NO: 150647 - protein, 117 aa, Glycine max
  Coding DNA Sequence Number=SeqID_33869
  Subcellular localization annotation: CTP_CleavageSite=33; ConfidenceScore=5.39e-01
MARTLSPLKARTLNHLKARTLSPLKVRTLSPLMARTLSPLKARTLSPLRFKGYIYLGCYTENKRGYISCGSVQVEGTSTWLFKENKGGYIPCASLACKGFYKVERNLQNHWLLGDWI

SEQ ID NO: 150648 - protein, 245 aa, Glycine max
  Coding DNA Sequence Number=SeqID_33870
  Gene Ontology: Mol. function=methyltransferase activity; Biological process=DNA methylation
  Homolog annotation: Hit_ID=Q88MN0; Match level="QueryCoverage=53%, HitCoverage=43%, E-value=4e-59, Identity=77%"; Hit description =Methyltransferase, putative
  Subcellular localization annotation: CTP_CleavageSite=51; ConfidenceScore=5.34e-01
MTFEATHSAISSPASASGPMPFGAQDGLTIDLFGRVPARANLSPRQAKELRLMTSGTSGRPGIGSSKSAALQQSLASRLQARTQNLGSTLFRLTWKPWALRPLLSRSLARLSAHPIKEIVLTSWPTPSSMIVDAKPHPPITSGRKPTDPQIGLADVAVHLASWGTPTASEPGGTGDQYVARSIAKTGNSAPTMLTHQVELAGWPTPMAGTPAQNGNNAAGNTDSSRRTVELATWPTPRAADGEKN

SEQ ID NO: 150649 - protein, 143 aa, Glycine max
  Coding DNA Sequence Number=SeqID_33871
  Gene Ontology: Mol. function=RNA-directed DNA polymerase activity; Biological process=RNA-dependent DNA replication
MVIPKFKVPDFDKYKGTTCPKNHLKTYCRKMGAYTKDEKLLIHFFQESLTGAAVTWYTNLEPSQVHSWKDLMVAFVRQYQYNSDMALDRMQLHSICKREHKSFKEYAQRWRDLAVQVVPSMTKKEMIKIIVYTLPVFYYEKMV

SEQ ID NO: 150650 - protein, 227 aa, Glycine max
  Coding DNA Sequence Number=SeqID_33872
FILNSEGHPGKILRKDLTTLAQVWSVLSYSNLAPTSHTSDLTVDRARLIFGLISHLDMNIGVLISGQMTFIAQSNTSRLGFLALITALCRARGVVSDSLTFECLSPVINLAYTRKNCWNPDDPTVSIRGARRARARPAELPSTFAAPTPASTSIAPSVPMVAPLDFIPTVEQFDKMVAWPGTQPSLHREDEGPTAQVPQHMEDKSSEATILEPFDIGEEAEETHIRQ

SEQ ID NO: 150651 - protein, 80 aa, Glycine max
  Coding DNA Sequence Number=SeqID_33873
MPNLYDRTTKLEETLTQFMQVSMSSQKSTKSAIKNLEVQVGQLAKQLAEKSSSSFTTNTEKNLKEECKAVMTRSKMAIPS

SEQ ID NO: 150652 - protein, 76 aa, Glycine max
  Coding DNA Sequence Number=SeqID_33874
MIKGLNRIAIAQNGRKLHSTDICGQTSPEILPEECLPSMMRIMKLANYRLKAQVEKDKAPEWRRMKAQRQRHYQDY

SEQ ID NO: 150653 - protein, 238 aa, Glycine max
  Coding DNA Sequence Number=SeqID_33875
  Gene Ontology: Mol. function=iron ion transporter activity; Cellular component=integral to membrane; Biological process=iron ion transport
  Homolog annotation: Hit_ID=Q5Z922; Match level="QueryCoverage=89%, HitCoverage=62%, E-value=5e-45, Identity=40%"; Hit description =Putative SLC11A3 iron transporter
MNSVTRRIDLTCKLLAPVVTGFIISFVSLKASALTLALWNTVSVWVEYWLFTSVYKGIPALGLSSQRRMERPSQSDQQRNNQTLEEDSLLSGTDGGSELADRKCTRGISAGIEIAATVVYPVLQSQISTIRTGLWSIWSQDLVPESDRLIVGGVQNSLQSLMDLLAYVMGIIISNPRDFWKLSLFIPGSHISCIPLLHPCIPCAEAHLSLRTSKVELMCCNSILICEGLSVGKKLCTV

SEQ ID NO: 150654 - protein, 389 aa, Glycine max
  Coding DNA Sequence Number=SeqID_33876
  Gene Ontology: Mol. function=iron ion transporter activity; Cellular component=integral to membrane; Biological process=iron ion transport
  Homolog annotation: Hit_ID=Q9LZC8; Match level="QueryCoverage=96%, HitCoverage=86%, E-value=1e-104, Identity=47%"; Hit description =Transporter like protein
  Pfam annotation: Domain name=FPN1; Domain location=236-343; Score =3.2; E_value=0.037; Accession=PF06963.3; Description=Ferroportin1 (FPN1)
  Pfam annotation: Domain name=MFS_1; Domain location=26-387; Score= -17.4; E_value=0.002; Accession=PF07690.6; Description=Major Facilitator Superfamily
  Pfam module annotation: Pfam domain module=FPN1::MFS_1; Domain location=236-343::26-387
MEENVKLKESPFTGQQEKPSALITYLYIGHFLARWGARMWEFSVGLYMINIWPESLLYAAIYGAVESAAIAVFGPIIGRWVDKLSCVRSTNFSIFILLVIIINVCGGIGVLSTLAGTILIEREWLLVISEDQPPELLTKMNSVTRRIDLSCKLLVPVISGFIISFVSLKASAITLALWTTVSVWVEYWLFTSVYHGIPALVQSSQRRMERLIQCDMEMNNQTMEKDSLLPVTDDGSELADRKARKKISERILEIPYIAAWRVYLQQEVVLPGLALALLFFTVLRVIDEIPITCLSFGTLMTATLEWEGIPEYIIGISRGISAVIGIAATVVYPVLQSRISTIRTGLWSIWSQDLVSESDRLIVGGVQNSLQSLMDLLAYVMGIIISDPR

SEQ ID NO: 150655 - protein, 58 aa, Glycine max
  Coding DNA Sequence Number=SeqID_33877
MVRGSVEVEVFKEVWNFKVPSKVKTFIWLLSSVTPVVRGNGSTGNMYIKASCVGLREV

SEQ ID NO: 150656 - protein, 139 aa, Glycine max
  Coding DNA Sequence Number=SeqID_33878
MDEIQDLPLVILLLYLICTFYNGQMNQDVATRDDQQTRDKFVTYVSLEDESSSRKGLQIYDYKLPFRVFGLASPNVSTDGSIEEPTHEEELDGKGRFLYKPLEQWNGGGDNNNVVVVTVTLAVVVVEWWWRKRNGGRFK

SEQ ID NO: 150657 - protein, 36 aa, Glycine max
  Coding DNA Sequence Number=SeqID_33879
MAVNGFDVAPGQLPHAPEDHPHRPLRPQPRHPPRPV

SEQ ID NO: 150658 - protein, 180 aa, Glycine max
  Coding DNA Sequence Number=SeqID_33880
MGKVEEVQEQMKADREAMKEQMATMMEAMMSMKKIMKANEVAVAATRAVDKYERGPHYAQIQNKHAFPPYGLPPNYTPPNVAYIPNEDVNNSALMLIESQQPHHPCLGYATEGQAVGDIPLQNTLEGPQYHPQPHPSHSTTIKNPHAMAEMGKSDHLKERLRAIEGGEDYAFANLEELFL

SEQ ID NO: 150659 - protein, 108 aa, Glycine max
  Coding DNA Sequence Number=SeqID_33881
IMPARRPMDPKKSNRVLGFPTLITGLCQFYGVHVAPSKVIRPPTNRAFIKKYCAPRQAQGETPQQPGDGRQRATDAPSPPLKPLNSSTKAGALPTTHGRPAGDKVQSQ

SEQ ID NO: 150660 - protein, 144 aa, Glycine max
  Coding DNA Sequence Number=SeqID_33882
  Subcellular localization annotation: CTP_CleavageSite=59; ConfidenceScore=5.32e-01
MEFKYRDGQIRRTPSPLRSPLPSNSYVSNRPLHGCDFASGGFPSNVSAPRVFPMVMPINVNEVFQRELEKEKIWRELEKEKIRREIIAREMAFAQRRELEDEVRKEMELERTSRMSMQRSEGIAFREPISESINQSRSNNITMF

SEQ ID NO: 150661 - protein, 104 aa, Glycine max
  Coding DNA Sequence Number=SeqID_33883
AISLAGGVGVETPHSQGLLLHDGALYLKALKPSELVDSGLHKQLEMQFHQFRKDRTFSIRVEFIPDKWLRLSLKEHFSMLVLLLHRDPAIGITDAGGAGCHDAR

SEQ ID NO: 150662 - protein, 82 aa, Glycine max
  Coding DNA Sequence Number=SeqID_33884
KVEAFAKAKKKSLEEACNKVKLDETLEGKEALELEGVLASIKTLFIEKHKKKLAEEERLAALVGKESKDNLVEVVLDRVASE

SEQ ID NO: 150663 - protein, 504 aa, Glycine max
  Coding DNA Sequence Number=SeqID_33885
  Gene Ontology: Mol. function=bis(5'-nucleosyl)-tetraphosphatase (symmetrical) activity
  Homolog annotation: Hit_ID=Q8ZIK7; Match level="QueryCoverage=49%, HitCoverage=86%, E-value=1e-119, Identity=79%"; Hit description =Bis(5'-nucleosyl)-tetraphosphatase, symmetrical
  Pfam annotation: Domain name=DUF525; Domain location=130-250; Score =249.3; E_value=8e-72; Accession=PF04379.5; Description=Protein of unknown function (DUF525)
  Pfam annotation: Domain name=Metallophos; Domain location=224-376; Score=21.2; E_value=0.0036; Accession=PF00149.18; Description =Calcineurin-like phosphoesterase
  Pfam annotation: Domain name=RrnaAD; Domain location=1-135; Score= -75.6; E_value=0.0047; Accession=PF00398.10; Description=Ribosomal RNA adenine dimethylase
  Pfam module annotation: Pfam domain module=DUF525::Metallophos::RrnaAD ; Domain location=130-250::224-376::1-135
MHFMLQKEVVNRLVAGPGSKAYGRLSVMAQYYCQVIPVLEVPPQSFTPPPKVDSAVVRLVPFTQPPYPVSDVRLLSRITTEAFGQRRKTLRNSLGHLFTAGALDELNIDASLRAENVTVAQLNLRRTECMSELARVCVQVLSQYVESQSSPDEDRYVFAYTITIRNLGRNSVQLRSRYWLITNGNGRETEVQGEGVVGEQPHIAPGNEFQYTSGAVLETPMGTMQGHYVMIDEEGETFHVEIPVFRLAVNFDAQQDELWLTGDLVARGPGSLEVLRYVRSLGDCVRMVLGNHDLHLLAVYAGISRNKPKDRLTPLLEADDADELINWLRRQPLLQVDEEKKLLMAHAGITPQWDLETAQQCAREVEAVLSSDSYPLFLDAMYGDMPNNWTPELSGLARLRFSTNALTRMRFCFPNGQLDMICKEAPASAPPPLKPWFQVPGKISSDYTQIFGHWASLEGKGTPEHVIGLDTGCCWGGTLTLLHWESGQYYTQVSNRDQAMAESA

SEQ ID NO: 150664 - protein, 127 aa, Glycine max
  Coding DNA Sequence Number=SeqID_33886
  Gene Ontology: Mol. function=4-hydroxythreonine-4-phosphate dehydrogenase activity; Biological process=pyridoxal phosphate biosynthetic process
  Homolog annotation: Hit_ID=P19624; Match level="QueryCoverage=99%, HitCoverage=47%, E-value=5e-41, Identity=74%"; Hit description=4 -hydroxythreonine-4-phosphate dehydrogenase (EC 1.1.1.262) (4- (phosphohydroxy)-L-threonine dehydrogenase)
MRGGQRNAQRFGRQHHHHAIATGALSKELGVAGEGDAGVIDHAFVHRTVRRRSPAAPSRWAAASAYRPAAAVVPRRADSRAASAANPVEPRAGAARRRLRTPPAQPASHAEPAQRRDRDQSRRVRRA

SEQ ID NO: 150665 - protein, 170 aa, Glycine max
  Coding DNA Sequence Number=SeqID_33887
MENWRTALGNQFAGLQTRWWRMHERQSIHGAPNKSGEWRIALGNHFAWLQTHWWRMHERQSIHGAPNKSGEWRIALGNHFAWLQTHWWRMHERKLIHGALNKSGEWRIALGNHFAWLQTHWWRMHERHSIHGAPNKSGEWRIALGNHFAWLQTHWWRMHERHSIHGALNK

SEQ ID NO: 150666 - protein, 160 aa, Glycine max
  Coding DNA Sequence Number=SeqID_33888
  Gene Ontology: Mol. function=oxidoreductase activity; Cellular component=membrane
  Homolog annotation: Hit_ID=Q4BD08; Match level="QueryCoverage=98%, HitCoverage=53%, E-value=6e-28, Identity=43%"; Hit description=Twin -arginine translocation pathway signal
MAAPDLADYKPIFFSAEEWQFILAATDRLIPAGGNGKAPGALETNVPIFIDQQLHSPEFGAEIYLQGPFDVHAPATMGYQIPFTPQQMYRTGIKLVEQWTQSTYHKAFSQLTLAEKDAVLTKVNKNDGIDFTALGEPNLKASQFFSQLLSDTKHGYLADP

SEQ ID NO: 150667 - protein, 209 aa, Glycine max
  Coding DNA Sequence Number=SeqID_33889
MTTLTQIWMTLLLSNIQPSDHNSDLPLPKCQLVYAILTRMSIHVAQLIADAIYIFAGMAPTRHHLDPDKSNRALGFPALITGLCQSFGVPVAPSKAADAPPPHQASPARSFDTEQYLRHLVRQQAANHRANVQTHDCLYQMSLSLQSQGFTSFPCPTPDQFRAEVAWPGDWPEARAGEAPAEAPDEADEAREDEEMTDLLDFLGGSGAT

SEQ ID NO: 150668 - protein, 98 aa, Glycine max
  Coding DNA Sequence Number=SeqID_33890
  Gene Ontology: Mol. function=methyltransferase activity; Biological process=cell cycle
  Homolog annotation: Hit_ID=P64237; Match level="QueryCoverage=96%, HitCoverage=46%, E-value=1e-36, Identity=72%"; Hit description =Methyltransferase gidB
  Pfam annotation: Domain name=GidB; Domain location=1-93; Score=-16.6; E_value=4e-05; Accession=PF02527.6; Description=Glucose inhibited division protein
VQHELGLTNVTPVQSRVEEFPAEPPFDGVISRAFASLEDMLTWCHHLPGATGHFYALKGVRPDDEIAALPAGFAIEKIEPLRVPELEGERHLVVIRRQ

SEQ ID NO: 150669 - protein, 369 aa, Glycine max
  Coding DNA Sequence Number=SeqID_33891
  Gene Ontology: Mol. function=amino-acid N-acetyltransferase activity; Cellular component=mitochondrion; Biological process=amino acid biosynthetic process
  Homolog annotation: Hit_ID=Q46X04; Match level="QueryCoverage=72%, HitCoverage=76%, E-value=5e-94, Identity=65%"; Hit description =Arginine biosynthesis bifunctional protein argJ [Includes: Glutamate N-acetyltransferase ...
  Homolog annotation: Hit description=(EC 2.3.1.35) (Ornithine acetyltransferase) (Ornithine transacetylase) (OATase); Amino-acid acetyltransferase (EC 2.3.1.1) (N-acetylglutamate synthase) (AGS)] [Contains: Arginine ...
  Homolog annotation: Hit description=biosynthesis bifunctional protein argJ alpha chain; Arginine biosynthesis bifunctional protein argJ beta chain]
  Pfam annotation: Domain name=ArgJ; Domain location=121-369; Score =176.8; E_value=5.4e-50; Accession=PF01960.9; Description=ArgJ family
  Pfam annotation: Domain name=DALR_2; Domain location=1-51; Score =71.3; E_value=3e-18; Accession=PF09190.1; Description=DALR domain
  Pfam module annotation: Pfam domain module=ArgJ::DALR_2; Domain location=121-369::1-51
MDDDFNTSEAIAVLFELANDLNKDKSAATAALLKQLAAIIGLLQRAPESFMQGESDSALDVESLIAARIAAKTAKNYAEADRIRKELADAGIILEDTPQGTRMPVKLSAPAAETLLPVKGVQLGFAQAHIRKPNRKDVLVMTVPEGSSVSGVFTLNRFCAAPVTVCKEHLKLGKGIRALLVNTGCANAGTGQQGLDDARASCIGLAQALNISPEQVLPFSTGVILETLPMERLLAGIAPAVANLQENNWLNAAETIMTTDIVAKGASRTLMVDGKQVTITGISKGSGMIHPNMATMLGYIATDAAISQAALDSIIQHAVNKSFNCITVDGDTSTNDSLILMATGQAGGSRQKRRRVPQSGLRYRPLAAD

SEQ ID NO: 150670 - protein, 72 aa, Glycine max
  Coding DNA Sequence Number=SeqID_33892
MLIDVGNALACACCVCSWRAKCTDLLGSLALALGHVHTLDVVYVRGGRSALIFQVYVHGVECTDLVRWPRRG

SEQ ID NO: 150671 - protein, 69 aa, Glycine max
  Coding DNA Sequence Number=SeqID_33893
  Gene Ontology: Mol. function=aspartic-type endopeptidase activity; Cellular component=membrane; Biological process=proteolysis
  Homolog annotation: Hit_ID=Q8A9K7; Match level="QueryCoverage=86%, HitCoverage=33%, E-value=2e-09, Identity=50%"; Hit description =Putative signal peptidase
MAPTVMAESATLKIYLKNSMCFPPIRGKLSGTFQSTSGKWSISTTQPLMKDEYPCPAEAIFEIPPYPIQ

SEQ ID NO: 150672 - protein, 263 aa, Glycine max
  Coding DNA Sequence Number=SeqID_33894
MTVTALGALYTSRASRPSRDGVDRASAVDITGYPHGQWIPFDADAIGQLLGYPLVLEEGQECEYGQRRNQSDGFDEEAIAQLLCIPGQDFARTSAGRRVRIMRTNMTTLTQIWMTLLLSNILPTDHNSDLPMPKCQLVYAILTRMSIHVAQLIADAIYIFAGMAPTRHPFDPDKSNRALGFPSLITGLCQSFGVPVAPTKVIRPPITRAFIEKYCTQRQAQGDAPQAAGAPPPPHQAGQAGSFDMEQYLRHLVRQQAANHRAH

SEQ ID NO: 150673 - protein, 85 aa, Glycine max
  Coding DNA Sequence Number=SeqID_33895
  Gene Ontology: Mol. function=protein kinase activity; Biological process=protein amino acid phosphorylation
  Homolog annotation: Hit_ID=Q6YTQ6; Match level="QueryCoverage=79%, HitCoverage=4%, E-value=1e-15, Identity=61%"; Hit description =Helicase-like protein
FQFLKTQLAISIKGTQLATLLNQTSLIIWDEAPMTHKFYFEALDHSLRDIIKHNLKDCKIFGGKVMVFGGDVWQILPVIPKRQPL

SEQ ID NO: 150674 - protein, 95 aa, Glycine max
  Coding DNA Sequence Number=SeqID_33896
MTKARQKGVRKENGGDACHPARPCEQVTETYEFRNDTCFLSVMLRNLADYIIIPFLTYGMLRNLTNCATMLPFEFRHVTELRKLPDDGCQVPPNG

SEQ ID NO: 150675 - protein, 178 aa, Glycine max
  Coding DNA Sequence Number=SeqID_33897
  Gene Ontology: Mol. function=DNA binding
  Homolog annotation: Hit_ID=Q1SFS3; Match level="QueryCoverage=91%, HitCoverage=31%, E-value=1e-18, Identity=35%"; Hit description =Lambda repressor-like, DNA-binding
WIKFIEGKAYGKIWDLAMIEVSVEAIASLTQYYDQSLRCFTFGDFQLAPTIEEFEGILGCPLGGRKSCLFARFYPSRARIEKVVKILEQELDQVKQNRNGVVGIPRKRLEEKAKALANQGEWTSFIDILALLVFGTILFPNVDGPVDLAAINAFLAYHHSKESPVIAILADAYDTFDL

SEQ ID NO: 150676 - protein, 69 aa, Glycine max
  Coding DNA Sequence Number=SeqID_33898
MAQCVCLSLYVCVIVCVCVCVFVSLSGSKGSLNCKHHEPHDEGSSIKSMLYKLLVNLRSGVFMLQIDGF

SEQ ID NO: 150677 - protein, 290 aa, Glycine max
  Coding DNA Sequence Number=SeqID_33899
  Gene Ontology: Mol. function=voltage-gated chloride channel activity; Cellular component=integral to membrane; Biological process=chloride transport
  Homolog annotation: Hit_ID=Q5PD50; Match level="QueryCoverage=52%, HitCoverage=32%, E-value=1e-42, Identity=57%"; Hit description =H(+)/Cl(-) exchange transporter clcA
  Pfam annotation: Domain name=Glutaminase; Domain location=189-290; Score=-104.4; E_value=5.9e-07; Accession=PF04960.6; Description =Glutaminase
MTRFGIAHAKQIEAHTADVAANLYRGSFAPQHHARTQRAHAADKFNRQHAPPAHRAQLFQRALDFRNARASCLRREAAHQKIADAAQQRRDKKRAQQRHGQVIRTLCQPADPQVENKIDRAIESHPHQPGEDTDQRGQQQQCQRGFIASQQFLQQHKAPGAHRVGRLGGISNALLEEIVTDVRPLTRQGKVADYIPALAGVDADQLGIAIATADGRSYQAGDAGTRFSIQSISKVLSLTVALTLYEDAEIWQRVGKEPSGQAFNSLPTHRATPAHAGVCASSGTAAGHSV

SEQ ID NO: 150678 - protein, 358 aa, Glycine max
  Coding DNA Sequence Number=SeqID_33900
  Gene Ontology: Mol. function=acyltransferase activity; Cellular component=membrane; Biological process=homophilic cell adhesion
  Homolog annotation: Hit_ID=Q1IEN2; Match level="QueryCoverage=99%, HitCoverage=75%, E-value=3e-46, Identity=34%"; Hit description =Putative outer membrane autotransporter
GAGQRETRGTVLDQPASTEYRTGERQVIAAQHGEVGTGGKADCVAYRNRCRRIQRSATAYVQLAGTQCLRIAQLQQARVEADPSAERIGSIQCQRGRTVLDQAASAADETAQRHVLAAQQIQRCACPEVEVVGEVQRYRTVQRGIGTHRQCTGAQCADVPQVHAAAVGGQPTTEAVGAVEGQRAGTVLHQPAGTGHHATQRDRLRARQRQCGTRAQGHIVDQVQRGAAIERDATANAQYSRTERAAVAQQQAARVRVESTAEGVGTVQGQCQRTVLDQAAGAGDVAGQGQVLAARQGQRRAEVDRIAQVQRISGVQRTVATYGRRTASQRTGVDQHQATGGKIYPTAECVGAGQRLHA

SEQ ID NO: 150679 - protein, 169 aa, Glycine max
  Coding DNA Sequence Number=SeqID_33901
MGPEPFKFINDWLELKGVDDFAKHTYEALQVEGWVAFKLEEKLKKLKFPLKEWSKYNYGELQKKWDDIKKEIALSDRKVEHGVLTVEEVQAKADLVGNLKQTSTLLESQVYQNARLSCMKEGDSNTRFSEEEVRFAIWSCFGDKSLGLDGFNFRFVKRFWNLLKADVIQ

SEQ ID NO: 150680 - protein, 130 aa, Glycine max
  Coding DNA Sequence Number=SeqID_33902
  Subcellular localization annotation: CTP_CleavageSite=44; ConfidenceScore=5.02e-01
MGLSSVAFAAEAATTAPAASATTATAAPAKAQVKHHGKKAPVQKAQAAKKHHKKAGLTCTTPGSPGVFSSGVRIDAAPLLVRDRSDRPDPLRTDRRKRSMRKSVLLLLCSLPLIAAQAARADGPSKAEQT

SEQ ID NO: 150681 - protein, 59 aa, Glycine max
  Coding DNA Sequence Number=SeqID_33903
MTEGCGEGFCLANLPGDAFSLWGNFFEAKKQMMADAKVGGAGLWPRAKFRIGWPPPPPP

SEQ ID NO: 150682 - protein, 160 aa, Glycine max
  Coding DNA Sequence Number=SeqID_33904
MGGRKPYLFSRFYPFHDKSCQGSENLSTRVGPGKAKQEWGGRNTEKILGAIDVFLAYHNHKESPVVAMLAGLYDTFDRRCEESNARIVCCTPTLYVGLVSHLFLQEGRPVYPLQGYRSCVEKGKANWDQLLASMGGRLLIGSLARRKEESGFYLHAKDVP

SEQ ID NO: 150683 - protein, 80 aa, Glycine max
  Coding DNA Sequence Number=SeqID_33905
MTQELVARGDTLRLSAPRHSVTPSVIDEQRPIWSSAPFPEMSAFSDGDFSSLTSYLELRRSEFLIGGYVGARALLLSAAP

SEQ ID NO: 150684 - protein, 148 aa, Glycine max
  Coding DNA Sequence Number=SeqID_33906
IYESVIINFLAYDYHSKFDLHFTPPLHHQTCKRRRASRKHIWTYEITQSMLGAPYSLQLPPSVTQCLIHCGDHMTILRKFGPPLQWNVIVLDKGISDKYITQPWYKFLQEGDFSHGDELSFYYRRAEKIWEALLENMLSTSVIYDFQH

SEQ ID NO: 150685 - protein, 85 aa, Glycine max
  Coding DNA Sequence Number=SeqID_33907
MGFYGKGKCYNARGISLSSDMIPSELGYERAAQISRRSNGERIQDRRFSEIGLLTQEMEALEEDYGDGNGKNESRQFIEGLMDLE

SEQ ID NO: 150686 - protein, 104 aa, Glycine max
  Coding DNA Sequence Number=SeqID_33908
MGKEISEQEMELTTLAMVLQTPGEKEFEYVIECLVNEDGGRMVACIEKLGDPDDESIGHVMFEELENNRPKEKPKVELKTLPAHLKYVFLEDNETKPVIISSSL

SEQ ID NO: 150687 - protein, 45 aa, Glycine max
  Coding DNA Sequence Number=SeqID_33909
MVDQQFTQVSKDKDTNFIVAILPSYWLLAKNPSNETCQKKECKRY

SEQ ID NO: 150688 - protein, 125 aa, Glycine max
  Coding DNA Sequence Number=SeqID_33910
MVTKGWSFVGQQWWVRKEGESYVREGRKASEIFLLIIQNAPFTKIPGRNFQDVTPSLDDKGEKRCRTIWFPRMSSDSPSLDDKGEKRCGTIWFPRRRKRKGKIPNQGKWGKAKKKENSRSKIGRE

SEQ ID NO: 150689 - protein, 122 aa, Glycine max
  Coding DNA Sequence Number=SeqID_33911
MPICTNILRAETQIKNVTNITNEKNKNTHSTAYMLGRRDLESKEGKALMNNNTYSPTHNSPAIKILRGKYISVILALSKMSIWYGHNMLKSPKDPYNNEYSEPLLLIYANLTSTSFVQLWQS

SEQ ID NO: 150690 - protein, 73 aa, Glycine max
  Coding DNA Sequence Number=SeqID_33912
MEDILMKTQFMGLRKGVMNGELHRAITTDGSKLEGGGHMNENAIHGAPKKGLRMENCTKQSLRMAPNPKVEDT

SEQ ID NO: 150691 - protein, 277 aa, Glycine max
  Coding DNA Sequence Number=SeqID_33913
  Pfam annotation: Domain name=Transposase_23; Domain location=57-121; Score=-8.1; E_value=0.0088; Accession=PF03017.5; Description =TNP1ENSPM transposase
KEAIKKELSNKGSPELLQIQPDIQQVAARVSTQGSNVVTNVQASQEHHADAIPLMGLYVQLKDGTTRLVAMGKIMEGDSVIHTVAYADDVVRVSVETVIDPEAEVPYATSEIQYVKQAVDTFVAWPTHLVKAVLDEVPQSIPHNEDAHVPKPTNVDADDPLRGLIKYSFDIYDNPLEINFDGRFLGIVDASASIFITYSDVSEIIAGDKSLNISVIQLWLMYIHEWSQIFSQGFMYAFLEPQSLVCSKERRSECEQYLLRWLKESDREVYIGPYFHQ

SEQ ID NO: 150692 - protein, 74 aa, Glycine max
  Coding DNA Sequence Number=SeqID_33914
MTKLGLCLSSGPPPQDDKRVRITIRMTKLGLCLSSGPPPLDDKRVRITIRYLRVSWVQNDQTWSLLVIGPAASG

SEQ ID NO: 150693 - protein, 89 aa, Glycine max
  Coding DNA Sequence Number=SeqID_33915
MTIGYPCMQAFTVMDKKGTANKEQAQEVALVCIKNKLKRLLKRLALTNPLKVLQEHNKGLDQTYLREVAKEKKHRLLTMLECDEHDARP

SEQ ID NO: 150694 - protein, 61 aa, Glycine max
  Coding DNA Sequence Number=SeqID_33916
MPSAASICQLMSSNRELMFKDMTEMILMQADHIVDFKWEKWDMYKNVRYREERKDIQEPRT

SEQ ID NO: 150695 - protein, 39 aa, Glycine max
  Coding DNA Sequence Number=SeqID_33917
MEEKLMLKISGGLRSTYLKLFHGIAAKDKAEEVRGDVIP

SEQ ID NO: 150696 - protein, 89 aa, Glycine max
  Coding DNA Sequence Number=SeqID_33918
MGIACPKNHLKMYCPKMGAHAKDENLLMHFFQESLTGAAVTWYTNIKPSRVDSWKDLMVAFVRQYQYNSDMALDRMQLQNMCKKSMNPS

SEQ ID NO: 150697 - protein, 128 aa, Glycine max
  Coding DNA Sequence Number=SeqID_33919
  Subcellular localization annotation: CTP_CleavageSite=53; ConfidenceScore=5.07e-01
MDMNVGYLISHQISLTAQHDTSRLGFLALIIALCKARGVQSDSRGPRKARGKRSEASSTAPSETGGPSSSTLPPSSSIEIPVIPPAPTQIPLPAPLYTGPTYLIFTPQMLHSMLQSIHRGQSIIMQSL

SEQ ID NO: 150698 - protein, 178 aa, Glycine max
  Coding DNA Sequence Number=SeqID_33920
MGEVEEMQEKMEAIKEQMATMMKAMMSMKKIMEANAIIVAAISVVAKVNPMLPSGLKQMNHPTSNMAHISQTMGETHEIPHHNLADFEPWLGYATEGQAVGGIPFKNTLEGPQFRPQPQPLHFAVGRAPPAMAEKGKADHLKGRLRAIEGGEDYAFANLEKLFLIPKHGHSQVQGAGL

SEQ ID NO: 150699 - protein, 380 aa, Glycine max
  Coding DNA Sequence Number=SeqID_33921
  Gene Ontology: Mol. function=transferase activity, transferring hexosyl groups; Biological process=antibiotic metabolic process
  Homolog annotation: Hit_ID=Q2JEH8; Match level="QueryCoverage=99%, HitCoverage=96%, E-value=3e-48, Identity=33%"; Hit description =Glycosyltransferase, MGT family
  Pfam annotation: Domain name=Glyco_tran_28_C; Domain location=230 -378; Score=-13.7; E_value=0.009; Accession=PF04101.6; Description =Glycosyltransferase family 28 C-terminal domain
  Pfam annotation: Domain name=Glyco_transf_28; Domain location=4-150; Score=-13.6; E_value=0.042; Accession=PF03033.10; Description =Glycosyltransferase family 28 N-terminal domain
  Pfam annotation: Domain name=UDPGT; Domain location=3-378; Score= -126.7; E_value=0.00031; Accession=PF00201.9; Description=UDP -glucoronosyl and UDP-glucosyl transferase
  Pfam module annotation: Pfam domain module=Glyco_tran_28_C::Glyco _transf_28::UDPGT; Domain location=230-378::4-150::3-378
MAKFVFVVPPLTGHVNPTLSIGAELLNRGHEVAWISLDKNLNTKLPAGGELLLIQYDQTDEEKRDSEQYLDIISKKVVYGIDSIKFLYDDVLIPLNRHCYNGIVHLLDSYKPDLVIGDHQLFAAAIAAKKLNLPYSTTVTAPAAIKIMDELPKVHEWEVNKIIELQKELGIMEDYSLASSDLLTMVLTSRYFFGEMELPSNYRFTGPVLTERRISCEFDWERFNSSTQKKILVSIGTTFDHDHKKAFFQKVIDAFKDEDLTVVVVSDPQLFDSWPENFMVYQQVPQLDLLPHLDGVVCHGGHNTVSETLSNGLPLVVIPIAYDQSHVAGRVVRTGAGERLNFNRFKSNHLKEAVQQILSNSDYRKAAEVIRQSFIEAGGT

SEQ ID NO: 150700 - protein, 266 aa, Glycine max
  Coding DNA Sequence Number=SeqID_33922
  Gene Ontology: Mol. function=DNA binding
  Homolog annotation: Hit_ID=Q1SFS3; Match level="QueryCoverage=99%, HitCoverage=51%, E-value=2e-85, Identity=58%"; Hit description =Lambda repressor-like, DNA-binding
  Subcellular localization annotation: CTP_CleavageSite=31; ConfidenceScore=5.05e-01
MAFYSSQILTTSSISMPLKSFLRKNPVPTLLADTYHSIHDRTQAGRGTISCCAPLLYQWFTFHLPQSRAFKTNDDKLSWPRRIMTLDPSDIVWYQAASDVGEIIVSCGEYPNVPLLGMRGGISYNPLLARRQFGYPIKTKPNNLALTNEFYLNHGDHSNKRERFAQAWSAIRRLNRSQLGKKSDYVHESYTQWVIDRTKSFGLPYRLPRYLSSTIPPSSLPIPFDTKEEFHEQLTKERQEKETWKRRCQELEQENETLKGKIAQQS

SEQ ID NO: 150701 - protein, 96 aa, Glycine max
  Coding DNA Sequence Number=SeqID_33923
MYISMAQKYIMKHSQQNMLSNKNPPTLIPKTIPKFLKVKVIYIMVFHLRLVVSFKTRKGKQGSKGLSKELIQGSINKNQAKATVQAINGAKHTKRL

SEQ ID NO: 150702 - protein, 71 aa, Glycine max
  Coding DNA Sequence Number=SeqID_33924
MWLKEDKTPEVLSGNRDERTKRACALSLFIAIVKILDFQMNTLSGPSLSRTCTTKRHFAYAKRALWAKPEC

SEQ ID NO: 150703 - protein, 84 aa, Glycine max
  Coding DNA Sequence Number=SeqID_33925
MLRLAPPSRLARQGNGGNVACPTYSEHNLGLRPLPTTFQLNKNKHQFKDKMPQGFEQECTNGALKYTNGNLESQRMRYLLVGGQ

SEQ ID NO: 150704 - protein, 130 aa, Glycine max
  Coding DNA Sequence Number=SeqID_33926
  Gene Ontology: Mol. function=zinc ion binding
  Homolog annotation: Hit_ID=Q1SXX9; Match level="QueryCoverage=85%, HitCoverage=11%, E-value=7e-54, Identity=84%"; Hit description=Zinc finger, RING-type
MQGEINIHQFFTGYTNGRRDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVCNICLFLSWAVIFKDFF

SEQ ID NO: 150705 - protein, 192 aa, Glycine max
  Coding DNA Sequence Number=SeqID_33927
  Homolog annotation: Hit_ID=Q337M4; Match level="QueryCoverage=39%, HitCoverage=20%, E-value=4e-21, Identity=68%"; Hit description =Uncharacterized conserved protein, putative, expressed
MNTDCLGRRLGPRLLGKVDDSGVNNRFTYKTTSYQDPVVEINYERADIIILKLKMTIASLSPDCLLQQSSTVEDSISFKFSDGITESVPCSYTEFAERLVLRQYKNLPDTEVKEFHRRDGFEVASADKMAKSCMISIVLGGLVLNGDVSRTTRRIVVVEDDKRAERGMPSFNSELPNSNSWVEDVTRVWDPC

SEQ ID NO: 150706 - protein, 296 aa, Glycine max
  Coding DNA Sequence Number=SeqID_33928
  Homolog annotation: Hit_ID=Q2QUQ6; Match level="QueryCoverage=44%, HitCoverage=13%, E-value=2e-13, Identity=31%"; Hit description =Expressed protein
  Pfam annotation: Domain name=DUF1723; Domain location=42-91; Score =57.4; E_value=4.8e-14; Accession=PF08330.1; Description=Protein of unknown function (DUF1723)
MDGITHMKNGAHGSIKIQHKYEDVWMKAGIDQAIKALTFQIRRNDELIIELAQRWCSKTNAFVFPWGEATIILEEMKVCWRYFVKGAPISSPLVSNAEKEIEQELIRAFRMFFKSKAKRADHNPRMKHFMSNESLVEHEAILSLWLSRAGNGYIWRPYDNSPALQLYNENDKWSASNGYKFVHCIMCLHYVEAIKSKERDMHDHYFERSSEHLLPTSSSVKKESGGFYGPPPSFTSKINTEQEDFDEEGKVSIIQLSDSSDELDVLVRKKLEMARLCLVLYWMFFHQQVLKEQYVC

SEQ ID NO: 150707 - protein, 432 aa, Glycine max
  Coding DNA Sequence Number=SeqID_33929
  Gene Ontology: Mol. function=protein serine/threonine kinase activity; Cellular component=membrane; Biological process=protein amino acid phosphorylation
  Homolog annotation: Hit_ID=Q9LJU5; Match level="QueryCoverage=71%, HitCoverage=84%, E-value=1e-137, Identity=76%"; Hit description =Receptor protein kinase-like protein
  Pfam annotation: Domain name=Pkinase; Domain location=109-372; Score =120.3; E_value=5.5e-33; Accession=PF00069.15; Description=Protein kinase domain
  Pfam annotation: Domain name=Pkinase_Tyr; Domain location=109-372; Score=73.1; E_value=8.9e-19; Accession=PF07714.7; Description =Protein tyrosine kinase
  Pfam module annotation: Pfam domain module=Pkinase::Pkinase_Tyr; Domain location=109-372::109-372
MPKGRSKRIISGSFLDPDSPRPPNSLGVKLSNGFQGPTLREIREKKKKEEKNEAKALPNCDRNRLLRRSSFSIHGKRNLITNELAKLGKGNITSKIFPYRELCVATQNFNPANMIGEGGFGRVVAVKQLDRNGFQGNREFLVEVLILSLLHHPNLVNLVGYCAEGEHRILVYEYMINGSLEDHLLEITPDRKPLDWQTRMKIAEGAAKGLECLHEQANPPVIYRDFKASNILLDENFNPKLSDFGLAKLGPTGDKTHVSTRVMGTYGYCAPEYASTGQLTSKSDVYSFGVVFLEMITGRRVIDNARPSEEQNLVLWAQPLLRDRMKFTQMADPLLEDNYPIKSLYQALAVAAMCLQEEADTRPLISDVVTAIEFLARKKVEVDEPRHTKETSSTQDGDSSEHNESDEESDGEEDDENEDEEKDKNVEINKKE

SEQ ID NO: 150708 - protein, 153 aa, Glycine max
  Coding DNA Sequence Number=SeqID_33930
MDRDTLGYSRRRGVKGSPLQPTTLRFRRCRGSRTLCELGIVDRQKEYGRVGIHIRHFTRITLWCTWCQQIEQMLRPSPSNTLDTATFLGDLCLVCNWSGLKTLIFYLGMKVSHDTQEFIMTPDWEDHPDMTPEDEEEYRELLQDLEPSFERED

SEQ ID NO: 150709 - protein, 488 aa, Glycine max
  Coding DNA Sequence Number=SeqID_33931
  Homolog annotation: Hit_ID=Q2QUQ6; Match level="QueryCoverage=60%, HitCoverage=33%, E-value=6e-25, Identity=28%"; Hit description =Expressed protein
  Pfam annotation: Domain name=DUF1723; Domain location=38-84; Score =47.4; E_value=4.7e-11; Accession=PF08330.1; Description=Protein of unknown function (DUF1723)
MEPSEDTIIEIKEEQLMVSPLSEAGIDQAIKASTFQIRRNDELILEPAQRWCSKTNTFVFPCGEATITLEDMKGRSYATDEHFMSNESRVEHEGFLSLWLSRFVFPPKSYNAISKNVFPIAVHLARGSKIALAPAVLAGIYRDLRLLNNKIRTATKVEVGVKLWTPFQLAQVWALERFPLLHSRLPHGIRQGKLMVAKWHKVKMLKHDSFKLILDSLRARNGFIWRPYKNSPPLELYNEKDMWACNNPNYFDELESFARCLRVSVGMECVEQYGANRIAMQFGMDQDIPDKNLYTALRAWHASRACHQPNVTSGYYHWWNQSNPSKEEDIHDGCVVSSSEHLLQTLSSGKKEGGGSDDPPPDFTSKFKREQEENFDEVGKLSIIILSSDSYLSSDARCFGEDVGNGEASSIVLYMLFHHHQGLKEQGVSMAMTMEDKEGEDASHRIVGIASNFESRIEKLERVIAKLEAAKNGQRVQNTGVKAKPSAP

SEQ ID NO: 150710 - protein, 74 aa, Glycine max
  Coding DNA Sequence Number=SeqID_33932
MSAERDQSGASHIETLEVEQRMLSSNSNGHNFSLGCPIQTLHISRCSKLNNESYEEIQIVITFHSDFRFRCITD

SEQ ID NO: 150711 - protein, 78 aa, Glycine max
  Coding DNA Sequence Number=SeqID_33933
MKSVNFREHRVEQGDKISSFREINEFLSDCEIPRGGGDIPTPLDFSIGKCTVSLEHDRTGTALLGIVCRVLCCEYNTI

SEQ ID NO: 150712 - protein, 95 aa, Glycine max
  Coding DNA Sequence Number=SeqID_33934
MKFPHVNDFVVPGGTKGAEDCVSPCMLSSVLSSGQQKTLDDTRVRITVRMTKLGLCLSSGPPPLDDKRVRITVRMTKLGLCLSSGPPPLDDKRCG

SEQ ID NO: 150713 - protein, 198 aa, Glycine max
  Coding DNA Sequence Number=SeqID_33935
  Gene Ontology: Mol. function=protein binding
  Homolog annotation: Hit_ID=Q86AI8; Match level="QueryCoverage=86%, HitCoverage=33%, E-value=9e-11, Identity=30%"; Hit description =Similar to Homo sapiens (Human). Mucin 2
MPRLRRATRPRHQRTACPHLQRATSYPHHQRTIRPHLERTTRPHHQRVSLPHLQRTTCPRLERATRPHLGATRPHHWVLVTLTVRGLRVLTLRGLHVLTIRGLHALTSRGLHVLALRKLHALTLGTSYPHCQRTTRPHLERTTRPRHQRAARPHLQRATRPRHQRAARPHLQRTTPPHLERATCPHFQCAPHPHLKRI

SEQ ID NO: 150714 - protein, 94 aa, Glycine max
  Coding DNA Sequence Number=SeqID_33936
MATSNTPATEIIPTMEISTILIDNESSIHKKIASKVLGIKVVLSSDIIAKATTCLWKAVPIRRDRRRVMFPMLQGHFTGRMLKRLVIRKPLCTN

SEQ ID NO: 150715 - protein, 170 aa, Glycine max
  Coding DNA Sequence Number=SeqID_33937
MPLCHGTWQKLNHGIQHKKMQRETQSQKISRKIPIIVARARWRGHNGDKVVERDRATKTELRWRRGKTAKTELSQRRRERNENKMMYKHTKQKVATRKKNEGKVENIQIQNIANQRQLVEKINEERKTLLINSLLLLHLLRLILIQDQQERTWHFLGLILSEQFFYFLKF

SEQ ID NO: 150716 - protein, 68 aa, Glycine max
  Coding DNA Sequence Number=SeqID_33938
  Gene Ontology: Mol. function=acyltransferase activity; Biological process=metabolic process
  Homolog annotation: Hit_ID=Q1RYA7; Match level="QueryCoverage=55%, HitCoverage=12%, E-value=5e-09, Identity=70%"; Hit description =Diacylglycerol acyltransferase
MEDIHILIEQLILERRVVFNYQGWVQSLNKSPIPFKNPLYIVVGRPIELEKNPEPTMEQVANQFVEAL

SEQ ID NO: 150717 - protein, 67 aa, Glycine max
  Coding DNA Sequence Number=SeqID_33939
MIVGMTVKVIIRLLSAKARVYIHKEALLKDEKSGDEQRLDQGEANNDNRLNDQSEDGGVLNDVGWGQ

SEQ ID NO: 150718 - protein, 168 aa, Glycine max
  Coding DNA Sequence Number=SeqID_33940
  Gene Ontology: Mol. function=chitin binding; Cellular component =extracellular region; Biological process=chitin metabolic process
  Homolog annotation: Hit_ID=Q86AI8; Match level="QueryCoverage=92%, HitCoverage=36%, E-value=4e-15, Identity=36%"; Hit description =Similar to Homo sapiens (Human). Mucin 2
MSKSCGFGMTGPLDESISCFLIRVDPWVLVPIAFRGIHILAFRGLHVLTLRGLHVLALRGLHVLTIRGLHALTSRGLHALALRGLPALALGLHALAIRGLHVLTFVGLHALTFREPHHHLERTTRPRQQRAACLHLERTTRPRHQRAARPHLQRTTHPRLERAARPHL

SEQ ID NO: 150719 - protein, 53 aa, Glycine max
  Coding DNA Sequence Number=SeqID_33941
  Subcellular localization annotation: CTP_CleavageSite=19; ConfidenceScore=5.21e-01
MILKSIYIKAQQKFPTKNLAFHRKAAPFSYNRRFWKKNSNYTMVGMSPPPLGT

SEQ ID NO: 150720 - protein, 90 aa, Glycine max
  Coding DNA Sequence Number=SeqID_33942
MSQKNYDLELIHRWIVVKFKHQVHNPIARIPTVGNVKSMSDLRGKPFALEKNESHEDSTSGGFNLFSVSLTFENSIGAVRGKTGGISGNR

SEQ ID NO: 150721 - protein, 128 aa, Glycine max
  Coding DNA Sequence Number=SeqID_33943
  Pfam annotation: Domain name=zf-CCHC; Domain location=25-42; Score =24.0; E_value=0.00011; Accession=PF00098.13; Description=Zinc knuckle
MTTKRNQRRSNLNPKKKGEDFSLVPKCYECDQSGHLRFDCPVFKRRMKKSDKKNFKDKKEKKAYITWDDNDMDSSSDSENEIINLGLMAKDYESEEEVTSSNYDLFISFDELQDEFNDFHKESSNLPN

SEQ ID NO: 150722 - protein, 121 aa, Glycine max
  Coding DNA Sequence Number=SeqID_33944
MDPTKRLRKTINKLKGQGRQRMKSELTSESTSTYEEGRCSKPAAEHQYGFPLRRWRSPARNNSQSLSQQGCPNGITQLRDRKREAASMLKIAKDVGVSFQGSDDAVIRRFLEPEQKDKELL

SEQ ID NO: 150723 - protein, 418 aa, Glycine max
  Coding DNA Sequence Number=SeqID_33945
  Gene Ontology: Mol. function=transporter activity; Cellular component= integral to membrane; Biological process=transport
  Homolog annotation: Hit_ID=Q1ATK6; Match level="QueryCoverage=95%, HitCoverage=85%, E-value=6e-92, Identity=45%"; Hit description=Major facilitator superfamily MFS_1
  Pfam annotation: Domain name=LacY_symp; Domain location=1-316; Score=- 321.3; E_value=0.067; Accession=PF01306.10; Description=LacY protonsugar symporter
  Pfam annotation: Domain name=MFS_1; Domain location=17-369; Score =83.4; E_value=7e-22; Accession=PF07690.6; Description=Major Facilitator Superfamily
  Pfam annotation: Domain name=Sugar_tr; Domain location=1-412; Score =28.2; E_value=9.4e-08; Accession=PF00083.14; Description=Sugar (and other) transporter
  Pfam module annotation: Pfam domain module=LacY_symp::MFS_1::Sugar _tr; Domain location=1-316::17-369::1-412
ARRAEYYDFFAYGTAAVLFFGHLFFPSHDPLVSTLAAFATYAVGFLARPIGGMVFGHIGDKVGRKKALVATILIVGLGTFCIGLLPTYEKIGVWAPVLLIAIRLLQGFGVGGEQAGAVLMTAEYAQPSRRGFFASWVQIGAPVGFLLPLALFAVLNAALSAEQMMDWGWRVPFLLSALLVIVGLFIRLRIDESPVFAAIRETKAAESRPLKEVLRGNPRLVVNGVAAKLIEACAFALFTVIILAWGKANQLDAGILMNSMIVAVILEVLAIPLMGALSDRIGRKPVYLIGTLLIMLSIVPFFLALAHNSYWLTQLAMIVALTLGHSMCYAPQASWFPELFPTHIRCSGIAVIWQIGSLIGSGVLGLVAVKILQVTHGHWYGLALYVAVLGVISLFGLLRLPETAPARRQGEYHPWQQH

SEQ ID NO: 150724 - protein, 325 aa, Glycine max
  Coding DNA Sequence Number=SeqID_33946
  Gene Ontology: Mol. function=transporter activity; Cellular component= membrane; Biological process=transport
  Homolog annotation: Hit_ID=Q7VZR5; Match level="QueryCoverage=97%, HitCoverage=65%, E-value=2e-66, Identity=43%"; Hit description=Outer membrane component of multidrug efflux system
  Pfam annotation: Domain name=OEP; Domain location=62-251; Score =105.4; E_value=1.7e-28; Accession=PF02321.8; Description=Outer membrane efflux protein
MVAKGKLSLLTMMLILAGCTVGPDYRAKHDEPLILSQPLDQKLYSNERLQREWWRQFQDPQLNQAIDLALRNNQDIQIAQARLLEARAALDERQLDRLPSITSGMSYTRSLSQENPGVAGEPNVAKNYRGALDMQWEVDLFGRLQRISEAAMARSQASEDDLAQVQIIVTADVARNYFQMRGAQKKLEIAHEHLTNQQQTVRVVEAMVAAGRGQEDELASARAERARVEASLAPMTEQYYLARYKLAVLMGLRPNDVEQIIPKTPLPTLSVRLPIGDVGELLRQRPDVASAERSLAASTADVGAATADLYPRINLGGFIGFVAIR

SEQ ID NO: 150725 - protein, 91 aa, Glycine max
  Coding DNA Sequence Number=SeqID_33947
MGPKSILRFMRTLGPSPVSLDQSSWNLLSNALGGGQMSYRMSRHHASEHADYMCPYEQIKQVNNTRELFTQFGATSPTSGGYQAREEIHSQ

SEQ ID NO: 150726 - protein, 131 aa, Glycine max
  Coding DNA Sequence Number=SeqID_33948
  Homolog annotation: Hit_ID=Q84VH5; Match level="QueryCoverage=66%, HitCoverage=12%, E-value=3e-31, Identity=79%"; Hit description =Envelope-like protein
MLSQHPNMLNYTDSVMKRESPLSLHYKLFEGTHVPDIVSTSGKAAASGAVSKDALITELKDTCKVLEATIKANTEKKMELERLIKRLSESGIDGEAAEEDGEAAEVEEEAAEEEEDAAEETESDDDSEATP

SEQ ID NO: 150727 - protein, 139 aa, Glycine max
  Coding DNA Sequence Number=SeqID_33949
  Gene Ontology: Mol. function=unspecific monooxygenase activity
  Homolog annotation: Hit_ID=O04892; Match level="QueryCoverage=81%, HitCoverage=26%, E-value=8e-31, Identity=58%"; Hit description =Cytochrome P450 like_TBP
PAPPGNGLNPEGRVQRLEEHPHVAWCPASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 150728 - protein, 47 aa, Glycine max
  Coding DNA Sequence Number=SeqID_33950
MGHKHRSNLFVDELRLLWCFALRLPGDVVLLDESSISRGLDDLAGGD

SEQ ID NO: 150729 - protein, 56 aa, Glycine max
  Coding DNA Sequence Number=SeqID_33951
MAQDEENSTDQIPEPSPVPVPDDAIPSALAYELEQPIPQDSPATQWIVLHEMSVYE

SEQ ID NO: 150730 - protein, 181 aa, Glycine max
  Coding DNA Sequence Number=SeqID_33952
MEGLVDLAAIDAFLAFHHGKESPVVAILAMYDTFDRGCEKSGARIVGRIRILSSFEGCPMRGTPSDESITPFIARGFSDHNARDRELRGSSNGIIGGYHKWLRVRTQGLDWLPNLKTVRDDEVKALEESDEVQALKAELERAWVVEEKFKSIAIKGSNSEEVKGIITGQRHDLEGRAKGFP

SEQ ID NO: 150731 - protein, 54 aa, Glycine max
  Coding DNA Sequence Number=SeqID_33953
QLRHEIVYPDGYMLFFKGGRHGNILSISGSFAMTKDIRIWLGMFCIGWAIEIAK

SEQ ID NO: 150732 - protein, 237 aa, Glycine max
  Coding DNA Sequence Number=SeqID_33954
  Gene Ontology: Mol. function=calcium-dependent phospholipid binding; Cellular component=membrane; Biological process=transport
  Homolog annotation: Hit_ID=Q9M2T2; Match level="QueryCoverage=63%, HitCoverage=98%, E-value=3e-35, Identity=46%"; Hit description =Elicitor responsive/phloem-like protein
  Pfam annotation: Domain name=C2; Domain location=43-127; Score=90.8; E_value=4.3e-24; Accession=PF00168.20; Description=C2 domain
MGRPSLRLPLLPIPTSTLITLNQILLKHVARIRIFRDMAIGFMEVQLVKAKGLRDTDIFGKMDPYVLIQYKGQEKRSGVANGKGKNPVWNEKFIFKVEYPGSSNQHKLILKIMDKDLYTDDFVGEAIIHVGDLLAQGVENGGAKLQTLKYRVVRANKSYCGEIDVGVTFTRKVEDKFVEEDIGGWKETENIAASMSVCQGVWLDTLMQELQLKQAGLVKLLVDNKSIISGGSKILNK

SEQ ID NO: 150733 - protein, 70 aa, Glycine max
  Coding DNA Sequence Number=SeqID_33955
  Homolog annotation: Hit_ID=Q9M2T2; Match level="QueryCoverage=73%, HitCoverage=35%, E-value=3e-10, Identity=51%"; Hit description =Elicitor responsive/phloem-like protein
MEYPGSGDQYKLNLRIMDKDVFSANDFVGQATIYVKDILAEGAAELRPHKYSVEEEYIEDDVGAWKESCF

SEQ ID NO: 150734 - protein, 295 aa, Glycine max
  Coding DNA Sequence Number=SeqID_33956
  Gene Ontology: Mol. function=nucleic acid binding; Biological process= RNA splicing
  Homolog annotation: Hit_ID=Q9FR79; Match level="QueryCoverage=53%, HitCoverage=52%, E-value=5e-37, Identity=55%"; Hit description=Pre -mRNA splicing factor
  Pfam annotation: Domain name=RRM_1; Domain location=46-100; Score =6.6; E_value=0.035; Accession=PF00076.12; Description=RNA recognition motif. (a.k.a. RRM, R
MGCGGTVQHTTVLRGEDTVAVAEEEGPAGGDSVEAGAGTAMGASWRREEVFLVCGCGSFVLKCFLEPRGFAFVQFVDPYDASEAQYHMNRQIFAGREISVVVAEETRKRPEEMRHRTSRFRGPASYGGRRSSHYGNVNFKIYNRELKTVLTQVLDPINDCYDGDPDMANLPRSYSPAPRRQSDYSVSPGRQAEHPRSPRGPPREKDGDQKRRSYSPAYGNGNLCTSLRLMLIVASGSHRDHPLDLDQDLLNCHQGVEDEVAGSWQCAAGASVHFLQLIATFAKSCILLEVCEYDG

SEQ ID NO: 150735 - protein, 328 aa, Glycine max
  Coding DNA Sequence Number=SeqID_33957
  Gene Ontology: Mol. function=4 iron, 4 sulfur cluster binding; Cellular component=integral to membrane; Biological process =regulation of transcription, DNA-dependent
  Homolog annotation: Hit_ID=Q5JM88; Match level="QueryCoverage=82%, HitCoverage=68%, E-value=1e-125, Identity=81%"; Hit description =Radical SAM domain-containing protein-like
  Pfam annotation: Domain name=Radical_SAM; Domain location=31-197; Score=68.7; E_value=1.9e-17; Accession=PF04055.11; Description =Radical SAM superfamily
LLLKLEDNRLVETVGIPVMVDKGLTRLTACVSSQVGCPLRCSFCATGKGGFSRNLQRHEIIEQVLAIEEVFKNRVTNVVFMGMGEPMLNLKAVLEAHRCLNKDVQIGQRMITISTVGVPNTIKKLASHKLQSTLAVSLHAPNQKLRETIVPSAKSYPLDALMSDCREYFQQTSRRVSFEYALLAGVNDSVDHALELAELLHRSGSGYHVNLIPFNPIEGSEYQRPSKRAVLTFSGALESSKITVSVRQTRGLDANAACGQLRNKFQKTPLVTDPFDLAVTDTSMPYNNNFAVFAVAVSVVISTCHLRNCGQTPNCLLAILLEHADLGY

SEQ ID NO: 150736 - protein, 1072 aa, Glycine max
  Coding DNA Sequence Number=SeqID_33958
  Gene Ontology: Mol. function=binding; Cellular component=COPI-coated vesicle; Biological process=protein transport
  Homolog annotation: Hit_ID=Q9M2T1; Match level="QueryCoverage=95%, HitCoverage=87%, E-value=0.0, Identity=56%"; Hit description=Adaptor protein/ adaptin-like
  Pfam annotation: Domain name=Adaptin_N; Domain location=31-664; Score= 265.3; E_value=1.2e-76; Accession=PF01602.10; Description=Adaptin N terminal region
  Pfam annotation: Domain name=HEAT; Domain location=136-172; Score =16.2; E_value=0.12; Accession=PF02985.12; Description=HEAT repeat
  Pfam annotation: Domain name=HEAT; Domain location=174-210; Score =12.8; E_value=1.2; Accession=PF02985.12; Description=HEAT repeat
  Pfam module annotation: Pfam domain module=Adaptin_N::HEAT::HEAT; Domain location=31-664::136-172::174-210
MMFPQFGATAESLSKASTAVFRIGTDAHLYDDPEDVNIAPLLDSKFDSEKCEALKRLLALIAQGFDVSNFFPQVVKNVASQSLEVKKLVYLYLLHYAEKRPNEALLSINYFQKDLGDTNPLVRAWALRAMAGIRLHVIAPLVIVAVQKCARDPSVYVRKCAANALPKLHDLRMEEHASAIEEIVGLLLNDHSPGVVGAAASAFTSVCPNNFSLIGRNYRRLCEILPDVEEWGQIILIGILLRYVIARHGLVKESIMFSLYNKDIDNLEEDESYITSKEDAGYSIDKTVSELATMVFQCYIEGPDEYLSRSSSTNRVAPKLDVSQYTSCSNDVVKILLHCTSPLLWSNNSAVVLAAAGVHWIMASKEHIKRIVKPLLFVLRSSSASRYVKFGIDGFTFTRKFYSVVKKIIRRDEVLCNIQVFAKAIPSLFAPHYQDFFICSSDSYQIKALKLDVLSSIATDSSISFIYKEFQDYIRDPNRRFAADTVAALGLCAQRLPKMATSCVEGLLTLVRQEFFCGEIRSLDGEEGVLTQAIISIKSIIKLEPSSYEKVIIQLVCSLDKIKVPAARAMIIWILGEYCSLGDIIPRMLSTVLKYLARCFTSEALEAKLQFLNTTAKVLLCIKGEDILTVRKVWSYVIELAERDLNYDIRDRSRFLKKLLSSNLESQHGEEENSESQKRDQSYILAECIFGGQTKAMTVPSEPIDYRFYLPGSLSQLVFHAAPGYEPLPKPCSLPYTDLDQYDGAAKSDSDEEDDTGTSGSLDEGSASDYSSEQSITASGEASGSDESVSGNEGEDNADPLIQISDTGNVCEYQNSGAPSGTAGFRDLMSTKSLESWLDEPARSSKGSEIEQSQVRRSSARITIGNIGNRVKPKCYTLLDPVNGNGLKVNYSFSSETSSISSHLVCLEVLFENCSLEPMFDIVLIEEDYSKSSDSTDRTSSPTENTLKFHVNKPALVSMEEIPSLEPGETANRTLLVRFHHHLLPLHLALFCNDKKFPVKLKPDIGYFIKPLPLSIEDFRDKESRLPGMFEYVRRIKHQSNSYEMPFISVFKMRVCQGGKLKFELQRIGSFL

SEQ ID NO: 150737 - protein, 744 aa, Glycine max
  Coding DNA Sequence Number=SeqID_33959
  Homolog annotation: Hit_ID=Q9LHB1; Match level="QueryCoverage=76%, HitCoverage=48%, E-value=2e-67, Identity=46%"; Hit description =Transcription factor X1-like protein
  Pfam annotation: Domain name=XS; Domain location=548-665; Score =187.1; E_value=4.3e-53; Accession=PF03468.5; Description=XS domain
  Pfam annotation: Domain name=zf-XS; Domain location=194-237; Score =84.5; E_value=3.3e-22; Accession=PF03470.5; Description=XS zinc finger domain
  Pfam annotation: Domain name=zf-XS; Domain location=358-402; Score =72.4; E_value=1.4e-18; Accession=PF03470.5; Description=XS zinc finger domain
  Pfam annotation: Domain name=zf-XS; Domain location=478-522; Score =87.3; E_value=4.7e-23; Accession=PF03470.5; Description=XS zinc finger domain
  Pfam annotation: Domain name=zf-XS; Domain location=78-120; Score =68.6; E_value=2e-17; Accession=PF03470.5; Description=XS zinc finger domain
  Pfam module annotation: Pfam domain module=XS::zf-XS::zf-XS::zf -XS::zf-XS; Domain location=548-665::194-237::358-402::478-522::78-120
MKISDKVTWQQSALSANIIFCLSGAKLLSPGETVMPHCSNKDTDISASQISWWYVDTSYEELKKGSHSVKTSDVTFICPYCPRRKQDYLYRELLEHAYMVGRSSSEKRSARERANHLALVKYLENDLIIIMDGPSEPVDKGTKLSLGQTVVAQCSNKETGMSASPINWWYVEKFYKELKKGNHMVQTSDLTLCCPYCPKKRKQDYVYRELLEHASGVGQSSSEKRHVREKATHLALMKYLKNDLKYLNDPSKSVNEGNPPVNRVHQISSQERSVREDATHLPSAKYFKKDLTNVSDPSSKPVNEGTITGSPGETVIGCCSNKDSNISSSQIGRYAEKFYEELKRGIHNVKTSDETFRCPYCSNKKINRDYVYREILEHASGVGQSKSQKRSFIEKANHLALVKYLKKDLMNVGAPCPSKPMDQGTKTISPGETVMGHYSHNDNNIRASQISGWYVHKSYEALKKGSHNVKTSEMTFSCPYCPNKKRKRDYVYREILEHASGVGQSSSEKRSAIEKANHLALMKYLEKDLMIVDGPPKTADEGSPPFNFEKQFVWPWTGIVVNIPTRLTEEGCCVGESGSKLRDEYRSRGFNPQRVRILSNFCGHSGTAVVEFNKNWTGLDNALAFERAYELDHHGKKDWFANTEHKSGIYAWIARADDYKVNNIIGEQLQKMGDIKTISELMEEEARMQDKLLSSLNNTLQVKKKRLKEMEVKYYETSHRMDIVMGEIDKLTQGHNQVVKGPSL

SEQ ID NO: 150738 - protein, 88 aa, Glycine max
  Coding DNA Sequence Number=SeqID_33960
  Gene Ontology: Cellular component=extracellular region; Biological process=cellulose and pectin-containing cell wall organization and biogenesis
  Homolog annotation: Hit_ID=Q71FJ3; Match level="QueryCoverage=91%, HitCoverage=29%, E-value=3e-30, Identity=80%"; Hit description =Expansin
  Pfam annotation: Domain name=Pollen_allerg_1; Domain location=12-86; Score=89.9; E_value=7.5e-24; Accession=PF01357.11; Description =Pollen allergen
MCRVPCRKQGGMRFTINGFRYFNLVLITNVAGAGDIVRTSVKGSKTGWMSMSRNWGQNWQSNAVLVVLNLPWDVDIRETAREKIMVGK

SEQ ID NO: 150739 - protein, 220 aa, Glycine max
  Coding DNA Sequence Number=SeqID_33961
  Gene Ontology: Cellular component=extracellular region; Biological process=cellulose and pectin-containing cell wall organization and biogenesis
  Homolog annotation: Hit_ID=Q6J4U6; Match level="QueryCoverage=71%, HitCoverage=60%, E-value=6e-78, Identity=83%"; Hit description =Expansin 1
MRTNRVSTRNNKKMNLNFGWFPESCNYAPKDGDDAGAVLSDFEEHGHGQVEVGPGRIAPPSIVVRKGVVWGAEVCGGYEYGGAASVAPAGVVRALYLEAGTAAQPVVEQRRAQRRRVHAVPLAVQVPVPARAAHCPRRVAAAVERGVRGLPRAAAVHARDPGLGGSQKGYKGHNADVRKVNQSHAEREHGTQLSSGVCVLSREERKGTKEVRDLRASKLI

SEQ ID NO: 150740 - protein, 261 aa, Glycine max
  Coding DNA Sequence Number=SeqID_33962
  Gene Ontology: Mol. function=ferric iron binding; Biological process =aromatic compound metabolic process
  Homolog annotation: Hit_ID=Q9LHB1; Match level="QueryCoverage=98%, HitCoverage=39%, E-value=6e-64, Identity=51%"; Hit description =Transcription factor X1-like protein
  Pfam annotation: Domain name=XH; Domain location=142-249; Score =143.6; E_value=5.3e-40; Accession=PF03469.5; Description=XH domain
MAVLEQQKAGENVLKLAADQKDSWLLMLFDNLFIQRQKEQFHAKIILLERQLEVKQKLELEIQQLKGKLNVMAYIEDDGDTEVLNKVDALHKDLREKEQSLRDLDSLNQTLIIKERQSNDELQEARKELINGIKEISCRANVGVKRMGELDIRPFLEAMKKKYNDEDAEDRASELCSLWEEYIKDPDWHPFKITMIEGKHQEIIDDDDEKLKGLKNEMGEGVYKAVVTALTEINTYNPSGRGKESYLARGSKIVIDAMETN

SEQ ID NO: 150741 - protein, 68 aa, Glycine max
  Coding DNA Sequence Number=SeqID_33963
  Homolog annotation: Hit_ID=Q10BD4; Match level="QueryCoverage=84%, HitCoverage=69%, E-value=2e-08, Identity=48%"; Hit description =Expressed protein
MVKDIEEGCRTPKRSACRIPAAMVCPPPPKKKSAAYTARQRVPPKNGYFVPPDLELIFRVAPTREAFT

SEQ ID NO: 150742 - protein, 539 aa, Glycine max
  Coding DNA Sequence Number=SeqID_33964
  Gene Ontology: Mol. function=protein binding; Cellular component =cytosol; Biological process=regulation of transcription, DNA -dependent
  Homolog annotation: Hit_ID=Q9LHH0; Match level="QueryCoverage=99%, HitCoverage=99%, E-value=1e-158, Identity=61%"; Hit description =Actin-like protein
  Pfam annotation: Domain name=Actin; Domain location=16-535; Score =106.8; E_value=6.3e-29; Accession=PF00022.9; Description=Actin
MPFISKIQRQSDFNLFDSNTPLVIDNGASYFRIGWAGESEPRVVFRHIVQRPCHKETGETVTIVGDHDPAFLKYFDCTHSGPHSAFDSNVVYQFETMQYILDFGFDRMGANGTEIDHPVLITECVCNPVQSRSKMAELLFETYGVPSIAFGVDVAFSYKYNQQRGVCAKDCLALCPGFNTTHVIPFVDGEPVYEGCCRTNIGGFHVTDHLKQLLSLKYPYHLARFTWEKVEDLKMEHCYIAPDYVSEARLFQKGAKEAEEKTRYWQIPWVPPPIEEPPSEEEIARKAAIKEKQGQSLREMAEAKRSSEINELENELHGLEFLWHQLEQVEESKVPSFLAETGYGSRQEIESARNIVMQSLQKAKGEPKNEQDATEKVDPATNDSLINIPDEVPHARPLTKEDFQIVLGVERFRCPELLFNPNWIAVDQVGLDEMVGVSIRRLPYKDESLEERLTSSILVTGGSSLFPGIIERLEVGIRMIRPCGTPIKIVRALDPVMDAWRGAASFASDPQFHQQTFSILDYHEKGEDWLRNYQLQYTL

SEQ ID NO: 150743 - protein, 90 aa, Glycine max
  Coding DNA Sequence Number=SeqID_33965
MIFTPLSKLRPKTLETPLPPPMTIDDHHKPPLLAAGPPHEVEHFNQSEIFRIHLKDSVENKAPNLFFHGFFENSAFGRERERPLSDVERS

SEQ ID NO: 150744 - protein, 101 aa, Glycine max
  Coding DNA Sequence Number=SeqID_33966
  Pfam annotation: Domain name=DUF1723; Domain location=17-66; Score =23.6; E_value=0.00071; Accession=PF08330.1; Description=Protein of unknown function (DUF1723)
MKTWITNLQAKFEGDPTVNDFGLQFYLNKFGPETHTFHSPHREATITLQDVALQLGLKIDELLVTSVITGNVCVACQALLGDTPPDKYIKGKMITWLRQNF

SEQ ID NO: 150745 - protein, 112 aa, Glycine max
  Coding DNA Sequence Number=SeqID_33967
  Gene Ontology: Mol. function=protein serine/threonine kinase activity; Cellular component=membrane; Biological process=protein amino acid phosphorylation
  Homolog annotation: Hit_ID=Q1SDW8; Match level="QueryCoverage=94%, HitCoverage=25%, E-value=2e-42, Identity=79%"; Hit description =Protein kinase
MLTVLQRKARKSVKTILRENFGHESVTLEPLQFSLAVIEAATNNFSNDNRIGKGGFGEVYKGILFDGRQIAVKRLSKSSKQGANEFKNEVLLIAKLQHRNLVTFIGFCLEEL

SEQ ID NO: 150746 - protein, 102 aa, Glycine max
  Coding DNA Sequence Number=SeqID_33968
MALTIKMLQVMAASMRWRQRQQMEFSAVNHNKYMLHKHDKFYAICQSIHVATDWCGIQTAYNQSVEKFFWVGARKRNKTIVVEEYVENTVTEAQGKEVFFGG

SEQ ID NO: 150747 - protein, 253 aa, Glycine max
  Coding DNA Sequence Number=SeqID_33969
  Homolog annotation: Hit_ID=Q2QP00; Match level="QueryCoverage=86%, HitCoverage=22%, E-value=6e-31, Identity=55%"; Hit description =G14587-6, putative, expressed
MLAGILVDKSIQKGGQVKLRGIEVDALLKALKTLFKRKASNLEEAEALVLKWVHQVLSRASGIIEKFISENSEQNAEGSFFTPPRSETSKGRKSVAKSKSLSKAVIAIYTVGNPIFTLCKMLKLNVSKYLPCYSNFFFMEVISYITKITRCLLDPCELVRRQTFILLSRLLQRDYVKWKGVLFLLFLLSLGDESEKIRQLADFLFGNILKVKSPLLAYNSFVEAVFGLNNCHVHNGHGESQGSQKESQIFSIK

SEQ ID NO: 150748 - protein, 57 aa, Glycine max
  Coding DNA Sequence Number=SeqID_33970
  Homolog annotation: Hit_ID=Q94KF7; Match level="QueryCoverage=55%, HitCoverage=18%, E-value=5e-08, Identity=75%"; Hit description=Pto -like kinase OG5
MEKLMPRIEGKGEFGQPRWRLLASLQGQQPMDTLSWKQRLEICIGAAKGLHYLHIGA

SEQ ID NO: 150749 - protein, 130 aa, Glycine max
  Coding DNA Sequence Number=SeqID_33971
MDSFSGVVGLKGEILSLHSLSGSSSVEWIQGSLVSQRQPLTWYKRKQRMFLMEKGHISLSFNSSTPHYPLFLAWVLLKSCHALTGYIPISGIRIGNVKVRKGSPLVTCLLEGSRGSGKTALSDTVGIDSH

SEQ ID NO: 150750 - protein, 359 aa, Glycine max
  Coding DNA Sequence Number=SeqID_33972
  Gene Ontology: Mol. function=RNA-directed DNA polymerase activity; Biological process=RNA-dependent DNA replication
  Homolog annotation: Hit_ID=Q1T5K4; Match level="QueryCoverage=93%, HitCoverage=35%, E-value=3e-26, Identity=27%"; Hit description=RNA -directed DNA polymerase
MTEEKIVQGGYWERFIEENVLTRVARVLNSATMSTPFNYSGLPIGANARKLSTWQPVIDKMRSKLTSWRRRQLSFGGRICLRGNGYRGFSVRICLWREVLIQKYELENLDYHIKGGGVVKGTQWWCDTLTSCEIFENEHRWFQSGLGRGVRGGNNVSFWEAKWLGDKKSKNIREAGDWCRGVWSWHFSWRQLWLQWEILIVQQMDEALEGWEPNVGEKDGWVWKNNAAKIFIVKEVYASLITYRFGDVCSFFNQIWNLLVPSKVKGLLWRVGHKIQTKDNLRRMIILQDGTSLNWVFCNLGMEFAKYLLFECCFCHQIWQRCYVWLGKIRVLHVECKEHFSQHFRILPGAKARCVEGTV

SEQ ID NO: 150751 - protein, 300 aa, Glycine max
  Coding DNA Sequence Number=SeqID_33973
  Homolog annotation: Hit_ID=Q9SJF0; Match level="QueryCoverage=27%, HitCoverage=17%, E-value=3e-15, Identity=74%"; Hit description =Serine/threonine-protein phosphatase BSL2
MSDKSTPSPRNPRKSQRRSELEIREEKDSTFVEEDGKPRTRRQIARTKKEKPNSVPPSTPSPKSEEENGGNLDHVGQVCFVDLVAIADSLIGCFVFLEFGMQLPVHALMGFFCFVEGGTSIVLYIDYLFLGDYVDRGQHSLETISLLLALKVENIQRPITMEAGSIVLMDLLCMKCFSRSDPTENDDSVEGLRPNARGPGLVTFGNQKSYRLKRQLQFKEIVLLRREQLYFTRFACFIGSDLYSSLLGFYERRDWQIILDCPVRIARGCKYCVADHRSSCLVKIKDDKQLSRVFQEEVKE

SEQ ID NO: 150752 - protein, 84 aa, Glycine max
  Coding DNA Sequence Number=SeqID_33974
MRGNPGKTPSSGGNNTSDGVVIREDQNPRNPSSDATASREQVNAMYDPAFERAGVPIDPILRLFNANSAEKPAEEGRENPNWKS

SEQ ID NO: 150753 - protein, 101 aa, Glycine max
  Coding DNA Sequence Number=SeqID_33975
  Pfam annotation: Domain name=zf-CCHC; Domain location=24-41; Score =19.9; E_value=0.00052; Accession=PF00098.13; Description=Zinc knuckle
MKGGMINLTCHKYGHFSWGCKANIECYNCHKYGHFSWKCKSNVEEKFNGASNSDKKDDKNLWYLDNGASNHMGGYKEKFVELEEEAKGNVSRSMEWSEAKS

SEQ ID NO: 150754 - protein, 98 aa, Glycine max
  Coding DNA Sequence Number=SeqID_33976
  Subcellular localization annotation: CTP_CleavageSite=61; ConfidenceScore=5.59e-01
MVTLSNSFNLMLPTMKFKAFGVRNKPPSLNPTDPSLPVQQFILFTLFLHPTSPAMIKLLCRVMVIDMLLFKYIMFPNVGNGHSPRCHESLHSVAWTSF

SEQ ID NO: 150755 - protein, 75 aa, Glycine max
  Coding DNA Sequence Number=SeqID_33977
MGNTHCATIGGGFRGLGAKGKIRVLHVECKEHFSQHFRVLPGAKARCVSGPVICNDMVVVEAYEPYHLQRSKSGS

SEQ ID NO: 150756 - protein, 278 aa, Glycine max
  Coding DNA Sequence Number=SeqID_33978
  Homolog annotation: Hit_ID=UPI00005F9E5E; Match level="QueryCoverage =46%, HitCoverage=84%, E-value=3e-14, Identity=38%"; Hit description =COG5654: Uncharacterized conserved protein
  Pfam annotation: Domain name=RES; Domain location=136-263; Score =73.6; E_value=6.3e-19; Accession=PF08808.1; Description=RES domain
MGLPRNRLKAHKLITDGMDVGIVERAATILKATPIDIAQMVSIDRNTYRRREKSGSQLSVEQGARIYQVFEVLDAVIQLFAGDPEVAMHWMYQPALALDNAQPINMLSTPAGCDADPAAPVRVFYRIVKAEYASQAFNGAGAEKWGGRWNPPGMKAVYLSSSKALATLELVVHAGKTLLEQSRFVVFTVAVPESDIIALDSSKLPAGWEKYQQQEETQAIGAAFLDPHNGFPLLMTVPSILTGEDNALFNPDHPAAAALIATATSAPFAIDRRIKDDP

SEQ ID NO: 150757 - protein, 196 aa, Glycine max
  Coding DNA Sequence Number=SeqID_33979
  Gene Ontology: Mol. function=helicase activity; Biological process =protein amino acid phosphorylation
  Homolog annotation: Hit_ID=Q1SN45; Match level="QueryCoverage=94%, HitCoverage=11%, E-value=6e-41, Identity=42%"; Hit description=AAA ATPase
  Pfam annotation: Domain name=DUF889; Domain location=1-195; Score =206.2; E_value=7.4e-59; Accession=PF05970.5; Description=Eukaryotic protein of unknown function (DUF889)
MRLQGNAQLIDDQETTKFAKWILDIGDGVIGNQNDGYATIEIPEYLLITEYNDPIDAIVKSTFPDLYQHHSNPEFFKSRAILASTNETVEEVNDYILSLIPKKSETIGSWHFQSITTEFLNSLNTSGLPNHRIKLKIDSPIMLLRNLDQTQGLCNGTRLIVTRLAKHVIAAEIISGKNLGDNVYIPRMSMSPSQSP

SEQ ID NO: 150758 - protein, 92 aa, Glycine max
  Coding DNA Sequence Number=SeqID_33980
MAFACDIVKFELWNEFVHVDVEFDGHRFRSEEHQCRFEEIKGRSFLKERRVQLRDREYAEFQEEIARRQRTQLATPMAKYDLEIVMEFYANA

SEQ ID NO: 150759 - protein, 126 aa, Glycine max
  Coding DNA Sequence Number=SeqID_33981
  Gene Ontology: Mol. function=ribonuclease H activity; Cellular component=mitochondrion; Biological process=DNA integration
MMKEMCEDFKIQHHNSMPCRPKMNGAVEAANKNIKKIVQKMIVSYKDWHKMLPFALHGYRTSVRTLTEATSFSLVYGMEVVLPFEVKVPSLRILAESGLEESKWAQTHFDQLNLIKGKRLAAMSHG

SEQ ID NO: 150760 - protein, 41 aa, Glycine max
  Coding DNA Sequence Number=SeqID_33982
VALRVGESQSQSQDYFGECGYYVMHWMSTIIIGTFRNNWEA

SEQ ID NO: 150761 - protein, 69 aa, Glycine max
  Coding DNA Sequence Number=SeqID_33983
MEAQSQSQSQDYFGECGYYVMHWMSTIIIGTFRNNWEAYFNDPRPLEPERLKALRIQWAQFYLRVRDQA

SEQ ID NO: 150762 - protein, 77 aa, Glycine max
  Coding DNA Sequence Number=SeqID_33984
MFQINLIRKMLTDHLIHNLLEASLLRQQWRKQRTMALTSTVDADDAPSTVDDGVALHGNLLNAPRNLFTASSSSRQQ

SEQ ID NO: 150763 - protein, 671 aa, Glycine max
  Coding DNA Sequence Number=SeqID_33985
  Homolog annotation: Hit_ID=Q9FMQ0; Match level="QueryCoverage=90%, HitCoverage=93%, E-value=1e-110, Identity=40%"; Hit description =Genomic DNA, chromosome 5, P1 clone:MXC9
  Pfam annotation: Domain name=UBA; Domain location=181-220; Score =38.2; E_value=2.7e-08; Accession=PF00627.21; Description=UBATS-N domain
  Pfam annotation: Domain name=UBA; Domain location=243-283; Score=9.0; E_value=0.34; Accession=PF00627.21; Description=UBATS-N domain
  Pfam module annotation: Pfam domain module=UBA::UBA; Domain location =181-220::243-283
FIEIEEKVTNAIARGGIFATEEMSPASKSKSKDKKAVKEAQKSSAKSSGSGNAVAGVPASAYNPLLGTFHTLETSPTSTSQVNSNGRFRNIDETDEHPAGSVVAGVEYDSVSNNGSWSGESEDHKDKAASNPPARLEAVPGADNDKREKIRQKNEKKHQRQKERRAQELHDRCTGYIMSRKLEALAQQLVAMGFSHERATVALILNEGRVEESVAWLFEGGEEADNHKETNIGGGNLKIDISEELARIADLEIRYNCSKQEVERAVVACEGDLDKAAESLRELKLDRPSGPPKPEEIGDLPSLTNKQSEAVNQNARTQTKPILSPNQPKKDEKDFNYAKQAVMLGGSTESSNRLVQPLKRILPKSEWAKPQQAAVPADKRWPGAGSNPSVSFSLASPLQVSSTPAKTEASYMAVGGDYKNLQPGATREPVIVMQRPQTVNAKQIPAASMSSSPPGVAASWYPTNSVEVMRSNGFMSHPPSTRSLSSNYFSSNQLYHQLQCQPPQQFVAGNSSSVDLQATNQGNNLWNRTSASPTLAAASSLGLFSGLGSAATSGATSPVDWSTGGTMQFDYTNIDWSLDRGLSPPRSNALLFGLSPFTKSSSTLYGSNASGTVAQQAIRSLPSNGSMVPLPGLQEGGVSSAEPSGSRDWSSPFEGKDLFSLPRQFVSSPSL

SEQ ID NO: 150764 - protein, 133 aa, Glycine max
  Coding DNA Sequence Number=SeqID_33986
MASKIQILPVVGVVAMYIMNSIITVLYFNGRVYEDNDGVIFEGRKYVALQICDDEDVETMIESFQQQQQMSVLELYVEKDVAGGSMFHAANSVTSCGRNVSHHESELPRNISNLHVDEDDDDDDDDYLASNSY

SEQ ID NO: 150765 - protein, 161 aa, Glycine max
  Coding DNA Sequence Number=SeqID_33987
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=17%, E-value=4e-33, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNAMRKEINSIEKNQTWELVNPLQDKKPIALKWVYKVKVNTEQEVVKYKASLCTKQVARLEIVRLVAATESLRDWSIHQLDVKSAFLNRPLEEKSWKVGKNTEMLIVCLYVHDLLTIGSNESEIEKFKQDMMSEFKMSDLGFLSYFLGIEFKTTQYGIVMH

SEQ ID NO: 150766 - protein, 66 aa, Glycine max
  Coding DNA Sequence Number=SeqID_33988
MDEFDLQVAWLGAQPSPFGGGGASAAQELVPEEPATATTEGEDELTLPEPFYFDVDAHMAQEEGKI

SEQ ID NO: 150767 - protein, 119 aa, Glycine max
  Coding DNA Sequence Number=SeqID_33989
MCRLSKECVKGLPHQLNLSNVYDDVKLPQHPHLSDHCPKGRGARLLTPHKFLQGSYPEGSIQLPFMLTQAPKGATSGSIEDVRELVEVGPKYFLIVTPAPTAWTWQGCSGCPMAIVSTS

SEQ ID NO: 150768 - protein, 208 aa, Glycine max
  Coding DNA Sequence Number=SeqID_33990
  Gene Ontology: Mol. function=ATPase activity; Cellular component =membrane; Biological process=protein metabolic process
  Homolog annotation: Hit_ID=UPI0000D9D9B4; Match level="QueryCoverage =86%, HitCoverage=89%, E-value=3e-23, Identity=41%"; Hit description =PREDICTED: similar to heterogeneous nuclear ribonucleoprotein M isoform b
  Pfam annotation: Domain name=Sperm_act_pep; Domain location=107-116; Score=1.5; E_value=1.4e+02; Accession=PF08250.2; Description=Sperm -activating peptides
  Pfam annotation: Domain name=Sperm_act_pep; Domain location=121-130; Score=1.5; E_value=1.4e+02; Accession=PF08250.2; Description=Sperm -activating peptides
  Pfam annotation: Domain name=Sperm_act_pep; Domain location=135-144; Score=1.5; E_value=1.4e+02; Accession=PF08250.2; Description=Sperm -activating peptides
  Pfam annotation: Domain name=Sperm_act_pep; Domain location=149-158; Score=1.5; E_value=1.4e+02; Accession=PF08250.2; Description=Sperm -activating peptides
  Pfam annotation: Domain name=Sperm_act_pep; Domain location=163-172; Score=1.5; E_value=1.4e+02; Accession=PF08250.2; Description=Sperm -activating peptides
  Pfam annotation: Domain name=Sperm_act_pep; Domain location=177-186; Score=1.5; E_value=1.4e+02; Accession=PF08250.2; Description=Sperm -activating peptides
  Pfam annotation: Domain name=Sperm_act_pep; Domain location=191-200; Score=1.5; E_value=1.4e+02; Accession=PF08250.2; Description=Sperm -activating peptides
  Pfam annotation: Domain name=Sperm_act_pep; Domain location=23-32; Score=1.9; E_value=1.1e+02; Accession=PF08250.2; Description=Sperm -activating peptides
  Pfam annotation: Domain name=Sperm_act_pep; Domain location=37-46; Score=1.5; E_value=1.4e+02; Accession=PF08250.2; Description=Sperm -activating peptides
  Pfam annotation: Domain name=Sperm_act_pep; Domain location=51-60; Score=1.5; E_value=1.4e+02; Accession=PF08250.2; Description=Sperm -activating peptides
  Pfam annotation: Domain name=Sperm_act_pep; Domain location=65-74; Score=1.5; E_value=1.4e+02; Accession=PF08250.2; Description=Sperm -activating peptides
  Pfam annotation: Domain name=Sperm_act_pep; Domain location=79-88; Score=1.5; E_value=1.4e+02; Accession=PF08250.2; Description=Sperm -activating peptides
  Pfam annotation: Domain name=Sperm_act_pep; Domain location=93-102; Score=1.5; E_value=1.4e+02; Accession=PF08250.2; Description=Sperm -activating peptides
  Pfam module annotation: Pfam domain module=Sperm_act_pep::Sperm_act _pep::Sperm_act_pep::Sperm_act_pep::Sperm_act_pep::Sperm_act _pep::Sperm_act_pep::Sperm_act_pep::Sperm_act_pep::Sperm_act _pep::Sperm_act_pep::...
  Pfam module annotation: Pfam domain module=Sperm_act_pep::Sperm_act _pep; Domain location=107-116::121-130::135-144::149-158::163 -172::177-186::191-200::23-32::37-46::51-60::65-74::79-88::93-102
  Subcellular localization annotation: CTP_CleavageSite=48; ConfidenceScore=5.33e-01
MGYGVWGMGFGVWGLGFGVWGLGFGVSGSGFGVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRVQGSGFRV

SEQ ID NO: 150769 - protein, 183 aa, Glycine max
  Coding DNA Sequence Number=SeqID_33991
PTASARRQRVLVTAAHDELVVPAPNVEVDVFLDDPMAPADVEDTGADIPTDTGAQAAEDEHEGFSGGPSDLSVLTQYADHFACSRPELKLSSHGRKVHSLGRPIPAIKGLVAGIGLSPLIARGDDHTGRRLLASASGRGLRQGSVVDRTYACNGYVISASADARQALRDLSQTGRYAWGVAAL

SEQ ID NO: 150770 - protein, 213 aa, Glycine max
  Coding DNA Sequence Number=SeqID_33992
  Gene Ontology: Mol. function=helicase activity
  Homolog annotation: Hit_ID=Q1SM26; Match level="QueryCoverage=49%, HitCoverage=26%, E-value=2e-28, Identity=59%"; Hit description =Nucleic acid-binding, OB-fold
MTKHVIAAEIISGKNIDLAVYIPRMSMSPSQSPWPFKLLKRQFPIMLSYAMAINKSQGLLLSMVGLYLPKPVFTHGQLYVALLRVNSTKGLKILIHDDEQKSMNSTTNTLHITTSFPIQEATIELHRFQQKPTATYGIEKINQLIKSTQLLSHITGSSGNFISTVYHHTFTTSDKPKMSIASSTASTRMRYPIVRPPAIIQFRATLHNDQVIV

SEQ ID NO: 150771 - protein, 136 aa, Glycine max
  Coding DNA Sequence Number=SeqID_33993
MYESNRTRGSSKPCTTGVRAFRETIEFYDLIDAGFEGPKYNWKREGGPFNFKKLGMRIKVSSLWCMKIGDLMRSRTTIWGGVRKKLAEILFQEELLWFQKLRCKWLKFRDSNSRYFHWNTIVHRQKKMLWAGCWMT

SEQ ID NO: 150772 - protein, 171 aa, Glycine max
  Coding DNA Sequence Number=SeqID_33994
  Gene Ontology: Mol. function=isopentenyl-diphosphate delta-isomerase activity; Cellular component=cytosol; Biological process=isoprenoid biosynthetic process
  Homolog annotation: Hit_ID=Q8L831; Match level="QueryCoverage=85%, HitCoverage=22%, E-value=1e-42, Identity=50%"; Hit description=Nudix hydrolase 3
MCTLLKFVYLLPYQAWYSNPSLRDWLKEHADTSELNKLKWSYYQINKSPRSSLDEDEAFLSTADSAIRMLSKATRIMKDWKGLEYRATFPLLKPAGANFYPPDMDKMEFELWKDGLAKHGQKEATGSHDLYIVPYSEEYKSLLAKAVVLLHKAGDVSDSPRYVGFHPCSHY

SEQ ID NO: 150773 - protein, 196 aa, Glycine max
  Coding DNA Sequence Number=SeqID_33995
MILNLKRGPSFPDNWKVNFGLIMDLLWQQRTKSLQLKGVEHSRGVFQIAEDGVGMVRNLYFFYVGPCFSINKELRNSMFWKLTLGNRVIVNCDRARLRHLLDMTSRVGLIKNGAGVFLGGLLVKEDSSMLKSNRILKRLSFFILDGCERKHECVYTLSMLSRSVVVLPCKFCLIMFSGSVMGLLIFWPKGYPCNKV

SEQ ID NO: 150774 - protein, 153 aa, Glycine max
  Coding DNA Sequence Number=SeqID_33996
MGLPIIEAYTDMEAVEFVQKLKTTKEINNGGAKKKESKDIKRKGLKGIRGNRFSKLMNDLVQEYHLSLCFLLEMHASFVKAEAIVRRFGFDSHHIEGSNGQLGGLWCLWKSRVATYPSTGGRGEKPKVRLPMKKTRGVATNVYSGKMLEKPKR

SEQ ID NO: 150775 - protein, 268 aa, Glycine max
  Coding DNA Sequence Number=SeqID_33997
  Gene Ontology: Mol. function=RNA-directed DNA polymerase activity; Biological process=RNA-dependent DNA replication
  Subcellular localization annotation: CTP_CleavageSite=35; ConfidenceScore=5.36e-01
MKLKLQKWTWTCVLALSLHCSLSTSACIRTSSRLASMHVFALNVPLHAQRTKVSNEKTRIFFSKYVGGNIREEISQAIGFQRTADLGKYLGINLHHRRISRNSHQGIKLKKGRLTLTKPVLSALPTYNMQSEFLPREIQRRGCIGWLGKRFELWKKPVYSWVSMVQGKYRCGEHEFPIINKKRVGSNLWSDIKVVWEKVVANCDLIDGARRWNLSSDGRFSTKKRCRSFLKRVFEGVLATNQAKWERRFANSWDCPMCCMEKESPLHY

SEQ ID NO: 150776 - protein, 150 aa, Glycine max
  Coding DNA Sequence Number=SeqID_33998
MVSARVYGDDVSEGATYAQEEDLLDKIKKKIKESETLLSEGVVGVNEGVVGANEGDSPYREKLLTEIGGDEIDFVENHDENDCDMMEIHSLGVEKKKEFVHVKDGVEIPVSDEDHLGHKKDGCSEPIMGMKKVTRKVANVTKDMKEVNVQ

SEQ ID NO: 150777 - protein, 64 aa, Glycine max
  Coding DNA Sequence Number=SeqID_33999
  Homolog annotation: Hit_ID=Q6K683; Match level="QueryCoverage=53%, HitCoverage=4%, E-value=3e-07, Identity=80%"; Hit description =MutT/nudix protein-like
MECSVINDRKYINNEYNDVYLVTTLDPIPLEAFALQVRMSCFTSARTQYEELVFGWGERKGKKV

SEQ ID NO: 150778 - protein, 54 aa, Glycine max
  Coding DNA Sequence Number=SeqID_34000
MRKLIKERMENKVVNFVGLNKVVLGIKWMNGMNKGEDERKERITLSSEGNTQRL

SEQ ID NO: 150779 - protein, 134 aa, Glycine max
  Coding DNA Sequence Number=SeqID_34001
MTKSKGKDPLEGLGGPMTRARARKAKEALQQGPIGNLGISLLGDQMVADLLAVGGFISALDFPKTITNNGEFHDGGGGGDNNNPAPKSLWLHGYVEDSRKDSDYKKLWKPPSNHGFIPCTKPTPNYSSKKLELV

SEQ ID NO: 150780 - protein, 62 aa, Glycine max
  Coding DNA Sequence Number=SeqID_34002
MLIEHTEELYRRIEQVENQGNGDDGGCRRKRWRNNEGDAREDKIEEETEVSMIRANVMEDRE

SEQ ID NO: 150781 - protein, 1258 aa, Glycine max
  Coding DNA Sequence Number=SeqID_34003
  Gene Ontology: Mol. function=protein binding; Cellular component =membrane; Biological process=defense response
  Homolog annotation: Hit_ID=Q1SXP3; Match level="QueryCoverage=99%, HitCoverage=100%, E-value=0.0, Identity=46%"; Hit description =Disease resistance protein; Peptidase aspartic, active site
  Pfam annotation: Domain name=LRR_1; Domain location=1020-1044; Score =3.4; E_value=67; Accession=PF00560.23; Description=Leucine Rich Repeat
  Pfam annotation: Domain name=LRR_1; Domain location=1068-1090; Score =5.1; E_value=31; Accession=PF00560.23; Description=Leucine Rich Repeat
  Pfam annotation: Domain name=LRR_1; Domain location=1091-1110; Score =2.6; E_value=93; Accession=PF00560.23; Description=Leucine Rich Repeat
  Pfam annotation: Domain name=LRR_1; Domain location=1114-1136; Score =2.3; E_value=1.1e+02; Accession=PF00560.23; Description=Leucine Rich Repeat
  Pfam annotation: Domain name=LRR_1; Domain location=1169-1192; Score =4.7; E_value=37; Accession=PF00560.23; Description=Leucine Rich Repeat
  Pfam annotation: Domain name=LRR_1; Domain location=1194-1217; Score =8.6; E_value=6.9; Accession=PF00560.23; Description=Leucine Rich Repeat
  Pfam annotation: Domain name=LRR_1; Domain location=569-591; Score =6.1; E_value=21; Accession=PF00560.23; Description=Leucine Rich Repeat
  Pfam annotation: Domain name=LRR_1; Domain location=593-615; Score =11.9; E_value=1.7; Accession=PF00560.23; Description=Leucine Rich Repeat
  Pfam annotation: Domain name=LRR_1; Domain location=616-638; Score =13.9; E_value=0.57; Accession=PF00560.23; Description=Leucine Rich Repeat
  Pfam annotation: Domain name=LRR_1; Domain location=640-661; Score =12.5; E_value=1.3; Accession=PF00560.23; Description=Leucine Rich Repeat
  Pfam annotation: Domain name=LRR_1; Domain location=663-684; Score =12.8; E_value=1.1; Accession=PF00560.23; Description=Leucine Rich Repeat
  Pfam annotation: Domain name=LRR_1; Domain location=795-816; Score =2.8; E_value=85; Accession=PF00560.23; Description=Leucine Rich Repeat
  Pfam annotation: Domain name=LRR_1; Domain location=818-840; Score =1.0; E_value=1.8e+02; Accession=PF00560.23; Description=Leucine Rich Repeat
  Pfam annotation: Domain name=LRR_1; Domain location=881-904; Score =10.3; E_value=3.4; Accession=PF00560.23; Description=Leucine Rich Repeat
  Pfam annotation: Domain name=LRR_1; Domain location=995-1018; Score =7.1; E_value=14; Accession=PF00560.23; Description=Leucine Rich Repeat
  Pfam annotation: Domain name=NB-ARC; Domain location=157-452; Score =241.1; E_value=2.4e-69; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::NB-ARC; Domain location=1020-1044::1068-1090::1091 -1110::1114-1136::...
  Pfam module annotation: Domain location=1169-1192::1194-1217::569 -591::593-615::616-638::640-661::663-684::795-816::818-840::881 -904::995-1018::157-452
MAFAMVGEALISASVEILLDRITSAEFRDFFANRKLNVSLLDELKIKLLELNAVLNDAEEKQITNEAVKAWLDELKDAVLDAEDLLDEINTDSLRCKVEGQCKTFTSQVWSSLSSPFNQFYKSMNSKLEAISRRLENFLKRIDSLGLKIVAGRVSYRKDTDRSVEYVVARDDDKKKLLSMLLSDEDENNNHIQVLTIWGMGGLGKTTLAQSLLNDDAVQNHFDLKAWAWVSDPFDVFKATKAIVESATSKTCDITNFDALRVELKTTFKDKFFLLVLDDLWNMQYHDWDQLITPFSCGKKGSKIIVTTRQHRIAEITRTFPIHELKILTDDNCWCILAKHAFGNQGYDKYPILAEIGRQIATKCKGLPLAAKTLGGLLRSNVDAEYWKGILNSNMWANNEVLPALCISYLHLPPHLKRCFAYCSIFPRQHLLDRKELILLWMAEGFLTQIHGEKAMESVGEDYFNELLSRSLIEKDKNEGKEQLRMHDLIYDLARLVSGKRSCYFEGGEVPLNVRHLTYRQRDYDVSKRFEGLYELKVLRSFLPLCGYKFFGYCVSKKVTHDWLPKVTYLRTLSLFGYRNITELPDSISNLVLLRYLDLSHTSIKSLPDAAFRLYNLQTLKLSSCYYLTELPEQIGDLLLLRYLDLSHTPINRLPEQIGNLVNLCHLDIRGTNLSEMPSQISKLQDLRVLTSFVVGREGGVTIRELRKFPYLQGTLSILRLQNVVDPKDAVQADLKKKEHIEELMLEWGSEPQDSQIEKDVLQNLQSSTNLKKLSISYYSGTSFPKWLGDSTYSNVIDLRITDCNYCFSLPPLGQLPSLKELVIGRMKMVKTVGEEFYCNNGGSLSFQPFPLLESIRFKEMSEWEEWLPFEGGGRKFPFPCLKRLSLSECPKLRGNLPNHLPSLTEVSISECNQLEAKSHDLHWNTSIEDINIKEAGEDLLSLLDNFSYRNLRIEKCESLSSFPRIILAANCLQRLTLVDIPNLISFSADGLPTSLQSLQIYNCENLEFLSPESCLKYISLESLAICGSCHSLASLPLDGFSSLQFLRIEECPNMEAITTHGGTNALQLTTLTVWNCKKLRSLPEQIDLPALCRLYLNGLPELTSLPPRCLPSSLQTLEVDVGMLSSMSKHELGFLFQRLTSLFRLSIAGFGEEDVVNTLLKECLLPTSLQYLSLRFLDDLKLLEGKGLQHLTSLTELAIWHCKSLESLPEDQLPSSLELLEIGSCPLLEARYQSRKGKHWSKIAHIPAIKINGKVII

SEQ ID NO: 150782 - protein, 58 aa, Glycine max
  Coding DNA Sequence Number=SeqID_34004
MTSQSIMGCSIKPPESLPPMSMAESNKNENIVEGGKAITVPKNMDTQLRFTPINTGFH

SEQ ID NO: 150783 - protein, 617 aa, Glycine max
  Coding DNA Sequence Number=SeqID_34005
MFEFDLNIFCHFKDRFFKVLATGVVADGLPLILNRDKEPRFSFYWSDLIRFKLFDEDLLTLVERVDKAILEQLPTSLEAIPSLPSASDPLAALDGIMGDFAWRPLVKQVRPTGGIIPLFVAVSTVRERGQHVGEVGPISIVAKVDPSAHSSILAKWKWDDGAGPSGCRVDAQCGSPYDHVGYASGSPAIEASALSPRLAVAVQEANPAIAECATTNAPMVLPSMVPPPSTVLVAMPPFLSSRPRVSLDHLYTSSDIDSLWDATYKPKQNAPVGFVLGCDKNFIRSAGENEQRHQEVLHKVASLEAEVTKWRAIARTIWRVKCLKVANAIIAFPEAIRSNHLLSSKVGVMLAKLLRTRLDGDELFKRCKDLQVEKKDLVGKVENIATEKGKLAKVVANLEARLKDSESRLKESELRATKEREANKELEEELLIYKKEDVKDGVLLDEEKIPPKEEAVDEEQGATKFDFNLVKDLAIHLVGLPSALRSFSPNACEESMFDLPLVEGLANQSGGRSLDLQSFSSDGYDEADLRFCKNVSKGGPWVFDRLVFLHRYKRNGVLLHTCFLQVARIGAMVPFGGSTRELFDLSFGRRAVAYMSLAMGCTYWRRGGVLLHICHLP

SEQ ID NO: 150784 - protein, 85 aa, Glycine max
  Coding DNA Sequence Number=SeqID_34006
  Subcellular localization annotation: CTP_CleavageSite=26; ConfidenceScore=5.20e-01
MLAHLIDGKVPTSSLSFRDHESHLFNAQVGSAFGSTTTRTVVIVNEEEPFVPSVLGIKSGQPMLDLVMVLCDGVGGVEERGVVGD

SEQ ID NO: 150785 - protein, 1253 aa, Glycine max
  Coding DNA Sequence Number=SeqID_34007
  Gene Ontology: Mol. function=protein binding; Cellular component =membrane; Biological process=defense response
  Homolog annotation: Hit_ID=Q1SXP3; Match level="QueryCoverage=99%, HitCoverage=99%, E-value=0.0, Identity=46%"; Hit description=Disease resistance protein; Peptidase aspartic, active site
  Pfam annotation: Domain name=LRR_1; Domain location=1020-1044; Score =5.6; E_value=26; Accession=PF00560.23; Description=Leucine Rich Repeat
  Pfam annotation: Domain name=LRR_1; Domain location=1068-1090; Score =7.5; E_value=11; Accession=PF00560.23; Description=Leucine Rich Repeat
  Pfam annotation: Domain name=LRR_1; Domain location=1091-1110; Score =0.8; E_value=2e+02; Accession=PF00560.23; Description=Leucine Rich Repeat
  Pfam annotation: Domain name=LRR_1; Domain location=1114-1136; Score =2.3; E_value=1.1e+02; Accession=PF00560.23; Description=Leucine Rich Repeat
  Pfam annotation: Domain name=LRR_1; Domain location=1169-1192; Score =6.1; E_value=20; Accession=PF00560.23; Description=Leucine Rich Repeat
  Pfam annotation: Domain name=LRR_1; Domain location=1194-1221; Score =4.9; E_value=34; Accession=PF00560.23; Description=Leucine Rich Repeat
  Pfam annotation: Domain name=LRR_1; Domain location=569-591; Score =4.9; E_value=35; Accession=PF00560.23; Description=Leucine Rich Repeat
  Pfam annotation: Domain name=LRR_1; Domain location=593-615; Score =10.6; E_value=2.9; Accession=PF00560.23; Description=Leucine Rich Repeat
  Pfam annotation: Domain name=LRR_1; Domain location=616-638; Score =15.9; E_value=0.14; Accession=PF00560.23; Description=Leucine Rich Repeat
  Pfam annotation: Domain name=LRR_1; Domain location=640-661; Score =9.5; E_value=4.7; Accession=PF00560.23; Description=Leucine Rich Repeat
  Pfam annotation: Domain name=LRR_1; Domain location=663-684; Score =12.8; E_value=1.1; Accession=PF00560.23; Description=Leucine Rich Repeat
  Pfam annotation: Domain name=LRR_1; Domain location=795-816; Score =0.5; E_value=2.3e+02; Accession=PF00560.23; Description=Leucine Rich Repeat
  Pfam annotation: Domain name=LRR_1; Domain location=818-840; Score =1.1; E_value=1.8e+02; Accession=PF00560.23; Description=Leucine Rich Repeat
  Pfam annotation: Domain name=LRR_1; Domain location=881-904; Score =10.3; E_value=3.4; Accession=PF00560.23; Description=Leucine Rich Repeat
  Pfam annotation: Domain name=LRR_1; Domain location=995-1018; Score =8.3; E_value=7.9; Accession=PF00560.23; Description=Leucine Rich Repeat
  Pfam annotation: Domain name=NB-ARC; Domain location=157-452; Score =247.4; E_value=3e-71; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::NB-ARC; Domain location=1020-1044::1068-1090::1091 -1110::1114-1136::...
  Pfam module annotation: Domain location=1169-1192::1194-1221::569 -591::593-615::616-638::640-661::663-684::795-816::818-840::881 -904::995-1018::157-452
MALAMVGEALISASVEILLDRITSAEFRDFFANRKLNVSLLDELKIKLLTLNAVLNDAEEKQITNSAVKAWLNELKDAVLDAEDLLDEINTDSLRCKVEGEFKTFTSQVRSLLSSPFNQFYRSMNSKLEAISRRLENFLKQIDSLGLKIVAGRVSYRKDTDRSVEYVVARDDDKKKLLSMLFSDEDENNNHIQVLTIWGMGGLGKTTLAQSLLNDDAVQNHFDLKAWAWVSDPFDVFKATKAIVESATSKTCDITNFDALRVELKNTFKDKKFLLVLDDLWNMQYHDWDQLIAPFSCGKKGSKIIVTTRHHRIAEITRTFPIHELKILTDDNCWCILAKHAFGNQGYDKYPILAEIGRQIATKCKGLPLAAKTLGGLLRSNVDAEYWNGILNSNMWANNEVLAALCISYLHLPPHLKRCFAYCSIFPRQYLLDRKELILLWMAEGFLPQIHGEKAMESIGEDYFNELLSRSLIEKDKNEGKEQFQMHDLIYNLARLVSGKRSCYFEGGEVPLNVRHLTYPQREHDASKRFECLYELKFLRSFLPLYGYGSYPYCVSKKVTHDWLPKLTYLRTLSLFSYRNITELPDSISNLVLLQYLDLSYTSIKSLPDAAFRLYNLQTLKLSNCESLTELPEQIGDLLLLRYLDFSYTSINRLPEQIGNLVNLRHLDIRGTNLWEMPSQISKLQDLRVLTSFVVGRENGVTIRELRKFPYLQGTLSILRLQNVVDPKDAVQADLKKKEHIEELTLEWGSEPQDSQIEKDVLQNLQPSTNLKKLSIRYYSGTSFPKWLSYYSYSYVIVLCITDCNYCFSLPPFGQLPSLKELVIERMKMVKTVGEEFYCNNGGSLSFQPFPLLESIQFEEMSEWEEWLPFEGEGRKFPFPCLKRLSLSECPKLRGNLPNHLPSLTEVSISECNQLEAKSHDLHWNTSIEKIKIREAGEGLLSLLGNFSYRNIRIENCDSLSSLPRIILAANCLQSLTLFDIPNLISFSADGLPTSLQSLHISHCENLEFLSPESSHKYTSLESLVIGRSCHSLASLPLDGFSSLQFLRIEECPNMEAITTHGGTNALQLTTLDVWNCKKLRSLPEQIDLPALCRLYLNELPELTSLPPRCLPSSLQTLEVDVGMLSSMSKHELGFLFQRLTSLFRLSITGFGEEDVVNTLLKECLLPTSLQYLSLRNLYDLKLLEGKGLQHLTSLTELAIWNCKSLESLLEDQLPSSLELLEISSCPLLEARYQSRKGKHWSKIAHIPAIKIN

SEQ ID NO: 150786 - protein, 136 aa, Glycine max
  Coding DNA Sequence Number=SeqID_34008
  Gene Ontology: Mol. function=oxidoreductase activity; Cellular component=membrane; Biological process=electron transport
  Homolog annotation: Hit_ID=Q6YLS3; Match level="QueryCoverage=86%, HitCoverage=31%, E-value=2e-47, Identity=63%"; Hit description =Flavonoid 3', 5'-hydroxylase
FVNNDIWAIIVPFLKTLEQNFSNQPSIAGATHLAYDAQLLRKLSNLHMLGGKAVDDWAQVRNEEIGYMLRAMHDCSKRGSESNEFKDMVVELMTVAGYFNIGDFIPFLAKLDLQGIERGMKQLHKKFNLMRCVAMF

SEQ ID NO: 150787 - protein, 210 aa, Glycine max
  Coding DNA Sequence Number=SeqID_34009
EGSIDVAVVKEFYANFYSPADQAPKYARIRGQLIKIDADSLNEFLQTPGQPWKLLRKYLTTLAQTWSIFLYSNQAPTSRTSDLNTDRARLVYGLITRMNMNIGGLISGQMTMMAQSNSSRLGFPALIIAFCRSRGVGSDALTSYENLRPAIDLAYIIRNCWNVNDQIVNFPEARKTKLRAADVPSSFAPIVGIPTSSTSALLPALADLSA

SEQ ID NO: 150788 - protein, 107 aa, Glycine max
  Coding DNA Sequence Number=SeqID_34010
MIMRSQNIYSSQDEATTSPSSSESEEAEEEESSEEIYPQEEGQPLMVKEECKEVSVSSTRLAMKERHFEIMTNIKETSPLRQPPHFILCIKILVSIVTPLGLSFFLK

SEQ ID NO: 150789 - protein, 311 aa, Glycine max
  Coding DNA Sequence Number=SeqID_34011
MGFVTWWEKYYLTRSVGDTTIMISRLESGFVQPTVENIRSSLQARGKAPMTKRSAETSRADMRPKKPTGVKIQEGKQEEKEEEERPLIRKRKLPTTSTKFAEQTEAGNSQAQMPKKKKKVKQVEPEPSVAVEGGEPAKKKKKKTKSSKEQGDHQPVDVQPPSTDIDGTEVKAAPSIAEMGNPVEQPNSPREQPTVEVQQNVSAEEIPSCARTSPAPEADAVNVEEWGEGQGIGSSSPHGWAEVDDPHEPNQSDNTIPHESSQKSSSEENFFDEDAIKEAEAGGSDIYPVSSTSKLSASLGIAEDTFIQMQN

SEQ ID NO: 150790 - protein, 229 aa, Glycine max
  Coding DNA Sequence Number=SeqID_34012
  Gene Ontology: Mol. function=transporter activity; Cellular component= integral to membrane; Biological process=transport
  Homolog annotation: Hit_ID=Q5GTW5; Match level="QueryCoverage=99%, HitCoverage=52%, E-value=6e-92, Identity=76%"; Hit description =Dicarboxylate transport protein
GHRVVAGEGALDHLRAVHRVGVEGHGATGGDQEAQQQRPPLVHEQLVHRTGLLCLAFACGFDGRLRQRFVHAAAQPEHHHRGDATDAEGDAPAPLGDLRLAPEGQHQQQGQLGQHMAANQGDVALAPYSPPVAKPCSRRANSRMTAAQMPMLAAVGVMAMRNEHSAIRVTETVSARRRPWRSAKRPKNQAPIGRIRNVAAKIAHTYIVEFLSSGEKNCDSKYTANTEYT

SEQ ID NO: 150791 - protein, 78 aa, Glycine max
  Coding DNA Sequence Number=SeqID_34013
  Gene Ontology: Mol. function=hydrolase activity; Cellular component =mitochondrion
  Homolog annotation: Hit_ID=Q1RVU0; Match level="QueryCoverage=65%, HitCoverage=29%, E-value=8e-16, Identity=78%"; Hit description=NUDIX hydrolase
MAELVARTGRHQQRYEHGYRLIAGCVPFRYKDDCGDSCSEKIVEVLMINSTSIGSFVSKGTLTLNLYPLLLKSRIQSC

SEQ ID NO: 150792 - protein, 88 aa, Glycine max
  Coding DNA Sequence Number=SeqID_34014
MEAPLIGDALPARLYASDDRVYVQRVSKLGFDGDRLLKQILEKGGYTTTWKKLKHHGVPSSLLSINQTQKQSMHLLNSKKLYPIILND

SEQ ID NO: 150793 - protein, 209 aa, Glycine max
  Coding DNA Sequence Number=SeqID_34015
MASRKRKSIGTRPIAQYDTRRFHSFEAWTRYTDNVLGRHILPKRKVEIYHTELGEFKAELERRNFHKRLTNLVDNIIDLALVKEFYANLYSSEGPSPKQVRVRGHLVRIDADNLNTFLETPVVLAEEGHPGKILRKDLTTLAQVWTVLSYSNLAPTSHTLDLIVDRARLIFGLVSQMDMNVGTLIFGQITSMDQSNSSRLGFPTFIIAL

SEQ ID NO: 150794 - protein, 70 aa, Glycine max
  Coding DNA Sequence Number=SeqID_34016
MEGLIPFVYKAIMQSKGDKEGHPIGSWLCESPYSYMRLPGDSVPTSVFNTSSNCSMKMNKFVPEEKAEGA

SEQ ID NO: 150795 - protein, 157 aa, Glycine max
  Coding DNA Sequence Number=SeqID_34017
MIQCGKDYTSKMRFVDIFKCWSFAAFGLSCDEVESWLPPMSIPESGRWFNDLVRLRSNLVDADGEGERLNQPNGMISHESESEKEDKLVTGGCAADLVLEEEEKVLKRCSISEIFEMKEDVEEEKSSPEIEMVLKRLSFDTSEVSIKVTKFQSNSRP

SEQ ID NO: 150796 - protein, 81 aa, Glycine max
  Coding DNA Sequence Number=SeqID_34018
  Subcellular localization annotation: CTP_CleavageSite=20; ConfidenceScore=5.01e-01
MAPKSTLRLMRTLGPSLASLAQTFWSLLSNALGGCLFIVTLVLSFDGVGKKLGLVLGFDDVGNACLCLYVLVNGTFAGVKN

SEQ ID NO: 150797 - protein, 134 aa, Glycine max
  Coding DNA Sequence Number=SeqID_34019
MDEFDLQVAWLGAQPSPSGGGGASTAQEPTLEEPEAVAEGEDELTPPKPFYFDADARMAQKEGTSTDQIHEPSPTPIPDDAIPSAPASELEHPISQDSPAAQPLEENEHVIGSMTENVSQFVRLIVKECINRIL

SEQ ID NO: 150798 - protein, 80 aa, Glycine max
  Coding DNA Sequence Number=SeqID_34020
MDCPLYVGGITGAEEGTGAVEEEGAGVSGGAEVVGTSYLLPLAFLGPLNVTVGSSRFQHFFLIYAKLMSRLKFSRDLESD

SEQ ID NO: 150799 - protein, 470 aa, Glycine max
  Coding DNA Sequence Number=SeqID_34021
  Gene Ontology: Mol. function=chromatin binding; Cellular component =chromatin; Biological process=chromatin assembly or disassembly
  Homolog annotation: Hit_ID=Q1SAV4; Match level="QueryCoverage=59%, HitCoverage=97%, E-value=8e-59, Identity=37%"; Hit description =Integrase, catalytic region
  Pfam annotation: Domain name=rve; Domain location=172-298; Score= -11.8; E_value=0.057; Accession=PF00665.16; Description=Integrase core domain
MAQPPPRERTLREMAAPDFTYKSLCIQYPDEDVPYVLKIGLIHLLPKFHDLAGEDPYKHLKEFHIVCSTMKPPYGIQYRAGAHNQAADALSHVTADALLSLFVPCPLFMEELCHQLEANAGYHRLRQAIQSSPAKHPEFTWDVINFVSQCLNCQHVKYETKRVTGLLCPLPVPHRPWEDLSLDFITGLPPFLGNTVTLVVVNRFFKGIHLGMLLAAHTARTVAFLFMDISGTQLRMSFAYHPQSDVQTEVLNRVIEQCLCAFVHNRPREWGKFLPWVEWSHNTSWNAATNITPFKTTFGHKPFNFLEYIAESSTLDAMDEMLSKREEAFQVMLKLRPYRQVSAKGAQTTRGKLAKRFYGPFQVLECIGPMTYRLQLLKEAPSENAPREVLVQWDELPLDDTSWEKNWEQLCEDYHLEDKVNLHGPTDDTKKGASSSRDTQSGVQNQNQEVQIPVKTKRTLTRSSYRNDYV

SEQ ID NO: 150800 - protein, 233 aa, Glycine max
  Coding DNA Sequence Number=SeqID_34022
  Homolog annotation: Hit_ID=Q5XM22; Match level="QueryCoverage=28%, HitCoverage=37%, E-value=1e-16, Identity=61%"; Hit description =Resistance-like protein HAAS-2
MVRTRGLGRSLSRVIGRALRREVSCDSDEAPERRRPTASALHEQHEEATNDDVVIDIKGFSSGPHNTSILSGYVHHVAVTIWNGEEHPELKLSFHGRKVKKFNRPPPEIKDLVVVTGLSPLIACSLETSNRGLISAFAESFEALHMDKVVFLLVELLEVSSKEVRAETVQCHGPYVRLLWLQDTYRSKCDVAQWTIAARAYLLHLVGCTLFANKSATHVYVVFLDAFRDLTQS

SEQ ID NO: 150801 - protein, 374 aa, Glycine max
  Coding DNA Sequence Number=SeqID_34023
  Homolog annotation: Hit_ID=Q852S5; Match level="QueryCoverage=35%, HitCoverage=62%, E-value=2e-46, Identity=68%"; Hit description =Nucleoside diphosphate kinase 2, chloroplast precursor
  Pfam annotation: Domain name=NDK; Domain location=136-256; Score =190.2; E_value=4.9e-54; Accession=PF00334.9; Description=Nucleoside diphosphate kinase
MGFELRPSLQGIKSGCTRSRAVDEHVRRLRITGVGLCERLQTIGEELSVYANNLGVNLEFWVVEKNLENMKPEDIKVREEEVLVVNSILQLHCVVKESHRALNSVLQMIHGLGILVVLTRSFLSQPQTEMEAEQVDQTYIMVKPDGMQRGLGFKLTDLKLFKCSKELAEEHYKDLKQKSFFPKLIDYITSGPVVCMGVGVVASARKLIGATYPLQAEPDTIRGDLTVQTRKNVVHGSDNPENGKHEIDNMFGIFDVVEAIVVAPGKIILTGEHAVVHGSTAVASSIDLYTYVSLCFSTPSDNEDSLKLKLKEAALEFSWSITKIRAAFPESTTQLSSPPNSCSVENAKVIATLVEELNIPEAKLGLAYGVSAFL

SEQ ID NO: 150802 - protein, 383 aa, Glycine max
  Coding DNA Sequence Number=SeqID_34024
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=96%, HitCoverage=56%, E-value=1e-116, Identity=57%"; Hit description =Putative wall-associated receptor kinase-like 20 precursor
  Pfam annotation: Domain name=Pkinase; Domain location=87-366; Score =140.1; E_value=6.1e-39; Accession=PF00069.15; Description=Protein kinase domain
  Pfam annotation: Domain name=Pkinase_Tyr; Domain location=87-366; Score=112.1; E_value=1.6e-30; Accession=PF07714.7; Description =Protein tyrosine kinase
  Pfam module annotation: Pfam domain module=Pkinase::Pkinase_Tyr; Domain location=87-366::87-366
IKCEHGRGCKRRNKKTSLIGGTTLFAIATLTTAMITTLVLYLRRQRIKGETEQSLSRARDILNANNSGGRSAKIFTMKELTKATSNFSKANLLGFGGFGEVFKGTLDDGTITAIKRAKPGNIRGIDQILNEVKILCQVNHRSLVRLLGCCVELPEPLLVYEYVPNGTLFEHLHHHHHNNNSSKGIRLGWHSRLRIAHQTAEGIAYLHNAAVPRIYHRDIKSSNILLDDNLDAKVSDFGLSRLVVSDATHITTCAKGTLGYLDPEYYVNFQLTDKSDVYSFGVVLLELLTSKKAIDFNREEEDVNLVVLIKRALREGRLMDNVDPMLKSGDSRLELETMKAFGALAIACLDDRRKNRPTMKDIADEIECIIGILVGAKVDGLGV

SEQ ID NO: 150803 - protein, 628 aa, Glycine max
  Coding DNA Sequence Number=SeqID_34025
  Gene Ontology: Mol. function=RNA-directed DNA polymerase activity; Cellular component=chromatin; Biological process=chromatin assembly or disassembly
  Pfam annotation: Domain name=RVP_2; Domain location=186-320; Score= -40.7; E_value=0.0015; Accession=PF08284.2; Description=Retroviral aspartyl protease
  Pfam module annotation: Pfam domain module=RVP_2::RVT_1; Domain location=186-320::385-604
MASSDKLDEILLRLSNNQLTLGESMNNLTQKIDALLNRVTPILSPSPSPTSSPFSPAYHSFVLHGRPRARLVPVDDWKCPIYVVVGVPVGPANTIRTITLFFLRPNTRDKREVQAHQPPTLTQVTGLARLQEEKLLDVCHPPRSRAPPMTVVPPPTLAKLPRTRPLSPLLPPPGRQTLSVQVAPSDPDSAQINFQSLAGQLALNTLRMLGSLFSHQVVVLVDGRSTHNFIQQELVTLLQLPCHATSSPLQVMVGNGQHLQCTNWCEAITIDIQSSKFIVDLHVLPIFSANVVLGIPWLKSLGHVLTDYNTLTMQFIHEGRVVELKGDTDVVTIPHDIPLPIQPILNQFAYLFQQPWCLPSERDTDHHIHLLSQSTSKGLIQPSTSPFSSPVLLVKKSDGSWQFCVDYCALNAITVHDHFPIPTIDELLDELGGARCFSKLDLLQGYHQIRMHSEDMPKTAFRTHHGHYKFRVLSDNQFVLKITKYFFAQNQVEYLGHLVLHKGVEPLASKVEAIQQWPTSRTVRTVRSFLGMVGFYRCFIRGYGSIAAPLVHVTTLAEFNWSPQSQAAFDQLKQALSQALVLALPDFDLPFTIEMDASRVGMDIRDYSGDEEMEAVLAWALLYNNYRP

SEQ ID NO: 150804 - protein, 214 aa, Glycine max
  Coding DNA Sequence Number=SeqID_34026
  Pfam annotation: Domain name=zf-CCHC; Domain location=140-157; Score =7.6; E_value=0.055; Accession=PF00098.13; Description=Zinc knuckle
MADNAVFNNEAFAKLLNPYYTHPNENPAGVAIVAQVLNGGNYHSWSRAMLLVLKTKKKVQFVDDSLPRPALNDLNFTIWDHCLIQELDNFRPIPSCTCAVVCACDIIPVIKRDTSHGTYGRGRGRGGHTSGGTGRGRSSKICTYCNKTSHMVDTCYKKHGYPPHLHRGGVINQYFMDDQEIEDDLQSLRQKEVSADASSVAFTPKQHQARLSLL

SEQ ID NO: 150805 - protein, 299 aa, Glycine max
  Coding DNA Sequence Number=SeqID_34027
  Gene Ontology: Mol. function=DNA binding; Cellular component=oxygen evolving complex; Biological process=DNA integration
  Homolog annotation: Hit_ID=Q1SLU3; Match level="QueryCoverage=77%, HitCoverage=18%, E-value=3e-42, Identity=40%"; Hit description =Integrase, catalytic region
  Subcellular localization annotation: CTP_CleavageSite=63; ConfidenceScore=5.10e-01
MPHPPHPSPPEISSSLIDSHHQSALPQPSPRKSQRQKQPPSYLKDYHCSLLSATAHNSVSPISSNIRVGISINLMLTLHFLHGDLNEEVYMKVPPGFQQSKADYSLFTKRSPTSLTIVLVYVDDLVLIGTNLSEIQQLKHSLDAKFSIKDLGMLKYLLGFEVARSNSSIALHQRKYCLDLLQDTGLLAAKPCSLPMDPTLKLHKSSGVPLSDPIVYRRLVGRLLYLTHTRPDICYVVGKLSQYLQSPTDIHMQAAQHTLKYLKGNPGRGLFFSSSSSTSLTGFSDSDWGAYLDTRRSIT

SEQ ID NO: 150806 - protein, 234 aa, Glycine max
  Coding DNA Sequence Number=SeqID_34028
  Gene Ontology: Mol. function=nucleic acid binding; Biological process= DNA integration
  Pfam annotation: Domain name=zf-CCHC; Domain location=189-206; Score =12.9; E_value=0.0072; Accession=PF00098.13; Description=Zinc knuckle
  Pfam module annotation: Pfam domain module=Retrotrans_gag::zf-CCHC; Domain location=46-164::189-206
MAKKAVVNNAALTNLLNPYYTHPNENPGVVLVAQVLSGGNYHSWSRVMLLALKTKKKSLDPEILQTIMWMENASDSWNTLKKHYYQGDVFRISDLQEEIYLLKQGDANITTYFTKLKGLIQELDNFRPIPSCTCAIVCSCELIPIVKSHREGDYVIRFLRGLNDQYSTVRGRGHGSYTSGGRGRGRSTKICTYCNKSGHMVDTCYKKHGYPPHLHRGGAVNQYSMDDQEIEDDL

SEQ ID NO: 150807 - protein, 59 aa, Glycine max
  Coding DNA Sequence Number=SeqID_34029
MDPYPSGSLLSKVFLAVSGPGSVSCRWSNGAKGEAIMWKRLTLEGRLLEYKCEFKFHIG

SEQ ID NO: 150808 - protein, 154 aa, Glycine max
  Coding DNA Sequence Number=SeqID_34030
  Homolog annotation: Hit_ID=Q1RX51; Match level="QueryCoverage=59%, HitCoverage=55%, E-value=2e-07, Identity=39%"; Hit description=Zinc finger, CCHC-type
MEIYIESSQYRIFLIITNGDIPITRPEAEWINDDLAIMELNTKAKYTLTCALSKNESNKICKIRIAEETYCKAQIKLKVLDSFLKVWKPKTTTIQEARDLKNLAWDELLGILRVHEVHLQNREHLQKKNSIALKYEETIFKREENASLSKALKV

SEQ ID NO: 150809 - protein, 141 aa, Glycine max
  Coding DNA Sequence Number=SeqID_34031
MKKKGKFQHSSKHKDSIFKKKNKEESNEIIWFECRKPTYMKVECPWLKKKRYFGDKKKKSLMVTWDDSDNDKSGSLDDELANICPVVDKDDKVKIKTCSKFATSSFASLDDEEGEEVACLTNDFGKFLESSKTLTTPLKVH

SEQ ID NO: 150810 - protein, 75 aa, Glycine max
  Coding DNA Sequence Number=SeqID_34032
MRKDLGSRVPFMLLDYKCSPVGCIFVPGPLEQKSNILNRGLFSIKESIIIRRSERSLGWRSISYEVFEHVYVLDV

SEQ ID NO: 150811 - protein, 670 aa, Glycine max
  Coding DNA Sequence Number=SeqID_34033
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=91%, HitCoverage=92%, E-value=0.0, Identity=52%"; Hit description =Putative wall-associated receptor kinase-like 20 precursor
  Pfam annotation: Domain name=Pkinase; Domain location=355-633; Score =145.9; E_value=1.1e-40; Accession=PF00069.15; Description=Protein kinase domain
  Pfam annotation: Domain name=Pkinase_Tyr; Domain location=355-633; Score=114.4; E_value=3.3e-31; Accession=PF07714.7; Description =Protein tyrosine kinase
  Pfam module annotation: Pfam domain module=Pkinase::Pkinase_Tyr; Domain location=355-633::355-633
MDQLNIAMLIFTTIALFLSRAEAMRKCGNCGLNPVPYPLSTGPDCGDPWYKIRCTAGTLWLDALAGSAYLISSIDPLTRSIITRPASITPKTCVSTDFHSEGMHLNETLPFSVASGNTVFLFNCTTHAPSMNCAASGTCHRYVKEHADFGACGRVGVCCEYKSAGSLKEYVVRVHGGGCAAYQSFVDFNGTAAGKRWPEPGVGIKWVAPQEPVCKAPIDCKELLNSKCGVGPAGGVVQRCLCNVGFKWTRSMIQRAKDMEKIATAKFGRKRKCFWLVSSAICQQLTVRITGAIMVASLGGIFSIVTVIGVIFYKKHNQAKQAKIKKRKEISSAKANALSSRIFTGREIRKATNNFSQENLVGTGGFGEVFKGTFDDGTVFAIKRAKLGCTKGIDQMQNEVRILCQVNHRSLVRLLGCCLELENPLLIYEYVSNGTLFDYLHRYSSGSREPLKWHQRLKIAHQTAEGLCYLHSAAVPPIYHRDVKSSNILLDDKLDAKVSDFGLSRLVELAEENKSHIFTSAQGTLGYLDPEYYRNFQLTDKSDVYSFGVVLMELLTAQKAIDFNREEESVNLAMYGKRKMVEDKLMDVVDPLLKEGASALELETMKSLGYLATACVDDQRQKRPSMKEVADDIEYMIKIVKGQERLLEASFFHEPNGGYLPEDELWDGDI

SEQ ID NO: 150812 - protein, 121 aa, Glycine max
  Coding DNA Sequence Number=SeqID_34034
MKTINSRFQLRTKISFRVRLLKANFLIHETNNGALSRGRRSRSKVSISEHAEGSLSMSHNQIDPRICLSIYRREGMTTTPRAPDQSDGKFRPRLNTDERPIANKYREAKMKKTLKRESKRT

SEQ ID NO: 150813 - protein, 180 aa, Glycine max
  Coding DNA Sequence Number=SeqID_34035
MVVFEGALDLRLKHLSEIFVGAGLGSEGVGEAKRGCDSSSRCLSAENRESNVEGSGRRRCHGRAARQLRQHGGGDAAKHRVHGHFCVCAEQRGRLEAQSKGFKQSFSSLPRGTCSLSVSRQYLALDGIYRPIGREHGASWSFPPAGRWINKFAGQSDCETSTMILPHVHLWKPCYDFSFL

SEQ ID NO: 150814 - protein, 176 aa, Glycine max
  Coding DNA Sequence Number=SeqID_34036
MNAKIADFGMMILCIPRIWSCKKHVLKNIKDLKLEHGGFISSTEHTKMRKKLESAPTPTPTTRSLNSKSSTLNNSLKTVYVNLRKFSFLASSIEANGERLYNGEVRSSEREGWATLAYLSVTWADSGGAIEAWCSQRHNVFPYQVAKGSDRGLELQTFYLGIIFNSDRFDSFDKIC

SEQ ID NO: 150815 - protein, 222 aa, Glycine max
  Coding DNA Sequence Number=SeqID_34037
  Gene Ontology: Cellular component=mitochondrial matrix
  Homolog annotation: Hit_ID=Q8W487; Match level="QueryCoverage=72%, HitCoverage=64%, E-value=4e-37, Identity=50%"; Hit description =Protein At2g39795, mitochondrial precursor
  Pfam annotation: Domain name=MAM33; Domain location=49-220; Score =100.9; E_value=3.7e-27; Accession=PF02330.6; Description =Mitochondrial glycoprotein
MQNDVVYCIKLDFVLLVVGGGGGCRSFRKYLSIVKLCKVSFGVRQYPVITALKPIFKVEVPVDFPFDIEDNPGERTIQLKGKFGDETIKVQVDIPNVAPGEENEDDENGDNEKNDSESSIPLVVSVFKENGVSLEFGVTAFPDEISIDSLSIKQCEESEDQLAYEGPEFIDLDENLQKAFHKYLEIRGIKPSTTNFLQEYMFAKDNKEYLMWLKNLKNFVEK

SEQ ID NO: 150816 - protein, 287 aa, Glycine max
  Coding DNA Sequence Number=SeqID_34038
  Gene Ontology: Mol. function=oxidoreductase activity; Cellular component=apical plasma membrane; Biological process=L-ascorbic acid biosynthetic process
  Homolog annotation: Hit_ID=Q9M338; Match level="QueryCoverage=92%, HitCoverage=97%, E-value=1e-84, Identity=61%"; Hit description =Reductase-like protein
  Pfam annotation: Domain name=Aldo_ket_red; Domain location=14-269; Score=233.2; E_value=5.5e-67; Accession=PF00248.11; Description =Aldoketo reductase family
MDKEATNVPLHFDLNTGAKIPSVGLGTWEARRGVVGDAVIAAVKAGYRHIDCARIYDNEKEFASDADRGGSENTVFYWGSTSISDCAPEDVSKALTRTLADMQLDYIDLYLMHWPFRTKLGSRGWNPENMAPLCLPETWNAMEGLFASGQARAIGVSNFSTKKLQDLLGYAKIPPAVNQVECHPVWQQPALHNLCKSTGVHLTAYCPLGSPGSWVKGQVLKEPLLKEIAEKLHKSPAQVALRWGTPKCKGYFEMNLLSMKLVVLTKILKNCGMEKYEMQITFDEARD

SEQ ID NO: 150817 - protein, 615 aa, Glycine max
  Coding DNA Sequence Number=SeqID_34039
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=94%, HitCoverage=75%, E-value=0.0, Identity=72%"; Hit description=VuP5CS protein
  Pfam annotation: Domain name=AA_kinase; Domain location=2-203; Score =50.6; E_value=5.1e-12; Accession=PF00696.18; Description=Amino acid kinase family
MCLCKPLSGIALRWNFFSDLQNPQGDLDGKACAAVGQSSLMALYDLMFSQLDVTSSQLLVNDGFFRDTAFRKQLSDTVSSLLDLRVIPIFNENDAVSTRKAPYEGKNCLQDSSGIFWDNDSLAGLLALELKADLLVLLSDVEGLYSGPPSDPKSKLIHTYVKEKHQSEITFGEKSRLGRGGMTAKVNAAVCAAYAGTPVIITSGYATDNIIRVLRGERIGTVFHKDAHLWTSIKEVSAHEMAVAARNSSRRLQASKVLNSEERRKILLAMADALEINESVIRLENGADVADAEEMGYEKALISRLTLRPEKISSLVKSVRMLADMEEPIGQILKRTELADKLILEKISCPLGVLLVIFESRPDALVQIAALAIRSGNGLLLKGGKEAKRSNAILHKVITSIIPDTVGDKLIGLVTSREDIPDLLKANLVVPRGSNKLVSQIKGTTKIPVLGHADGICHVYVDKTANIDMAKKIIRDAKIDYPAACNAMETLLVHVDLSRNGGLDELVAELQREDHAVKLENMYNRDNMTAMMYLLPLTTYITMEGKFKFPYKIYVLILYIINIIILKIYFFLSCFCSAHTECIVAEDSEVAEAFLSQVDSVKFQEILMWQIGMVV

SEQ ID NO: 150818 - protein, 59 aa, Glycine max
  Coding DNA Sequence Number=SeqID_34040
  Gene Ontology: Mol. function=hydrolase activity, hydrolyzing O -glycosyl compounds; Biological process=carbohydrate metabolic process
  Homolog annotation: Hit_ID=Q2HTE2; Match level="QueryCoverage=88%, HitCoverage=9%, E-value=2e-15, Identity=77%"; Hit description =Sialidase
MQIQTAIPRTVWLDFTGRQLVQWPVEELNSLRGKEVNTDNQRLEKGDYSEVKGITAAQV

SEQ ID NO: 150819 - protein, 78 aa, Glycine max
  Coding DNA Sequence Number=SeqID_34041
MDAPDLPEDDEDPLPDVDSPEDIMPASEADSTEESGPGGTANTSTVVTFALDVTVLFCKLPCFGQFLMMKTIMFYLVI

SEQ ID NO: 150820 - protein, 87 aa, Glycine max
  Coding DNA Sequence Number=SeqID_34042
MEPGESTTIHIKRRDGKPLVLRSAMILKKLGDLEDPAQWVSTIETRWRSRGWGRRGSVWVSEGGWKVMEEVIKLIKAMAWRVSPRES

SEQ ID NO: 150821 - protein, 188 aa, Glycine max
  Coding DNA Sequence Number=SeqID_34043
  Gene Ontology: Mol. function=oxidoreductase activity; Cellular component=membrane; Biological process=electron transport
  Homolog annotation: Hit_ID=Q38JF3; Match level="QueryCoverage=100%, HitCoverage=35%, E-value=3e-81, Identity=79%"; Hit description =Ferulate 5-hydroxylase
MAFAHYGPFWRQMRKICVMKLFSRKRAESWNTVRDEVDFIIRSVTNNLGSPVNVGELVFNLTKNIIYRAAFGSSSQEGQDEFISILQEFSKLFGAFNVADFVPFLGWVDPQGLNKRLVKARASLDSFIDKIIDEHVQKRRSGHDGDEESDMVDELLNFYSHEAKLNDESDELLNSISLTRDNIKAIIM

SEQ ID NO: 150822 - protein, 511 aa, Glycine max
  Coding DNA Sequence Number=SeqID_34044
  Gene Ontology: Mol. function=protein binding; Cellular component =membrane; Biological process=defense response
  Homolog annotation: Hit_ID=Q1SXP3; Match level="QueryCoverage=89%, HitCoverage=43%, E-value=1e-115, Identity=45%"; Hit description =Disease resistance protein; Peptidase aspartic, active site
  Pfam annotation: Domain name=NB-ARC; Domain location=126-382; Score =135.0; E_value=2e-37; Accession=PF00931.13; Description=NB-ARC domain
MALAMVGEALISASVEILTKRIASREFRDFFSSRKLNISVLDELMKLLALNAVLNDAEEKQITDLAVKEWLEELKDAVLDAEDLLDEINTDALRCEVEDETKTSTTKVRSMFSSSFKNFYKRMNSKLEAISGRLEHFVRQKDILGLQKDDKEKLLSMLLSDDDAMSNDIAVITVLGMGGLGKTTLVQSLYNDSEVQKHFDLTAWAWVSDDFNILKVTKKIVESFTSKDCHILKVIVTTRQQKVAQVTHTFPTYELQHLSDENCWQILARHAFGHEGYDKYPSLEKMGRKIARKCNGLPLAAKTLGGLLRSNVDAAEWNRTLNSNLWAHDDVLPALRISYFHLPAHLKRCSAYCSIFPKQSLLDRKELILLWMAEGFLQHNKEKAIESVGDDCFNELSSRSLIQKDSAIAEENFQMHDLIYDLARLVSGRSSCYFEGGEISRTVRHLSFLREMFDVSEKFEAFSSNKGDIISSKDEDVTIATTGVHQANKEVQVVSKTKRRIVRPTYLKDFV

SEQ ID NO: 150823 - protein, 88 aa, Glycine max
  Coding DNA Sequence Number=SeqID_34045
MSREHVYAISNGNENGEKIPFQPKKEMILEKWVKVRKTTYLSLRRPVALSCALCTTIFVLWCVLRTGTSISWLSHEPLAMPPLVLMTA

SEQ ID NO: 150824 - protein, 78 aa, Glycine max
  Coding DNA Sequence Number=SeqID_34046
MERNDIVMEAYNVASGAGMQSNTTAHDGWSTDTELWPHERDHGRGACQRDNYTKHEGRSHEGGFQRMLFFQWLMGLLI

SEQ ID NO: 150825 - protein, 40 aa, Glycine max
  Coding DNA Sequence Number=SeqID_34047
MAYSVPILLPLDLLVYVVKIAIVDQDCHYGAVECRRKLGA

SEQ ID NO: 150826 - protein, 66 aa, Glycine max
  Coding DNA Sequence Number=SeqID_34048
MEVQCIDRVVELKIPAILQSFVGMPLLHVIQLALPNMVLQIQYSICASLQYNAFTVVSLVIAMFSG

SEQ ID NO: 150827 - protein, 78 aa, Glycine max
  Coding DNA Sequence Number=SeqID_34049
MTKGAEDDETKLVSACYQTLSLTDSKRVCAGYRIGCLRMSTDSQVTIAKGGVVDKSGAFAPTYPQFMMRNSNLRSSFL

SEQ ID NO: 150828 - protein, 185 aa, Glycine max
  Coding DNA Sequence Number=SeqID_34050
  Gene Ontology: Mol. function=nucleoside-triphosphatase activity; Cellular component=integral to membrane; Biological process=transport
  Homolog annotation: Hit_ID=O81016; Match level="QueryCoverage=88%, HitCoverage=12%, E-value=3e-53, Identity=61%"; Hit description =Probable pleiotropic drug resistance protein 4
MWNSAENAFARSSSFREETEDEEALRWAALERLPTYKRARRGIFKNVIGDIKEIDVRDLQAQEQRLLLERLVDCVDNDPERVGLHFPKIEVRFQDLTVETYVHVGSRALPTIPNFICNMTEALLRQLRMYRRKRSKLTILADISGIIKPSRLTLLLGPPSSGKTTLLLALAGRLGPGLQKSTMAL

SEQ ID NO: 150829 - protein, 1098 aa, Glycine max
  Coding DNA Sequence Number=SeqID_34051
  Gene Ontology: Mol. function=nucleoside-triphosphatase activity; Cellular component=integral to membrane; Biological process=transport
  Homolog annotation: Hit_ID=O81016; Match level="QueryCoverage=98%, HitCoverage=86%, E-value=0.0, Identity=55%"; Hit description =Probable pleiotropic drug resistance protein 4
  Pfam annotation: Domain name=ABC2_membrane; Domain location=212-388; Score=90.8; E_value=4.2e-24; Accession=PF01061.14; Description=ABC-2 type transporter
  Pfam annotation: Domain name=ABC2_membrane; Domain location=831-1045; Score=219.1; E_value=9.8e-63; Accession=PF01061.14; Description=ABC-2 type transporter
  Pfam annotation: Domain name=ABC_tran; Domain location=544-734; Score= 106.5; E_value=7.5e-29; Accession=PF00005.17; Description=ABC transporter
  Pfam annotation: Domain name=PDR_assoc; Domain location=393-458; Score=130.7; E_value=4.2e-36; Accession=PF08370.2; Description=Plant PDR ABC transporter associated
  Pfam module annotation: Pfam domain module=ABC2_membrane::ABC2 _membrane::ABC_tran::PDR_assoc; Domain location=212-388::831 -1045::544-734::393-458
MLKGISGGQKKRLTTGELLIGPARVLFMDEISTGLDSSTTYQIIRYLKHSTRALDGTTIVSLLQPAPETYELFDDVILLCEGQIVYQGPREAAVDFFKQMGFSCPERKNVADFLQEVSSHNGIYVSTIVGFSDGSPDTSNSCQQVTSKKDQEQYWSVPDRPYRYVPVGKFAEAFSLYREGRILSEQLNLPFDRRYNHPAALATVSYGAKRLELLKTNYQWQKLLMKRNSFIYVFKFVQLLLVALITMSVFFRTTMHHNTIDDGGLYLGALYFSMVIILFNGFTEVSMLVAKLPVLYKHRDLHFYPSWAYTLPSWFLSIPTSLIEAGCWVTVSYYASGYDPAFTRFLRQFLLFFFLHQMSIDRIPVWWIWGFWISPLMYAQNSASVNEFLGHSWDKKAGNQTTYSLGEAVLKERSLYAENYWYWIGLGAMVGYTILFNILFTIFLAYLNPLGRQQAVVSKDELQEREKRRKGESVVIELREYLQRSASSGKHFKQRGMVLPFQPLSMAFSNINYYVDVPLELKQQGIVEDKLQLLVNVTGAFRPGVLTALVGVSGAGKTTLMDVLAGRKTGGVIEGSVYISGYPKRQDSFARISGYCEQTDVHSPCLTVWESLLFSAWLRLSSDVDFETQKAFVEEVMELVELTPLSGALVGLPGIDGLSTEQRKRLTIAVELVANPSIVFMDEPTSGLDARAAAIVMRTVRNIVNTGRTIVCTIHQPSIDIFESFDELLFMKRGGELIYAGPLGPKSSELISYFEAIEGVPKIRSGYNPATWMLEATSSVEENRLGVDFAEIYRKSSLYQYNQELVERLSKPSGNSKELHFPTKYCRSSFEQFLTCLWKQNLCYWRNPQYTAVRFFYTVIISLMLGSICWRFGAKRETQQDLFNAMGSMYSAILFIGITNGTAVQPVVSVERFVSYRERAAGMYSALSFAFAQVVIEFPYVFAQAIIYSSIFYSMASFLWTFDRFIWYLFFMYFTMLYFTFYGMMTTAVTPNHNVAAIIAAPFYMLWNLFSGFMIPHKRIPIWWRWYYWANPVAWSLYGLLTSQYGGDTHLVKLSDGNSMTIREGQISCKVTYYWFIGILLDMKSDYWLVMTDFGESE

SEQ ID NO: 150830 - protein, 829 aa, Glycine max
  Coding DNA Sequence Number=SeqID_34052
  Gene Ontology: Mol. function=DNA binding; Cellular component=nucleus; Biological process=multicellular organismal development
  Homolog annotation: Hit_ID=Q6H976; Match level="QueryCoverage=99%, HitCoverage=96%, E-value=0.0, Identity=49%"; Hit description=STYLOSA protein
  Pfam annotation: Domain name=SSDP; Domain location=48-292; Score= -33.4; E_value=2.5e-06; Accession=PF04503.4; Description=Single -stranded DNA binding protein, SSDP
  Pfam annotation: Domain name=WD40; Domain location=541-579; Score =28.0; E_value=3.4e-05; Accession=PF00400.22; Description=WD domain, G-beta repeat
  Pfam annotation: Domain name=WD40; Domain location=583-621; Score =48.4; E_value=2.4e-11; Accession=PF00400.22; Description=WD domain, G-beta repeat
  Pfam annotation: Domain name=WD40; Domain location=626-664; Score =25.8; E_value=0.00015; Accession=PF00400.22; Description=WD domain, G-beta repeat
  Pfam annotation: Domain name=WD40; Domain location=668-703; Score =5.4; E_value=8.6; Accession=PF00400.22; Description=WD domain, G -beta repeat
  Pfam annotation: Domain name=WD40; Domain location=707-744; Score =28.8; E_value=1.9e-05; Accession=PF00400.22; Description=WD domain, G-beta repeat
  Pfam annotation: Domain name=WD40; Domain location=751-788; Score =20.1; E_value=0.0077; Accession=PF00400.22; Description=WD domain, G- beta repeat
  Pfam annotation: Domain name=WD40; Domain location=791-829; Score =28.3; E_value=2.7e-05; Accession=PF00400.22; Description=WD domain, G-beta repeat
  Pfam module annotation: Pfam domain module=SSDP::WD40::WD40::WD40::WD4 0::WD40::WD40::WD40; Domain location=48-292::541-579::583-621::626 -664::668-703::707-744::751-788::791-829
MHIGFLRGKKLVIDAPSGFLFEWWSVFWDIYIARANQKLQDTAQKHQEAAVSYSKSQQIKARLMQKQLEQELQNTNQNQQMQFLLQRHAQQQQQRLRGTQLISGSASCPISSDPLMRQNRATSNANTTKTYEDRLKLPLQKDALDDTSIQQKVIDDVAQLLNPNHALLLKAAATTGEQATGQTLLSAPSILQGDIQHVQNLNQKLPGSTQSWLLKQDLNSDMNAMMRSQAVVSEGSFISCHEFAFDFWSTIILILGSNQGGSNLTLKGWPLAGLDELRSGFLQPNNLMQSSQSFHQLSVRQQLMLQAQQNLISPSASDFESRRLRMLVNDQNMALLKDGQSNSLGDLIPDNRSPAQVGSSVLPHPDSDMFLKQQIQKSSQQHQQCSQHPLSSHQSESLQKQEKNGPGTMTVEGNVSNTLQGNNQVSISKTGRKRKPASSSGPANSSGTANTTGPPISSPKTPSTQTPADMMTVSTLQQNVPSSKSSFMFGTDGLGPLTSAQNQLADMDHLVGDGCLGDNVESFLSPDDTDVSKKIGKEISFKDIKHIGASLHKVECCHFSSDGKLLATGGHDNKASLWCTELFNLKSTLEEHSEWITDVRFCPSMLRVATSSADKTVRVWDVDNPSYSLRTFTGHATTVMSLDFHPSKDDLICSCDNSEIRYWSIKNGSCTGVFKGGATQMRFQPCLGRLLAAAVDNFVSIFDVETLGCRLKLQGHNNLVRSVCWDLSGKFLASLSDDMVRVWNVASGGKGECIHELKDCRNKFSTCVFHPFYPLLVIGCHETIELWDFGDNKTMTLHAHDDVVSSLAVSNVTGLVASTSHDKHFKIWK

SEQ ID NO: 150831 - protein, 122 aa, Glycine max
  Coding DNA Sequence Number=SeqID_34053
MWLVRKEDVFRVQKGIKGTRSSAKERILRPRDRLDYLEGSIISCIDGSQTMVGSNALLYLSELPLQPACSPPFFLTNGHPHQGQPCNFSLNFFPTTSGAHVSYQHVNSDHTRTTIATIPSII

SEQ ID NO: 150832 - protein, 650 aa, Glycine max
  Coding DNA Sequence Number=SeqID_34054
  Gene Ontology: Mol. function=protein kinase activity; Cellular component=integral to membrane; Biological process=protein amino acid phosphorylation
  Homolog annotation: Hit_ID=Q949V3; Match level="QueryCoverage=94%, HitCoverage=94%, E-value=0.0, Identity=61%"; Hit description =Putative receptor protein kinase
  Pfam annotation: Domain name=LRRNT_2; Domain location=26-63; Score =34.9; E_value=2.7e-07; Accession=PF08263.3; Description=Leucine rich repeat N-terminal domain
  Pfam annotation: Domain name=LRR_1; Domain location=117-139; Score =13.8; E_value=0.64; Accession=PF00560.23; Description=Leucine Rich Repeat
  Pfam annotation: Domain name=LRR_1; Domain location=141-163; Score =15.6; E_value=0.18; Accession=PF00560.23; Description=Leucine Rich Repeat
  Pfam annotation: Domain name=LRR_1; Domain location=165-185; Score =6.3; E_value=19; Accession=PF00560.23; Description=Leucine Rich Repeat
  Pfam annotation: Domain name=LRR_1; Domain location=186-208; Score =10.5; E_value=3.1; Accession=PF00560.23; Description=Leucine Rich Repeat
  Pfam annotation: Domain name=LRR_1; Domain location=93-115; Score =18.3; E_value=0.028; Accession=PF00560.23; Description=Leucine Rich Repeat
  Pfam annotation: Domain name=Pkinase; Domain location=343-609; Score =67.1; E_value=5.8e-17; Accession=PF00069.15; Description=Protein kinase domain
  Pfam annotation: Domain name=Pkinase_Tyr; Domain location=342-609; Score=30.4; E_value=2.4e-14; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=26-63::117 -139::141-163::165-185::186-208::93-115::343-609::342-609
MALFITVVVVLFLLQLSSSVRVNSEPTQDKQALLSFLSQTPHSNRLQWNASESACDWVGVKCDASRSFVYSLRLPAVDLVGRVPPGTLGRLTQLRILSLRSNALTGEIPSDFSNLIFLRSLYLQKNQFSGEFPPSLTRLTRLARLDLSSNNFTGQIPFSVNNLTHLTGLFLERNHFSGKIPSITLRLVNFNVSYNNLNGSIPETLSAFPETSFVGNIDLCGPPLKDCTPFFPAPAPSPSENSTPVKTRKKSKKLSTGAIVAIVVGSVLGLALLLLLLLLCLRRRRRQPAKPPKAVVEEHSVPAEAGTSSSKDDITGGSAEVERNKLVFFEGGIYSFDLEDLLRASAEVLGKGSVGTSYKAVLEEGTTVVVKRLKDVVVTKKEFETQMEVLGNIKHENVVPLRAFYFSKDEKLLVYDYMSAGSLSALLHGSRGSGRTPLDWDSRMKIALGAARGLTCLHVAGKVVHGNIKSSNILLRGPDHDAGVSDFGLNPLFGNGAPSNRVAGYRAPEVVETRKVSFKSDVYSLGVLLLELLTGKAPNQASLGEEGIDLPRWVQSVVREEWTAEVFDAELMRFQNIEEEMVQLLQIAMACVSVVPDQRPSMQDVVRMIEDINRGETDDGLRQSSDDPSKGSEGHTPPPESRTPPRSLTP

SEQ ID NO: 150833 - protein, 243 aa, Glycine max
  Coding DNA Sequence Number=SeqID_34055
  Gene Ontology: Mol. function=bile acid:sodium symporter activity; Cellular component=integral to membrane; Biological process=organic anion transport
  Homolog annotation: Hit_ID=Q672Q4; Match level="QueryCoverage=97%, HitCoverage=58%, E-value=4e-99, Identity=75%"; Hit description =Putative anion:sodium symporter precursor
  Pfam annotation: Domain name=SBF; Domain location=1-143; Score=92.7; E_value=1.1e-24; Accession=PF01758.7; Description=Sodium Bile acid symporter family
  Subcellular localization annotation: CTP_CleavageSite=37; ConfidenceScore=5.18e-01
MYIMHNPLTSIFDSQTLKLSAPLATGLILVACCPGCQASNVATFIAKGNVALSVLMTTCSTIGAIIMTPLLTKLLAGQLVPVDAVGLALSTFQVVLVPTIVGVLANELFPKFTSKIITVTPLIGVILTTLLCASPIGLASDVLKAQGAQLVLPVVFLHAASFALGYWVSRISFGESSSRTVSIECGMESSAFGFLLAQRHFTNPLVAVPSAVSVVCMALGGSALAVFWTNRPIPLDDKDDFKK

SEQ ID NO: 150834 - protein, 80 aa, Glycine max
  Coding DNA Sequence Number=SeqID_34056
MEEEWDTAYPAKCHKKRSGGEFWSLGKKAKEFYNAFLFFFFFFTAPVISQALLSPVYTRLFFLTKVNYGGLRKEEGKENS

SEQ ID NO: 150835 - protein, 217 aa, Glycine max
  Coding DNA Sequence Number=SeqID_34057
  Homolog annotation: Hit_ID=O81017; Match level="QueryCoverage=46%, HitCoverage=35%, E-value=9e-16, Identity=44%"; Hit description =Putative Na+ dependent ileal bile acid transporter
  Subcellular localization annotation: CTP_CleavageSite=57; ConfidenceScore=5.09e-01
MVSLVSFLPILISFVFLFVFMEVKGHFYLTKSGGSCAIRRKLRGPVVAVLELPLSLQASRRSESHGDGGVVLTSEDGFEGMESILSLLHYLRAMMKFKFFSEKPLSDEATISMKKKWNSKILCNATTDISGDIPESAGELSQYEKVIEILTALFPVWLRTWLIGNMFINCCQVMSLFQVGVGFLAQYLIKPMLGFAIAMVLLSLPEHFHASLSLCFV

SEQ ID NO: 150836 - protein, 79 aa, Glycine max
  Coding DNA Sequence Number=SeqID_34058
  Gene Ontology: Mol. function=ATP binding; Cellular component =chromosome; Biological process=DNA metabolic process
  Homolog annotation: Hit_ID=Q8L6H8; Match level="QueryCoverage=78%, HitCoverage=5%, E-value=7e-28, Identity=96%"; Hit description=SMC4 protein
  Pfam annotation: Domain name=SMC_N; Domain location=2-78; Score= -118.0; E_value=0.0055; Accession=PF02463.9; Description=RecFRecNSMC N terminal domain
  Subcellular localization annotation: CTP_CleavageSite=33; ConfidenceScore=5.13e-01
MSFSAVVGPNGSGKSNVIDAMLFVFGKRAKQMRLNKVSELIHNSTNHQNLDSAGVSVHFQEIVDSMYWLYGEIKFTSAI

SEQ ID NO: 150837 - protein, 66 aa, Glycine max
  Coding DNA Sequence Number=SeqID_34059
CSSPHLVLVRSRSEGDVDLFSMERSTKEDFIGKQLKQQLTRTATELAFLRGGNGTKGRAGARAAAS

SEQ ID NO: 150838 - protein, 32 aa, Glycine max
  Coding DNA Sequence Number=SeqID_34060
MEVVPTATTLISKGMISLETIERDITALGSYH

SEQ ID NO: 150839 - protein, 204 aa, Glycine max
  Coding DNA Sequence Number=SeqID_34061
DLNARILQGVHKAWDAVQRKDKELKGSSNGIIDGYRQAAREEEAEAPEESEEVQALKAKLEKGQAIKEKFKSTAIKVRRECDELKDINMATAEDLERETKRARKKEHGRNNNSELKLQRDERDQSRVEGMILKDELKACLRRSKPSGNYEDRLVDEYTKVSVEKEARGRAKAMADMYSALKEIHGLLNYCQHMIDLMAHIIRSR

SEQ ID NO: 150840 - protein, 103 aa, Glycine max
  Coding DNA Sequence Number=SeqID_34062
  Homolog annotation: Hit_ID=Q1SMK1; Match level="QueryCoverage=71%, HitCoverage=4%, E-value=3e-08, Identity=39%"; Hit description =Integrase, catalytic region; Peptidase aspartic, active site; Ribonuclease H
MPRCSPMIRVGRVGVVPLWEGRLVNPSKGHNCQLVGDQRWQQVSICQWDWGKLQKLIRQRTSLVGWELSQKSFRHGPKNLGGVEHTDEYHAKLIEASTKQVLR

SEQ ID NO: 150841 - protein, 105 aa, Glycine max
  Coding DNA Sequence Number=SeqID_34063
MVICTFINQRQTSPLTCRDRYGHLHPFVEDSTSIDRDYFSLTFVIQRRRRQVSPLTRKDEYGRLPPLVEDSMLFDLYSYSLPFTIQRQTSPIACGDCNGHSLLLF

SEQ ID NO: 150842 - protein, 405 aa, Glycine max
  Coding DNA Sequence Number=SeqID_34064
MKAHGICIFLALDHHFVHFWFHLALVFTPYKKFPQESFQQKGPGRTPPKKALALPSQLTQILTGTDSGAPSISSTSRPSRDGHSSERGGRWAPLVTTMAKFDPEIGAWDMRSWVRGQWIPFNADALSQFLGHPLILEEGQLCEYIWRRIQVSGFDEEAIAQLLCIPGQDFARTIVGRRVRIMRTSMTTLTQIWMTLLLSNIDAILPRTGPVTRAMSKRLQDDWARAAEEGPKVLINLRTHLLLEVASPIIFLLLHSAAIRPQEAKDPIDEEDPRPTSSTWSYIKHPTQNGTYEAPYGPEKVQQGPGFPRSDHRARHHNSLEMPSRRKLMHRCLLRVHLSSLAEDPNTYAWPTHEQFDPTVAWPGDWPDAQTGAGHAGTSGDGYGTEEDDDMANVMDFFLGGGGDV

SEQ ID NO: 150843 - protein, 313 aa, Glycine max
  Coding DNA Sequence Number=SeqID_34065
  Gene Ontology: Mol. function=chitin binding; Cellular component =extracellular region; Biological process=chitin metabolic process
  Homolog annotation: Hit_ID=UPI0000E478AA; Match level="QueryCoverage =88%, HitCoverage=26%, E-value=2e-35, Identity=30%"; Hit description =PREDICTED: similar to cortical granule protein with LDL-receptor -like repeats
RGLHVLASRGLHVLDFRRLYVLTFRGLHVLTSRGLHVLASRGLYILAFKGLHVLVFRGLHVFNFRGLYVLAFRGLHVLAFRGLHVLTSRELHVLTSRRLYVLAFRGLHVLAFRGLHVLNFRGLYVLAFRGLHVLAFGGLHVLAYRGLYILASRGLQILTSRGLYVLAFRGLRVLDLRGLHVLAFRGLYVLASRGLHILTFRGIHVLDFRGLHVLTIRGLYVLAFRGLHVLTSIGLLASRGLYILAFRGLHVLDFRGLHVLTFRGLHVLAYGGLHVLASIGLLIRQVCEVLIFTLSLSQSAGLASHPLSATLLD

SEQ ID NO: 150844 - protein, 193 aa, Glycine max
  Coding DNA Sequence Number=SeqID_34066
  Pfam annotation: Domain name=G-patch; Domain location=1-43; Score =9.3; E_value=0.013; Accession=PF01585.13; Description=G-patch domain
MVAREMLGNGYEPGMGLGKNNGGRTSLISTRGNRGKFGSFISVRLRHEGQVVAICEDDFPNGSDLVIIPGNRSSISSKKRIRRRVKRTKMWDFPGEVKISTGMIAPIREELMALLKNYQDIFAWSYQDIPVSQRALHGRAKARLTGELSKGGKMRGVATNEGISTSHVDKSGALAPTYPSSKRKSDLRSSFLS

SEQ ID NO: 150845 - protein, 104 aa, Glycine max
  Coding DNA Sequence Number=SeqID_34067
MNGKWRAKKKKELEGPRFSALIFMTHRSDYRQIVPWQQEPNFQSNHVRTKDQNGVGDAVVGANTTNVLVRNGGFENDKDKIADNDPPSYPHLTRMASGTAALGY

SEQ ID NO: 150846 - protein, 96 aa, Glycine max
  Coding DNA Sequence Number=SeqID_34068
MGKNEMKIIGMTIMVMLIFVQADYCYASMKTQPDKLTCPAQCGIDCLVANIGYPICFAICVAKCRKTATIDKYDCITGCGVNKSITVNIGILYLPT

SEQ ID NO: 150847 - protein, 119 aa, Glycine max
  Coding DNA Sequence Number=SeqID_34069
  Gene Ontology: Mol. function=phenylalanine ammonia-lyase activity; Cellular component=cytoplasm; Biological process=phenylpropanoid metabolic process
  Homolog annotation: Hit_ID=P07218; Match level="QueryCoverage=54%, HitCoverage=13%, E-value=7e-09, Identity=53%"; Hit description =Phenylalanine ammonia-lyase class 1
MFVRIIKPSLKGCSGIRFEIVLEVEGIVKLLNHNMRVCPSASAGLRSIQEGTPVDNPLIEVSRNKALHGDSFQDCFFEEALKVVLHKVECTRNDLETGSLPSPNKIKECRSYPLYKFVN

SEQ ID NO: 150848 - protein, 131 aa, Glycine max
  Coding DNA Sequence Number=SeqID_34070
  Homolog annotation: Hit_ID=O04892; Match level="QueryCoverage=49%, HitCoverage=12%, E-value=3e-10, Identity=58%"; Hit description =Cytochrome P450 like_TBP
MACPPLETAQPGGRVQRLERAPHVAWCPGAPPGGPLKNPEDRVPPHARVVLITASGLQGKGSRQNGSVTSGKGLALRAGHGGPSPEPVGCRWTARAGFRGESGSSRAGRGTDWERALRGLFPGRRTVNSEL

SEQ ID NO: 150849 - protein, 91 aa, Glycine max
  Coding DNA Sequence Number=SeqID_34071
  Subcellular localization annotation: CTP_CleavageSite=37; ConfidenceScore=5.03e-01
MSFLRVWRARSCDVGVMATKSLQRRSGEGSARSGSVMFSMQQQWVLAIGSVFDEGGEPNAEGTTGCSIGAVLEVMRLSGSSRGSFDDGTQQ

SEQ ID NO: 150850 - protein, 224 aa, Glycine max
  Coding DNA Sequence Number=SeqID_34072
  Gene Ontology: Mol. function=metal ion binding; Cellular component =nucleus; Biological process=response to DNA damage stimulus
  Homolog annotation: Hit_ID=Q2RB11; Match level="QueryCoverage=72%, HitCoverage=47%, E-value=3e-41, Identity=52%"; Hit description=Nse1 non-SMC component of SMC5-6 complex family protein, expressed
  Pfam annotation: Domain name=zf-C3HC4; Domain location=74-117; Score =2.4; E_value=0.089; Accession=PF00097.15; Description=Zinc finger, C3HC4 type (RING finger)
  Pfam annotation: Domain name=zf-RING-like; Domain location=74-117; Score=44.2; E_value=4.4e-10; Accession=PF08746.1; Description=RING -like domain
  Pfam module annotation: Pfam domain module=zf-C3HC4::zf-RING-like; Domain location=74-117::74-117
MDSVTIVTDSQSQGSQPNVPTALKNFSLSQKEKTLHELVRDQWLDLTTDGVIRLGLKSFLDLRSWFRNNDLPSCHVCNEAGIKAELCQNENCTVRIHHYCLKQLFLQRKVAEVCPSCGTSWPYTVPKAEAEQTEDDNEPRGSKQVIKSERKRRRANRVVDDEVGSNNQDELNESRESQHGNGLVQKRGRPRRSDDADIGGSDASQSLTAISDARRVTRSSARLS

SEQ ID NO: 150851 - protein, 168 aa, Glycine max
  Coding DNA Sequence Number=SeqID_34073
  Homolog annotation: Hit_ID=Q2RB11; Match level="QueryCoverage=92%, HitCoverage=39%, E-value=6e-35, Identity=49%"; Hit description=Nse1 non-SMC component of SMC5-6 complex family protein, expressed
  Pfam annotation: Domain name=SMC_Nse1; Domain location=7-165; Score =41.6; E_value=2.8e-09; Accession=PF07574.3; Description=Nse1 non-SMC component of SMC5-6 compl
MSSALNWRHHVVIQSLLSRGPLSEKDLHAMFQDLTKRNPGLTQVVGLVSFNQVVQDWHPGWFLSTERQLFDSFILKINKALSCANFELRACIDQYDGQVYYGVVNTVSDEHSKLGTKYTVPQIAFYKAIIEAIVQDASANAAIFSIHALNLSLDSQMIRAKCPKLIIV

SEQ ID NO: 150852 - protein, 282 aa, Glycine max
  Coding DNA Sequence Number=SeqID_34074
  Gene Ontology: Mol. function=nucleoside-triphosphatase activity; Cellular component=chloroplast
  Homolog annotation: Hit_ID=Q2PMM5; Match level="QueryCoverage=98%, HitCoverage=12%, E-value=1e-161, Identity=98%"; Hit description =Protein ycf2
MDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEDFLGSCRATRSFFSDRWSDFI

SEQ ID NO: 150853 - protein, 136 aa, Glycine max
  Coding DNA Sequence Number=SeqID_34075
MAYPWWDDNKVKSNEDHKGKMKEQNQPGKSHNEHGYISGYVKGYVSCYEHGYKHGKSECGDDLLESHIGYELSHGHNSDDGYEYDYYSDYSEDDYEYDSESDYNESSDYSEVAMKMTLNLIMVALTAVVVAVNVMM

SEQ ID NO: 150854 - protein, 130 aa, Glycine max
  Coding DNA Sequence Number=SeqID_34076
  Gene Ontology: Mol. function=ribose-5-phosphate isomerase activity; Cellular component=intracellular; Biological process=pentose -phosphate shunt, non-oxidative branch
  Homolog annotation: Hit_ID=P0A7Z0; Match level="QueryCoverage=97%, HitCoverage=58%, E-value=3e-56, Identity=84%"; Hit description =Ribose-5-phosphate isomerase A
  Pfam annotation: Domain name=Rib_5-P_isom_A; Domain location=1-126; Score=186.6; E_value=6.1e-53; Accession=PF06026.5; Description =Ribose 5-phosphate isomerase A (phosphoriboisomerase A)
MQMIKGGGAALTREKIVAAVAQKFICIADASKQVDVLGNFPLPVEVIPMARAYVARELVKLGGLPEYRQHVVTDNGNIILDVHNLRILDPIALEKTINALPGVVTVGLFAARGADIALIGTPDGVKTITN

SEQ ID NO: 150855 - protein, 113 aa, Glycine max
  Coding DNA Sequence Number=SeqID_34077
MESNDSSWQSLVVVGGGGGGLGCWERFWGRRGEKNMYLYTVGCNSIGFKCYFTNPNSYYVQTWVASSQSKFVGDPMVNGSDIEVLPKQVLGQTWNHIVPTQINQTPHQAIAQE

SEQ ID NO: 150856 - protein, 123 aa, Glycine max
  Coding DNA Sequence Number=SeqID_34078
  Gene Ontology: Mol. function=two-component response regulator activity; Cellular component=intracellular; Biological process=two -component signal transduction system (phosphorelay)
  Homolog annotation: Hit_ID=Q8D0X7; Match level="QueryCoverage=65%, HitCoverage=36%, E-value=5e-23, Identity=69%"; Hit description =Nitrate/nitrite response regulator
  Subcellular localization annotation: CTP_CleavageSite=56; ConfidenceScore=5.52e-01
MALTGWPRPGGRSTRAGCTSIIRRCSAPSSKRPRRIGRGGAISGFCTPGTSPSPPRENARPACAVCCGCAPSRFLHIYATAPPPACWTGRAPPLAGRPVRVRSRRLRGPAARCAPANSRPWRR

SEQ ID NO: 150857 - protein, 71 aa, Glycine max
  Coding DNA Sequence Number=SeqID_34079
MECTNCEKDFGFVSLTSTQGVTDKLKQIKQEKEEKKEEKKKREGNDEMKGIKGYPKVPPPFLTVVPNDAMQ

SEQ ID NO: 150858 - protein, 50 aa, Glycine max
  Coding DNA Sequence Number=SeqID_34080
MSHCEREEPTTERANRVRENEARRENESHVRERVVGEEVSYCIDPKENNW

SEQ ID NO: 150859 - protein, 104 aa, Glycine max
  Coding DNA Sequence Number=SeqID_34081
MRVQEEFLEIIVTSCETRYRKMFSLTPSHHERRETERIVKKEKFCFKKAKFCLIFQGIKVHRGEVSLWRKSITSKHHDQELIVAAPPQPLVTLKEANNNNIEAQ

SEQ ID NO: 150860 - protein, 729 aa, Glycine max
  Coding DNA Sequence Number=SeqID_34082
  Homolog annotation: Hit_ID=Q6UDM5; Match level="QueryCoverage=66%, HitCoverage=78%, E-value=6e-11, Identity=22%"; Hit description =Starmaker
MHAPPFASGCHSVDSAISLADQPLDFAPRFNRDSDLQMQSTYSHHDSSSSMNNWVSPVAPGVGYPPIPPILSSGQQHDPSITTPGHVAPPFGRFPGPGLPSTIQPTGAPFTLSTGTTIHPTVAFSADVYGVSGIPDRPKKASVPNWLKDEIKKKVIPAPAGNLKEETFVNDGIDKSYARGDEADSKSIDSSRSAEDEEDEEDQVEAARTAAINLEIKRVLTEVLLKVTDELFDEIATKVLAEDDFTAEGYNNVFSVVGHKVATSNHKASASPPSATVPKASAKVFVPIKEKVENVDASEKSNSSSPGDVLGLGNYGSDADDGDNEIESSSVPTPAKDAAYKSGIKKPLSDTHDLSVNGISQLDEHAISETNLVNNQVKTISLPSRSSNGAATDQLHDDKVTKESNHSHSSKVVSEDLRDNGLNFIERNHDRFNGFSSKDTSGIPRSELPGKNISVEKAMDDHSGRESRKKSEKNDRPDRSTSEKDFVKEVHSSKTKIDEKGNENQRRKDERNQKRDKTDYGSEAKERVKQHSLRHGEKAKESDSRKRSSHVDVKDDKKEAEKSHRGSATDDTSRKREHAKDKGEHKSRQKDASNNDRHRRRRSSSVSSRGRTKKDCINHAGDSSGEGSDGSKRKLHSRKRDLSPSPVRSKRRYYLLRDPYIVQVVDNFCGLLIASVLSAGILPILLLILPGEGGQDPDHLFGGRDEWMGTEMVDFASTVFIQENINLEA

SEQ ID NO: 150861 - protein, 492 aa, Glycine max
  Coding DNA Sequence Number=SeqID_34083
  Gene Ontology: Cellular component=endoplasmic reticulum
MKTLEEANVLVTSDYSTCLNSGLVGLLELHFFLSGISGGAMRLSSLKDHTRTFKNAILDSTSLSNITIFTAPKPFKGSIRTRQTLAIRSWLALSPYVTVVLFSQDPSVSSFADAFDSRVLVDTNIDFTFLGTPFFHSMVAKSRSYTSEISVIIDSETVILSGFISTLNHVYQLDHDWLLVASAQNVSSFPFHLDESGKHWQTDNRKRMNVQELQKILQHNWQGKHCCYSRMLMVWNNKDAPLHSGVLPPFLYGKGTHNNWLIHEAMSSEFRFVFDASLTITSFHLNEEDDFSPTHGNSSAVDIENRSWEYIGNSHIGANYGSFFYSEANFTSLVKLLKCNKQYIMVDTKKNIVYPIGHQGAMNLMKEKVIPSWLKENTVYCIDRLNSHTKSLDCSVKDQTKIPSILELPFSLESLLSITSDKTKTVILTVAGYSYKDMLMSWVCRLRKLSIENFVVCALDKETSQFSILQQILIKSVLYKLPNNFVNSLKYF

SEQ ID NO: 150862 - protein, 88 aa, Glycine max
  Coding DNA Sequence Number=SeqID_34084
MFLGAEDKTVVFKSCGPHHGVRIGLDGCGLVGSGGYFRVCGLGEVRGVAYCCGDLSFAKCQCYARFSINGAHAYNYNNKAHDFFEHEE

SEQ ID NO: 150863 - protein, 63 aa, Glycine max
  Coding DNA Sequence Number=SeqID_34085
MDSKFGFGCLRKKEKLNARDISSTRHYLRNPNGGSVRKHIRNLLFNFHNYPTVNKSEIVILLR

SEQ ID NO: 150864 - protein, 224 aa, Glycine max
  Coding DNA Sequence Number=SeqID_34086
  Gene Ontology: Mol. function=nucleic acid binding
  Homolog annotation: Hit_ID=Q1SKA8; Match level="QueryCoverage=66%, HitCoverage=56%, E-value=4e-09, Identity=29%"; Hit description=Zinc finger, CCHC-type
  Pfam annotation: Domain name=zf-CCHC; Domain location=148-165; Score =19.9; E_value=0.00051; Accession=PF00098.13; Description=Zinc knuckle
MLAGNVTIEKPRDQWDEDERKRVQNNLKAKNIITSTLGMDEYIRVSNNLTNTSLATLFGNHQEHEIELMRLNQHEENDKKKKGIALKASSSIHEESGKEDMNEQNNLEEDDDLSLFVKRFNKFLRNKGNRRRSNFNPKKKGEDSSSVPKCYECDQPRHLRFDCPIFKRRMEKSNKKTFKDKKEKKAYITWEDNDMDSSSDSKNEIVNRSLMVKDYESEEEGNIF

SEQ ID NO: 150865 - protein, 124 aa, Glycine max
  Coding DNA Sequence Number=SeqID_34087
  Homolog annotation: Hit_ID=O82161; Match level="QueryCoverage=27%, HitCoverage=10%, E-value=4e-09, Identity=76%"; Hit description=Phi-1 protein
GYPVRVLVDKGNRGELQCAWCEWKEVSRASDVGPADFDMQDPRLKTATWRGCVMVVDIGRWERKQGMDNRGGDGFGSDFGVFLNFLYSVSLLLSFSVTWLGDHYGEVSIGNDDFGWGGEVNEFH

SEQ ID NO: 150866 - protein, 186 aa, Glycine max
  Coding DNA Sequence Number=SeqID_34088
  Gene Ontology: Mol. function=ammonium transporter activity; Cellular component=membrane; Biological process=nitrogen utilization
  Homolog annotation: Hit_ID=Q4J7I4; Match level="QueryCoverage=98%, HitCoverage=99%, E-value=5e-74, Identity=74%"; Hit description =Conserved membrane protein
  Pfam annotation: Domain name=Grp1_Fun34_YaaH; Domain location=2-184; Score=121.1; E_value=3.2e-33; Accession=PF01184.10; Description =GPR1FUN34yaaH family
MTEQKRANPAPLGLSGFALTTLVLSTFNAGLITQGASVVLGLAAFYGGLAQLLAGILEWRAGNTFGYTAFFTYGAFWEWYFLTAGGFFGGVTPQAIGLVLIAFGIFTLAMWFGTFKANLGLFMTFLLLWITFFLLGVGAMTGNVGLSHAGGYVGILTAIAAWYTGLAIVVAEGLGKSPPVGRPIMK

SEQ ID NO: 150867 - protein, 168 aa, Glycine max
  Coding DNA Sequence Number=SeqID_34089
  Gene Ontology: Mol. function=oxidoreductase activity; Cellular component=integral to membrane; Biological process=potassium ion transport
  Homolog annotation: Hit_ID=Q6D2B4; Match level="QueryCoverage=89%, HitCoverage=47%, E-value=9e-60, Identity=77%"; Hit description =Probable oxidoreductase
  Pfam annotation: Domain name=Aldo_ket_red; Domain location=22-168; Score=-115.8; E_value=0.015; Accession=PF00248.11; Description =Aldoketo reductase family
MTDQSRFTKEDHMRQHKTRQLGDSGISVPLLTFGGNVFGWTVDEKTSFSLLDALVEKGLFFIDTADVYSRWAPGNAGGESETIIGKWLKKSGKRDSIVLATKVGMELTPEKTGLKPAYIRQAVEDSLRRLQTDVIDLYQAHRDDDSTPLVETLKAFDSLIKEGKVRAI

SEQ ID NO: 150868 - protein, 79 aa, Glycine max
  Coding DNA Sequence Number=SeqID_34090
  Homolog annotation: Hit_ID=Q1SWX1; Match level="QueryCoverage=85%, HitCoverage=13%, E-value=1e-08, Identity=38%"; Hit description=IMP dehydrogenase/GMP reductase
MGPLQMQAFRKAYGKILDFTIAEISTEAIASLAQYYDQPLRCFTFGDFQLVPTVEEFEEILGCPFGGSNRIFSPGSFPP

SEQ ID NO: 150869 - protein, 282 aa, Glycine max
  Coding DNA Sequence Number=SeqID_34091
  Gene Ontology: Mol. function=DNA binding
  Homolog annotation: Hit_ID=Q1RUD8; Match level="QueryCoverage=76%, HitCoverage=42%, E-value=1e-26, Identity=34%"; Hit description=IMP dehydrogenase/GMP reductase
MANQDEWVPFMDVLALLIFGVVLFPNVDGLVDLAAIDAFLAYHHSKESPVVAVLADLFDTFDRRCEKSSARIICCLPALCVWLVSHLFQQDIRHPCPLRSHRSCVKKRRVDWDQHLVGIGGRTINWFPRWKEGKEGVLFSCRDYPNIPLIGTRGCINYNPALAIRQLGYPMRGAPTEKSLSPFLVRDFGAQSFKIIQRVHKAWESPLRKDKELRGIRNGIISGYHEWLKVRTRGLDWLSKLKIINEENFEAPEEDEEVRALKTELGKARLAKEKFKLVATDV

SEQ ID NO: 150870 - protein, 82 aa, Glycine max
  Coding DNA Sequence Number=SeqID_34092
MATARGALKHPVYGIVTLRTTFLNEKLHTTPEFQQTLLTTTNHVALHATRPLGHGNKKWGGRQKQSFCSYVSSICDEELRPT

SEQ ID NO: 150871 - protein, 138 aa, Glycine max
  Coding DNA Sequence Number=SeqID_34093
  Subcellular localization annotation: CTP_CleavageSite=45; ConfidenceScore=5.31e-01
MNLLPSAVHASSTHESGAPRIYCLALFANSPFSTFIWSPMNLLPSAVHVSSTIESGAPRIYCLALFANSPFSTFIRSPMNLLPSAVHVSSTIESGAPRIYCQALFANSPFSTFFRRPMNSLPSAVHVSSTIESGAPRN

SEQ ID NO: 150872 - protein, 434 aa, Glycine max
  Coding DNA Sequence Number=SeqID_34094
  Gene Ontology: Biological process=protein localization
  Homolog annotation: Hit_ID=Q6K796; Match level="QueryCoverage=92%, HitCoverage=9%, E-value=1e-111, Identity=54%"; Hit description =Vacuolar protein sorting 13C protein-like
MRAVKVDYLTQKGTYPHSIIAKACWVHVLLADGDLTVKMKLHSLKIKDELQGRLSVAPRYLAVSVLQSETSSSDMYDSHGKEVSHDDDDSFTDALSEFISQTDGGYCLHNMDLDHQGLVGIASDFESLENIMHEKGTPREVYYEAQGSDTSNFVSVSFTTRSSCSPDYDGIDTQMCVRMSKLEFFCNRPTIVALISFGLDISSGNKVTSPTDTLATSSEKLVVKERTDEEGPVSGLLGFGKERVVFYLNMNVDSVTIFLNKEDGSQLATLVQESFLLDLKVHPSSLSIDGTLGNFRLCDTSLGSDQCWDWLCDIRNPGVDSLIKFKFNSYSAGDDDYEGYDYSLQGHLSAVRIVFLYRFVQEIMMYFMELASPHTEEAIKLVDKVGGFEWLIQKYEIDGATALKLDLALDTPIIIVPRNSMSKELVIFKSVCGV

SEQ ID NO: 150873 - protein, 539 aa, Glycine max
  Coding DNA Sequence Number=SeqID_34095
  Gene Ontology: Biological process=protein localization
  Homolog annotation: Hit_ID=Q6K796; Match level="QueryCoverage=99%, HitCoverage=12%, E-value=1e-145, Identity=50%"; Hit description =Vacuolar protein sorting 13C protein-like
MSDKEYKVILDCTYMNLSEEPRLPASFRGGKSGSRDTIRLLVDKVNLNSQLLLSRTVTIIAVTVNHALLELCNGTDGESPLAHIAMEGLWVSYRMTSLSETDLFVTIPKFSVLDVRPDTKPEMRLMLGSSADASKQTVTGNVPFLFNPGSFRRTTSEVEIDDMPISTMFLMDYRWRVSSQSYVIRVQQPRVLVVPDFLLAVAEFFVPSLGALTGREEKMDPKNDPISRNSSIVLMESIYKQEEDVVHLSPSKQLVADSVGIDEYTYDGCGKVICLSVETDAKEVRSTRFRPIIVIGHGKKLRFVNVKIENGSLLRKYTYLSNDSSYSISSEDGVDMVVSGNLPSSDEKSLDNVNQTSGTSIDSQSGSNATQSFSFETQVVSSEFTFYDGTKSFLDDSFYGEKLVRAKLDLSFMYASKEKDTWIRALVKDFSVEAGSGLIILDPVDISGGYTSVKDKTNISLLSTDICIHLSLSALSLMLNLQSQASAALSFGNAIPLVQCTNYDRIWVSEKETGHNNNITFWRPRAPANYVILGDCVTS

SEQ ID NO: 150874 - protein, 55 aa, Glycine max
  Coding DNA Sequence Number=SeqID_34096
MANCNPWMKTKSSFFQSFLVLPAHYMNPGKGIWAINFQADIVHRWVFLCKPRKLQ

SEQ ID NO: 150875 - protein, 32 aa, Glycine max
  Coding DNA Sequence Number=SeqID_34097
MASLDSLDFSLFRLSTDFCSPFAIFVQAQVDN

SEQ ID NO: 150876 - protein, 195 aa, Glycine max
  Coding DNA Sequence Number=SeqID_34098
  Homolog annotation: Hit_ID=Q9LVE6; Match level="QueryCoverage=99%, HitCoverage=53%, E-value=6e-47, Identity=48%"; Hit description =Similarity to senescence-associated protein
  Pfam annotation: Domain name=Senescence; Domain location=35-195; Score=1.8; E_value=6.7e-12; Accession=PF06911.3; Description =Senescence-associated protein
MGCNSSKAEPPLENSNHHHHHHHHAEFQKPKTLKQEVVLQIPGCKVHLMDEGEAIELAQGHFTIMKIMDKNVPLATTIKVGNSVQWPLTKDEPVVKVDALHYLFSLPVKDGGEPLSYGVTFPEQCYGNMGMLDSFLKDQSCFSGLERNKKSDLNWEKFAPRVEDYNHFLARAIAGGTGQIVKGIFMCSNAYTNQV

SEQ ID NO: 150877 - protein, 139 aa, Glycine max
  Coding DNA Sequence Number=SeqID_34099
  Gene Ontology: Mol. function=transferase activity
  Homolog annotation: Hit_ID=O82193; Match level="QueryCoverage=97%, HitCoverage=25%, E-value=3e-51, Identity=74%"; Hit description =Expressed protein
MVWILATCTLISLFSMWNLTRIEVLLCNILSPEAPRLSLASYNWFKVFVAMLVGNFLYPISAIRSHFTQSINWSGIIYHLKDGKINKIHRIPRRQDVAPVFTDLGGKHLYGKKGMPTKGSFLSSLSKRLFQWRQPKKSE

SEQ ID NO: 150878 - protein, 166 aa, Glycine max
  Coding DNA Sequence Number=SeqID_34100
  Homolog annotation: Hit_ID=O22704; Match level="QueryCoverage=32%, HitCoverage=45%, E-value=3e-22, Identity=83%"; Hit description =Putative Cytochrome B5
  Pfam annotation: Domain name=Cyt-b5; Domain location=98-166; Score =53.4; E_value=7.6e-13; Accession=PF00173.18; Description=Cytochrome b5-like HemeSteroid binding doma
MATEERKPMEDDKELLEKKLGRSHGQQTHTMNNTNISFAEEKEETNESHSSLVSGDINKHLPTLFVLDASHLSLFFASFSGHKAKAQASLNVDKASKSYSKTEVSLHNKRTDCWIIIKNKVYDVTSYVEEHPGGDSILVHAGDDSTEGFFGYAFIPICPLLIAYLY

SEQ ID NO: 150879 - protein, 365 aa, Glycine max
  Coding DNA Sequence Number=SeqID_34101
  Gene Ontology: Mol. function=transferase activity
  Homolog annotation: Hit_ID=Q946Y1; Match level="QueryCoverage=97%, HitCoverage=67%, E-value=1e-167, Identity=77%"; Hit description =Ceramide glucosyltransferase
  Pfam annotation: Domain name=Glycos_transf_2; Domain location=60-226; Score=8.8; E_value=0.00026; Accession=PF00535.16; Description =Glycosyl transferase
MQGCIINLILAFGWACAAFVRNREINRIKKSMRNGNNFAFLCHDISELEHSNQADLPSVTVIMPLKGFGEHNLHNWKTQLTSLYGGPQEYLLVVESTEDPAYHAVAKLITELEDSVKARIIIAGLSTTCSQKIHNQLVGVEAMHKDSKYVLFLDDDVRLHPGSIGALVREMEKNPKIFIQTGYPLDLPSGSLGSYCIYEYHMPCSMGFATGGQTFFLWGGCMMAIFLQMHSEDFRQDNCGVVSGLRDGGYSDDMTLAAIAGAHKKLISSPAVAVFPHPLASDLNFGRYWNYLRKQTFVLESYVTKVNQVMNRALFAVHCYFSWGFVAPYCMAVIHVAAALRFRAREYSLEEMDYSSGGENTTFPL

SEQ ID NO: 150880 - protein, 413 aa, Glycine max
  Coding DNA Sequence Number=SeqID_34102
  Gene Ontology: Mol. function=DNA binding
  Homolog annotation: Hit_ID=Q1T493; Match level="QueryCoverage=98%, HitCoverage=91%, E-value=2e-20, Identity=27%"; Hit description =Nucleic acid-binding, OB-fold, subgroup
  Pfam annotation: Domain name=Rep_fac-A_C; Domain location=214-347; Score=-34.9; E_value=0.00024; Accession=PF08646.1; Description =Replication factor-A C terminal domain
MAHVADKIKLIDGSREALKLSIRITDLWFIGIPGKTEQAEMVVVDSDDQLKSRKTDLKENLTYVMHNFKVIKNDGKFRVCDHEYKLCFTGVTVVRQCDMEQLPFRKFRFVAFSSVIAGDFKIRLLVGSYPASVSNSFKASKLMINDLVLEIQEFRESLLDLGIEVRSIFAPIGQGSSQVSGSSQLSSKDVFLSKTEVKNISEINASSEEFVCVTVAKITTIVMNNYSWCYPACGQCYKKVDMQSVSFTCPCGKENNQHVLRYRVEVMVSHKGEQTKFLIWDCECAQLIGQSADEVNMLKIEDGDVDLNASPQALDRLLGCFLAFKVKVQPRFRNSVVLKYSDEPELINVMLDMIPDSEQSLSITADHDRSMLGSSEPTEFESQSVSVTGDHDPLLRIPLTPTKRVSSDELDNE

SEQ ID NO: 150881 - protein, 1201 aa, Glycine max
  Coding DNA Sequence Number=SeqID_34103
  Gene Ontology: Mol. function=ATPase activity, coupled to transmembrane movement of substances; Cellular component=integral to membrane; Biological process=transport
  Homolog annotation: Hit_ID=O23998; Match level="QueryCoverage=98%, HitCoverage=98%, E-value=0.0, Identity=55%"; Hit description=P -glycoprotein homologue
  Pfam annotation: Domain name=ABC_membrane; Domain location=30-312; Score=119.3; E_value=1.1e-32; Accession=PF00664.13; Description=ABC transporter transmembrane region
  Pfam annotation: Domain name=ABC_membrane; Domain location=646-926; Score=147.8; E_value=2.9e-41; Accession=PF00664.13; Description=ABC transporter transmembrane region
  Pfam annotation: Domain name=ABC_tran; Domain location=1002-1186; Score=208.7; E_value=1.3e-59; Accession=PF00005.17; Description=ABC transporter
  Pfam annotation: Domain name=ABC_tran; Domain location=366-550; Score= 200.2; E_value=4.9e-57; Accession=PF00005.17; Description=ABC transporter
  Pfam annotation: Domain name=SMC_N; Domain location=991-1190; Score= -134.2; E_value=0.088; Accession=PF02463.9; Description=RecFRecNSMC N terminal domain
  Pfam module annotation: Pfam domain module=ABC_membrane::ABC _membrane::ABC_tran::ABC_tran::SMC_N; Domain location=30-312::646 -926::1002-1186::366-550::991-1190
MDEAETRKLEMERKERASIATILRYADWIDVVLMLMGAVGAIGDGMSTNVLLLFASRIMNSLGYSNNLQSTKTYMAEVEKCSLYFVYLGLAAMVVAFMEGYCWSKTSERQVLKIRYKYLEAVLRQEVGFFDSQEATTSEIINSISTDTSLIQEVLSEKVPLFLMHSSSFISGVAFATYFSWRLALVAFPTLLLLIIPGMIYGKYLIYLSKSTVKEYGKANSIVEQALSSIKTVYSFTAEKRIIGRYSDILCRTSRLGIKQGIAKGIAVGSTGLSFAIWAFLAWYGSRLVMYKVVLPDLKYFTEASVAASRIFDMIDRTPLIDGEDTKGLVLESISGRLDFEHVKFTYPSRPDMVVLNDFNLQVEAGKTVALVGASGSGKSTAIALVQRFYDADEGVVRVDGVDIKSLQLKWIRGKMGLVSQEHAMFGTSIKENIMFGKSDATMDEIVAAASAANAHNFIRQLPEGYETKIGERGALLSGGQKQRIAIARAIIKNPVILLLDEATSALDSESELLVQNALDQASMGRTTLVVAHKLSTIRNADLIAVVNSGHIIETGTHHELINRPNGHYAKLAKLQTQLSMDDQDQNQELGALSAARSSAGRPSTARSSPAIFPKSPLPDDQATPSQVSHPPPSFTRLLSLNAPEWKQGLIGTLSAIAFGSVQPLYALTIGGMISAFFAESHQEMRHRIRTYSFIFCSLSLASIILNLLQHYNFAYMGAKLTKRIRLCMLENILTFETAWFDEEQNSSGALCSRLSNEASMVKSLVADRLSLLVQTTSAVIIAMIIGLAVAWKLALVMIAVQPLTILCFYTRKVLLSTLSTKFVKAQNQSTQIAVEAVYNHRIVTSFGSITKVLRLFDEAQEAPRKEARKKSWLAGIGMGSAQCLTFMSWALDFWYGGTLVENREISAGDVFKTFFVLVSTGKVIADAGSMTSDLAKSSTAVASVFEILDRKSLIPKAGDNTNGIKLEKMSGKIELKNVDFAYPSRAGTPILRKFCLEVKPGKSVGLVGRSGCGKSTVIALIQRFYDVERGSVKVDNVDIRELDIHWYRQHMALVSQEPVIYSGSIRDNILFGKQDATENEVIEAARAANAHEFISSLKDGYETECGERGVQLSGGQKQRIAIARAIIRNPKILLLDEATSALDVQSEQVVQEALDRTMVGRTTIVVAHRLNTIKELDSIAYVSEGKVLEQGTYAQLRHKR

SEQ ID NO: 150882 - protein, 96 aa, Glycine max
  Coding DNA Sequence Number=SeqID_34104
MDNQLGISACHLTSRVRINRNRLCGQPLGYLRMSSDFTGYDSKKVQMTTLASACQSNLRSPNDDVRITERCLRMLPDSWVMRAKGGVVDKSEAFAP

SEQ ID NO: 150883 - protein, 197 aa, Glycine max
  Coding DNA Sequence Number=SeqID_34105
  Gene Ontology: Mol. function=oxidoreductase activity, acting on single donors with incorporation of molecular oxygen, incorporation of two atoms of oxygen; Cellular component=integral to membrane; Biological process=...
  Gene Ontology: Biological process=protein amino acid phosphorylation
  Homolog annotation: Hit_ID=Q9C6F0; Match level="QueryCoverage=72%, HitCoverage=44%, E-value=3e-53, Identity=72%"; Hit description =Hyoscyamine 6-dioxygenase hydroxylase, putative
MGKQSTPQFSALNCIDLSNPDINQSVNLLKEACLDSGFFYVVNHGISQEFMDEVFAQSKKFFSLPHNEKMKTLRNEQHRGYTPVLDELLDPENQEITKRGIILELKKVKMIHNRRNLFMDRITGPHQMFCPGGGRPWKSSIKRHFFNMDKVLNCNWDRGFVTFLDMTGKLETNVADAAIIAVANTLTTWMLQPRIVF

SEQ ID NO: 150884 - protein, 140 aa, Glycine max
  Coding DNA Sequence Number=SeqID_34106
  Gene Ontology: Biological process=two-component signal transduction system (phosphorelay)
  Homolog annotation: Hit_ID=Q5JKW3; Match level="QueryCoverage=84%, HitCoverage=29%, E-value=3e-13, Identity=43%"; Hit description =Putative HPt phosphotransmitter
  Pfam annotation: Domain name=Hpt; Domain location=46-133; Score=23.1; E_value=0.00099; Accession=PF01627.13; Description=Hpt domain
MESSDEMHSKIITMKQSFFDEGFLIPTQFQELELLQDRDNMNFVRDVFCLFFTDMTRQFSEIEQILREEIDGQPREDMNRLLQRLKGSVLSIGALKILNGVNKMIQLFEEGNLERIMAAFEQVKMESVNLRAKVEPYFQN

SEQ ID NO: 150885 - protein, 318 aa, Glycine max
  Coding DNA Sequence Number=SeqID_34107
  Gene Ontology: Mol. function=RNA-directed RNA polymerase activity
  Homolog annotation: Hit_ID=UPI000034ED40; Match level="QueryCoverage =98%, HitCoverage=33%, E-value=2e-60, Identity=39%"; Hit description =RNA-directed RNA polymerase
MDATYVKELESYVGHSKYGIFFPRVGTRSVADEIAGGDFDGDTYWVSNHPQGDPWIENSVPLDSSVKKPSEFSPEELEEELFRLFLKTRFQPSYAMGMSENSWMALMDRLLTLNNCTNENEKERVKENMLKLIDIYYEALDAPKSGRKVQVPNDLIAELFPHYMEKDKSFTSTSILGLIYDEVEIWLENDMVGVPPSCLEKWKTKYEEYRKDMTDALNLKDKSKSHEEAAEVNRKYKEEFYGPTLEMEGCLKSIGDIFNEALAVYNVSYEYAMLKKEVKRCGFAWKIAGSALTRLYIIKQNEKALNCDPSVVREIFRL

SEQ ID NO: 150886 - protein, 701 aa, Glycine max
  Coding DNA Sequence Number=SeqID_34108
  Gene Ontology: Mol. function=transcription coactivator activity; Cellular component=nucleus; Biological process=SRP-dependent cotranslational protein targeting to membrane
  Homolog annotation: Hit_ID=Q3I4X9; Match level="QueryCoverage=85%, HitCoverage=98%, E-value=0.0, Identity=82%"; Hit description=GAMYB -binding protein
  Pfam annotation: Domain name=SKIP_SNW; Domain location=190-356; Score= 403.0; E_value=4.4e-118; Accession=PF02731.6; Description=SKIPSNW domain
MATLKELLPPAKSSSTAYYDHTNDPWFKQRFSSEEEEKSAAAAAAKQKPVPPYLKRAGFVPRKIEDFGDGGAFPEIHVAQYPLDMGREKSGAKPGSKILPVTVDANGNVAYDAIVRQNENARKIVYTQQKDLIPKFLKNDEDDDDVVSDDEAQKQIEETMQETKAALEKIVNVRLSAAQPKNVPKQNSDAKYIKYKPSQQSDAFNSGAKERVIRMVEMPVDPLEPPKFKHKRVPKASGSPPVPVMHSPPRPVTVKDQQDWKIPPCISNWKNPKGYTIPLDKRLAADGRGLQEVQINDNFAKLSEALYVAEQKAREAVAMRSKVQKEMMLKEKERKEQELRALAQKARSERIGGERIGVVPAAPPAVAVDEDDMRVDYEHEKENPRERDRERSFVKESREEKEERMQREKIREERRKERERERRLEAKDAAMGKRSKITRDRDRDISEKVALGMASTKPGTEVMYDERLFNQDKGIASGFATDDQYNVYEHGLFTAQPTLSTLYRPKKNLDDETYGGADEQLEKIMKTDRFKPDKGFAGASERAGPRDRPVEFENEEADPFGLDQFLTEVKKGKKAMEKVGGGGTMRASAGSSMRDGNEGGSVIFGTWFRAEIAVVDNCICFLWQSLFPLFDETLESNNFLDKELLPVQQYVQLVVRKFGIRLGQGSKRGFCYDEWARFGEPMMVGERRFCFREIEESRGGC

SEQ ID NO: 150887 - protein, 121 aa, Glycine max
  Coding DNA Sequence Number=SeqID_34109
  Homolog annotation: Hit_ID=UPI000034ED40; Match level="QueryCoverage =97%, HitCoverage=10%, E-value=2e-23, Identity=48%"; Hit description =RNA-directed RNA polymerase
MVDNEKPRILTDGTGFISRDLALLCPNNVYKGSNLENNCIQEINNLVELEDMSNAMGEAEQLSTHEPPLLIQCRLFHMGHAIKGTLLVNRKLPPRTIQVRPSMINVEKDPSVHMQSINSLE

SEQ ID NO: 150888 - protein, 102 aa, Glycine max
  Coding DNA Sequence Number=SeqID_34110
  Subcellular localization annotation: CTP_CleavageSite=39; ConfidenceScore=5.10e-01
VCNIYPCIGYANGQTKYTKYSDSKSIQMPKLHRISRMTRVMSKMTAIATKSISLKPLGRDGTKARTKGDAEVAEGVAGVGHVDDKLSVSEGEEEGVEADNGN

SEQ ID NO: 150889 - protein, 281 aa, Glycine max
  Coding DNA Sequence Number=SeqID_34111
  Homolog annotation: Hit_ID=UPI000034ED40; Match level="QueryCoverage =54%, HitCoverage=15%, E-value=2e-30, Identity=50%"; Hit description =RNA-directed RNA polymerase
MAENHNHRDLLILPPSVEALIESICRDQNRPPLDYSTRHRLKLQGEEQSLRILNKIAATRIRLSFAGFVNHMLDDINHQNNNNNNNNNNNNNNNNNSHSQPEPSTRQQTSPTRPPRPTPSSLLHALGELEFRKAFLILSYIGRESLENCITDAKIRSLKDLPMAKFEKTIWEDFGEKCIYDQSDRQLHRDWNSGRTHVYQCFVFPDGNLRFKGPILQSTRTHLQKTLGDDNVLLVKFAEDGSGKNFRTHAEEANALYGKFGKEGIRVGLRLYRFFGNPASC

SEQ ID NO: 150890 - protein, 95 aa, Glycine max
  Coding DNA Sequence Number=SeqID_34112
MIHTTFGPILINFAPLEVVTKVEVKQMIGLAMDNFAEKQTTEDEEFRRIMQQAIATQFSSLGESLILNLQQAEMHLFNIVATTPMLLPLVQPQPP

SEQ ID NO: 150891 - protein, 92 aa, Glycine max
  Coding DNA Sequence Number=SeqID_34113
MENWRTALRYNFAGLQTRSSEKSGEWRIGEHLYAITSRGSRFEGGGHMNSARQINSWGSEKSGEWRIGEQCYAITSRGFGLDGGGHMNSARQ

SEQ ID NO: 150892 - protein, 1253 aa, Glycine max
  Coding DNA Sequence Number=SeqID_34114
  Gene Ontology: Biological process=protein localization
  Homolog annotation: Hit_ID=Q6K796; Match level="QueryCoverage=96%, HitCoverage=28%, E-value=0.0, Identity=44%"; Hit description =Vacuolar protein sorting 13C protein-like
  Pfam annotation: Domain name=DUF1162; Domain location=788-1134; Score= -60.1; E_value=0.00015; Accession=PF06650.2; Description=Protein of unknown function (DUF1162)
  Subcellular localization annotation: CTP_CleavageSite=76; ConfidenceScore=5.18e-01
MGCILQQWKNKWDAPSSVILQKGHCISVSCPVENMPLTRSLLSNLFRFETFDTNAPSGLGKRVRISATSILNVNVSAANLESFVGSILSWRQQLDLEQKALKLNAEAGGQQGKGENTTFSALDEDDLQTVVVENKLGCDIFVKKVEHDVDTVDKLQNGDCVSVWIPPPRFSNRLNVANESREARYYVAVQILEAKGLPIINDGNSHNFFCALRLVVDSQASEQQKLFPQSARTKCVKPVVSRTKDQVEGTVKWNELFIFEVPRKAPAKLEIEVTNLAAKAGKGEVVAALSFSVGHGANILKKVASVRMFHQPNDVPNIRSYPLNRLVQQNVEAMHDGCLFASTSYFERNKIANLQNDIESENVGDRDMGFWVGLGPESEWESIRSLLPLSVAPISLQNEYIGMEVVMKNGKKHVIFRGLVTVVNDSDVILNILTCHASHGCDSLLGVNSSNTVTAEVFQNQYYQPSSGWGNNWPAVHNDNPGHWSTRDFSYSSKDFFEPPLPPGWKWASGWSIDKSQYVDKEGWAYGPDIKSLRWPPISSHFSTKSASDVVRRRRWIRTRQSLSEQGTESLQGGASTVQPGASAVLSWRSSSKNSDQCLQVRPKFDNSQPSYSWGCAIAVGSSYIYSKDQLLDPGSTRLTSVTPTCSLKLNELEKKDILVCCNPSSGSKQLWFSVCTDASVLNTELNVPVYDWRISINSPLKLENRLPCPAEFSISEKTKEGNCIERHHGVVSSRQSVHIYSADIQKPLYLTLFVQGGWVMEKDPTIVLDPSFSNHVSSFWMIHRQSKRKLRVSIEHDMGGTSAAPKTLRLFVPYWIVDDFSLSLAYRVVEVEPLENVEMDSVLLSRAVKSAKTALKNPIGSLDRRHSNSRRSLQVLEVIEDNSPFPSMLSPQDYAGRSGVSMFQSPKDTRLGISVSMQSSEVYSSGISLLELEKKERIDVKAFNSDGSYYKLSALLNMTSDRTKVVHFQPHTLFINRFGCSLCLQQCDTQSAVWIHPTDSPKPFAWQLSAKVELLKLRIDGYKWSTPFSVSYEGVMRISLKKDVGDEPMQIRVAVRSGAKKSRFEVVFRPDSLSSPYRIENRSMFLPIHFRQVDGIPDSWQLLVPNSAASFLWEDLGRRRLLELLVDGTDPMKSLKFDIDEIFDHQSIHVNDGPTRALRVTIVKEEKTNVVKISDWMPENEPTGVPRRHLSSTNDSQKQQLTSITDCEFHINFDLAELGISIIDHTPEEILYLSVQNLVLAYSTGLGSGISR

SEQ ID NO: 150893 - protein, 341 aa, Glycine max
  Coding DNA Sequence Number=SeqID_34115
  Gene Ontology: Mol. function=protein homodimerization activity; Cellular component=integral to membrane; Biological process=Golgi organization and biogenesis
  Homolog annotation: Hit_ID=Q8S8N9; Match level="QueryCoverage=94%, HitCoverage=45%, E-value=1e-96, Identity=61%"; Hit description =Golgin-84
MARVTLFISYQASMESMMRNRELSETRMMQALREELASAERRAEEERAAHNATKMAAMEREVELEHRAVESSTALARIQRVADERTAKATELEQKVALLEVECASLNQELQDMEARVRREQKKAPEEANQVIQAWQEELERARQGQREAENKLSSLEARFIFFFLAEMQKMRVEMAAMKRDAEHYSRQEHMELEKRYRELTDLLYYKQTQLETMVSEKAAAEFQLEKEIKRLQEAKAEAERSRVSRRASSSWEDETEIKSLEYVSSYCLKLQKAVKLLDSGAVRATRFLWQYPTARVILFFYLVFVHLFLMYLLHRLQVQADTLAAREVAESMGLSNQNLP

SEQ ID NO: 150894 - protein, 89 aa, Glycine max
  Coding DNA Sequence Number=SeqID_34116
  Homolog annotation: Hit_ID=Q9FQZ6; Match level="QueryCoverage=89%, HitCoverage=43%, E-value=2e-09, Identity=47%"; Hit description =Avr9/Cf-9 rapidly elicited protein 146
MEMEASPKQIVARKLWNIGRIVFLMLRKSKLAADFNLNLLLKRGKLAATKAIANTILTLHLHRSQNDDDAVYYPRDYEFSCSNSPALFH

SEQ ID NO: 150895 - protein, 354 aa, Glycine max
  Coding DNA Sequence Number=SeqID_34117
  Gene Ontology: Mol. function=protein binding; Cellular component =extrinsic to membrane; Biological process=protein localization
  Homolog annotation: Hit_ID=Q6K796; Match level="QueryCoverage=99%, HitCoverage=7%, E-value=1e-138, Identity=70%"; Hit description =Vacuolar protein sorting 13C protein-like
MCGLQVDNQLPLTPMPVLFRPQRAVSETDYILKCSITMQSNGSLDLCVYPYIGLHGPESSSAFLINIHEPIIWRLHEMIQQVKLSRLYDSKTTAASVDPIIQIGYGLLETAYDITLNYSVLNISEVRFRVSMAMSPSQRPRGVLGFWASLMTALGNTENMPVRINQRFNENVCMRKSSMITMAISNVRKDLLGQPLQLLSGVDILGNASSALGHMSKGVAALSMDKKFIQSRQRQENKGVEDLGDVIREGGGALAKGLFRGVTGILTKPLEGAKSSGVEGFVQGVGKGIIGAAAQPVSGVLDLLSKTTEGANAMRMKIASAITSDEQLLRRRLPRVIGGDNLLKLYDEYKAQGQ

SEQ ID NO: 150896 - protein, 61 aa, Glycine max
  Coding DNA Sequence Number=SeqID_34118
VQCFQSKNMNLRAFSLVGMPVAVGLAFWLEACRAQLLTALDEGSDGHKQPLIATLDNNNYS

SEQ ID NO: 150897 - protein, 243 aa, Glycine max
  Coding DNA Sequence Number=SeqID_34119
  Gene Ontology: Mol. function=nucleic acid binding; Biological process= DNA integration
  Homolog annotation: Hit_ID=Q0KIN0; Match level="QueryCoverage=89%, HitCoverage=14%, E-value=4e-28, Identity=29%"; Hit description =Integrase core domain containing protein
  Pfam annotation: Domain name=zf-CCHC; Domain location=197-214; Score =13.7; E_value=0.0055; Accession=PF00098.13; Description=Zinc knuckle
MSWSASVELWFLGQGYHDHLEKGVDAVPNDKRAEWEKLDFQLCAVLWQSVEPDVLEILRSFKTCCSFWKKAQEIFANDIQSLFDATQKVAALKQTSHDMIAHVGKARAAVEELKRFLAAKSLEEVNRKLDKFYMVLILRSDQVPSMDSLITRLLRVPQALKEENLAESVETSAMAASRGRGGGRNNRGGRGGRSGRPQCTYCKRMGHTQENCYSLHGFPDKVAQLMVPKLQLKEVVKYLYLPH

SEQ ID NO: 150898 - protein, 45 aa, Glycine max
  Coding DNA Sequence Number=SeqID_34120
MAEKNSDASSAAAAEQISQAQNISVIGNCSFQHFTPFGCEKTITL

SEQ ID NO: 150899 - protein, 48 aa, Glycine max
  Coding DNA Sequence Number=SeqID_34121
MFELDFRQSYWKSPEKRKHLELKLSSHGRKVEKFDRLAPEIEDLVIAT

SEQ ID NO: 150900 - protein, 260 aa, Glycine max
  Coding DNA Sequence Number=SeqID_34122
  Gene Ontology: Mol. function=molecular_function; Cellular component =cellular_component; Biological process=multicellular organismal development
  Homolog annotation: Hit_ID=Q8L8Q4; Match level="QueryCoverage=46%, HitCoverage=55%, E-value=1e-35, Identity=64%"; Hit description=Bcnt -like protein
  Pfam annotation: Domain name=BCNT; Domain location=169-248; Score =123.2; E_value=7.4e-34; Accession=PF07572.3; Description=Bucentaur or craniofacial development
MTLPPTSESKSYLARAAVKHRGLVLSLFCALAIAIEFTMVIETRFWDCWVQKEGLEKREEDENTVNASSAESVKEPVIGSSLEAKQDDTGEATESLGQGASKNGPGILQSSTSDEAKKLAAAALAAVKDDAAMAASSRGKLVVRDFAGQEIEVKKLVDSDSKEAMERAKAPPPSAVDTVLEQIKKKQKLSVLDKTKKDWGEFKEEKRLEEELDAYKKSSNQYLDKVSFLQRADYREFERERDARLALQSRKRPDNMQEDD

SEQ ID NO: 150901 - protein, 99 aa, Glycine max
  Coding DNA Sequence Number=SeqID_34123
  Homolog annotation: Hit_ID=Q9FMP6; Match level="QueryCoverage=77%, HitCoverage=27%, E-value=3e-20, Identity=61%"; Hit description =Genomic DNA, chromosome 5, P1 clone:MXC9
MEAHSIGTFETNEVTALLVLLGGSLDMFVVNSFGSAFQALFICLLLPFLSKLWGIPFGQLPNYLKDGAACFLNVGTLSRAVIKCEILKMEYTIQNLELW

SEQ ID NO: 150902 - protein, 37 aa, Glycine max
  Coding DNA Sequence Number=SeqID_34124
MEKTLGKVSGVPKNRTRIHCEHVNVMFNVEIDCMHVR

SEQ ID NO: 150903 - protein, 81 aa, Glycine max
  Coding DNA Sequence Number=SeqID_34125
  Homolog annotation: Hit_ID=Q1SY67; Match level="QueryCoverage=97%, HitCoverage=9%, E-value=2e-15, Identity=43%"; Hit description =Peptidase aspartic, active site
MESEEDEDVGLPPELERIIAQEDREMRPHQEETKLVDLGTGCGKKEIKIGTGMTAPICEELMALLKNYQDIFAWSYQDMLG

SEQ ID NO: 150904 - protein, 62 aa, Glycine max
  Coding DNA Sequence Number=SeqID_34126
  Pfam annotation: Domain name=G-patch; Domain location=1-32; Score =5.7; E_value=0.037; Accession=PF01585.13; Description=G-patch domain
MVARVMLGYGYDPGMGLGRNNGQQNQPGLRHEGQVTAICEDDSPRRSDLVWLCPPSFQLGNW

SEQ ID NO: 150905 - protein, 84 aa, Glycine max
  Coding DNA Sequence Number=SeqID_34127
MVSDKEDVGTEVGGDGRELITEEDDRATVGGNVDEGDNIGDCAMTTNTTISMSIKTSDHRHGKKKRNMMGKMRKRGHQRKRIKG

SEQ ID NO: 150906 - protein, 487 aa, Glycine max
  Coding DNA Sequence Number=SeqID_34128
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=96%, HitCoverage=57%, E-value=1e-149, Identity=45%"; Hit description =Protein kinase
  Pfam annotation: Domain name=LRRNT_2; Domain location=26-65; Score =32.5; E_value=1.5e-06; Accession=PF08263.3; Description=Leucine rich repeat N-terminal domain
  Pfam annotation: Domain name=LRR_1; Domain location=116-138; Score =18.0; E_value=0.034; Accession=PF00560.23; Description=Leucine Rich Repeat
  Pfam annotation: Domain name=LRR_1; Domain location=140-162; Score =15.7; E_value=0.17; Accession=PF00560.23; Description=Leucine Rich Repeat
  Pfam annotation: Domain name=LRR_1; Domain location=164-186; Score =9.8; E_value=4.1; Accession=PF00560.23; Description=Leucine Rich Repeat
  Pfam annotation: Domain name=LRR_1; Domain location=188-212; Score =7.2; E_value=13; Accession=PF00560.23; Description=Leucine Rich Repeat
  Pfam annotation: Domain name=LRR_1; Domain location=214-236; Score =4.7; E_value=38; Accession=PF00560.23; Description=Leucine Rich Repeat
  Pfam annotation: Domain name=LRR_1; Domain location=238-260; Score =15.5; E_value=0.19; Accession=PF00560.23; Description=Leucine Rich Repeat
  Pfam annotation: Domain name=LRR_1; Domain location=262-284; Score =12.3; E_value=1.4; Accession=PF00560.23; Description=Leucine Rich Repeat
  Pfam annotation: Domain name=LRR_1; Domain location=285-307; Score =17.5; E_value=0.05; Accession=PF00560.23; Description=Leucine Rich Repeat
  Pfam annotation: Domain name=LRR_1; Domain location=309-331; Score =16.4; E_value=0.11; Accession=PF00560.23; Description=Leucine Rich Repeat
  Pfam annotation: Domain name=LRR_1; Domain location=333-355; Score =2.4; E_value=1e+02; Accession=PF00560.23; Description=Leucine Rich Repeat
  Pfam annotation: Domain name=LRR_1; Domain location=357-376; Score =7.2; E_value=13; Accession=PF00560.23; Description=Leucine Rich Repeat
  Pfam annotation: Domain name=LRR_1; Domain location=381-403; Score =8.7; E_value=6.8; Accession=PF00560.23; Description=Leucine Rich Repeat
  Pfam annotation: Domain name=LRR_1; Domain location=405-428; Score =14.7; E_value=0.34; Accession=PF00560.23; Description=Leucine Rich Repeat
  Pfam annotation: Domain name=LRR_1; Domain location=429-448; Score =6.9; E_value=15; Accession=PF00560.23; Description=Leucine Rich Repeat
  Pfam annotation: Domain name=LRR_1; Domain location=451-473; Score =14.9; E_value=0.3; Accession=PF00560.23; Description=Leucine Rich Repeat
  Pfam annotation: Domain name=LRR_1; Domain location=68-90; Score=3.7; E_value=58; Accession=PF00560.23; Description=Leucine Rich Repeat
  Pfam annotation: Domain name=LRR_1; Domain location=92-114; Score =5.2; E_value=31; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=26-65::116-138::140 -162::164-186:...
  Pfam module annotation: Domain location=:188-212::214-236::238 -260::262-284::285-307::309-331::333-355::357-376::381-403::405 -428::429-448::451-473::68-90::92-114
MPILSLLSFFLFLTYANSQSQYSLLYDQEHAVLLRIKQHLQNPPFLNHWTPSNSSHCTWPEISCTNGSVTSLTMINTNITQTLPPFLCDLTNLTHVDFQWNFIPGEFPKYLYNCSKLEYLDLSQNYFVGKIPDDIDHLASLSFLSLGGNNFSGDIPASIGRLKELRSLQLYQCLLNGTFPAEIGNLSNLESLYVFSNHMLPPTKLPSSLTQLNKLKVFHMYESSLVGEIPEAIGHMVALEELDLSKNDLSGQIPNDLFMLKNLSILYLYRNSLSGEIPGVVEAFHLTDLDLSENKLSGKIPDDLGRLNNLKYLNLYSNQLSGKVPESIARLRALTDFVVFINNLSGTLPLDFGLFSKLETFQVASNSFTGRLPENLCYHGSLVGLTAYDNNLSGELPESLGSCSSLQILRVENNNLSGNIPSGLWTSMNLTKIMINENKFTGQLPERFHCNLSVLSISYNQFSGRIPLGVSSLKNVVIFNASNNLFN

SEQ ID NO: 150907 - protein, 1010 aa, Glycine max
  Coding DNA Sequence Number=SeqID_34129
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=98%, HitCoverage=99%, E-value=0.0, Identity=63%"; Hit description=Protein kinase
  Pfam annotation: Domain name=LRRNT_2; Domain location=33-72; Score =35.0; E_value=2.6e-07; Accession=PF08263.3; Description=Leucine rich repeat N-terminal domain
  Pfam annotation: Domain name=LRR_1; Domain location=100-122; Score =5.2; E_value=30; Accession=PF00560.23; Description=Leucine Rich Repeat
  Pfam annotation: Domain name=LRR_1; Domain location=124-146; Score =19.0; E_value=0.017; Accession=PF00560.23; Description=Leucine Rich Repeat
  Pfam annotation: Domain name=LRR_1; Domain location=148-170; Score =15.5; E_value=0.19; Accession=PF00560.23; Description=Leucine Rich Repeat
  Pfam annotation: Domain name=LRR_1; Domain location=172-194; Score =7.3; E_value=12; Accession=PF00560.23; Description=Leucine Rich Repeat
  Pfam annotation: Domain name=LRR_1; Domain location=196-220; Score =8.9; E_value=6.2; Accession=PF00560.23; Description=Leucine Rich Repeat
  Pfam annotation: Domain name=LRR_1; Domain location=222-244; Score =1.8; E_value=1.3e+02; Accession=PF00560.23; Description=Leucine Rich Repeat
  Pfam annotation: Domain name=LRR_1; Domain location=246-268; Score =16.3; E_value=0.11; Accession=PF00560.23; Description=Leucine Rich Repeat
  Pfam annotation: Domain name=LRR_1; Domain location=270-292; Score =11.3; E_value=2.2; Accession=PF00560.23; Description=Leucine Rich Repeat
  Pfam annotation: Domain name=LRR_1; Domain location=293-315; Score =17.3; E_value=0.054; Accession=PF00560.23; Description=Leucine Rich Repeat
  Pfam annotation: Domain name=LRR_1; Domain location=317-339; Score =8.7; E_value=6.8; Accession=PF00560.23; Description=Leucine Rich Repeat
  Pfam annotation: Domain name=LRR_1; Domain location=341-363; Score =3.9; E_value=54; Accession=PF00560.23; Description=Leucine Rich Repeat
  Pfam annotation: Domain name=LRR_1; Domain location=365-384; Score =7.7; E_value=10; Accession=PF00560.23; Description=Leucine Rich Repeat
  Pfam annotation: Domain name=LRR_1; Domain location=389-411; Score =8.4; E_value=7.5; Accession=PF00560.23; Description=Leucine Rich Repeat
  Pfam annotation: Domain name=LRR_1; Domain location=413-435; Score =11.2; E_value=2.3; Accession=PF00560.23; Description=Leucine Rich Repeat
  Pfam annotation: Domain name=LRR_1; Domain location=436-455; Score =7.7; E_value=10; Accession=PF00560.23; Description=Leucine Rich Repeat
  Pfam annotation: Domain name=LRR_1; Domain location=458-480; Score =7.5; E_value=11; Accession=PF00560.23; Description=Leucine Rich Repeat
  Pfam annotation: Domain name=LRR_1; Domain location=482-504; Score =6.5; E_value=18; Accession=PF00560.23; Description=Leucine Rich Repeat
  Pfam annotation: Domain name=LRR_1; Domain location=506-528; Score =9.3; E_value=5.2; Accession=PF00560.23; Description=Leucine Rich Repeat
  Pfam annotation: Domain name=LRR_1; Domain location=530-552; Score =17.3; E_value=0.057; Accession=PF00560.23; Description=Leucine Rich Repeat
  Pfam annotation: Domain name=LRR_1; Domain location=554-573; Score =8.3; E_value=8; Accession=PF00560.23; Description=Leucine Rich Repeat
  Pfam annotation: Domain name=LRR_1; Domain location=575-597; Score =15.3; E_value=0.22; Accession=PF00560.23; Description=Leucine Rich Repeat
  Pfam annotation: Domain name=LRR_1; Domain location=76-98; Score=5.3; E_value=29; Accession=PF00560.23; Description=Leucine Rich Repeat
  Pfam annotation: Domain name=Pkinase; Domain location=691-972; Score =147.9; E_value=2.7e-41; Accession=PF00069.15; Description=Protein kinase domain
  Pfam annotation: Domain name=Pkinase_Tyr; Domain location=691-972; Score=76.1; E_value=1.1e-19; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=33-72::100-122::124-146::148-170::172-194::196-220::222 -244::246-268::270-292::293-315::317-339::341-363::365-384::389 -411::413-435::436-455::...
  Pfam module annotation: Domain location=458-480::482-504::506 -528::530-552::554-573::575-597::76-98::691-972::691-972
MELFTSSCLKFLFHSLVILFVLFNHANSQSQLHDQERATLLKIKEYLENPEFLSHWTPSSSSHCSWPEIKCTSDGSVTGLTLSNSSITQTIPSFICDLKNLTVVDFYNNYIPGEFPTTLYNCSKLEYLDLSQNNFVGSIPHDIDRLSNLQYLSLGYTNFSGDIPASIGRLKELRNLQFQNSLLNGTFPAEIGNLSNLDTLDLSSNNMLPPSRLHDDWTRLNKLKFFFMFQSNLVGEIPETIVNMVALERLDLSQNNLSGPIPGGLFMLENLSIMFLSRNNLSGEIPDVVEALNLTIIDLTRNFISGKIPDGFGKLQKLTGLALSINNLEGEIPASIGLLPSLVDFKVFFNNLSGILPPDFGRYSKLETFLVANNSFSGKLPENLCYNGHLLNISVYENYLSGELPQSLGNCSSLMELKIYSNEFSGSIPSGLWTLNLSNFMVSHNKFTGELPERLSSSISRLEIDYNQFSGRIPTGVSSWTNVVVFKASENYLNGSIPKELTALPKLNILLLDQNQLTGSLPSDIISWQSLVTLNLSQNQLSGHIPDSIGLLPVLTILDLSENQLSGDVPSILPRLTNLNLSSNYLTGRVPSEFDNPAYDTSFLDNSGLCADTPALSLRLCNSSPQSQSKDSSWSPALIISLVAVACLLALLTSLLIIRFYRKRKQVLDRSWKLISFQRLSFTESNIVSSLTENNIIGSGGYGAVYRVAVDGLGYIAVKKIWENKKLDKNLESSFHTEVKILSNIRHRNIVKLMCCISNEDSMLLVYEYVENRSLDRWLHRKNKSSAVSGSVHHVVLDWPKRLHIAIGAAQGLSYMHHDCSPPIVHRDVKTSNILLDSQFNAKVADFGLARMLMKPGELATMSSVIGSFGYIAPEYAKTTRVSEKIDVFSFGVILLELTTGKEANYGDEHSSLAEWAWRHQQLGSNIEELLDKDVMETSYLDGMCKVFKLGIMCSATLPSSRPSMKEVLQILLSCEDSFSKGESIIGHYDDVPLLKNSKREHKLDIDNDS

SEQ ID NO: 150908 - protein, 481 aa, Glycine max
  Coding DNA Sequence Number=SeqID_34130
  Gene Ontology: Mol. function=zinc ion binding
  Homolog annotation: Hit_ID=Q69L44; Match level="QueryCoverage=98%, HitCoverage=62%, E-value=1e-115, Identity=41%"; Hit description=SWIM zinc finger family protein-like
MARWDAILSLPVQNPPTLEISSAELVWSKVEGWHDKLDRVALIPYARVDDFVRGESNNKECPTRFHVEARRRRSPSTPFKQKVDGILEYILYWCSFGPDDHRKGGIVRPSRTTYVPKKKNAGRPNTKRGCICHFIVKRLIAEPSVALIIYNDDKHVDKKGLPCHGPQDKKAAGTRAMFAPYISEDLRLRVLSLLYVGVSVETIMQRHNESVERQGGPCNRDDLLTHRYVRRQERAIRRSTYELDDDDAVSISMWVESHQNLVFFYEDFSDSNPFTLGIQTEWQLQQMIRFGNSGMLASDSRFGTNKLQYPIHSLLVFNLDKKAIPVAWIIAPKFSSLDAHRWMRALYNRVHTKDPTWKLAGFIVDDPSYDVLAIRVFVWGPIKFWEMIDLLERVFDPGHELIGCLPVMISFWRIRHLWHKNIVKCLETDMQIKISRRLGWIVDNICRHQGSMSLFEEFMEDFIDESKFMDYFKATWHPRIG

SEQ ID NO: 150909 - protein, 232 aa, Glycine max
  Coding DNA Sequence Number=SeqID_34131
  Gene Ontology: Mol. function=DNA (cytosine-5-)-methyltransferase activity; Cellular component=chromatin; Biological process =regulation of transcription, DNA-dependent
  Homolog annotation: Hit_ID=Q94F88; Match level="QueryCoverage=66%, HitCoverage=18%, E-value=3e-37, Identity=50%"; Hit description=DNA (cytosine-5)-methyltransferase CMT3
  Pfam annotation: Domain name=BAH; Domain location=132-232; Score=8.9; E_value=0.0062; Accession=PF01426.8; Description=BAH domain
  Subcellular localization annotation: CTP_CleavageSite=45; ConfidenceScore=5.63e-01
MPSKRKTRSSASPAAAPPSKRASRSSASRVADSAPVKSEAEEVVAASSVVKEEAQASFTDVTDGNVSDGEGTNARFVGEPVPDEEARRRWPKRYQEKEKKQSAGPKSNRNDEDEEIQQARRHYTQAEVDGCMLYKLYDDAHVKAEEGEDNYICKIVEIFEAIDGALYFTAQWYYRAKDTVIKKLAYLIEPKRVFFSEVQDDNPLDCLVEKLNIARITLNVRVRSKEGNHSTL

SEQ ID NO: 150910 - protein, 149 aa, Glycine max
  Coding DNA Sequence Number=SeqID_34132
  Pfam annotation: Domain name=zf-CCHC; Domain location=77-94; Score =31.1; E_value=3.8e-06; Accession=PF00098.13; Description=Zinc knuckle
MELQRLNQNEEINKKKRSIALKASSSMHSENEEEESEDEEDFSLFVQKFQKFVKKRRIEKRQNFNNGRRSQEDYQILRCYKCNQLGHIKANCPSNEEWPEKSDRKRYEERRTKKSYIAWDDNDSSNGLEKEINLLTKDYESNENISLED

SEQ ID NO: 150911 - protein, 123 aa, Glycine max
  Coding DNA Sequence Number=SeqID_34133
  Gene Ontology: Mol. function=structural constituent of ribosome; Cellular component=ribonucleoprotein complex; Biological process =translation
  Homolog annotation: Hit_ID=P56804; Match level="QueryCoverage=80%, HitCoverage=99%, E-value=1e-33, Identity=77%"; Hit description =Chloroplast 30S ribosomal protein S14
  Pfam annotation: Domain name=Ribosomal_S14; Domain location=45-96; Score=62.1; E_value=1.8e-15; Accession=PF00253.11; Description =Ribosomal protein S14pS29e
MARKSVIQREKKRQKLEQKYHLIRRSSKKEISKVPSLSDKWKIHGKLESLPRNSAPIRLHRRCFSTGRPRANYRDFGLSGHILREMVHAMFIARCNKIQLSNLVARKAHNLEVTGSNPVSATF

SEQ ID NO: 150912 - protein, 83 aa, Glycine max
  Coding DNA Sequence Number=SeqID_34134
PIPAGVAVFARARLFASSSQDPDFESSFFPIELQIRLKLLNAGNLSTYLASVEFCFDGFSLEDLKDFCRCKRSHRWITGNNSR

SEQ ID NO: 150913 - protein, 131 aa, Glycine max
  Coding DNA Sequence Number=SeqID_34135
  Gene Ontology: Mol. function=RNA-directed DNA polymerase activity; Cellular component=intracellular; Biological process=RNA-dependent DNA replication
MAKEDREMKLYQEEIELVDLGANSERKEVKVGTGMTPPIREELVALLRDYQDVFAWSYQHMPGLSHDIVQHRLPLNSDCSLVKQKLSRMKPEMSLKIKEEVKKQFNAGFLAVARYPEWVANIVPVSMKDGK

SEQ ID NO: 150914 - protein, 85 aa, Glycine max
  Coding DNA Sequence Number=SeqID_34136
MLWNFTDYATMLFLTSGMLRNFKDYATMLFLTSGMLWNFIDYASMLFLRVLKGTNKLQREFRATKLLLLLALEGWSRNLEAWKCW

SEQ ID NO: 150915 - protein, 188 aa, Glycine max
  Coding DNA Sequence Number=SeqID_34137
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=76%, E-value=2e-85, Identity=71%"; Hit description =Apocytochrome f precursor
  Pfam annotation: Domain name=Apocytochr_F_C; Domain location=129-188; Score=53.7; E_value=2.5e-14; Accession=PF01333.10; Description =Apocytochrome F, C-terminal
GYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAVIDIIPPGPELLVSEGESIKLDQPLTSNPNVGGFGQGDAEIVLQDPLRVQ

SEQ ID NO: 150916 - protein, 109 aa, Glycine max
  Coding DNA Sequence Number=SeqID_34138
MASKKRKAPSTPTQARFDRSSSIDIAIVKEFYANLYDPEDKSPKQVSVRGHLVKFDENTLNTFLKTSVILEEGENLCTYSRFALLRPNPQELAAKLCIPGKGFELNADG

SEQ ID NO: 150917 - protein, 119 aa, Glycine max
  Coding DNA Sequence Number=SeqID_34139
MSSSQSISINTQALCNIYTKTQSYMQYGIMSVKNHVGRLGVHDKTNHTLASQVTLIGLKGTLKPGDPQGLHSEESVKFISSPLKSLSINSSPLKGLSINSPPLKGLNINSSSLKGLSIN

SEQ ID NO: 150918 - protein, 94 aa, Glycine max
  Coding DNA Sequence Number=SeqID_34140
MSLHVLYLYVFSGFPPGIPRLLYLSLQSFKEMNGQDHLELPSGWGQNMNSRNQSRYLGTDASGDGVTTDRSLPLLCAKQAENAAQGGPVSFGVA

SEQ ID NO: 150919 - protein, 146 aa, Glycine max
  Coding DNA Sequence Number=SeqID_34141
  Subcellular localization annotation: CTP_CleavageSite=25; ConfidenceScore=5.17e-01
MVMGDSSADSPSLVDALFLTQKSICCSKSVGIFVSLLKHVCILVEKTLRTFSSLTSYPELRRSEFLIGGYVGARASLLSTTPPFVAMTQELVARGDTLRGSGPDDTRRYLTVIRTLLSSRGGGPDDKQRPSLVILHPCIIQRRRAR

SEQ ID NO: 150920 - protein, 147 aa, Glycine max
  Coding DNA Sequence Number=SeqID_34142
  Subcellular localization annotation: CTP_CleavageSite=24; ConfidenceScore=5.68e-01
MEESSKKRKGSSTSASASRAHRSRATSASTTPIPPSLSSSTLFSSEEQQIRYSNLFSSRSIIDPKFIDMDFFSAESFDCIQAFQNLGLIPFMSLQLPVYSELVKAFYCNLKIQESTLISEVFGIKMVIDQSLFHNLTQLSSGGVPFE

SEQ ID NO: 150921 - protein, 238 aa, Glycine max
  Coding DNA Sequence Number=SeqID_34143
  Pfam annotation: Domain name=Transposase_23; Domain location=37-107; Score=-3.8; E_value=0.0029; Accession=PF03017.5; Description =TNP1ENSPM transposase
MQSQGLALPPEPDVGPSAARVSTKESCVDPSGNDLDTGDSYKCGLYIEEYPSRLVALGRVYEGSTTIHNIPLLHDQVKVSVEEIRDVDAPIPVPTKEVKVVGQALNTFLAWPTHLVKRLSEQGAVRPAKPADRPDDEVDDPLYLMTLTIPQLFLKPLQHEDLSEIAHGGQCLSISVIQLWILHMTETSMRAGNIDVYGFLEPQSIQRSGQSQFESENYIKNWMQNSKRDVYLGAYLNG

SEQ ID NO: 150922 - protein, 252 aa, Glycine max
  Coding DNA Sequence Number=SeqID_34144
  Gene Ontology: Mol. function=binding; Cellular component =intracellular; Biological process=protein kinase C activation
  Homolog annotation: Hit_ID=Q1S6D3; Match level="QueryCoverage=94%, HitCoverage=27%, E-value=1e-115, Identity=85%"; Hit description =Asp/Glu racemase; Tetratricopeptide-like helical
MTMQHGIKPTVTHYGCMVDLLGCVGCLEEALEVIVNMPVKPNSIVWGSPLGACRVHKNVQLADMAAKQILELEPENGAVYVLLCNIYAASKKWENLCQVRKLMMERGIKKTPGCSLMELNGNVYEFVAGDQSHPQSKEIYAKLENMMQGLIKAGYSPDTSEVFLDLGEEDKETALYRHSEKLAIAYALISSGPGVTIRIVKNLRMCVDCHHMAKLVSQAYNRELIVKDKTRFHHFRHGKSYANFDPHSNHRN

SEQ ID NO: 150923 - protein, 61 aa, Glycine max
  Coding DNA Sequence Number=SeqID_34145
MAVYGGYWWLKKEKKMAFFLSYLDYKAQNAQASNALRNGNVAHTPDIFSKIPTVTSWTSVL

SEQ ID NO: 150924 - protein, 204 aa, Glycine max
  Coding DNA Sequence Number=SeqID_34146
  Gene Ontology: Cellular component=integral to membrane
  Homolog annotation: Hit_ID=Q7CGZ2; Match level="QueryCoverage=58%, HitCoverage=29%, E-value=6e-45, Identity=75%"; Hit description =Putative resistance protein
MALAFVRQQPFVACTLLGATTVDQLKINIDSLDVVLDEDVLQALEEIHTRANTTPNPTPTPTTGTPSFTTSEYSASISNMAAFSPSANTATATPIRIPAGMQRFTVFSVTKRAAAPAPTTIPTATMAFSSVGVALSAMPSATGTHSTSRKRSVTPAPQNRLVPIKEKRVCPSRHNVTQAVKKLFVMARGRQEAPGRAAARRGIY

SEQ ID NO: 150925 - protein, 174 aa, Glycine max
  Coding DNA Sequence Number=SeqID_34147
  Gene Ontology: Mol. function=nucleic acid binding; Biological process= DNA integration
MTRSKRFVEAEDEDSVVSKKKAAEKKGIDERKNEVIERSRSGQAREKKREKAVIEGPEVPYPVVPSKKKKDHHLARFLDIFRKLEITMPFGQMPLYSKFLKDMLKRKHKYIHQENIVVEGNCSVVIQKILPPKHKDPGSVTIPCSIGEVTVGKTLIDLGASINLMPLSMCRRLG

SEQ ID NO: 150926 - protein, 151 aa, Glycine max
  Coding DNA Sequence Number=SeqID_34148
MTNRLRYLLFLFTKIQGTNRLTILCLNTLEGTSFVVQVDCTSTWVVILRTREGFYKVIGNLKNRWLLGVATCPFAGERGEAHRCAFQRRKDARSRHQRLFVENVGKTEENQSKRKFQVRELYLRLRKVLAPLTFVSKDNSLFFRIVEIVLP

SEQ ID NO: 150927 - protein, 73 aa, Glycine max
  Coding DNA Sequence Number=SeqID_34149
MEHRNLGIPRSCGSACHRTLGSRISFLNDHLEETLGPTKIGENHSKCINLTQCVVRKSLAHRILSAIKGRGPL

SEQ ID NO: 150928 - protein, 90 aa, Glycine max
  Coding DNA Sequence Number=SeqID_34150
  Gene Ontology: Mol. function=oxidoreductase activity; Cellular component=intracellular; Biological process=lignin catabolic process
  Homolog annotation: Hit_ID=Q9FJD5; Match level="QueryCoverage=96%, HitCoverage=15%, E-value=2e-30, Identity=72%"; Hit description =Laccase
  Pfam annotation: Domain name=Cu-oxidase_2; Domain location=1-89; Score=71.8; E_value=2.2e-18; Accession=PF07731.4; Description =Multicopper oxidase
MVSNGTKVVVLPFNTSVELVMQDTSILGAESHPLHLHGFNFFVVGQGFGNFDPKKDPANLNPVDPVERNTVGVPSGGWVAIRFLADNPVL

SEQ ID NO: 150929 - protein, 209 aa, Glycine max
  Coding DNA Sequence Number=SeqID_34151
  Gene Ontology: Mol. function=two-component sensor activity; Cellular component=integral to membrane; Biological process=two-component signal transduction system (phosphorelay)
  Homolog annotation: Hit_ID=Q7W9H0; Match level="QueryCoverage=100%, HitCoverage=30%, E-value=1e-85, Identity=72%"; Hit description =Probable signalling protein
LVDETAVDFQFGRGKSLEVQQAGVAGAEVVDRNGHAQSRQALEHRQAGFGVAHGGRFGHFQRQAGRRHIVPRQRGAHGLDQAGVGELQRGNVDRNGPVPLPGVDPFAHLAAGFIDDPFADRQDQPGLFRRGDELVRTHQAARRVVPAQQGLGAHDGAGRRLVLGLVVQHELVAFLRQAQVVQQLDLFVRVGVHRRLEEAVAGAAQALGV

SEQ ID NO: 150930 - protein, 389 aa, Glycine max
  Coding DNA Sequence Number=SeqID_34152
  Gene Ontology: Mol. function=serine carboxypeptidase activity; Biological process=proteolysis
  Homolog annotation: Hit_ID=Q6JJ33; Match level="QueryCoverage=94%, HitCoverage=78%, E-value=1e-120, Identity=57%"; Hit description =Putative serine carboxipeptidase
  Pfam annotation: Domain name=Peptidase_S10; Domain location=21-383; Score=60.9; E_value=2.8e-16; Accession=PF00450.12; Description =Serine carboxypeptidase
MEKKVLFFVSILLFIALLFHGGKVLAFKSQDGSEEWGYVQVRPKAHMFWWHYKSPYRVEDPSKPWPIVLWLQGGPGASGVGIGNFEEVGPLDTSLKPRNSTWLKKADLLFVDNPVGTGYSFVEDKKLFVKTDDEAATDLTTLLIELFNRDEKLQKSPLFIVAESYGGKFAVTVGLSALKAIGDGKLKLRLGGVALGDSWISPEDFVFSWGPLLKDLSRLDDNGLQRSNSIAERIKQQIEDGKFVEATESWSKLEDVISSSSNNVDFYNLLEDAGGDNIAAMELGLYEKLSMKRYSRYLSSMRSRSSPGGDDDLDKLLNGVIKKKLKIIPENVTWGGQSGDVFDYLAGDFMRPRINEVDELLTKGVNVTVYNGQVPQLFYLTSGPVPELI

SEQ ID NO: 150931 - protein, 135 aa, Glycine max
  Coding DNA Sequence Number=SeqID_34153
  Gene Ontology: Mol. function=acyltransferase activity; Biological process=metabolic process
  Homolog annotation: Hit_ID=Q1RYA6; Match level="QueryCoverage=78%, HitCoverage=25%, E-value=4e-30, Identity=57%"; Hit description =Diacylglycerol acyltransferase
MQRTAAATDEPRRRSGDAEGEKVFKGSEVFGDTSPNYLKTILALALWLGTIHFNVALVLFAIFFLSLHKALLLFGLLFVLMVIPVDEKSKFGRKLSRYICKHVCAYFPITLHVEDMKAFHPNRAYGFWQQAVKEH

SEQ ID NO: 150932 - protein, 174 aa, Glycine max
  Coding DNA Sequence Number=SeqID_34154
  Gene Ontology: Mol. function=transferase activity
  Homolog annotation: Hit_ID=Q1RZ85; Match level="QueryCoverage=74%, HitCoverage=19%, E-value=3e-30, Identity=55%"; Hit description =Asp/Glu racemase; Polynucleotidyl transferase, Ribonuclease H fold
  Subcellular localization annotation: CTP_CleavageSite=60; ConfidenceScore=5.27e-01
MRNLRAAAPDLSPDSVTHVIQGNDYVTPSFVTAWARLSGIRHVPRVRPSRVPPRRGRFVRAHAPRRRVPELLLVPHGSLVLRLCERAKRGFKSNTLVRCALIHMYSLRGGVFIGDAYKVFAEMREKNVFAWTAIIAAHVACSDMLSARRLFDLGPQRGVVLWNVVVSGYIELGA

SEQ ID NO: 150933 - protein, 71 aa, Glycine max
  Coding DNA Sequence Number=SeqID_34155
MDDLAQIPLLTPCEPLPLVAEVWSKEPMVVAGGGGDVEGLDLEQNRGLKNYDSGIVGLEVVATGKSEGAIN

SEQ ID NO: 150934 - protein, 156 aa, Glycine max
  Coding DNA Sequence Number=SeqID_34156
  Gene Ontology: Mol. function=transferase activity; Cellular component= nucleus; Biological process=protein kinase C activation
  Homolog annotation: Hit_ID=Q1RZ85; Match level="QueryCoverage=94%, HitCoverage=30%, E-value=3e-49, Identity=50%"; Hit description =Asp/Glu racemase; Polynucleotidyl transferase, Ribonuclease H fold
  Pfam annotation: Domain name=PPR; Domain location=44-78; Score=41.8; E_value=2.4e-09; Accession=PF01535.11; Description=PPR repeat
VKVRECGDGEVVPNDYTVVTVLSVCSRLGDLEMALDVFNGLDVITWNTIINGLAMHGHMANALSLFEQMKSTGERPDGVTLVGILSACTQMGLARDRFMHFRSMVDDYSIVPQIEHYGSRACRMYKNVEMAELALQRLIELEPNNPANFVMLSNIY

SEQ ID NO: 150935 - protein, 282 aa, Glycine max
  Coding DNA Sequence Number=SeqID_34157
  Gene Ontology: Mol. function=sulfotransferase activity; Cellular component=integral to membrane
  Homolog annotation: Hit_ID=Q1RYA5; Match level="QueryCoverage=89%, HitCoverage=61%, E-value=6e-89, Identity=65%"; Hit description=Auxin Efflux Carrier
  Pfam annotation: Domain name=Mem_trans; Domain location=1-282; Score=- 9.0; E_value=3.8e-07; Accession=PF03547.8; Description=Membrane transport protein
MPLHSLYLILGAHILIWTGNLGNLPMIIIAAICKQEGSPFGEPDLCNQYGMAYAALSMAIGAVFLWSYVYNLMRISSSRIQNEDRTSNDSSMLKASADISVSHPHNFSKTLNTTKGTVDNAYTILLPETNSEEKVSFPSKIKHYVRMISSHLNFKSMFAPSTLGAIAGFIIGVVPQIRNFMIGNNAPLHVVEDSASMLGEAAIPTVTLIMGANLLKGLKGTTAPVWTIVGIVVVRYIFLPLLGIAVVKGAMHLSLVHSDALYQFVLLLQYALPPAMNIDVML

SEQ ID NO: 150936 - protein, 105 aa, Glycine max
  Coding DNA Sequence Number=SeqID_34158
GWWVYARFVDVENLLWTIARPPPSTTCDGVVPGDMSRGSGDLGDVRRAPGSQQIKGTKTTKQGGLCGGWPAVNLEARRASSNRLPRGVIDYQASKRELEDYGGLW

SEQ ID NO: 150937 - protein, 123 aa, Glycine max
  Coding DNA Sequence Number=SeqID_34159
  Gene Ontology: Cellular component=integral to membrane
  Homolog annotation: Hit_ID=Q1RYA5; Match level="QueryCoverage=92%, HitCoverage=29%, E-value=3e-37, Identity=64%"; Hit description=Auxin Efflux Carrier
MGFIKLFSVASFPVIKVLLITALGLFLALDNISILGEDARKKVNQLVFYVFNPSLVGSNLAKTITFESVVKLWFMPVNILGTFILGSALGWILIKMTRPPKRMEGLILGCCSAGMNSSSQIIE

SEQ ID NO: 150938 - protein, 212 aa, Glycine max
  Coding DNA Sequence Number=SeqID_34160
  Gene Ontology: Mol. function=DNA binding; Cellular component =intracellular; Biological process=regulation of transcription
  Homolog annotation: Hit_ID=Q69XV5; Match level="QueryCoverage=56%, HitCoverage=26%, E-value=4e-31, Identity=56%"; Hit description=DNA -binding protein-like
  Pfam annotation: Domain name=ARID; Domain location=1-92; Score=-18.1; E_value=0.0092; Accession=PF01388.11; Description=ARIDBRIGHT DNA binding domain
MGDTTSRDQGFQSILHSHDNGIPEISIQDSRVSEVVLVTSYKLWRQVGESFKPPKTCTTVSWTFRVFYEKALLDYERHTTKGGELNVPITPHAEPINIENQCVQGSASLGRARRDAAARAMQGWHSQRLLSNGEFSDPIIKDRNSLSTQKREKQLKNISMVLHHIAIIFNYKVLHDSKDSPLLLAQIYLNARNHQTQLMLSKWHTANHLDHS

SEQ ID NO: 150939 - protein, 137 aa, Glycine max
  Coding DNA Sequence Number=SeqID_34161
  Gene Ontology: Mol. function=zinc ion binding
  Homolog annotation: Hit_ID=Q1S5Q3; Match level="QueryCoverage=81%, HitCoverage=77%, E-value=1e-10, Identity=34%"; Hit description=Zinc finger, GRF-type
  Pfam annotation: Domain name=zf-GRF; Domain location=20-65; Score =36.4; E_value=9.7e-08; Accession=PF06839.3; Description=GRF zinc finger
  Subcellular localization annotation: CTP_CleavageSite=30; ConfidenceScore=5.26e-01
MSQRSNASSSRTRVSSQVVLFCGCGRRAVRHVAGTNINRGRAFFTCSINKDEVGYCGYFIWVDQLIEALGVDDSVGTFSMEKRRQFGREEDKTMWKAQVNSKLDCMGIEMKMFRTIVYGLFLIQLLSMVVFVCIHKY

SEQ ID NO: 150940 - protein, 543 aa, Glycine max
  Coding DNA Sequence Number=SeqID_34162
  Homolog annotation: Hit_ID=Q8H612; Match level="QueryCoverage=98%, HitCoverage=95%, E-value=1e-144, Identity=48%"; Hit description =Pentatricopeptide (PPR) repeat-containing protein-like
  Pfam annotation: Domain name=DUF247; Domain location=18-523; Score =287.5; E_value=2.5e-83; Accession=PF03140.6; Description=Plant protein of unknown function
LRWVINIRKTLEEEVEEDGEFAVSIFSVPKLLMASDPDSYVPQQVAIGPYHYWRPELYEMQRYKIAAAKRFQKHQQSCKLENLVDQLNKLEQRVRACYHKFLDFNGETLVWMMTVDAAFLLEFLQVFAMQEGAKVQRVSSSMSHLVDYAGKKSAHNAILRDIVMLENQIPLFVLRKMLDLKFSSLEAADDMLSLMFIGLFKEISPFKMMEEYPNIDVSESVHLLDFLYDLIVPKLEQQPDTIEVELQQEEQKEGNNEEATSDSSHVKQFLCEVWKLLSKLNKGPVKMVKKVIVSKPLKVFVQLPWKIVSNLPGLKVLKQPLEHFLFSQEKADEKGESVNSSSNTLMKKPPSVEEITIPSVTELLNCGIRLVPTKGSISNISFDVKTSTVYLPTIGLDVNTEVFLRNLVAYEASVASGPLVITRYTELMNGIIDSEEDAKVLREKGIILNHLKSDKEVANLWNGMSKSLRLSRVPLLDKVIEDVNKYYNGRTKVKIWKFMKVYVFSSWQFLTFLAAICLLLLMALQAFCSVYTCSRFFRSALDS

SEQ ID NO: 150941 - protein, 126 aa, Glycine max
  Coding DNA Sequence Number=SeqID_34163
MNVVENGDYIPYDDQFNEIHRGQWMKEQKLKFMFNSKAWNVMLCALSEEEYTKELHRFMNKTPKSPLSHFSRMKEPKEKSFLALNSLKNMKTSLSREPVLRSSFIALKVDDESEEDSDEDELAFIS

SEQ ID NO: 150942 - protein, 134 aa, Glycine max
  Coding DNA Sequence Number=SeqID_34164
  Subcellular localization annotation: CTP_CleavageSite=21; ConfidenceScore=5.56e-01
MGRMSYNKVSTSTSSGKASSRCSRGFRLNPRKLYVLRLRKRFNFFLGLFDSWKLSYGEAIQLLKKVVCRKSGLKRNNSNNSTRSFVREEKIKGQDDCKMRSFVLGLHEKYIGIALAVKISSLASFASVMDHHSL

SEQ ID NO: 150943 - protein, 94 aa, Glycine max
  Coding DNA Sequence Number=SeqID_34165
PRVILRVPETDIPHVPEPREPSTSARPAVDEPRHAVEVCYGIVERLEHHLSLGVVTPGSSTHEVIEECLRMVRSVTQDQLVYVRSQRRRYTDQA

SEQ ID NO: 150944 - protein, 691 aa, Glycine max
  Coding DNA Sequence Number=SeqID_34166
  Gene Ontology: Mol. function=nucleic acid binding; Cellular component= nucleus
  Homolog annotation: Hit_ID=Q9FKY7; Match level="QueryCoverage=99%, HitCoverage=59%, E-value=0.0, Identity=51%"; Hit description =Arabidopsis thaliana genomic DNA, chromosome 5, TAC clone:K2A18
MEEYPEELRTPPVTLASLVGCPELHPLISTHFLSAQPPINTLALPDFSKINLFNNKKKNTDPSDSTAATSPSPIIAAGILKRDWLLKHRTKLPSVLAALFPSHHLLGDPAHWLQLCSDLDSIKTVIRGRNIKFAVVVVVQNNADEISEDRMIALRKRAEVDAKHVVVLNPNDTADLKQLASTFSELAGTYYREEGRRIKQRIEKKNVSSVELIVRYCFKVAVYAEFRSDWTEALKFYEEAYHTLREIVGVTTRLPAVQRLVEIKSISEHLHFKISTLLLHSGKVMEAVTWFRQHKNAYKRLVGAPDGIFLHWEWMSRQFLVFGELLETSSKITQGISPIVLGNSSKPLSEWEYYSAYYYQLAAHYLSEKRSALELAISMSETSDEIDNVADSVVPSVYVGQFARLLEQGDDVDMLPLTDEEFICYAVSEGKRFRDSLEIIALLKKAYESYNSMNIQRMSSFCGFQMSREYFAEGDISNAKKTFDSIASLYRKEGWVTLLWDVLGYLRECARKNGTIKDFVEYSLEMAALPISSDTGVQRDIGPAGPANLLQREIVQNEVFELVSGASGKETNEHPGNLKIMGDESLQLEVDLVSPLRLVMLASVAFHEQTIKPGASTLITVSLLSHLPHTVEIDRLEIQFNQSNCNFFITNAQKPQSVEVSNGIQQHRTEAEPSLSLESNKWLRLTYDIQS

SEQ ID NO: 150945 - protein, 91 aa, Glycine max
  Coding DNA Sequence Number=SeqID_34167
MENPEAEEKLGDWKGNGKRRRGSGYPLEFGVERKSEKLQVSTFSRKSKDLRNPVVVRLSTPHPLTPSWHAHPPPPSPPSPTLSPASPFAPT

SEQ ID NO: 150946 - protein, 624 aa, Glycine max
  Coding DNA Sequence Number=SeqID_34168
  Gene Ontology: Mol. function=hydroxymethylglutaryl-CoA reductase (NADPH) activity; Cellular component=integral to membrane; Biological process=lipid metabolic process
  Homolog annotation: Hit_ID=Q1RY98; Match level="QueryCoverage=99%, HitCoverage=99%, E-value=0.0, Identity=67%"; Hit description =Hydroxymethylglutaryl-coenzyme A reductase, putative
  Pfam annotation: Domain name=HMG-CoA_red; Domain location=190-614; Score=881.0; E_value=5.5e-262; Accession=PF00368.9; Description =Hydroxymethylglutaryl-coenzyme A reductase
MDVRRRPIPPSGDRRQTQKLKNTATTDSQTLLPLYLTNALFFAVFFSVAYFLLHRWREKIRTATPLHAVTPAETAAIVSLVASAVYLLGFFGVASRASLDELSDDEIILKEDSRAPGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGASCVGLKLAERVFGNTLRIHIHCKIALKSTQKQLFVTSRNHLECKSRSSRFARLQNIQCAIAGKNLYMRFRCSTGDAMGMNMVSKGVQNVLDFLQSDFPDMDVIGISEFSLLWFKAVAEIGIPCCFSPGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQ

SEQ ID NO: 150947 - protein, 490 aa, Glycine max
  Coding DNA Sequence Number=SeqID_34169
  Gene Ontology: Cellular component=nucleus
  Homolog annotation: Hit_ID=Q6NQJ8; Match level="QueryCoverage=89%, HitCoverage=76%, E-value=1e-54, Identity=48%"; Hit description =Protein SET DOMAIN GROUP 40
MGSTLEYQTQEQAPTNLNTLFPHVWVLLYVSLVFLTLAGEVWVLRETLGGERLFSEFPKSALMTRESVMEDEKLCDAVNRHSSLSPAQTSRWHPYLVHMPQTYDILAMFGEFEKRALQVQFLLEIFVYLVDEAMWVTEKAMLKAKSEWKEAHALMEDLMFKPQFLTFKAWVWAAATTMHIPWDEAGCLCLVGDLFNYDAPGMEPSGIEDLEHFLSNSSIHDTSLLNGDNNIMVDADHLDSHSEINRWAHYKKGDQTMHIPWDEAGCLCLVGDLFNYDAPGMEPSGIEDLEHFLSNSSIHDTSLLNGDNNIMVDADHLDSHSEINRWLVLLCYGIYTNLELVEHYGFLLQENPNDKVFIPLEPAVYSSTSWSKESLYVHHNGKPSYALLAALRLWATPQNKRRSVGHLVHSGSQLSADNEIFIMKWLSKTCDAVLKNLPTSIEEDTLLLNAMDNSQDFSTFIEITKLMSSRDEIHTCLEAHKMKDAHSFND

SEQ ID NO: 150948 - protein, 415 aa, Glycine max
  Coding DNA Sequence Number=SeqID_34170
  Gene Ontology: Mol. function=transferase activity; Cellular component= chloroplast; Biological process=biosynthetic process
  Homolog annotation: Hit_ID=Q2VEY0; Match level="QueryCoverage=97%, HitCoverage=86%, E-value=1e-152, Identity=69%"; Hit description =Putative phytoene synthase
  Pfam annotation: Domain name=SQS_PSY; Domain location=150-415; Score =307.4; E_value=2.6e-89; Accession=PF00494.10; Description =Squalenephytoene synthase
MSVTFLWFVSSPGLEVSHSTGLLDSVRHVKFLDSSKVMSRDFGSIRVEKDKEKGWRLCSLSTDMKYACVGRSGLESASNFPLIANVLANPAAGEVAVSSEQKVYDVVLKQASLVKRKLGATGELDAKPDIALPGNLSLLNEAYDRCGEICAEYAKTFYLGTLLMTPERRRAIWAIYDDCARVLYEVRPIYLINSQLPYSAPCYSVWCRRTDELVDGPNASQITPTALDRWESRLEELFQGRPFDMLDAALADTVAKFPVDIQPFKDMIEGMRLDLKKPRYKNFDELYLYCYYVAGTVGIMSVPIMGISPNSEATTESVYNAALALGIANQLTNILRDVGEDASRGRVYLPQDELAQAGLSDEDIFAGKVTDKWRNFMKSQIKRARMFFDEAEKGVTELNEASRWPVRNSKNLSIL

SEQ ID NO: 150949 - protein, 85 aa, Glycine max
  Coding DNA Sequence Number=SeqID_34171
MKKILGLQAPMELTSIGMEIGSHMYEFSFDEIIEGMNGERDKVQKEDQAPQQRISLEEETVQNTMGNNQQVLESTSMTRRESMNV

SEQ ID NO: 150950 - protein, 353 aa, Glycine max
  Coding DNA Sequence Number=SeqID_34172
  Gene Ontology: Mol. function=RNA-directed DNA polymerase activity; Cellular component=chromatin; Biological process=chromatin assembly or disassembly
  Pfam annotation: Domain name=RVP_2; Domain location=203-332; Score= -49.4; E_value=0.007; Accession=PF08284.2; Description=Retroviral aspartyl protease
MLEHTTRQTTLKCLKEVVARLTQAQATLTQGQATLTQNHATLAQSQSSMNTKMDRAPCSAHCPPFIPSPATFTYLNTHTTNCQASYEARFVALAKLQEEKLHDRRRHVRQPASPSMPPPPISPSPPSTARPLVKRLSTEELSIRRDKGLCYHCDEKLVIGHRCRPRLHLLITDEDADCSDISAPPSPVAVSDPLHHQDQLNVPQISLTAWSGMPAPETFRIYGTIARHQVVILVDDNSTHNFIQARLAAFLHLDQVPTTTMHVMIGNGGTIECNTKCPSIPILIQGYSFSIDLYQLPIGGANIILEVQWLKLLGPVTTDYASLTMRFNYLGQSISLHVDVPFCPSPASAQQLK

SEQ ID NO: 150951 - protein, 122 aa, Glycine max
  Coding DNA Sequence Number=SeqID_34173
MGVKVGEGGGVAWFWVRVAWPWVKVAWAWVNRATTSLRHLSVVCLVVCSSMVAGRKGAKKDEEIGRMHEGMSRRLPSKEELLEGIHKQVDQSTPSNSHLRPSLAQACSNSRRRKGVPHRAPS

SEQ ID NO: 150952 - protein, 401 aa, Glycine max
  Coding DNA Sequence Number=SeqID_34174
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=99%, E-value=1e-45, Identity=46%"; Hit description =Integrase, catalytic region
  Pfam annotation: Domain name=Chromo; Domain location=314-364; Score =11.9; E_value=0.038; Accession=PF00385.14; Description='chromo' (CHRromatin Organisation MOdifier
  Subcellular localization annotation: CTP_CleavageSite=63; ConfidenceScore=5.24e-01
MPMVTENIYLRLRASCHHLGRAKVAPLSTKNSFTKSELVPTITQASPVSRICFSSRTKFGYLPATSFRKCSWMNSTRHPSEAIWMLLKHSIESNNTSFGHLCLRIFEDMLLSAFFANRLSMRPINPSNSCNPYQFPLPSRKTYPWTSSPVSQLLTTTPLSCGTGFSPFEVTFDKPPTALPLYSTGASSMEAFDTLLTSRMAIHTTLQRRLQKYQSLMKCMADTHCRDLNFVVDDWVYVKLRPYRQTFVQPTYSKMSKRFYDPFQVQDRVGVVAYRLQLPIASRIYNVFHVSHHGPILTEAPVLPSFSTDNHPIIHPLRILDWKTDDITDPPTQHALVQWHGLPLKDTTWELWLELKALYDLEDKVCFPGEGIDSNNRPISQAPCNRPTRVITKPKYLEDYV

SEQ ID NO: 150953 - protein, 226 aa, Glycine max
  Coding DNA Sequence Number=SeqID_34175
  Homolog annotation: Hit_ID=Q9SGE3; Match level="QueryCoverage=39%, HitCoverage=37%, E-value=1e-26, Identity=62%"; Hit description =Histone H2B.2
  Pfam annotation: Domain name=Histone; Domain location=131-201; Score =63.1; E_value=8.9e-16; Accession=PF00125.14; Description=Core histone H2AH2BH3H4
MAHPLSRTCHSLLTPRIYLVPRNLTLGATRQPLESPEDTQTTEEEEVGSQEHVVIIPIQEVIPQAQKVSPNSDITTENKAEQENNTHQDGGVQNQEEEQKGVVNEEAKEEKNKSKTAKEQNGKEKKRGRKKRNIEGYQRYVYGVLKQVHPEMGISSKCMTALNNLMNDMFERLTFEVSKLTDYTGHMTLSSREIQGVVRLVLPGELEKHAIAEGVKAVNNYTSYDA

SEQ ID NO: 150954 - protein, 124 aa, Glycine max
  Coding DNA Sequence Number=SeqID_34176
MSTTTKGSTTEQPIPPQVEEESSVCKQEEEGEDAKIRVVIAQEGIEEFEECKTPTGSGYKIPIVKKCPLAPRKKRIKRAMPPFSSRVKRSSSSGLSYLVRHEEVESFFQSMFELTRVNKRCRSV

SEQ ID NO: 150955 - protein, 101 aa, Glycine max
  Coding DNA Sequence Number=SeqID_34177
  Homolog annotation: Hit_ID=Q9LTU4; Match level="QueryCoverage=46%, HitCoverage=3%, E-value=1e-07, Identity=46%"; Hit description =Helicase-like protein
MKQLRLWETLNIQLSRKHVLLWVSLEMIRNTLRQIEKLSIGVQSSMDNLSSSELNSFSQWILDIGDGKISEPNDGNAIIEISQELIISDFNDPIHGIVSST

SEQ ID NO: 150956 - protein, 82 aa, Glycine max
  Coding DNA Sequence Number=SeqID_34178
  Gene Ontology: Mol. function=metal ion binding; Cellular component =integral to membrane; Biological process=ubiquitin cycle
  Homolog annotation: Hit_ID=Q9SJJ7; Match level="QueryCoverage=56%, HitCoverage=19%, E-value=1e-12, Identity=59%"; Hit description=RING -H2 finger protein ATL2E
  Pfam annotation: Domain name=zf-C3HC4; Domain location=1-42; Score =37.7; E_value=3.9e-08; Accession=PF00097.15; Description=Zinc finger, C3HC4 type (RING finger)
CAICLEELREGDAVKVIPYCKHVFHPHCIDTWLDKQVTCPVCRCSELCGAAQQSGEEVGSVSATRQQVEQEEQEVVPIPNLD

SEQ ID NO: 150957 - protein, 858 aa, Glycine max
  Coding DNA Sequence Number=SeqID_34179
  Gene Ontology: Mol. function=zinc ion binding
  Homolog annotation: Hit_ID=Q6K9X4; Match level="QueryCoverage=83%, HitCoverage=77%, E-value=8e-76, Identity=37%"; Hit description =Ubiquitin-protein ligase-like
  Pfam annotation: Domain name=zf-C3HC4; Domain location=806-844; Score= 6.9; E_value=0.03; Accession=PF00097.15; Description=Zinc finger, C3HC4 type (RING finger)
  Subcellular localization annotation: CTP_CleavageSite=49; ConfidenceScore=5.21e-01
MAIAGLHSVSVLDSSFLRDSHSQSSGRGGDGRRGSTRSSSLLQMWREIEDEHVVNQVQGRSGEVPLEQRRDGLVADLSREDRLDIQERGQRHVIEDTVLGENESETWSQSQSQNESHDGNEDLNNSSCENSSDLGEVERERVRQIFREWMNSGARDHVSNISERNNGSRGEWLGETEQERVRVIREWVQMSSQQRSVSSGENREEPSAEIDTQIERVRDGLIVNQIGGQTEHTRRGIRKLCGRQAMLDMPKKAERERQREIHELLDHRAVSQFPYRNRIQALLRGRFLRNDRPVDNNRPLSVAESELGFLRRRQTVSGLREGFFARRENSGCSQATSNASDTSSNVEIDFNTNEQMGSSSSHIVPSVHSEESDPNDRGSNGLGVSGSQNWVRGTTCENLHWQESTAQVDELQHLPIESLDCQSSLSADVERGDNTEQNLDVMPTEDNANEITQQSLRIEDSEHCNNEEFSEVHNEQSELGDINNSENYSSNYNIHMEDNVVNGVNWNESGALEGEQPEEVSENEGSEWYQNNTEWRNSTEENVDDNHLSNTPNEWPENSLGNEDGENSRLQESHEVWQEDGGFQGAVENWLGGTSDHESAPVGRIRGFYFPEDDNVYSVELRELLSRRSVSNLLGSSFRESLDQLIQSYVERQGHANIDWELQETTPSSASVEQDLEQQSRDQIVGQEEGTVNSPLNLPSLPIPPPLPIWDQHHHRDNWSQNDINNQHLDLEIINDLRIDMARLQQRMNNMQRMLEACMDMQLELQRSIRQEVSAALNRSAGSSGIHDCESPEDKSKWECVRKGLCCICCESNIDSLLYRCGHLCTCSKCANELLQSRRKCPMCQAPVVEVIRAYSIQ

SEQ ID NO: 150958 - protein, 254 aa, Glycine max
  Coding DNA Sequence Number=SeqID_34180
  Homolog annotation: Hit_ID=Q5KS41; Match level="QueryCoverage=96%, HitCoverage=47%, E-value=2e-73, Identity=54%"; Hit description =FOLDED PETALS
  Pfam annotation: Domain name=DUF1298; Domain location=93-244; Score =347.4; E_value=2.4e-101; Accession=PF06974.4; Description=Protein of unknown function (DUF1298)
MDDIKLVKNEMKTTINDVLLGVTQAALTRYLNRAYVVFVNALLLDLKADVGANSNGVKQRSSVLKKIRLRASILVNIRPVGGIQELADMMAEKSKVKWGNCMGYIILPFSIVLYKDPLEYVRHAKATIDRKKHSLEAICSYACAKLVLNLLGVKVAAAITRRVLFNTTVAFSNVPGPVEEISFYGHPVAYIAPSVYGHPLALTIHFQSYANNMTISLAVDPLVISDPYLLCDDLEQSLKLIRDAIQKKHTVDAV

SEQ ID NO: 150959 - protein, 632 aa, Glycine max
  Coding DNA Sequence Number=SeqID_34181
  Gene Ontology: Mol. function=translation initiation factor activity; Cellular component=nucleus; Biological process=regulation of transcription, DNA-dependent
  Homolog annotation: Hit_ID=Q1PEV9; Match level="QueryCoverage=91%, HitCoverage=99%, E-value=1e-106, Identity=40%"; Hit description=RNA polymerase I specific transcription initiation factor RRN3 family protein
  Pfam annotation: Domain name=RRN3; Domain location=50-547; Score =407.9; E_value=1.4e-119; Accession=PF05327.2; Description=RNA polymerase I specific transcription initiation factor RRN3
  Subcellular localization annotation: CTP_CleavageSite=34; ConfidenceScore=5.26e-01
MQGEGVWGFGELAKGDFTSVRPSLLFPLRSRNCSSFAKKSMGRVQVSDKEEFSQMENNDFSDSQLVHHFRGVLVAVTTGDRENYDELVGYLHPKKHLNPDEVAILVTTLKALSGAVSYIDSVHHESLLFAVSRMSLWNCGIDIMDALLELIISLAVSNGKYIDWCLEMLVKNFVPPFYLLDSLRQENGIDRKNKVLSRVHAALKEIADLVPLAPLRLSPIVIQKMPSVFSKETEIVMYVENMLRLESGALGETVGSTMLPALVDRLLELDVEIGWDGILQEDAKGIFEMELEDVTEFTDEDENCDSMLSSELLNRKNLQGNLVVEKLDSLMVLAFLHLESCQNSGRLAEFVMFYACALDPEGCGVKFAMVLADMFGGDANPPITRMSAVAYLASYLTRAKFLSAALVTSIIQSLVDWCYAYCKFRDFDMNPRAHQVFYSGCQAIMYIMCFRMRSLMDVPRLKLQLLNMPMEAILKHKLSPLKAKAAQLFMASESFVFDDMLESDLSKAFGGMDRLDMFFPFDPCLLKRSESYIRPHFVRWSKVRTTYDDDDDNDEVSDSGSELSDDDFIDRNAKDMIDDDMMVSVEGADFNPDLNKMSITPRKSFKHGFETPLNQCTRMPARIRPSTSPESL

SEQ ID NO: 150960 - protein, 561 aa, Glycine max
  Coding DNA Sequence Number=SeqID_34182
  Gene Ontology: Mol. function=protein binding; Cellular component =intracellular; Biological process=small GTPase mediated signal transduction
  Homolog annotation: Hit_ID=Q8RX50; Match level="QueryCoverage=92%, HitCoverage=96%, E-value=1e-165, Identity=59%"; Hit description=PSR9
  Pfam annotation: Domain name=LRR_1; Domain location=245-266; Score =10.7; E_value=2.8; Accession=PF00560.23; Description=Leucine Rich Repeat
  Pfam annotation: Domain name=LRR_1; Domain location=268-289; Score =10.9; E_value=2.6; Accession=PF00560.23; Description=Leucine Rich Repeat
  Pfam annotation: Domain name=LRR_1; Domain location=291-312; Score =16.0; E_value=0.14; Accession=PF00560.23; Description=Leucine Rich Repeat
  Pfam annotation: Domain name=LRR_1; Domain location=314-335; Score =17.8; E_value=0.039; Accession=PF00560.23; Description=Leucine Rich Repeat
  Pfam annotation: Domain name=LRR_1; Domain location=337-358; Score =9.5; E_value=4.8; Accession=PF00560.23; Description=Leucine Rich Repeat
  Pfam annotation: Domain name=LRR_1; Domain location=360-381; Score =3.4; E_value=65; Accession=PF00560.23; Description=Leucine Rich Repeat
  Pfam annotation: Domain name=LRR_1; Domain location=383-404; Score =9.5; E_value=4.7; Accession=PF00560.23; Description=Leucine Rich Repeat
  Pfam annotation: Domain name=LRR_1; Domain location=406-427; Score =11.6; E_value=1.9; Accession=PF00560.23; Description=Leucine Rich Repeat
  Pfam annotation: Domain name=LRR_1; Domain location=454-475; Score =17.0; E_value=0.067; Accession=PF00560.23; Description=Leucine Rich Repeat
  Pfam annotation: Domain name=LRR_1; Domain location=477-495; Score =3.0; E_value=77; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=245 -266::268-289::291-312::314-335::337-358::360-381::383-404::406 -427::454-475::477-495
MDLLPARSVDETVEEIMRLHRSLPARPGIEEVEAARTLVENVEREDQAKLEAVARARERKGPHVPEELFAVLQEMQKNVVLFQSKEQRREALKLLDLENVHVLFDELIQRASNCVSARSSGSKNSVSKRETSFSTASVSAFKKEPVKSSEILFTRDDSYMNKTKPNFYSDGYTIGPSVSSKPPILDSSLIPASTSGEQSGDKLSLIKLASLIEVSAKKGTRELILQNKLMDQVDWLPDSIGKLSSLIKLDLSENRIMVLPSTIGSLSSLTSLDLHSNKIAELPECVGDLLSLVYLNVGGNQLSSLPASLGRLVHLEELDLSSNQLSVLPDAIGSLVSLKILNVETNDIEEIPHSIGRCVALKELCADYNRLKALPEAVGKIESLEVLSVRYNNVKQLPTTMSSLSNLKELNVSFNELEYVPESLCFATSLVKMNIGNNFADMRSLPRSIGNLEMLEELDISNNQIRVLPDSFGMLTRLRVLKVEENPLEIPPRHVAEKGAQAVVKYMADLVEKKDVKSQPLIKKKKGFIVHQSPVALVALIDLESALVARLDSIRASSGIE

SEQ ID NO: 150961 - protein, 217 aa, Glycine max
  Coding DNA Sequence Number=SeqID_34183
  Gene Ontology: Mol. function=RNA-directed DNA polymerase activity; Cellular component=nucleus; Biological process=RNA-dependent DNA replication
MSHHSSSVNGEGTSHKDPLSRILDELSSLMLWKEKLEGKEKGKGRVEINQDEREQIRNEERRKRMKEMKREKHVSYRGLSNYYRGRHSSHTKHHSQRIEKDRRPQEANIRLPYFHGKDNVEAYLDWEMKIEQLFACHHISEEIKVSLATLSFQGYALYWWTFLVREQRIHRDPLVEYWNDLKSALRKRHIPSYYERELMDKLQRLRQGSISVEEYRQ

SEQ ID NO: 150962 - protein, 407 aa, Glycine max
  Coding DNA Sequence Number=SeqID_34184
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=95%, E-value=3e-76, Identity=43%"; Hit description =Integrase, catalytic region
  Pfam annotation: Domain name=Chromo; Domain location=338-392; Score =30.2; E_value=7e-06; Accession=PF00385.14; Description='chromo' (CHRromatin Organisation MOdifier
  Pfam annotation: Domain name=rve; Domain location=29-185; Score=47.5; E_value=4.4e-11; Accession=PF00665.16; Description=Integrase core domain
  Pfam module annotation: Pfam domain module=Chromo::rve; Domain location=338-392::29-185
MKGLKKKVDSQHTKYETKKTASLLCPLPVPCRSWEDLSLDFITGLPMFRGYTTILVIVNRFSKGIHLGMLPTQHTSYTVTVLFKDLVGKIHEMSQCLVSDCDPLFLSRFWQELFRLSGTKLCLRFVYHPRSDGQTEVLNRVIEQYLRAFVHKKPSSWEKLLHWYLVGDFNIVAIDDILIAREAVFAEVKKKLEKAQVFHGINDSLGELAARWAWASETNPLLGFPHALSWLSASLSGCNSLSAYASLSETLAASPSSTFSLKLNQPIGYSKLAKRFYGPFRVIKRIGLSANKLQLPVDARIHPVFHCSLLKSFHSAHPDDNLHSITLPVLTKDDHLLIQPLAILNTRQTTDSKLEVLVQWQGLLPDDTTWEDWHQLQTDYHLEDKVLLEGMRNDSNTEKPETTEARP

SEQ ID NO: 150963 - protein, 174 aa, Glycine max
  Coding DNA Sequence Number=SeqID_34185
  Homolog annotation: Hit_ID=Q94JH8; Match level="QueryCoverage=57%, HitCoverage=67%, E-value=2e-15, Identity=41%"; Hit description=Cold induced protein-like
  Subcellular localization annotation: CTP_CleavageSite=96; ConfidenceScore=5.41e-01
MEQLKYKVVQGDDNNNKGPVVRSFFSSSSSESGISSGSSLDSDSFEEVTSPASSSSSAADQPATEPLSDMSSLFQQLPIKRGLSKYYEGKAQSFTSIAKVNSLEDLVKPENPYNKKLKTCSSYGGVMGETSQRGSCSSLSANRGTENFMDRRPPIPPHRSTTTSSIPNQTALFV

SEQ ID NO: 150964 - protein, 346 aa, Glycine max
  Coding DNA Sequence Number=SeqID_34186
  Gene Ontology: Cellular component=nucleus
  Pfam annotation: Domain name=Bromo_TP; Domain location=36-111; Score =66.7; E_value=7.5e-17; Accession=PF07524.3; Description=Bromodomain associated
  Subcellular localization annotation: CTP_CleavageSite=27; ConfidenceScore=5.07e-01
MENNSSTNATSKLPQKAKRKKKGLGVNVAQVADNTSEFSFAVAKIAVAQICQSAGYKSSKHNALEALTNVSTRYMEAIVRSAATFANASNRTDSNLFDLTNGIHDVCSVQGFPGGSIIHKSNLLGSSALKEIMNFVNLSNKVPFAKPIPFRNVSEVTIDSGTSMCLSKQVKTHIPRWLPHFPKENCAQVLVKERKCDEKLWEHSLTREENSGLLPSNGIDGKEEKEARMELPKGRERIKFRIRGEKEMHVELGVNMMNGHFSFPPWTICIDQQLLLPPPLQVQSSVMLSLSLIDLVMTVLDVGGSMTCVKLPMTDPPHKTPWKLLSKSDFRRTMRMWLKGGSRLRS

SEQ ID NO: 150965 - protein, 1292 aa, Glycine max
  Coding DNA Sequence Number=SeqID_34187
  Gene Ontology: Mol. function=microtubule motor activity; Cellular component=microtubule associated complex; Biological process =microtubule-based movement
  Homolog annotation: Hit_ID=Q1RYB8; Match level="QueryCoverage=99%, HitCoverage=99%, E-value=0.0, Identity=76%"; Hit description=Kinesin- related protein tck1-common tobacco-related
  Pfam annotation: Domain name=Band_41; Domain location=308-497; Score=- 63.7; E_value=0.0023; Accession=PF00373.8; Description=FERM domain (Band 4.1 family)
  Pfam annotation: Domain name=Kinesin; Domain location=896-1240; Score= 458.5; E_value=8.8e-135; Accession=PF00225.13; Description=Kinesin motor domain
  Pfam annotation: Domain name=MyTH4; Domain location=164-278; Score =170.8; E_value=3.5e-48; Accession=PF00784.8; Description=MyTH4 domain
  Pfam module annotation: Pfam domain module=Band_41::Kinesin::MyTH4; Domain location=308-497::896-1240::164-278
  Subcellular localization annotation: CTP_CleavageSite=58; ConfidenceScore=5.24e-01
MITDVPPSMSQNGRSSRYSFGSSNGNGDTPAQNGAAVINVDDYDSDSSNFAPPTPSTMSMAVPAELAGAVPLINRFQVDGFLKLMQKQIQSAGKRGFFSKRSVGPQVREKITFEDMLSFQKDPIPTSLLKLNVDLVSRATKLFQIILKYMGIDPSDRVTPISLDERVELVGKLYKQSLKRPELRDELFVQISKQTRNNPERQYLIKAWELMYLCASSMSPSKDISSYLSEYIHNIANGVGTDSEIQVLALNTLNALKHSVKAGPRHIIPGREEIEALLTGRKLTTIVFFLDETFEEITYDMSTTVADAVEVLESLIYFSLHLHAFLTHVCCACSDQYEEYIGLDENKYIGDLLVEFKAAKDRSKGEILHCKLIFKKKLFRESDEAVTEPMFVQLSYVQMQHDYILGNYPIGRDDAAQLSALQILAEIGFLNTPESCTDWNSLLECFLPRQISMTRAKREWEYDILSRYRSLENLTKDDARQQFLRILRALPYGNSVFFNVRKIDDPIGLLPGRIILGINKRGIHFFRPVPKEYLHSAELRDIMQFGSSNTAVFFKMRVAGVLHIFQFETKQGEEICVALQTHINDVMLRRYSKARSAAAGGGSLNGDISSNSKPPNMELYEKRVQELSKLIEESQKNADQLLEELRVKQKQEEKMQEELDDLKESLKADKQNLDAVTSDRNRLLSLCNEKDKELQAAILDKRNMESRMSKLNNAVIENTAKKDLANAGNRQVTQKLEDELKVCKYELLSANETIKSLKSEKLVLEQKLSALQTRNAGEISSLQWKLEQERKVVKSEAYELERKIEGCRQELLVAKATISMKDSELAALQNNLKELEELREMKEDIDRKNEQTAAILKMQGAQLAEMETLYKEEQVLRKRYFNVIEDMKGKIRVYCRLRPLSEKEIAEKEREVLTATDEFTVEYPWKDDKLKQYIYDRVFDADATQESVFEDTKASHLSYLFLVYGNIYNLHSLSISRGFAMQYLVQSAVDGYNVCIFAYGQTGSGKTFTIYGSDNNPGLTPRAIAELFRILRRDNNKYSFSLKAYMVELYQDTLIDLLPKNGKHLKLDIKKDSTGMVVVENVTVMSISTIEELNSIIQRGSERRHISGTQMNDESSRSHLILSIVIESTNLQSQSVARGKLSFVDLAGSERVKKSGSTGSQLKEAQSINKSLSALGDVISSLSSGGQHTPYRNHKLTMLMSDSLGGNAKTLMFVNVSPAESNLDETNNSLMYASRVRSIVNDPSKNVSSKEVARLKKLVAYWKQQAGRGLEYDDLEEIQDERPTKENGNGNR

SEQ ID NO: 150966 - protein, 307 aa, Glycine max
  Coding DNA Sequence Number=SeqID_34188
  Gene Ontology: Mol. function=identical protein binding; Cellular component=cellulose and pectin-containing cell wall; Biological process=negative regulation of enzyme activity
  Homolog annotation: Hit_ID=Q1RYB7; Match level="QueryCoverage=71%, HitCoverage=29%, E-value=1e-93, Identity=76%"; Hit description =Protease-associated PA; Proteinase inhibitor I9, subtilisin propeptide
MFNILSGTSMACPHVTGIATLVKAVHPSWSPSAIKSAIMTTATVLDKHHRPITADPEQRRANAFDYGSGFVNPARVLDPGLIYDSKPADFVAFLCSLGYDQRSLHQVTRDNSTCDRAFSTASDLNYPSIAVPNLKDNFSVTRIVTNVGKARSVYKAVVSSPPGVRVSVIPNRLIFTRIGQKINFTVNFKLSAPSKGYAFGFLSWRNRISQVTSPLVVRVAPGKNGLLQHTHTLFELKNQQNSHIHMQINEIGQVTQIFVKLKPQWMGFLTFLLFLVLPSSMDSTASPRFVVTSPGSRGHVASPTSGG

SEQ ID NO: 150967 - protein, 247 aa, Glycine max
  Coding DNA Sequence Number=SeqID_34189
  Gene Ontology: Mol. function=acyltransferase activity; Cellular component=integral to membrane; Biological process=metabolic process
  Homolog annotation: Hit_ID=Q1RYB9; Match level="QueryCoverage=96%, HitCoverage=64%, E-value=1e-113, Identity=74%"; Hit description =Phospholipid/glycerol acyltransferase
  Pfam annotation: Domain name=Acyltransferase; Domain location=42-145; Score=-8.3; E_value=0.015; Accession=PF01553.11; Description =Acyltransferase
MEWAARAEHLRGIPRKLVIAAVGGFAKTVSSFLNTADVHNGDTLLRLVRSRPHRVPLITVSNHMSTLDDPVMWGFKGFPIFDTNLARWVLAAEDICFRNALYSYIFRLHTFPEGKVYQEDAPIRQLKWGTASLIVRAPITPIVLPIVHHGFHEVMPENYMFGKRPPIPLWNKKIHIVIGDPIEFDLPAMRQKAISQSRNESFPTIGWPSTPDGLDEAAQRYLYTTISEQIRAAMERLRCLGKSFMKS

SEQ ID NO: 150968 - protein, 108 aa, Glycine max
  Coding DNA Sequence Number=SeqID_34190
  Gene Ontology: Mol. function=electron carrier activity; Cellular component=endoplasmic reticulum; Biological process=electron transport
  Homolog annotation: Hit_ID=Q1STX7; Match level="QueryCoverage=67%, HitCoverage=10%, E-value=8e-24, Identity=67%"; Hit description =Flavoprotein pyridine nucleotide cytochrome reductase; Flavodoxin/nitric oxide synthase
YFGGASLSAEEDGDLFGVIVNVDFGKLLDDVFRRLERLDLGGGGSAPDEDDNAADEDGDGGGDEHEEVAVLEEEGAAGQSTMGSLRCVVASWFGGEELGATGGGVVER

SEQ ID NO: 150969 - protein, 133 aa, Glycine max
  Coding DNA Sequence Number=SeqID_34191
  Homolog annotation: Hit_ID=Q9SES8; Match level="QueryCoverage=74%, HitCoverage=62%, E-value=4e-17, Identity=41%"; Hit description=ECA1 protein
  Pfam annotation: Domain name=DUF1278; Domain location=1-125; Score =156.7; E_value=5.9e-44; Accession=PF06915.2; Description=Protein of unknown function (DUF1278)
  Subcellular localization annotation: CTP_CleavageSite=20; ConfidenceScore=5.20e-01
MASTHNLYIFVSLVTITALVSSMVESRSLPNASSSLTVRLKLEGEPSNCWDSLWQLQACSGEIVTFFVNGETYLGHGCCQAIRVIGHDCWPNIVASLGFTNEETDVLEGYCDQAVDSPSPPSIVVDSKDDIVP

SEQ ID NO: 150970 - protein, 164 aa, Glycine max
  Coding DNA Sequence Number=SeqID_34192
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=41%, E-value=3e-88, Identity=98%"; Hit description =Ribulose bisphosphate carboxylase large chain precursor
  Pfam annotation: Domain name=RuBisCO_large; Domain location=39-162; Score=0.4; E_value=9.1e-10; Accession=PF00016.10; Description =Ribulose bisphosphate carboxylase large chain, catalytic domain
MFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAAWLIIAEIMVYFFIYTVQCMQLSTDKRIMVCTFVY

SEQ ID NO: 150971 - protein, 65 aa, Glycine max
  Coding DNA Sequence Number=SeqID_34193
MIMQIVEGIDEFGLGVTCDTGLASTTHDLSSMRLASWTGELSRLGIANSTGELCSRLGVLYNAIN

SEQ ID NO: 150972 - protein, 35 aa, Glycine max
  Coding DNA Sequence Number=SeqID_34194
MWDKGTKTTNSNSFLHCVSYTASSSSFLMNSSPES

SEQ ID NO: 150973 - protein, 243 aa, Glycine max
  Coding DNA Sequence Number=SeqID_34195
  Gene Ontology: Mol. function=DNA binding; Cellular component=nucleus; Biological process=regulation of transcription, DNA-dependent
  Homolog annotation: Hit_ID=Q0PJH7; Match level="QueryCoverage=97%, HitCoverage=54%, E-value=1e-105, Identity=82%"; Hit description=MYB transcription factor MYB177
  Pfam annotation: Domain name=Myb_DNA-binding; Domain location=60-105; Score=58.0; E_value=3e-14; Accession=PF00249.21; Description=Myb-like DNA-binding domain
MAIQSQNAFTRSRGGLPIGDGISLNSGVHPVADIPLHDQFSCGNDYALKVRKPYTITKQRERWTDEEHKKFLEALKLYGRAWRRIEEHVGTKTAVQIRSHAQKFFSKILRESSRNSTTLEESIEIPPPRPKRKPIHPYPRKLVEIPKTEISNSELPLRSNSLKPSDFGQENNSPKSVLSTVVSETLGSSDSDTPTRCLSPTSSISDVPTNRFPLAEPKTSFEEEGSPPSSAHDKQPPVVQLKS

SEQ ID NO: 150974 - protein, 125 aa, Glycine max
  Coding DNA Sequence Number=SeqID_34196
MAYTHIPHCNCGLWHKLGNPDESLETPNNSLQNCPMCGISCQCQDLHAILLKFQPARINLTLHLTLQSPTMLNGTARGFSVTSTRCISSRILGEMEVDEPWLGLWLPLNYQVDMGASQHRTLELG

SEQ ID NO: 150975 - protein, 141 aa, Glycine max
  Coding DNA Sequence Number=SeqID_34197
  Pfam annotation: Domain name=Transposase_23; Domain location=45-110; Score=-9.4; E_value=0.012; Accession=PF03017.5; Description =TNP1ENSPM transposase
  Subcellular localization annotation: CTP_CleavageSite=28; ConfidenceScore=5.02e-01
MQSHLQSQIQSQGLALPPKPEVGPSAARVSTKGSCVDPSTTNLDTGDSDKCGLYIEKNPSRLVALGRVYEGSTIVHNIPLLNGQVKVFVEEVKHAYAPVPVPTSEVAMYPAKPANGSDPQVTWDATVFEVFDEDFRLVHKA

SEQ ID NO: 150976 - protein, 277 aa, Glycine max
  Coding DNA Sequence Number=SeqID_34198
  Homolog annotation: Hit_ID=O04892; Match level="QueryCoverage=27%, HitCoverage=24%, E-value=1e-13, Identity=51%"; Hit description =Cytochrome P450 like_TBP
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERDGEARLIALCARTPKGIGLKFLNRDVAADGNVRESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLK

SEQ ID NO: 150977 - protein, 44 aa, Glycine max
  Coding DNA Sequence Number=SeqID_34199
MAERESKYSSICYEEREEQASLLQIIFTPVSGMELYIAKPFAAG

SEQ ID NO: 150978 - protein, 329 aa, Glycine max
  Coding DNA Sequence Number=SeqID_34200
GVHLTPYFPSVSDFVTSVSSSSVNVVVDDRDLCVSLLHDIVWEVRPRRVFDFELNNNNNNSVNYDKSWSWKRSGSVESCEFQRLKRHDVSVLLNGSWVVVAGDSQARIFTLSLLSLVLDSEGMESVKGSLFKRHSDYHTVVDEIGMKLDFMWAPYVTNLTSLVAGFKRNRVYPDLLVMGSGLWHMLHFTNASDYGFSLGVLRSSVNSLLPVSSEFGNDEADVAVSASVRSPSPHLFWLGMPTLVNSMLNTNEKREKMTDLMWGEYEREVQGSGMLRQFGGPLQLVDIGSLSWTCGIKCTDDGMHYDGVVYEAGVQIMLNALLIESHQRL

SEQ ID NO: 150979 - protein, 122 aa, Glycine max
  Coding DNA Sequence Number=SeqID_34201
  Subcellular localization annotation: CTP_CleavageSite=94; ConfidenceScore=5.27e-01
MQQGQAYIPIVRFPDPNYGIKMVNYKKLPSPIVSSPLVPLYVTQRSLSFMLVSPNTSLYMPNSRKFNIDFINKVMTNIQSQIPLSKWFFKGSVKTSNDGPQVRKDVKIGLNYQGAGLESQLP

SEQ ID NO: 150980 - protein, 227 aa, Glycine max
  Coding DNA Sequence Number=SeqID_34202
  Gene Ontology: Cellular component=cytoplasm; Biological process =autophagy
  Homolog annotation: Hit_ID=Q3MQ10; Match level="QueryCoverage=84%, HitCoverage=55%, E-value=1e-98, Identity=91%"; Hit description =Autophagy protein 5
  Pfam annotation: Domain name=APG5; Domain location=2-219; Score=80.5; E_value=5.2e-21; Accession=PF04106.3; Description=Autophagy protein Apg5
MSKPLLLNFLSVDISFVQFHLCYGPVISVGVKGVGNFETYRRVASKLKLGTFEDEYMENVSSVLVKSSQSTGDTDVTGQLKTGRIPVRLYLWTVNEEFDDFEDAPQIDNWDKVSYINRPVEIYKEDGKYFSLNDAVKRILPEFFLENSFVTDGDANINQSGEEGESSSDPGSCCNTLEIAEIKLVRIQGIEPILDIPFSWVVNNLMNPEYFLHMCVCLKVSKANAVQ

SEQ ID NO: 150981 - protein, 221 aa, Glycine max
  Coding DNA Sequence Number=SeqID_34203
  Gene Ontology: Mol. function=transferase activity; Cellular component= cytoplasm; Biological process=auxin mediated signaling pathway
  Homolog annotation: Hit_ID=Q8H1Y6; Match level="QueryCoverage=99%, HitCoverage=100%, E-value=1e-109, Identity=87%"; Hit description =Glutathione-S-transferse-like protein
  Pfam annotation: Domain name=GST_C; Domain location=99-195; Score =50.9; E_value=4.3e-12; Accession=PF00043.15; Description=Glutathione S-transferase, C-terminal domain
  Pfam annotation: Domain name=GST_N; Domain location=5-79; Score=65.5; E_value=1.7e-16; Accession=PF02798.10; Description=Glutathione S -transferase, N-terminal domain
  Pfam module annotation: Pfam domain module=GST_C::GST_N; Domain location=99-195::5-79
MSKGDKVEVLDFWASPFCARVKVALEEKGVNYVASEEDLFGGKSELLLKSNPIHQKVPVLLHNDKPLAESSIIVSYIDEVWSSNPLLPTLAYDRAQARFWTDYIDKKVFETGRSIWGSNGEEREVGTRDFIEVLKHLEEALGEKDYFGGDAFGYVDIIAIGHSAWFLAYEKLGGFKVEDHSPKISAWIKRSLQRESVAKVLPDPEKVYQFVLHFRKMLGLE

SEQ ID NO: 150982 - protein, 650 aa, Glycine max
  Coding DNA Sequence Number=SeqID_34204
  Gene Ontology: Mol. function=DNA binding; Cellular component=nucleus; Biological process=regulation of transcription
  Homolog annotation: Hit_ID=Q9FFI5; Match level="QueryCoverage=84%, HitCoverage=92%, E-value=1e-91, Identity=40%"; Hit description=NAM (No apical meristem)-like protein
  Pfam annotation: Domain name=NAM; Domain location=5-133; Score=320.9; E_value=2.3e-93; Accession=PF02365.6; Description=No apical meristem (NAM) protein
MAPVLPPGFRFHPTDEELVAYYLKRKINGRKIELEIIPEVDLYKCEPWDLPGKSLLPGKDLEWYFYSPRDRKYPNGSRTNRATKSGYWKATGKDRKVNSQARAVGMKKTLVYYRGRAPHGSRTNWVMHEYRLDERECETNSGLQDSYALCRVVKKTAVIPPKVGEHHYVNVPNANQITSDHSSSIEIYPEGRGEDLDSTNYFMPVDACSPHNMGNETSLTINSGIMTRDHEKWSHFSSQDPLFSLPTSSFSKFGAIAYPPSKVDIALEYARMQHRFVLPPLEVDDFPQVGISELKMTQASGSMQGSRTETDILQEILSVAQVSQELINQSNYSQEWGGNNDNYAPREDDFTFMVGTNYNHSNHGMSSMRYADKTWEDANTRTIEIGDVDEEFKAERMVENLRWVGMSSEDLQKSDQLDVQMEEQKIVPIEDISSFQTNEVQESEQHSNKEHNDDTEINDFSLGFINDNDGPNENFIEDGNIDDYSSSPSFEVVEEIKVNHGMLVSTHQVVETFFHQIVPSQTVQVHLINSVMAHNNHYVENAEAMLMIMENKGSSLRNKVKAYVMGKLIKPSKTIASAIVFVFALVLMHCVYLKEEVEIWNESNNEVNWFVGVKSHEKELSAVLKKIGIFLTISLAFCTMWASQNMVVNP

SEQ ID NO: 150983 - protein, 882 aa, Glycine max
  Coding DNA Sequence Number=SeqID_34205
  Gene Ontology: Mol. function=sucrose synthase activity; Biological process=sucrose metabolic process
  Homolog annotation: Hit_ID=Q9FX32; Match level="QueryCoverage=92%, HitCoverage=86%, E-value=0.0, Identity=71%"; Hit description=Sucrose synthase, putative
  Pfam annotation: Domain name=Glycos_transf_1; Domain location=564 -754; Score=83.3; E_value=7.3e-22; Accession=PF00534.10; Description =Glycosyl transferases group 1
  Pfam annotation: Domain name=Sucrose_synth; Domain location=8-561; Score=883.9; E_value=7.3e-263; Accession=PF00862.10; Description =Sucrose synthase
  Pfam module annotation: Pfam domain module=Glycos_transf_1::Sucrose _synth; Domain location=564-754::8-561
MASAPALKRTDSVVDNMPDALRQSRYHMKRCFAKYLEKGRRIMKLHHLMEEMELVIDDKSERSQVLEGILGFILSSTQEAVVDPPYVAFAIRPNPGVWEFVKVSSEDLSVEAITPTDYLKFKERVHDEKWATDENSFEADFGAFDSQIPLLTLSSSIGNGLEFTSKFLTSKLTGKLEKTQAIVDYLLTLNHQGESLMINDSLNSAAKLQMALVVADAFLSGLSKDTAYQNFELRFKEWGFERGWGDTAGRVKETMRTLSEVLQAPDPMNLEKFLSNLPIIFNVVIFSVHGYFGQADVLGLPDTGGQVVYILDQVKSLEAELLLRIRQQGLNVKPQILVVTRLIPDARGTKCHHELEPISDTKHSHILRVPFQTDKGILRQWISRFDIYPYLERFTQACIDATAKILEFMEGKPDLVIGNYTDGNLVASLMARKLGITQGTIAHALEKTKYEDSDVKWKELDPKYHFSCQFMADTVAMNASDFIITSTYQEIAGSKDRPGQYESHAAFTLPGLCRVVSGINVFDPKFNIVAPGADQSVYFPYTEKEKRLSQFHPAIEDLLFSKVDNIEHIGYLADRRKPIIFSMARLDVVKNLSGLVEWYGKNKRLRNLVNLVIVGGFFDPSKSKDREEMAEIKKMHDLIDKYQLKGQFRWIAAQTNRYRNGELYRCIADTRGAFVQPALYEAFGLTVIEAMNCGLPTFATNQGGPAEIIVDGVSGFHIDPLNGEESSNKIADFFEKCKVNQSQWNVISEAGLQRINECYTWKIYANKMVNMGNIYTFWRQVNKEQKEAKQRYIQMFYNLIFKNLVKTVPAPSDEPQQPVGKQPSLKSRSTGMHLCAVKKMVFHLIHANIFFLFPSWFAESDVHSPDCKGYLEINISTMKQVN

SEQ ID NO: 150984 - protein, 162 aa, Glycine max
  Coding DNA Sequence Number=SeqID_34206
  Gene Ontology: Mol. function=heme transporter activity; Cellular component=membrane; Biological process=cytochrome c oxidase complex assembly
  Homolog annotation: Hit_ID=Q1MJC7; Match level="QueryCoverage=100%, HitCoverage=24%, E-value=4e-69, Identity=79%"; Hit description =Putative cytochrome c-type biogenesis protein precursor
MIIEIGHYVLVLALATAIILSVVPVIGARRRDQAMMDVAPLGSIVLFGLVAFSFGVLTYAHVVSDFSVENVWENSHSLVPLIYKYSGVWGNHEGSMMLWLLILALFSAMVALFGRNLPDTLRANVLAVQAWVSVAFILFILLTSNPFVRLDPAPAEGRDLNP

SEQ ID NO: 150985 - protein, 132 aa, Glycine max
  Coding DNA Sequence Number=SeqID_34207
MEGRLLIGSLARRKEESGLYLHAKDVQMFPGWEHGDRELRGSSNGIIGGYHKWLRVRTQGLDWLPNLKTVGDNEVKASEESDEVQALKAKLERARVVKEKFKAAIVSSNSEEVKGIITGQRHDLEGRAKGLP

SEQ ID NO: 150986 - protein, 122 aa, Glycine max
  Coding DNA Sequence Number=SeqID_34208
MGAEDDVSLCVLSGFSSYRHQKKVYTDNHSGISASKRNVYTDNHSGISARQRDSNVSMIDLVSADDDVNLGVLMGLSAAIDKGRRRRDNHLGISARQRDYNVNMTDLVSAEDDINLRVSPSL

SEQ ID NO: 150987 - protein, 158 aa, Glycine max
  Coding DNA Sequence Number=SeqID_34209
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=91%, HitCoverage=27%, E-value=1e-64, Identity=66%"; Hit description =Photosystem I P700 chlorophyll a apoprotein A1
VSFVCVVWKEEDSMIIRSPEPEVKILVDRDPIKTSFEEWAKPAILMILRRFPRKVFSAHFGQLSIIFLWLSGMYFHGARFSNYEAWLSDPTHIRPSAQIWRASGITSELQLYCTAIGALVFAALMLFAGWFHYHKAAPKLAWFQDVESMLNHHLTGLL

SEQ ID NO: 150988 - protein, 451 aa, Glycine max
  Coding DNA Sequence Number=SeqID_34210
  Gene Ontology: Mol. function=transferase activity; Cellular component= integral to membrane; Biological process=transport
  Homolog annotation: Hit_ID=Q7VUT6; Match level="QueryCoverage=78%, HitCoverage=94%, E-value=1e-170, Identity=80%"; Hit description =Hypothetical protein dltB
  Subcellular localization annotation: CTP_CleavageSite=37; ConfidenceScore=5.78e-01
MATGTSGAAPCSRAWAAQASASSRSCAQVRLRSAPTTASASGARAESMNWKVFRSKRMPKLPASDGAAAAEHVERQGGQDQGEHASEETHDGPRQRGLQRRPGAGGVDQQVVTDRIGAEHQAADDVVHRQPVPYAHGQQRGEDADVLRRQTVAREERGLAQRLVDRHEHDVAQPFGQADVPAAPEVLGIQRRQRVAEVDRQGEAEQHADADGHGGIAGEIEEQVGAVERGVQRHAGERIIVGVQGRQAVAPDQLGQAELLDHAQHDQFQAGQPGVQVDAFIAALEVGLEIAPAVHRAGQQRQGEEQVDEVVQWRHALVARREQQHVDGAEGGERQAQHRAQVRHARLDQQQRRHGDDNGQPGRDVVAAHGPQRAARDGQQRDGLVGTRPEHRHPHAQADHADDVAITDAQRHADRTVCQQAQPAEQGAAEKAQTCEQFHAAVRTVDIGIRP

SEQ ID NO: 150989 - protein, 60 aa, Glycine max
  Coding DNA Sequence Number=SeqID_34211
MTMLVVIEVMKVVVIVVTIDSDNKGDIVGSGSDNNDNGDNDIGVKVMVTMLMIDSCYARK

SEQ ID NO: 150990 - protein, 73 aa, Glycine max
  Coding DNA Sequence Number=SeqID_34212
DRTLAFLHRLGLALMMGRLVVLLPPYLIKGLSSRLEDQDANYMLIKSKMESFSGHPHLNSLDKKANCLLAGSE

SEQ ID NO: 150991 - protein, 100 aa, Glycine max
  Coding DNA Sequence Number=SeqID_34213
MGKRLNRLIKVFDRKDSIPRILEQEIGEKDVGGATLPAADNLKLPPARDPFRHRPRAGMPVFAGDDEVPALGNAVDELPDAPCIIRQRRPPRPSSVVAGE

SEQ ID NO: 150992 - protein, 212 aa, Glycine max
  Coding DNA Sequence Number=SeqID_34214
  Gene Ontology: Mol. function=oxidoreductase activity, acting on NADH or NADPH, NAD or NADP as acceptor; Biological process=electron transport
  Homolog annotation: Hit_ID=Q8UG34; Match level="QueryCoverage=86%, HitCoverage=89%, E-value=5e-78, Identity=80%"; Hit description=FMN -dependent NADH-azoreductase
  Pfam annotation: Domain name=FMN_red; Domain location=11-210; Score= -42.3; E_value=0.058; Accession=PF03358.6; Description=NADPH -dependent FMN reductase
  Pfam annotation: Domain name=Flavodoxin_2; Domain location=9-210; Score=179.9; E_value=6.3e-51; Accession=PF02525.7; Description =Flavodoxin-like fold
  Pfam module annotation: Pfam domain module=FMN_red::Flavodoxin_2; Domain location=11-210::9-210
MEAEEISMSSILLVTSSPRGSESLSSQIAVELAGKIKASRPEAEVIHRDLGAAPIPHLDSVTTSAIRKAPEDRTPEEAAAAAISDGLVAELLAADTVILSTGLINFNIYSGLKSWIDNVARAGQTFKYTETGPVGLATGKKVYIVLAAAGVYSEGPAVSMNHAVPYLKTVLGFMGMTDVEVIYVEGLAFGPEAVEKAVAAAEAKVEELAQAA

SEQ ID NO: 150993 - protein, 116 aa, Glycine max
  Coding DNA Sequence Number=SeqID_34215
MVGYTPSSFDDMVFTDERIKGEDEGEARAVTAIPIQPSPLGPSRRFLQKAVASGGSNLARLGELGGNHLPYFAINRGGTEALSKRFRNVFRKEFRKGFNRSSTFFIRSSSFFDLQR

SEQ ID NO: 150994 - protein, 169 aa, Glycine max
  Coding DNA Sequence Number=SeqID_34216
MVGKGDKATLDTDRIDVARLLIKVKINKHVNAIWTLEESPTQVQKCGCWRWCERSSASGEDSLESVIGLEINSSNSDNGEVDNDSTKDELEGEKTQVANHDERRMTTIIEASEWCFKEKSHQLFQNISGQKECPVEKENIVINPQTPKRDQNDQVDKHVFLVEWGGTGS

SEQ ID NO: 150995 - protein, 172 aa, Glycine max
  Coding DNA Sequence Number=SeqID_34217
  Homolog annotation: Hit_ID=Q1RXS1; Match level="QueryCoverage=56%, HitCoverage=23%, E-value=2e-07, Identity=31%"; Hit description=Zinc finger, CCHC-type; Peptidase aspartic, catalytic
  Pfam annotation: Domain name=zf-CCHC; Domain location=93-110; Score =22.8; E_value=0.00017; Accession=PF00098.13; Description=Zinc knuckle
MREKERKPQEANINLRYFHGKDNIEANLDWEIRVEQKIKRKSTLKSYGSHSYPKKDQGLGILGAAPSKPKDDKAKTIEKQPPKASMQEKTISIKCFKCLGRGHITSQCPTKKTMILRGQDIYSSQDEATTSPSSSEREEAKWEESSEEIYPQEEGQPLMVKEECKEVIVSSK

SEQ ID NO: 150996 - protein, 142 aa, Glycine max
  Coding DNA Sequence Number=SeqID_34218
MDVTIAKLFRRCSGISSSKSLLKIQLQKTPITTNGYTIPDGNTYDGKVVSKDKPRTLAHELGHKASLPHIFDTESTVDNTKANENNLMNSGENNKVELRNSSGTDLTSSQSTSMQNHIKIISENRDRKEKEQQKSNQNQNGN

SEQ ID NO: 150997 - protein, 77 aa, Glycine max
  Coding DNA Sequence Number=SeqID_34219
IFQENFIAKCSLKNSWANTCKSIKSSSMDLHFVRIPEHKGWVIPVWFRSCKWIFTKIVEISSGLLEYWTQARVVVEP

SEQ ID NO: 150998 - protein, 95 aa, Glycine max
  Coding DNA Sequence Number=SeqID_34220
MAKIQGPKEGKTYSNIYKEKWIQPWPMGSEIYPEDHENTKAFFSSSSPILLDSSIQYPWGVPPLVLLTNATLSPTREILEPTFATSTLTRDNSRF

SEQ ID NO: 150999 - protein, 164 aa, Glycine max
  Coding DNA Sequence Number=SeqID_34221
KHKGYVSGSLSDEGKVELGGDSGKSESSLEKGLVDRSDASDVDAKVDNMARCFRTNQRILVLSAAKVAKKMKLKFTKEWIAYLRLPLPIDVYKEILKTTFTIIADHEMKCLLLLICGTHSTKDTLTAVTGNAEVTITKLNEERRRNTQEKDLLLRQEELNNLLF

SEQ ID NO: 151000 - protein, 97 aa, Glycine max
  Coding DNA Sequence Number=SeqID_34222
MATYGLQVKNAAGAIIVRVTDKLPRRLGELVTGRSNGSVPIPEFSGREPWFSWEMLEDGSVLSIPEIDVSGITLFWSFDAVPAVYRRSVKIHYGVIG

SEQ ID NO: 151001 - protein, 216 aa, Glycine max
  Coding DNA Sequence Number=SeqID_34223
  Gene Ontology: Mol. function=hydrolase activity; Cellular component =extracellular region; Biological process=carbohydrate metabolic process
  Homolog annotation: Hit_ID=Q4KA88; Match level="QueryCoverage=99%, HitCoverage=20%, E-value=3e-41, Identity=44%"; Hit description=Host specificity protein J, truncation
  Pfam annotation: Domain name=DUF1983; Domain location=110-193; Score =92.7; E_value=1.1e-24; Accession=PF09327.1; Description=Domain of unknown function (DUF1983)
LDWGLPPGPSIIERTEIYYSQNSSFEAAIPLGVFAYPQNTHTLLGLRAGQELWFWARLVDKNGVAGEWYPAATGIGVRGQASSDAGPILDQIGGKIEKSMLGQDLITEIESGGGAATEIKEVKDGLNAMVSIKAQSTGPDGKLYAAGMGVGVENTPEGMQTQVLFLADRLALINLANGVVSTPFAIQNGQTFISQAFIQDGTITSAKIGEYIQSNN

SEQ ID NO: 151002 - protein, 149 aa, Glycine max
  Coding DNA Sequence Number=SeqID_34224
MTQELVARGDTLRLSAPRHSVTPSVIDEQRPMWSSAPFTEMSASSGGDFFKSHKLSRTTGGGPDDMRRQNLVIPHPFAIQTQSCPMARRDKIWSFCTLCHPEAAGPMTCRDKIWSFRTPLPFRHSRVRWHAEKKFGHSAPFVIQRRRAR

SEQ ID NO: 151003 - protein, 79 aa, Glycine max
  Coding DNA Sequence Number=SeqID_34225
MNSAPFIIQEQQAEWINAHRQIMHPLSFRNNKLGDFANWVINAQRQILCPLSLRNNKLGGKRAETNSAPFIIQEQRVEW

SEQ ID NO: 151004 - protein, 277 aa, Glycine max
  Coding DNA Sequence Number=SeqID_34226
MTTLAQTWRVLSYSNLVPTSHTSDITLDRAKLIYGIIMKMNMNLGYLISHHIFIITQHDSSRLGFLALITTLCKAREVTSDSRSLESLSPAINLAYIKKNCWNLDDPTVTFREPRKARGKRSKAPLASVTPNAYAPSSSTLPDPTAPSTSTPHLPQLPTSAPTPLPVPVPAPAPPTGPSSFTSKTLFAMLQSLHRGQIIIIQRLQSFGQQPAMSVEEFLALVAWPGGQPPPSGMGKASAAQEPMPVEEPLPDVEDEPVPPEPFIFETNPSVQEEAAA

SEQ ID NO: 151005 - protein, 240 aa, Glycine max
  Coding DNA Sequence Number=SeqID_34227
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=3e-30, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GPHALTIRGLHVLAFRGLHALIFRGLNVLIFRRLHALAFRGPNILIFRGLDFLAFRGLHVLTFGGLYVLTFRGLHVLALTFRGLHVLAFRGLHVLAFRGLHVLTFRGLHVLAFRGLHVLTFRGLHVLTFRGLYLLIFRGLHVLAFRGLHTLTFGGLHVLTFRGLHPLIFTGLHVLTFRGRHAPPSKGYTPSPSKDCTSSPSKGCMPSPSEDYTSSPSEGYTFSPVEGYTLSPSVGSTSAP

SEQ ID NO: 151006 - protein, 60 aa, Glycine max
  Coding DNA Sequence Number=SeqID_34228
VVILVRMIHTRLFAAAQVKSCPGMHSSCVIASLSGCARIVGPSLGSGGGPGVDKRKLLAP

SEQ ID NO: 151007 - protein, 122 aa, Glycine max
  Coding DNA Sequence Number=SeqID_34229
SASNFSPFELATGQQPLTPHTIAAGGGLPISLLFCQDVAGAQRPSPNLLKLKAWPGLKEEESRPCREADRRDRPREERAQPTRAPPDVGQPESEASWERAETDDSKTKSETTGRLAERLSTR

SEQ ID NO: 151008 - protein, 52 aa, Glycine max
  Coding DNA Sequence Number=SeqID_34230
MSMKNLFERLGVHDKTDHTLVSQVTLTRIGTYLNEHSNQEYLPPRPRLRRVQ

SEQ ID NO: 151009 - protein, 85 aa, Glycine max
  Coding DNA Sequence Number=SeqID_34231
LVKEILQDSGTLKAGCLGTGRRHKGVAEPEEPTDLRSNPLQGGGDDTVLPMKGSVTRAMSKRLQEDWARAAKEGPRVLMNLRIDF

SEQ ID NO: 151010 - protein, 99 aa, Glycine max
  Coding DNA Sequence Number=SeqID_34232
MLEEKFVTIIDVSSNEEKVHYKTWERPIRLSLMLMRMTVADSIKTTLPKLRHFQKDCLKCKSWFEKNGELNTHRFLTIQTICPNEKFIFIGNEVKAPVE

SEQ ID NO: 151011 - protein, 69 aa, Glycine max
  Coding DNA Sequence Number=SeqID_34233
MIQNTETYIHKETHFRCRSLEEIKNYEKYGSLPRCHKVKIQDKEESNDKTRSEKEFTDNYKLMNTTESD

SEQ ID NO: 151012 - protein, 188 aa, Glycine max
  Coding DNA Sequence Number=SeqID_34234
  Homolog annotation: Hit_ID=Q84MH2; Match level="QueryCoverage=24%, HitCoverage=16%, E-value=9e-12, Identity=69%"; Hit description =Putative inosine-uridine preferring nucleoside hydrolase
RVILGGAFVVNGNVNPTVEVNAADVVFTSGVDVLAVGINVTHQVVLTGSSAASEFDSHRFRCVEHQQRFETIKGWSFHRERRVQLREDEYPNFQGEISRRHWARPVTPMAKFDPEIVIEFNANAWPTEEGVRDIAHGQFLGDPLILKEDQQCEFSQRRSQADSFGEEVIAQLLCIPGQDFARTAAGRR

SEQ ID NO: 151013 - protein, 59 aa, Glycine max
  Coding DNA Sequence Number=SeqID_34235
MTFVKSPDHHGAWFQSPIMSSSLDGNLLEAFYGVVLGHMGLVQNFNYQCSVRLGTHEQF

SEQ ID NO: 151014 - protein, 90 aa, Glycine max
  Coding DNA Sequence Number=SeqID_34236
  Gene Ontology: Mol. function=RNA binding
  Homolog annotation: Hit_ID=Q2HS79; Match level="QueryCoverage=92%, HitCoverage=17%, E-value=7e-12, Identity=45%"; Hit description =Cyclin-like F-box; Agenet
  Subcellular localization annotation: CTP_CleavageSite=77; ConfidenceScore=5.71e-01
MEPKLSFSNRALQCTSSSTAAHGFPAPSLTALTPTDSWSSTVVIRLRAQLLVFTSSDYFLHRRATGNSSRATRWWCSTTTAGGMAMSPQI

SEQ ID NO: 151015 - protein, 68 aa, Glycine max
  Coding DNA Sequence Number=SeqID_34237
ELATYPFNDFGTGRSQTGMCIIDIGDLSIEKIHRPETKRKKDSNNHLIWEKAIFFSTMSLSFDPIALR

SEQ ID NO: 151016 - protein, 155 aa, Glycine max
  Coding DNA Sequence Number=SeqID_34238
MGTRGCISYNPVLAIRQLGYPMRGAPLEEELAPIIAQGFNKTNVEALKKVRKAWEMVQKKDKELRGSNNGPIGGYRKWLKAHMQGLDWLPSLRTTKGEEVEAPEQDEEVQALRAELEQAQTVKERFNSAALKIRKENVELRDVNVATTKALEQET

SEQ ID NO: 151017 - protein, 113 aa, Glycine max
  Coding DNA Sequence Number=SeqID_34239
  Subcellular localization annotation: CTP_CleavageSite=66; ConfidenceScore=5.48e-01
MRGYLMVTRTFGQPVANKPVDAQRLTSSAAPFVVLTREVSRTFHQPGGNEPVDARRLTSSSAPFVVLTREVSDLRCYLMVTRTVGQPVANKPVDAQRLTSSAAPFVVLTREVR

SEQ ID NO: 151018 - protein, 225 aa, Glycine max
  Coding DNA Sequence Number=SeqID_34240
  Gene Ontology: Mol. function=transition metal ion binding; Cellular component=cytoplasm; Biological process=electron transport
MGDRLEDMICDLAQESFQQAHVPMYHTFQIDSKKPLYLGCNKSLTLLSAVLSLVNVKAKYGWSDKSFKSLLQVGHDMLPKENMLPKSYYQANKILCPMGMEYQKIRACPNDCILYRHELEEMHKCPRCGVSQYKVMDDDECSSDKNLKKAPLAKVLWYLSIIPRFKYLFANGDDAKDLTWHADGETATECSAIQLIHPSERKLIVCIQISPKRQEILGLDLPLME

SEQ ID NO: 151019 - protein, 125 aa, Glycine max
  Coding DNA Sequence Number=SeqID_34241
  Homolog annotation: Hit_ID=Q1T2D5; Match level="QueryCoverage=63%, HitCoverage=5%, E-value=6e-15, Identity=49%"; Hit description=Chromo
MADNTRMKELTGDVKRILKMMENRNKEYAARFETLETTLEMTLKDKTRDPGSISLAMNNHPFKVVPWYQMMTRENSFKTWIAFMRALETEFGPSPCECPRSQLFKLTQIGSVQSYYVQFTALANR

SEQ ID NO: 151020 - protein, 150 aa, Glycine max
  Coding DNA Sequence Number=SeqID_34242
MQSFCCEIVQQNFAQVQKNACVWLAVESLVQNEFWMFASISQRSKCRLIHYRLPVKFWESIQRLTNWIEGIVTVLVLFERCFAWMLWKLERIDGDPVLRENEEMGYVEYVSSVGSWATGDGGFMRALWMWESLLCTIARPPASTTCDGTP

SEQ ID NO: 151021 - protein, 136 aa, Glycine max
  Coding DNA Sequence Number=SeqID_34243
MASRKRARTDGIPSSSIPAPQSVAIGPNQVAWPEAQLPLVRPNEVAPPEPAPARVEPMPAEPRSLVGNPPPSLELEVVPPSPPLIIISDASSDETAAPPDSPAGETANPPDSPVGGIADLSDSSSAEVVALTDSPV

SEQ ID NO: 151022 - protein, 72 aa, Glycine max
  Coding DNA Sequence Number=SeqID_34244
MELWNRARGFAEEAAKRSQVKCNDDDTELSDVPAVSNVRQDLTEWQEKHARLVLSTVKGMGAFINVNGLHST

SEQ ID NO: 151023 - protein, 387 aa, Glycine max
  Coding DNA Sequence Number=SeqID_34245
  Gene Ontology: Mol. function=zinc ion binding; Cellular component =nucleus; Biological process=regulation of transcription
  Homolog annotation: Hit_ID=Q0GLE8; Match level="QueryCoverage=73%, HitCoverage=95%, E-value=1e-124, Identity=76%"; Hit description=Dof4
  Pfam annotation: Domain name=zf-Dof; Domain location=76-138; Score =139.8; E_value=7.6e-39; Accession=PF02701.6; Description=Dof domain, zinc finger
MGSAVKVVTAMLKGSLGIFVSHSLSCSLNNNDALTDINTSFRCYLIHQMQQIHSMPGGRFFSGSGSADRRLRPHHQNQQALKCPRCDSLNTKFCYYNNYNLSQPRHFCKNCRRYWTKGGVLRNVPVGGGCRKSKRSSKPNKITPSETASPPPPPHPDHNNNSNSHSSSESSSLTAAAATTTEAVSAPETLNSDSNNNNNMQESKLLIPALETNNSLEQGTGDCGGIFSEIGPFTSLITTTTSTNEPLGSGFGFGNSTLPDASSFQWHYQKVSSNNEELKLPENSFLDHTVDLSGMHSKTSHGGGFGSLDWQGGADQGLFDLPNTVDHAYWSHTHCDELHARWIMILESACGRGRVMNAKKVGTDAHHAADCVALHHLKVTVVNIHDA

SEQ ID NO: 151024 - protein, 214 aa, Glycine max
  Coding DNA Sequence Number=SeqID_34246
  Gene Ontology: Mol. function=inorganic phosphate transporter activity; Cellular component=membrane; Biological process=phosphate transport
  Homolog annotation: Hit_ID=Q8GTR3; Match level="QueryCoverage=82%, HitCoverage=33%, E-value=8e-59, Identity=65%"; Hit description =Phosphate transporter PHT2-1
  Pfam annotation: Domain name=PHO4; Domain location=98-208; Score= -128.5; E_value=5.4e-05; Accession=PF01384.11; Description=Phosphate transporter family
FRNIKLSYPFATLSSFAEGEQQENQEGTETPPSNDELGGIAKAFNISSRTASAISICMALAVLTFPLFMTSLGQGMVLKTKVLSYATLLFGFYMAWNIGANDVANAMGTSVGSGALTLRQAVLTAAVLEFSGALMMGTHVTSTMQKGILVANVFNGKDSLLFAGLLSSLAAAGTWLQGAVGGDFCLPSSTPKSHNHSRPRKPTDYKFAPAPTPD

SEQ ID NO: 151025 - protein, 231 aa, Glycine max
  Coding DNA Sequence Number=SeqID_34247
MLKRVVHSLDLVEQKEKDSRRKNRLRGREAPPTKDFVRGPDVFKFPHQSVFWHEDVPVPGHKYILISFRDVDKLKSKLLEEERSKEANGVVLETKTRSPSGHKDKVKVSNGVAGHEALETMITSGNGKMKEPNGVAGQEISVSLSPKDKVKSVEMVDTDMEGSLGEGGVEESFFSAKDFYAPKEKSTSTRPSRRKGLKGKKPFVAPLPKAKKLYRSLGWQPSLPTVKEPSP

SEQ ID NO: 151026 - protein, 320 aa, Glycine max
  Coding DNA Sequence Number=SeqID_34248
  Gene Ontology: Mol. function=inorganic phosphate transporter activity; Cellular component=membrane; Biological process=phosphate transport
  Homolog annotation: Hit_ID=Q8GTR3; Match level="QueryCoverage=99%, HitCoverage=54%, E-value=1e-135, Identity=77%"; Hit description =Phosphate transporter PHT2-1
  Pfam annotation: Domain name=PHO4; Domain location=1-305; Score =260.1; E_value=4.4e-75; Accession=PF01384.11; Description=Phosphate transporter family
  Subcellular localization annotation: CTP_CleavageSite=57; ConfidenceScore=5.16e-01
MVGFGLAYGGAGAVFWGSLARVISSWVVSPLMGAAVSFLVYKCIRRFVYSAPNPGLAAAAAAPIAVFLGVTGISFVAFPLSKSFPFALVQALASGTVGAFLVDRIIRKQLGHLLVKSSTPEPEPKEDTVHHHNIGFLDDVAGPKGAQLEIVYGVFGYMQVLSACFMSFAHGGNDVSNAIGPLAGALAILQGSTMGTEIIIPTDVLAWGGFGIVAGLMMWGYRVIATIGKKITELTPTRGFAAEFAAASVVLFASKLGLPISATHTLVGAVMGVGFARGFNSVRSETVKEIVASWVVTIPVGASLSVLYTWILTKILSYIL

SEQ ID NO: 151027 - protein, 213 aa, Glycine max
  Coding DNA Sequence Number=SeqID_34249
  Homolog annotation: Hit_ID=Q9FJG8; Match level="QueryCoverage=99%, HitCoverage=95%, E-value=8e-16, Identity=27%"; Hit description =Arabidopsis thaliana genomic DNA, chromosome 5, P1 clone:MAE1
MAWLARSFFSVCWLPLDDHELTSSPHGTMKSLAFDKKNEKSFNSISNNDLSRPSKKIHSKERLSNNPIIKDKDDGGVPIGNKFDCSSWSLSADEDYIVFCFGKDVAQGDKSVNEVHKNSRPVNRKLKYGENEEQVRDLNIHEKISNANQHHNDDDMRRAESSNSDQSEGSRSSFAFPVLGWEWIGSPVQMPKSEGLHLRKNKARAMRFECCRF

SEQ ID NO: 151028 - protein, 122 aa, Glycine max
  Coding DNA Sequence Number=SeqID_34250
  Gene Ontology: Mol. function=asparaginase activity; Biological process=glycoprotein catabolic process
  Homolog annotation: Hit_ID=P50288; Match level="QueryCoverage=70%, HitCoverage=25%, E-value=1e-24, Identity=73%"; Hit description=L -asparaginase precursor (EC 3.5.1.1) (L-asparagine amidohydrolase) [Contains: ...
  Homolog annotation: Hit description=L-asparaginase subunit alpha; L -asparaginase subunit beta]
MKCRQLRYRDEEGNLIDDISLSVPPERRQPREEALRHCLQIGVKALKAILPSLDVVGLVDMHVRELENIPLFNAGRGSVLTWKGTVETEASIMDGGSTMNCGAVFPPHYGRQRHLSRSTGQK

SEQ ID NO: 151029 - protein, 171 aa, Glycine max
  Coding DNA Sequence Number=SeqID_34251
  Gene Ontology: Mol. function=transition metal ion binding; Cellular component=cytoplasm; Biological process=proteolysis
  Pfam annotation: Domain name=Transposase_21; Domain location=113-171; Score=-117.4; E_value=0.00014; Accession=PF02992.5; Description =Transposase family tnp2
MVLSLVNVKARYGWSDKSFTSLLQVVRDMLLEENTLPKSYYQAKKILCSMGMKHEFEEMDKCPRCGVSRYKVKDDDKCNSDKSTKKGPPAKVLWYFPIIQRFKRLFANGDDAKDLTWHADGRNYDEMLRHPANSSQWKEINHLYPDFSKETRNLWLGLVTDGMNPYGSLST

SEQ ID NO: 151030 - protein, 180 aa, Glycine max
  Coding DNA Sequence Number=SeqID_34252
  Homolog annotation: Hit_ID=Q9FML0; Match level="QueryCoverage=23%, HitCoverage=21%, E-value=5e-10, Identity=71%"; Hit description =Arabidopsis thaliana genomic DNA, chromosome 5, P1 clone:MDC12
MPKQIQLYAVNVRENKKGGEGGGFTGEGSGAREGEDAGVAAKVTELAVGKTGEDFAAVAAEEFEVVAMGGRGAHHWVFVGFSGNEWDWGIMIFMYPSLIPEATGATGDIGCWRESCLRGHAVIAVGETTDVACIPPFSLASLVTWRESRPSHWQDMHSGLQSRRPGFSEHISSLLMVRIM

SEQ ID NO: 151031 - protein, 130 aa, Glycine max
  Coding DNA Sequence Number=SeqID_34253
  Homolog annotation: Hit_ID=Q53KV7; Match level="QueryCoverage=41%, HitCoverage=25%, E-value=1e-11, Identity=63%"; Hit description=PB1 domain, putative
  Pfam annotation: Domain name=PB1; Domain location=1-59; Score=3.5; E _value=0.1; Accession=PF00564.15; Description=PB1 domain
MVKLEELCGAHVTHLRCQLPTEDLDALVSITCDEDLNNLVEEYDGAVSSLKIRAFLCSSPAPSKSSSTTSSSCSSSSSSPSSCCRTAMAAPPQLAKKSYVSLSSPRYYSHPRVQGNRGVVYLVPSGNHWH

SEQ ID NO: 151032 - protein, 215 aa, Glycine max
  Coding DNA Sequence Number=SeqID_34254
ALFTMVRGQVMIVAVVGMAINSGAIQIAYTDHQSVKAIWIANLYVLYGFSTTRTKQPPQRDKERDETLTAEKHNNTTIGLAVIGGMSDDSDNAETKPSHERRRRNQNNVAGAQSNSPVSIVLFHNGPEDGTRVDNDNYLIQPIFACPSQFPLVFASHSTITIEGNTKDTLEAWRFMNHREVHGEGRWLSGNMVWSWRFGGEATKFAWERKLKREY

SEQ ID NO: 151033 - protein, 75 aa, Glycine max
  Coding DNA Sequence Number=SeqID_34255
MACQKRKRMRCSKRLMMKSSQWGKANIAIWYVLGWGGYIYVGKKSDIITGKHCSAGALYVLKYALLTPGCLYNYY

SEQ ID NO: 151034 - protein, 55 aa, Glycine max
  Coding DNA Sequence Number=SeqID_34256
MEETQSASAEMKETESKSTSCSTAKVTRLTLFFVTEMFREEKTLLFELLFIDAKE

SEQ ID NO: 151035 - protein, 135 aa, Glycine max
  Coding DNA Sequence Number=SeqID_34257
  Homolog annotation: Hit_ID=Q6H543; Match level="QueryCoverage=37%, HitCoverage=17%, E-value=3e-09, Identity=56%"; Hit description=Auxin- responsive protein IAA7
  Subcellular localization annotation: CTP_CleavageSite=40; ConfidenceScore=5.33e-01
MEDSKGFLSFNFEGSLNVAPSSSFAVAPSSLLILHNSSTIAFAGSNKGLAAPTPSAVDLVGSDNVPDQWNFRQMVCRHWLHHLCMKAQRDSSIGGVYNKQEEEKAITRLLDGSENYTLIYEDNEGDMMLVGDVPW

SEQ ID NO: 151036 - protein, 81 aa, Glycine max
  Coding DNA Sequence Number=SeqID_34258
GCADTRTRVPKVEAFGAPYDSSTMQHQFEAIHHGFNTMQGVSVERNNQFLMNHVAAGCSNLEDFLQYPEIFNSLVARMQNA

SEQ ID NO: 151037 - protein, 78 aa, Glycine max
  Coding DNA Sequence Number=SeqID_34259
  Subcellular localization annotation: CTP_CleavageSite=50; ConfidenceScore=5.35e-01
MRRRPPPPCRRCQANAVPSTAGRGSRQRSGPRGGVGRRDSAWCRRSWRYRAARAWWWRFSWGGGRRGLCRGLEWGPFR

SEQ ID NO: 151038 - protein, 75 aa, Glycine max
  Coding DNA Sequence Number=SeqID_34260
MRYEGGGRNPRELVLLQLNSDTLSVVKWRRYGRHGGMPWRFFFWPTDIGNLGMEARYGVFIWWNLGLQPCTAIHH

SEQ ID NO: 151039 - protein, 48 aa, Glycine max
  Coding DNA Sequence Number=SeqID_34261
MIQVQQSAQPQSQTKENLKVSPTVQKEEDTHNPQSFERKTYCESESDT

SEQ ID NO: 151040 - protein, 111 aa, Glycine max
  Coding DNA Sequence Number=SeqID_34262
MEYQKIHACPNDCILYRNEFEEMRNCRTCEVSRYRVNDGECSVDAIANNWVQQRHERELRKGFQGLVVKEIERREKEEEERRGNEAEASPNRDCDQSLRCSLFGVLHATIN

SEQ ID NO: 151041 - protein, 255 aa, Glycine max
  Coding DNA Sequence Number=SeqID_34263
  Gene Ontology: Mol. function=cysteine-type peptidase activity; Cellular component=cytoplasm; Biological process=proteolysis
MRIEQFLQFAAQNALVVGRKFFCPCVKCRNGRQHSVNDIRSHLICEGIILNYTEWILHGELPDMPTVSHIEHVDVDIGDCIKDMLHDLGQECFWQADAPLYGKYKARFRWSDKSFIELFVVLKKMLPEDNALSKNHFEEKKILCPMGMKYQKIHACLNGCILYKNQFSEMHKYPTCGVSRYKVKDDECSDDATTNNGLPKKRIYIILCMMIEGPRQLGNDIDVYLSALIEDLRKLWVDKVDLFDGISSRPSGCMQ

SEQ ID NO: 151042 - protein, 103 aa, Glycine max
  Coding DNA Sequence Number=SeqID_34264
MGGGGGRSCLCTIGALKRLKTSLDGKSDQLTPQWIEVKISHLINTLIRQVSHVQNGGYECGYYVMHWMWSIFIGGFKNEWTMWFGEGTPLDMETITRNGQHTF

SEQ ID NO: 151043 - protein, 115 aa, Glycine max
  Coding DNA Sequence Number=SeqID_34265
MTRNDQHGHPHPFRHPETIKSDYMRRQIMVIHTLFVIKRQSSPIARGDNSWSPTPLSDDTPRHISLHSLRQPEASEPVDTQRPMWPSAPFVEDSMSIDRDYFSLSFLSARDNQVR

SEQ ID NO: 151044 - protein, 210 aa, Glycine max
  Coding DNA Sequence Number=SeqID_34266
MPTSSHRLSDSSPKSYSLHPDAVILFPRTRFAIITGTSDKVNAPPTNIHNIQRMKHGRHQHAHRYHIPLVKNVIFLKENQHATGPDRYSHSYLPDPNYGVKMGFSKEAQNIQWWFQSQKICKDKLKLTRNKHRITTGASFSTKTARQVWKIPLWLKGSSRCGVSTENNGGPWWPPVVVGGGEKAWDVGNGFGREKEKGMAVFQGYTKYKG

SEQ ID NO: 151045 - protein, 248 aa, Glycine max
  Coding DNA Sequence Number=SeqID_34267
  Gene Ontology: Mol. function=transferase activity, transferring glycosyl groups; Cellular component=cytoplasm; Biological process =metabolic process
  Homolog annotation: Hit_ID=Q589Y1; Match level="QueryCoverage=65%, HitCoverage=33%, E-value=3e-58, Identity=59%"; Hit description =Glycosyltransferase NTGT5b
MDSPLHIQKPHVVCVPFPAQGHVNPFMQLAKLLHCVGFHITFVNTEFNHNRFVKSHGPDFVKGLPDFKFETIPDGLPPSDKDATQDVPALCDSTRKTCYGPLKELVMKLNSSSPEMPPVSCIIADGTMGFAGRVARDLGIQEVQLWTASACGFVGYLQFEELVKRGILPFKVVATYPSAGGRCVTRGMRVPRKEYARSRHQRLFEENVGKTGKDAIYELLSERVFPFAPTYSSIAMRKSDLRSSFFIK

SEQ ID NO: 151046 - protein, 115 aa, Glycine max
  Coding DNA Sequence Number=SeqID_34268
MEINHDVRREEIAKLVKEMMMGEKGMEMRQKSLEWKKKAIRATDVGGSSYNDFYKLIKETQLDAPLDRRQILAQRTRLGDTYNVVQSPQTIGGAREEPQERAQGDFDSYSPFTYY

SEQ ID NO: 151047 - protein, 78 aa, Glycine max
  Coding DNA Sequence Number=SeqID_34269
MVVYRIQNRGTLGWTWMIGLPNFTCRLEDVPLTGRGTCKTKDFDAQARDNLFVGESGCQGSGVRAHVAGLMWKIDTCL

SEQ ID NO: 151048 - protein, 215 aa, Glycine max
  Coding DNA Sequence Number=SeqID_34270
  Gene Ontology: Mol. function=nucleic acid binding; Biological process= DNA integration
MTRSKRIQEDFKENEGSFPKATDDVLTKKDQAPRKVEVPTYGNPILNKEGKNEVLAHPLIIVQIPKYAKYLKEILSNKEKLAYFTTIGLNKKCFAIVLRKLPPKLSDPGSFSVPCTIGNLQINRALCDLGASINLMPYSVYKKLGLQEPQPTNIFLLLAYKTLTYPRGIVENLLVKVGKFIFPIDFVILDMEEDEEIQIILRQPFLYIEGVLIDL

SEQ ID NO: 151049 - protein, 660 aa, Glycine max
  Coding DNA Sequence Number=SeqID_34271
  Homolog annotation: Hit_ID=Q1SMB6; Match level="QueryCoverage=41%, HitCoverage=66%, E-value=1e-46, Identity=41%"; Hit description =Cyclin-like F-box; F-box protein interaction domain
  Pfam annotation: Domain name=FBA_1; Domain location=145-289; Score= -43.0; E_value=0.011; Accession=PF07734.3; Description=F-box associated
MTHQRLLSFTVCDPKIVSFPMHLLLQNPPTPAKPLCSSSLNDSYLILGSCNGLLCLYHIPRCYVALWNPSIRFTSKRLPTGLSPGEGFSTFHGFGYDAVNDKYKLLLAMRVLGETVTKIYTFGADSSCKVIQNLPLDPHPTERLGKFVSGTLNWIAPKMGVSDEKWVICSFDFATETSGQVVLPYGDRDNVCKPVINAVRNCLCVCFFDSRKAHWAVWLMKEYGVQDSWTKLMVIPRFVQEDSWPWKLIPHDELCTCRGFPALEPLCISGNGIALFKTTASNIVVYNSNDDAHFWQNKGLSNSRGECAIWLVIWSAVIFCVWKLRNDAIFRQESVDKKKLVEDIKFVSWSWLNSLHSDFNASFVQWSFKTAFCLQVLVLGILGNKVNGFIGARCWYVKLTFMHMESREMDPICLFGTSGGTVMMYYPFFAEQKENLEKGKRKSRCLLFVLLLGIGFWNEVRRRSNSVTVVAAHRIGYASSKVAFSWRFLLDRIQTKKNLRKRKMGKVDGLNCLFCQQAEEFAEHLMFSCKFSYQVWKECYSWIGVKVVLPKDPKSHFWHHSGFIARKKAWWVVWLANKSSSDSAAYSLGEKQKPRGMHLTRTHQQRTTYTQIKGKEEKKYILNQGPIPGGFKFSYTNRPLPCAPSPSLSCSRAELLFLLV

SEQ ID NO: 151050 - protein, 167 aa, Glycine max
  Coding DNA Sequence Number=SeqID_34272
MFALKRDQLAEHQSVVISANESQEISIEHRELRDFQHIMTILCGQALGIVEDEWDEEEYDVDDFDPEYVLLSLLDNYFSSSLPGFAHFRPKLGQVCILQRDRETPSRIVRRHSMDRSMIPSVVKDSIGGGSLNHKGLIAACLLEMYPTNKVLSVVKMTKKKEGKGLI

SEQ ID NO: 151051 - protein, 184 aa, Glycine max
  Coding DNA Sequence Number=SeqID_34273
MEGNEETLELCNWIIDIHGDAIHIKNFIMNHNIREDDTGKANFMKEKIVNDDWWDKMWDFMIEKVKLEIYKKKKLPHSENCPFYDADVGGDAFDSMEDVEFLEFVELSVGSSGLRIIKKESKDPQGMYPPLFSLNNLVDVPSTRTDPQEMYPLLFSVTTTQVDVPSTCTTKDVPSNVLRQSSQA

SEQ ID NO: 151052 - protein, 100 aa, Glycine max
  Coding DNA Sequence Number=SeqID_34274
MGNTPLDEAQMCGNKNLIKLLEDATSAQWNITWTLYKLMVVNSFTVAATYKLLEGLQQSEQEGQQSANLFSKFWCAKVPTKVLVFSWKLLQDRLPTAQAL

SEQ ID NO: 151053 - protein, 105 aa, Glycine max
  Coding DNA Sequence Number=SeqID_34275
MSPLMVSGADKDVERCCMISGRGSGVSMGGVVGMGAAGGDDCIGEEDEEECGGVVVVIEWSARWHQMLILVPSTGPTREASNNGFWKYPNRKIYSSRQNILIVQC

SEQ ID NO: 151054 - protein, 60 aa, Glycine max
  Coding DNA Sequence Number=SeqID_34276
MARIGSLDPYSWKGRTSRSKIATIICWSIRRPRNEKKWNNKETDCKAIVDIFQNNSLTYW

SEQ ID NO: 151055 - protein, 348 aa, Glycine max
  Coding DNA Sequence Number=SeqID_34277
  Gene Ontology: Mol. function=signal transducer activity; Cellular component=membrane; Biological process=response to light stimulus
  Homolog annotation: Hit_ID=Q1SI22; Match level="QueryCoverage=100%, HitCoverage=52%, E-value=1e-66, Identity=42%"; Hit description =BTB/POZ; NPH3
  Pfam annotation: Domain name=NPH3; Domain location=217-348; Score= -26.1; E_value=8.2e-09; Accession=PF03000.5; Description=NPH3 family
MKFMKLGSRSDTFYTAESMINGLMCISFRTISSEVSSDFIIQVKGTRYLLHKFPLLSKCFRLQRLCSESSDSPQHQIVQLPDFPGGVETFELCAKFCYGITITLSAYNIVAARCAAEYLQMTEDVEKGNLIYKLDVFFNSCILNGWKDSIVTLQTTKALPLWSEDLAISSRCIEAIASKALSHPSKVSLSHSHSRRVRDDVSSCTGSESLRHKSTSRGWWAEDLADLSIDLYWRTMIAIKSGGKTPSNLIGDALKIYASRWLPNIRKNVHHVKREKTESDSDSDSASEVNSKHRLLLESIVSLLPAEKGAVSCSFLLKLLKAANILNASSSSKVELATRVGLQLEEAA

SEQ ID NO: 151056 - protein, 67 aa, Glycine max
  Coding DNA Sequence Number=SeqID_34278
MVQLGNRLKRVDDYGGSKTWGSLVLKVFLLGESMHGGQIAGLIGVGTVKTIMWKRLTLEGKIVGIQG

SEQ ID NO: 151057 - protein, 87 aa, Glycine max
  Coding DNA Sequence Number=SeqID_34279
MDTSPLRKEDAKTHNQGQDCKHMQHKIGPTMHLKKEKGVRRRREGGGRLQKCGGERKGMGCRKMREGSWVIWLDFGKGMGVGIPFVV

SEQ ID NO: 151058 - protein, 221 aa, Glycine max
  Coding DNA Sequence Number=SeqID_34280
  Gene Ontology: Mol. function=ribonuclease H activity
  Homolog annotation: Hit_ID=Q8S8F8; Match level="QueryCoverage=99%, HitCoverage=78%, E-value=2e-52, Identity=47%"; Hit description =Expressed protein
  Pfam annotation: Domain name=GRAM; Domain location=159-212; Score =12.2; E_value=0.014; Accession=PF02893.10; Description=GRAM domain
  Subcellular localization annotation: CTP_CleavageSite=11; ConfidenceScore=5.13e-01
MEQPPKPETVPESHVPNGHSTTTTATTTVTNGSGSELESQVPKERAASSSGSTKKSVHWSPELVTESTFTSSPRESRSNPYFSTSSSFSQPPPTFMETVVTVRNVLGRWGKKAAEATKKAESLAGNTWQHLKTSPSFAEAAMGRIAQGTKVLAEGGYEKIFLNTFETVPEERLLNSYACYLSTSAGPVMGVLYVSTAKIAYSSDNPISYRNDNQTEWSYYK

SEQ ID NO: 151059 - protein, 224 aa, Glycine max
  Coding DNA Sequence Number=SeqID_34281
  Gene Ontology: Mol. function=metal ion binding; Cellular component =integral to membrane
  Homolog annotation: Hit_ID=Q6R567; Match level="QueryCoverage=55%, HitCoverage=50%, E-value=2e-40, Identity=57%"; Hit description=Ring domain containing protein
  Pfam annotation: Domain name=zf-C3HC4; Domain location=36-84; Score =26.0; E_value=0.00013; Accession=PF00097.15; Description=Zinc finger, C3HC4 type (RING finger)
MALDHFEETVHQKGNWKSSSEIIADSDRNASGDFDCNICLECVQDPVVTLCGHLYCWPCIYKWLHFQSTSLDDEEQQRPQCPVCKSEVSQSSLVPLYGRGQTTLPSKGKPRQVGTVIPQRPHGPRTLNTRSVSQPISQSYHPYSNPYHPQQHFNSIPSGYTSPMIRTTGSIDNTFGIFVLECICKYPNPLPSSSAMPKERTTTRVLPNTVEIKLGHLRLVQLVF

SEQ ID NO: 151060 - protein, 64 aa, Glycine max
  Coding DNA Sequence Number=SeqID_34282
MATRGNHRWSWVVEEESIKGRVTLTFTLTPIPFQEHHFHHTIPVAFYLYMTSMLSLHIFIIFCS

SEQ ID NO: 151061 - protein, 256 aa, Glycine max
  Coding DNA Sequence Number=SeqID_34283
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=90%, HitCoverage=35%, E-value=4e-46, Identity=41%"; Hit description=Wall -associated kinase, putative
  Pfam annotation: Domain name=Pkinase_Tyr; Domain location=1-170; Score=-174.0; E_value=0.085; Accession=PF07714.7; Description =Protein tyrosine kinase
MNIVTDDASNQMISVSELMLQQTRVQSIIAQLSLILYLPYFGLSRLLPNYVIHVSIAPQGSPGYLDPQYFQFYRLTDKSDVYSFGVVLIELISSMPTVDAARERDEVNLANLVMKKIQKGKLSELVDPSFGFESDQVVKRMLTSVAGLAFRCVQRDNELRPSMNEVLEALKKFQNGNYESENLEKEDDDGVISSTSSSEVHPPQPASQDSGEVGILMNNKLPTLPNSLTEKLESESNMPNASKDETKHTTCLNVTH

SEQ ID NO: 151062 - protein, 223 aa, Glycine max
  Coding DNA Sequence Number=SeqID_34284
MDRARLVYGLVIGMDMKIGALISALITALCRARGVTSDSLTYESLSPTINLAYIKKNCWNVDDLAVNFRGARKVKARPTDVPSSSAPPAPPTSATPTPATHDSQRFEAMLQRSILSVKQFNEKEVATPERTPQTPKDPPSPGIELSFAQQVADPPTPVHERPANPSTPILEIPEDPTTPALTLNTTLPATPELQFSDEEGGRITTPPGTPVLHFDDEEQDQDE

SEQ ID NO: 151063 - protein, 41 aa, Glycine max
  Coding DNA Sequence Number=SeqID_34285
MTPDSVGKIESMSRLGDSNESLRNSQVLSLLAALGVMRNTT

SEQ ID NO: 151064 - protein, 241 aa, Glycine max
  Coding DNA Sequence Number=SeqID_34286
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=58%, HitCoverage=28%, E-value=3e-59, Identity=75%"; Hit description =Putative chaperonin containing TCP1, subunit 3
  Subcellular localization annotation: CTP_CleavageSite=24; ConfidenceScore=5.32e-01
MVLMQKSHSHIKLGAGKHMYQSTMTMLATSINFCCTWTPNFTPTFVFIGVSVWFHFASFFKKKNSNIFFYLVREKLPSVERPKVSIFYCQEEDWSLLLRMEEEYIEELCMQILKFKPDLVITEKGLSDFACHFLSNHGLSAIRRLRKTDNNRIAKACGAVIVNRPDELQESDVGTGAGLFEDPKACSVLLRGASKDHLNEVERNLQDTVSVARNIIKNSKLVPGGGATELTNDCQRCRDFS

SEQ ID NO: 151065 - protein, 131 aa, Glycine max
  Coding DNA Sequence Number=SeqID_34287
  Subcellular localization annotation: CTP_CleavageSite=52; ConfidenceScore=5.13e-01
MYLHEGIVSRNQKPSTVSLFTLSLIKLALADLRTASSTHHRDVRAPLTTTCNCSSRSHSIKGSLAIVELKKFRTAFAFGLLSLLLLVALLEIGANTGFVSPTMHLRELMKCKLGLAPCLMYFPISTDKRRK

SEQ ID NO: 151066 - protein, 64 aa, Glycine max
  Coding DNA Sequence Number=SeqID_34288
MEFSDITQGLCFFASNAEAHEETTTAVGYVLYPLKSSFNAHILFSLEHAAAPYFLIKVHGNDLL

SEQ ID NO: 151067 - protein, 72 aa, Glycine max
  Coding DNA Sequence Number=SeqID_34289
RENGLSDRSKLVKNGRKETESERNKDESQKNGNELKVSDLETYSLKNEERMKNGEERRKTFTDLLTETSRKH

SEQ ID NO: 151068 - protein, 61 aa, Glycine max
  Coding DNA Sequence Number=SeqID_34290
MAASEAKIRLSFGNGMPPLGMEMSQAACQGMKWHKVLREFTCMWKIFKKKKTQVKRIMQPG

SEQ ID NO: 151069 - protein, 183 aa, Glycine max
  Coding DNA Sequence Number=SeqID_34291
  Gene Ontology: Cellular component=integral to membrane; Biological process=phosphoenolpyruvate-dependent sugar phosphotransferase system
  Homolog annotation: Hit_ID=UPI0000196D5C; Match level="QueryCoverage =56%, HitCoverage=25%, E-value=1e-26, Identity=54%"; Hit description =nucleotide binding
MKKSIEPSTLSTLIINHGLDLLPQEEFLSLLGGASPLVHQFLVNTVGEVGVKRISNVLSDAGKELECIVLDHLQHVVEVIGFRIGELRGLSRWHAHYHDIGLDESLINNATEKAVFASKVKPIKSRAFKPKALIAKLSKWKKALDIAAVSCCSTSNFDSGKSGTTLSKWVRARSMAAKPLVSN

SEQ ID NO: 151070 - protein, 60 aa, Glycine max
  Coding DNA Sequence Number=SeqID_34292
MQIGLDLLVKGQGDLPPDIVFYFLICSPKFSEDQGYLVSTTSWMHLISILQLEAGWVLEK

SEQ ID NO: 151071 - protein, 167 aa, Glycine max
  Coding DNA Sequence Number=SeqID_34293
  Homolog annotation: Hit_ID=Q1SRN1; Match level="QueryCoverage=71%, HitCoverage=9%, E-value=3e-07, Identity=30%"; Hit description =Integrase, catalytic region
MDDKDYVGNKRLELSGQLISLLFESFLILFMACATGGEEIPVIGTPTLQIESAITPLGLNNFIASPQVPPRYLSEARQISSCLALVYSLELNACLCSWIIALGQRRDNFDLNFVIPISKIDLCWNFLERSRRLLMILLQLEMSQPIASTWTLFLKVFPGTSILLLLL

SEQ ID NO: 151072 - protein, 399 aa, Glycine max
  Coding DNA Sequence Number=SeqID_34294
APSVEKDFASSIKAATEVPPSYFQFYVWSDVGINLHVDLNLSSSDWINRFRNEVCISENMHRNKSRSLWQDLSGLGENYTQGKSSFLLSTNSGQIEDHGGQARSSSSLKLKKDGATELGQQNKDDIPLICDSLTPCSMTIEVKDDLQENHSTVSAELNVNVVDNLMQDQSTVSAEVSCAKGASKKFIDSDATNMPFIKSLCDSVVNSVSDPGMLELRNSKPDNECSEDCALPNGSCFVNPGVVCAGASLSSSVGLQNSEVISCHKYASVSLYDNDGSMDLSDPKSTADMEQGRLVKTRINFETDSNNFTSVTDEWEVGKIVDGRESSECSQFDDPMKKSSLDYNNHDSKMELRKKRKNRDSEIQGSNGKPTTTRVLRSMKNTTTRVLRSMKNTAVKPPR

SEQ ID NO: 151073 - protein, 125 aa, Glycine max
  Coding DNA Sequence Number=SeqID_34295
MESSMRLGYLMTVFAMSGSIVLLFYQVNKHLCNNFVKKFEFEIRGSMKHQTKKKVQFAKDVMEIPMEEKSDRINVARTQQVIDKVLFIDDVMKSKHEQKLKDAMPPNRAILYRGIMNDRKGRLGF

SEQ ID NO: 151074 - protein, 796 aa, Glycine max
  Coding DNA Sequence Number=SeqID_34296
KKLLDEKRKRVEEEALLSENPASVDDPPSPIKRHVKWKVARTRASGNMTSESAQEIADKIGSFVPHGRQDILNTTIGRPDHGGRVRAAGSGVTITQYYGRASRTCSNSSTSITQQQLDEVVARLREDMSGQIREELRSQIKEELRTQLEEENKRTLERMTMALKKAIKVELSHKGSPESLIIQPNIQQLAARVCTKGSNAQSNAQPSRESDGDVTQKMGLYVQRKDGTLGLVAMGKIMDGDSVIHTVGYADDVVRALHTFVAWPTDLVKLVFDEDEEIIPHKVDAHGDKPANVDTDDPMRGLIKYNFDIYDKPVECKFDGSKFGIADAPPLIFLTYSDQGSNYAFLEPQLLVVSKETCGECKGYLERWLKESDREVYVGPYFHQAHWQLLLLCPRQHVVVWLCSLRRKPDMHIKAAINSVMTKLKTSLSPESKAAAPKWIEVKSHVQTGCYECGYYVMHWMWNIITSDIKSDWSMWFGDDTPLDKENITTIRKKWARYFLKTALCTFEIFSDATNTVTNDNCYNAHVLKLHDSPMLSVLKGFHRMRAVIATLSIPENDIQRFEGISEVEVVTKSLQGLSIESALDLQKLLRVETCTSQTTALQRLEANLPLFQSRMGALLFLISALLSRGLDLHKGPALLELPAPKVVLNDFSKGLSFTFQLLLKDNLKDVQAAAQPELPYLRTSGIILAGEDDTSSKLNGIVDASISESTPSHASLDIGQDYSLPASGQTPSTDGRAQISMSWPNHLPQSGLYGLWGVNLITQWSRIQRRSNIDPSLSTEVTNTTTVTITVVVTV

SEQ ID NO: 151075 - protein, 138 aa, Glycine max
  Coding DNA Sequence Number=SeqID_34297
MVVVELHKGASGLVVVCANDRVERCGCALIENSDTIEEMTHKPKNTAVATCPFAGSRRRGSRVRFPKEERCAESPPTFICGKRRKNRRKSVKMKILSSGVVFTFEGGISTSHVDKSGVVAPTYPPSKRKSDLRSSFLR

SEQ ID NO: 151076 - protein, 75 aa, Glycine max
  Coding DNA Sequence Number=SeqID_34298
MVIFHHGDAAEDKGEEDCIRKTLRLISKVLLYNKRTQIHGTRNKVESLTGYKCYLAIDFSTKIAPSQGWYFLHGA

SEQ ID NO: 151077 - protein, 202 aa, Glycine max
  Coding DNA Sequence Number=SeqID_34299
MEASQKARKRENLLNQALTLKEEKGSRQVPRKGDGQTSFFFTNICQTYLLRIFGMLFTFMEKSQEVVIPGKMDKKRFVLHIPMKLESSEDEDGGSSMSDLEVVEDSLVGQAPEKQDFEFEFENIQIQNDEGSEGNIARKAWEMAKPIGVRGSQNDGYYIQSFQIMEDRHVAAKPLGRCSLVSDKDFVTKCEGDQQSDKEETY

SEQ ID NO: 151078 - protein, 226 aa, Glycine max
  Coding DNA Sequence Number=SeqID_34300
MWWFLDMVVRMRGASWASEGSRACGSEPMKGCDLDLAAWCDGDGLGGMKKKVKVKGKRDGKIKIIVRLEVIGRRNNRGHEFYQVLPPSNHLEEEEKQDSISQFWKMGLFKDEDPIYVWLYGGAFPNFSKEDLALIQNDPLNEESKSVVFSIRALKALGPDDLNPLFFLSQWDTVRSSIFLRVKEALLNLSSIKLLNHMNLILILKVRDNIILTLELFRSMRITKRK

SEQ ID NO: 151079 - protein, 178 aa, Glycine max
  Coding DNA Sequence Number=SeqID_34301
MHPMLLIDIKVRGNQGIKKSDCGKFKVWLENKQKSGGNNLAFVCLESNLVDIPIDSREMIVLKDKIVESMNGKFLELDVVDLVVPYDDIDAGIHILSTETRVPIVPVETKIVMGDIVDFQTNDMLDPHMMNENAQPDAYDIGVIVDRKSYHEVVSCPQLEIWKHTMNEEMQSISVNGI

SEQ ID NO: 151080 - protein, 53 aa, Glycine max
  Coding DNA Sequence Number=SeqID_34302
MELQQKIKEKRNISRICQRHLSIFPFDATSMEGVTLARGKLPWEAKKKASLRS

SEQ ID NO: 151081 - protein, 223 aa, Glycine max
  Coding DNA Sequence Number=SeqID_34303
  Gene Ontology: Mol. function=nucleic acid binding; Cellular component= nucleus; Biological process=DNA integration
  Homolog annotation: Hit_ID=Q1S1X7; Match level="QueryCoverage=99%, HitCoverage=17%, E-value=2e-49, Identity=44%"; Hit description =Integrase, catalytic region; Zinc finger, CCHC-type; Peptidase aspartic, catalytic
MDFGCSYHICPHRSWFVTYEKKSSRNVLMDNNDPCKTIGIGSMQIKMDDGIVRTLTNIHYVPKLMKNLVFLGAMGSKGFTCCVEGGVVQIKGKEKYVVMQGTKQENLYILQGSIVTCSVSTISQAESHVSNNNSLWHMCLGHMREKGNGNFGKQGLHGNHKVEHLQFCEHCVYEKQHKVKFPKVVHTIKATLDCILYDCWGPSRVPSLGRAKYFLSIIDNYSR

SEQ ID NO: 151082 - protein, 168 aa, Glycine max
  Coding DNA Sequence Number=SeqID_34304
MKIAWELISKPQYLWVQAMRAKYKCGSSIILDVIATLNASNTWRGVSVWQDVVENALNEIIAYPTPIDRYRVDMPLWKLTSDGDWVMHNMCSSTLKWRTVIGVTLAPTQGFCKFDVDGSVKNLGQSISYKGMQHDMDAIWKVGCNRKLGKCTIMANEVWGILTSLEQA

SEQ ID NO: 151083 - protein, 71 aa, Glycine max
  Coding DNA Sequence Number=SeqID_34305
MFEPGTLKGGGVKLHSPQNLPNVQEAYELTGFTSFAALSPHFCAFVSIFALLLTPYKGLYGMVVGQLCILK

SEQ ID NO: 151084 - protein, 371 aa, Glycine max
  Coding DNA Sequence Number=SeqID_34306
  Homolog annotation: Hit_ID=Q1SGC9; Match level="QueryCoverage=99%, HitCoverage=100%, E-value=4e-76, Identity=48%"; Hit description=HPr serine phosphorylation site
MMKLSLKLDGENEKQNLQQQQHSSQIMTAKVPISILNKPFLSGVTASTGTHSPSEFSFSLSTNFPSGPSLRLSYSPTASAPFSLSLKSGLGLLGSPAHSPLVFSANFSLSPTPSFFLHFKPRFGHFSLHKTVFSDTITHTHSLSTSFPPTPEIVPHGSSTTGWHNLKLEPSANSDQSNNNTYFENFKNDAKNALSPGVRVMARTVMPVTKGFLLNFRWGVNFPRNFGSKMPSLTVNKIGLERVEEGKEKKNNNDDKKQMRDSSGIDLKLLKGMCFWMGRDLEIMEKENREMKRLLDEMKLGISSTRNSREESNGSGWKLSESNGEVQRWRSYKSERQEDEKKVQPNKPLSVATTDVESELEKAIKAATSTS

SEQ ID NO: 151085 - protein, 552 aa, Glycine max
  Coding DNA Sequence Number=SeqID_34307
  Gene Ontology: Mol. function=transporter activity; Cellular component= membrane; Biological process=oligopeptide transport
  Homolog annotation: Hit_ID=Q1SGD4; Match level="QueryCoverage=98%, HitCoverage=89%, E-value=0.0, Identity=86%"; Hit description=TGF -beta receptor, type I/II extracellular region; Major facilitator superfamily MFS_1
  Pfam annotation: Domain name=MFS_1; Domain location=4-490; Score =23.1; E_value=2.8e-05; Accession=PF07690.6; Description=Major Facilitator Superfamily
  Pfam annotation: Domain name=PTR2; Domain location=66-474; Score =309.5; E_value=6.1e-90; Accession=PF00854.12; Description=POT family
  Pfam module annotation: Pfam domain module=MFS_1::PTR2; Domain location=4-490::66-474
  Subcellular localization annotation: CTP_CleavageSite=58; ConfidenceScore=5.09e-01
MINDALNQALATLAFFGIGVNLVLFLTRVVGQNNADAANNVSKWTGTVYIFSLVGAFLSDSYWGRYKTCAVFQVIFVIGLMSLSLSSYLFLLKPKGCGNETVSCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLICTPRYRHFKPSGNPISRFSQVLVAASRKSKLQMSSNGEDLFNMDAKEASNDANRKILHTHGFKFLDRAAFISSRDLGDQKGLGYNPWRLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCLHCNDSSTLSIFWQIPQYAFIGASEVFMYVGQLEFFNAQTPDGLKSFGSALCMTSISLGNYVSSLLVSVVMKISTEDHMPGWIPGHLNKGHLDRFYFLLAALTSIDLIAYIACAKWYKSIQLEAKTGEIDETQV

SEQ ID NO: 151086 - protein, 79 aa, Glycine max
  Coding DNA Sequence Number=SeqID_34308
  Gene Ontology: Mol. function=pyruvate kinase activity; Cellular component=chloroplast; Biological process=glycolysis
  Homolog annotation: Hit_ID=P55964; Match level="QueryCoverage=98%, HitCoverage=18%, E-value=3e-31, Identity=88%"; Hit description =Pyruvate kinase isozyme G, chloroplast
MVTCGDLGAELPIEEVPLLQEDIIIRYQSMQTPVIVATNMLESMINHPTPRRAEVSDIAIAVRQGADAIMLSGETAHGK

SEQ ID NO: 151087 - protein, 101 aa, Glycine max
  Coding DNA Sequence Number=SeqID_34309
  Gene Ontology: Mol. function=inositol or phosphatidylinositol phosphatase activity
  Homolog annotation: Hit_ID=Q1SGC6; Match level="QueryCoverage=79%, HitCoverage=12%, E-value=1e-15, Identity=55%"; Hit description =Inositol polyphosphate related phosphatase
MKARRGKRSEAFWPSIVMKKWLNIKPKVNDFSEDEVDTETESEDDACSIRGSRMCVREDNPHPLRTEGVQSIFSSLTSGNSPFLLSNLVLFTRQKKGKRFN

SEQ ID NO: 151088 - protein, 373 aa, Glycine max
  Coding DNA Sequence Number=SeqID_34310
  Gene Ontology: Mol. function=aminoacyl-tRNA ligase activity; Cellular component=mitochondrion; Biological process=tRNA aminoacylation for protein translation
  Homolog annotation: Hit_ID=Q1SPK9; Match level="QueryCoverage=56%, HitCoverage=35%, E-value=1e-80, Identity=66%"; Hit description =Arginyl-tRNA synthetase, class Ic; DALR anticodon binding
  Pfam annotation: Domain name=Arg_tRNA_synt_N; Domain location=81-173; Score=59.1; E_value=1.5e-14; Accession=PF03485.7; Description=Arginyl tRNA synthetase N terminal do
  Pfam annotation: Domain name=tRNA-synt_1d; Domain location=185-372; Score=-115.3; E_value=0.00082; Accession=PF00750.10; Description =tRNA synthetases class I (R)
  Pfam module annotation: Pfam domain module=Arg_tRNA_synt_N::tRNA-synt_ 1d; Domain location=81-173::185-372
  Subcellular localization annotation: CTP_CleavageSite=92; ConfidenceScore=5.65e-01
MVCTLLSGGGPLVIFSGGCLNLNRFSHFPSPPSLPSSRSDLLKVASRRFALSVTKTQQSPVTKPQSTSTAIIANNPASVKRQLAQLFDLSLRATVPDEPDVVPLIDACAVKGGVKFGDYQCNNAMGIWSKMKGKQTGFRGPPAIGQAIVNNLPPSEMIDSCSVAGPGFVNVVLSKKWIAEGEYVKVKRMLIDGINSWAPRLPVKRALIDFSSPNIAKEMHVGHLRSTIIGDTLARMLEFSRVECVIRRNHVGDWGTQFGMLITNLFEKFPNPDDVSEADIGDLQDYLPKHVMPPPIRNPEHVLHKTQWLAIFALFGACSLFAPPHFRSECVLSHMLIGEVTQAVVRSECVRDERQRCSDLSTCEIGSDDVVQI

SEQ ID NO: 151089 - protein, 90 aa, Glycine max
  Coding DNA Sequence Number=SeqID_34311
  Gene Ontology: Mol. function=actin binding; Cellular component=actin cytoskeleton; Biological process=actin cytoskeleton organization and biogenesis
  Homolog annotation: Hit_ID=Q1S181; Match level="QueryCoverage=97%, HitCoverage=66%, E-value=4e-42, Identity=86%"; Hit description=Plant profilin
  Pfam annotation: Domain name=Profilin; Domain location=2-90; Score =92.0; E_value=1.8e-24; Accession=PF00235.9; Description=Profilin
MSWQTYVDDHLMCDIDGTGHHLSSSAIIGHDGSVWAQSSSFPQIKSDEINGIMKDFDEPGHLAPTGLHLGGTKYMVIQGEPGAVIRGKKV

SEQ ID NO: 151090 - protein, 50 aa, Glycine max
  Coding DNA Sequence Number=SeqID_34312
TGGINRVVNAINLVAEDAVTAAYSISSNGIYHACMHVLLAAFIVEFSENV

SEQ ID NO: 151091 - protein, 486 aa, Glycine max
  Coding DNA Sequence Number=SeqID_34313
  Gene Ontology: Mol. function=protein binding; Cellular component =cellulose and pectin-containing cell wall; Biological process =protein amino acid phosphorylation
  Homolog annotation: Hit_ID=Q1S176; Match level="QueryCoverage=87%, HitCoverage=97%, E-value=1e-164, Identity=69%"; Hit description =Leucine-rich repeat
  Pfam annotation: Domain name=LRRNT_2; Domain location=132-171; Score =27.7; E_value=4.2e-05; Accession=PF08263.3; Description=Leucine rich repeat N-terminal domain
  Pfam annotation: Domain name=LRR_1; Domain location=208-230; Score =12.2; E_value=1.5; Accession=PF00560.23; Description=Leucine Rich Repeat
  Pfam annotation: Domain name=LRR_1; Domain location=232-255; Score =15.3; E_value=0.23; Accession=PF00560.23; Description=Leucine Rich Repeat
  Pfam annotation: Domain name=LRR_1; Domain location=256-275; Score =9.1; E_value=5.6; Accession=PF00560.23; Description=Leucine Rich Repeat
  Pfam annotation: Domain name=LRR_1; Domain location=279-301; Score =11.9; E_value=1.7; Accession=PF00560.23; Description=Leucine Rich Repeat
  Pfam annotation: Domain name=LRR_1; Domain location=302-324; Score =8.3; E_value=8.1; Accession=PF00560.23; Description=Leucine Rich Repeat
  Pfam annotation: Domain name=LRR_1; Domain location=327-349; Score =4.2; E_value=47; Accession=PF00560.23; Description=Leucine Rich Repeat
  Pfam annotation: Domain name=LRR_1; Domain location=351-373; Score =9.8; E_value=4.2; Accession=PF00560.23; Description=Leucine Rich Repeat
  Pfam annotation: Domain name=LRR_1; Domain location=375-397; Score =10.8; E_value=2.7; Accession=PF00560.23; Description=Leucine Rich Repeat
  Pfam annotation: Domain name=LRR_1; Domain location=399-420; Score =2.7; E_value=88; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=132 -171::208-230::232-255::256-275::279-301::302-324::327-349::351 -373::375-397::399-420
MEGTNTYKFLTLWSKSRNLHSKEVNICTEKVVQRYASNKLNYINLKENGEKVREHSRLKMENSCILAFLLLILHSSTTKAAFSVGGGVGVGVGVGVGVGNGNGGGDGGSGGVVWVGGGINSPEPPRSSVPNLEGAYTALQAWKSAITEDPLKILSSWVGPNVCAYKGVFCANPQDEMVASAFPVVAGIDLNHANLKGTLVKELSLLSDLSLLHLNSNRFTGTVPDTFRDLVFLEELDLSNNQLSGPFPAATLYMPGLIYLDLRFNYFSGPLPQELFSKNLDALFLNNNQFEGEIPQNLGSSPASVINLANNKLSGSIPASLGFMGSKIKEILFLNNQLTGCIPEGVGLFTEMQVLDVSFNSLMGHLPDTLSCLQDIEVLNLAHNKLSGELSDVVCSLRSLANLTVAYNFFSGFSQQCSRLFFRNVGFDFSLNCIPDRDMQRPPPECSGIPGGSLSCLRIPTPRPLVCGSMAVSKSKHIDPTSPSPP

SEQ ID NO: 151092 - protein, 244 aa, Glycine max
  Coding DNA Sequence Number=SeqID_34314
  Homolog annotation: Hit_ID=Q1SU13; Match level="QueryCoverage=82%, HitCoverage=50%, E-value=1e-52, Identity=48%"; Hit description=IMP dehydrogenase/GMP reductase
  Pfam annotation: Domain name=DUF1005; Domain location=71-239; Score =355.4; E_value=9.3e-104; Accession=PF06219.3; Description=Protein of unknown function (DUF1005)
MFAKFKLSYLCMCCGIWLHCIPRCLPSDFANNPSRWRRTLKGIRERHGRERKGWMIMIHDLSGSPVAAASMITPFVPSPGSDRVSRSNPGAWLILRTNNGASVSSWKPWGRLEAWRERGPVDGLGYKFELVTENGPANGIPIAEATMNVKKGGQFCIDYKVMRDSGLGSRLKGKGFVMGSTVEGEGKVSKPVVQVGAQHVTCMADAALFIALSAAIDLSMDACKLFSHKLRKELCHEEQQVSFP

SEQ ID NO: 151093 - protein, 177 aa, Glycine max
  Coding DNA Sequence Number=SeqID_34315
  Gene Ontology: Mol. function=acid phosphatase activity; Cellular component=intracellular; Biological process=translation
  Homolog annotation: Hit_ID=Q1S177; Match level="QueryCoverage=94%, HitCoverage=50%, E-value=6e-34, Identity=48%"; Hit description=Plant acid phosphatase
  Pfam annotation: Domain name=Acid_phosphat_B; Domain location=1-177; Score=52.5; E_value=1e-12; Accession=PF03767.5; Description=HAD superfamily, subfamily IIIB (Acid
MALTSMEIGFEIFNETSFDNWVDLAAAPALPASLSLYNELKELGFKIFLLTGRSEFQRNATGANLLSSGYRDWERLILRRDRTRDLFSLLSLLTIQLTLYLPCLVLLNNFHLKFLLNETGSSDQGKPATTYNSEKRAELENEGYRIHGNSGDQWSDLGGYAVAARSFKLPNPTDYIP

SEQ ID NO: 151094 - protein, 257 aa, Glycine max
  Coding DNA Sequence Number=SeqID_34316
  Gene Ontology: Cellular component=integral to membrane
  Homolog annotation: Hit_ID=Q1SGC5; Match level="QueryCoverage=62%, HitCoverage=56%, E-value=2e-65, Identity=74%"; Hit description =CD9/CD37/CD63 antigen
MTSSFNEIVKVKLLEWLVNRLWTCGYERIGASKAVCAYIYALIVLIKGIVIKFLKPIKYSILVALLILVELGCAAFIFFDKNWKEQIPTDKTGEFDAIYGFLIENWNIMKWVALGIVIFEALLFLLALIVRAANRPADYDSDEEFINPRQQVQQPLLNRLPAGPATGIPVAGTIDQRPSRNDAWSTRMREKYGLDTSEFTYNPSESNRFQQLGGVSSEVVDAPILLLQSQCLLWPMFCPWSLLACWENYDLVLKGSD

SEQ ID NO: 151095 - protein, 184 aa, Glycine max
  Coding DNA Sequence Number=SeqID_34317
  Homolog annotation: Hit_ID=Q10FZ4; Match level="QueryCoverage=78%, HitCoverage=69%, E-value=5e-09, Identity=28%"; Hit description =Expressed protein
MSKKVILPTVASHRRQPLLLQQSESYRKAGTRLMGEAVGGTAAVCCCFSFGLANIIYLAIYKVPAKLCQEALRRKRRRRRLQISMEEGAAIPSRPRCTCGCCDDIVGAGRVYPLCSDDGSDVAVLRSRSSVEKDKEVVELEEEMWERFYGSGFWRSPSQRENSSSQQRIATTVSAHNLQVVDVN

SEQ ID NO: 151096 - protein, 132 aa, Glycine max
  Coding DNA Sequence Number=SeqID_34318
  Gene Ontology: Mol. function=nucleic acid binding; Cellular component= endoplasmic reticulum membrane; Biological process=DNA integration
MDNPRKAYWQVVKWILIYLKGSTDMGLVFGRGINEVHNHVTRFCDSDYVVDLDRRRSLIDYVFTLGAYMAAIEAVKEALWLKGLIGDLEVSQKDIMVFCNSESAIHLTKNQMYHERTKHINVRMHFICDVIT

SEQ ID NO: 151097 - protein, 209 aa, Glycine max
  Coding DNA Sequence Number=SeqID_34319
  Homolog annotation: Hit_ID=Q2HTR2; Match level="QueryCoverage=36%, HitCoverage=14%, E-value=1e-20, Identity=67%"; Hit description =Cyclin-like F-box
  Subcellular localization annotation: CTP_CleavageSite=16; ConfidenceScore=5.01e-01
MPQAQCMSQATDARKKAFAKNCKGWKKLYCGSCTFGSKGMNMVLDKCTTLEELFVKCLRGIIDAAVAELIGPDMVAASLKLCFKLSSHYRDPGTLDIRKNFVGFFNWKSFWYFSHFCYQSGIKQGYLQGYFNKHSKVKHCFKINSKVKHCFTINSRSSKQDQEKVRPQTISSVDQAFSSKHIVSNIQGFANRLPGSVINYQKIILKQRI

SEQ ID NO: 151098 - protein, 70 aa, Glycine max
  Coding DNA Sequence Number=SeqID_34320
MKEQRVADNSIGVKLRRQQRRVKQLQSAEEVREVLMQSYPARALDRRLQVDWARDPREGPRVLMILRVDF

SEQ ID NO: 151099 - protein, 167 aa, Glycine max
  Coding DNA Sequence Number=SeqID_34321
MKNPQNCGVGDLDISIDRIKTLVNDRVLETLDFTDFNTCVNCIKGKQTNKTKKSAKRSSKILKIIHTDIYCPDMDSHGQKYFISFIDVATYPSAGGRRVTRGMRVPRKEYARSRHQRLFEENVGKTGKDAIYELLSERFGSCIYARGRVFPFAPTYSSICDEEIRPT

SEQ ID NO: 151100 - protein, 51 aa, Glycine max
  Coding DNA Sequence Number=SeqID_34322
MVDVLVIRVPLRSHPIDVTLAFLEKMKDEEVQCTISDFQGRDGHNCLLRWH

SEQ ID NO: 151101 - protein, 526 aa, Glycine max
  Coding DNA Sequence Number=SeqID_34323
  Gene Ontology: Mol. function=inositol or phosphatidylinositol phosphatase activity; Biological process=abscisic acid mediated signaling
  Homolog annotation: Hit_ID=Q84MA2; Match level="QueryCoverage=93%, HitCoverage=75%, E-value=1e-82, Identity=40%"; Hit description=Type I inositol-1,4,5-trisphosphate 5-phosphatase 1
  Subcellular localization annotation: CTP_CleavageSite=41; ConfidenceScore=5.00e-01
MALLQFCYCLLLCPIIVILNSDEARVSKQPTGTVSLSTMSLCMASFCMPLFWARVVMRKWLNMASNEPDYTADPDDDNEDDPESDSDNEELGKRTRFGDSREEQAPIESNEFLPRLRRQKSLTSRSQYINKKELRVCVGTWNVGGKLPSDDLDIDDWLGINEPADIYVLGLQEIVPLNPGNIFGAEDTRPVPKWENIIRDTLNRVRPKAPKMKSFSDPPSPSKFKPSDDAPDIEEEILLESDGDIGEEVHPLDEEHNVYDGGADKPTTYEEASNTNFQASDAADIANTEEPIGNDLKRQFSDGKRLSRLNCFRDENLPKKTETSSSQQASKLSRMISSSDRIGLSWPEPPLHLLSQGPLDRPTSFKSVRSFSASKSFRTCQTFKKTIDDIGLLAEIDLEALMKRKRRSSYVRIVSKQMVGIFITIWVRRSLRKHIQNLKVSTVGVGVMGYIGNKFSALLAYQIGSYLFSAIYCGLGIQLVKRREMNIKEMLMCVKYINELIFILLRILEFPETSLIMSECMFYIQR

SEQ ID NO: 151102 - protein, 600 aa, Glycine max
  Coding DNA Sequence Number=SeqID_34324
  Gene Ontology: Mol. function=gamma-glutamyltransferase activity; Cellular component=integral to membrane; Biological process =glutathione biosynthetic process
  Homolog annotation: Hit_ID=Q9M0G0; Match level="QueryCoverage=93%, HitCoverage=88%, E-value=0.0, Identity=60%"; Hit description=Gamma -glutamyltransferase-like protein
  Pfam annotation: Domain name=G_glu_transpept; Domain location=63-595; Score=752.0; E_value=3.7e-223; Accession=PF01019.11; Description =Gamma-glutamyltranspeptidase
MYILGRHNSFPVVGLVVRGNTSYGILSRAEKYNDGIATNQGDIVESEVGVVATDDSRCSTIGVSMLRQGGHAVDAAVAAALCIGVVFSASSGIGGGAFMVVRSSSTSQTEAFDMRETAPLAASQNMYQNNPKDKTLGPLSMGVPGELAGLHAAWLKHGRLPWKTLFQPAIELAENGFVVTPTLGEYMAGDANKILDDPGLRKLYAPNGTLLKAGDVCRNVELGRTLEVVAEQGPQAFYNGTIGENLVKDVRDAGGILMMEDLRNYKLEVTDATTVNVMGYTVYGMPPPSSGTLALSLVLNILDSYGGPDAARGNLGLHRLIEALKHMLAVRMNLGDPNFVNIDDTIYKMLSPSFAKDIQHMIFDNTTFPPEYYMNRWSQLRDHGTSHMCIVDADRNAVSLTTTVNNHFGAGFRSTSTGILVNNEMDDFSTPTDISPDKLPPAPANFIEPNKRPLSSMTPLIITKDDQLVGVLGGSGGMNIIAAVVQVFLNHFILGMKPLDAVVSPRIYHKLMPNVVRYENLTAHNGDHIELSKESRLFLEERGHQLSGSEALAVTQLIVQTLKTPMNMNRKVGENTKSLTKHGTLTAVSDPRKGGCPAAV

SEQ ID NO: 151103 - protein, 352 aa, Glycine max
  Coding DNA Sequence Number=SeqID_34325
  Gene Ontology: Mol. function=RNA binding
  Homolog annotation: Hit_ID=Q5ZC75; Match level="QueryCoverage=48%, HitCoverage=38%, E-value=7e-48, Identity=60%"; Hit description=30S ribosomal protein S1-like
  Subcellular localization annotation: CTP_CleavageSite=56; ConfidenceScore=5.71e-01
MPFTLHPSKSLCSPNFTITPGKDTTLFTNTFFFINKPRKNPTKFRSFAKVVLYTPRASIVSKKDPILGYTHFTLRSRSDGFDGFSTDVSQDDGTSQELEQLELLNKPSPVLVTEESSSEVEVEEEKPSKEEALAPFLKFFKGKDSGQEVEEDGEGLEVSEEKSDVEGENEEGDKKVSVEYYEPKPGDFVVGVVVSGNENKLDVNVGADLLGTMLTKEVLPLYGKEMENLLCDVDKDAEDFMVNGKMGIVKNEEAISGVPVPGRPVLEIGTILFAEVLGRTLSGRPLLSTRRLFRRIAWHRVRQIKQLNEPIEVRITEWNTGGLLTRIEGLRAFLPKAELVKRANSFTELKEN

SEQ ID NO: 151104 - protein, 193 aa, Glycine max
  Coding DNA Sequence Number=SeqID_34326
  Gene Ontology: Mol. function=nucleic acid binding; Biological process= DNA integration
  Homolog annotation: Hit_ID=Q1T010; Match level="QueryCoverage=83%, HitCoverage=12%, E-value=5e-21, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAGSTGVFSGNLPMFDRNNFDDCYNNKQVLDILNKAYGGLDITKKVNKAPYAWNKRIDSFLSQIGFVKCTSEHGVYLKVLKVVTDDLLVIGSNEEEIEDFKKKMMKEFEMSDLGLLSYFLWIEFKTIENGTVMHQTKYATNLLKKFNMFKCNLVVTPREIGLVIEKERTKELINCTSSRSLDHLDICVTSNLI

SEQ ID NO: 151105 - protein, 113 aa, Glycine max
  Coding DNA Sequence Number=SeqID_34327
  Subcellular localization annotation: CTP_CleavageSite=18; ConfidenceScore=5.28e-01
MTSSASCRHASPSTLLPYCAMLPTNTPPPFPPLSVTSLIHVAITLNVEYLCDSTLHMHRLRATNDPKPTGEPSTPSNLETSVERKRTYFEKLLSELESYPLGSIVDELGVVLL

SEQ ID NO: 151106 - protein, 848 aa, Glycine max
  Coding DNA Sequence Number=SeqID_34328
  Gene Ontology: Mol. function=protein serine/threonine kinase activity; Cellular component=integral to membrane; Biological process=protein amino acid phosphorylation
  Homolog annotation: Hit_ID=Q9SNA4; Match level="QueryCoverage=82%, HitCoverage=87%, E-value=1e-134, Identity=37%"; Hit description =Receptor-like protein kinase homolog
  Pfam annotation: Domain name=Pkinase; Domain location=405-690; Score =107.1; E_value=5.2e-29; Accession=PF00069.15; Description=Protein kinase domain
  Pfam annotation: Domain name=Pkinase_Tyr; Domain location=403-686; Score=106.2; E_value=9.5e-29; Accession=PF07714.7; Description =Protein tyrosine kinase
  Pfam annotation: Domain name=Snf7; Domain location=672-821; Score= -21.9; E_value=0.0028; Accession=PF03357.11; Description=Snf7
  Pfam module annotation: Pfam domain module=Pkinase::Pkinase _Tyr::Snf7; Domain location=405-690::403-686::672-821
NISSEYAYPKNPNLPLLLSDLRSFPLGERNCYRLVAGKRGELHLIRASFLYGNYDGENKPPEFDLYVDVNFWSTVKFRNASEEVTMEIISVAQSGVTHVCLVNKGAGTPFISGLELRPLNSSIYDTEFGESASLSLFKRWDIGSTNGSGRYEDDIYDRIWSPFNSSSWESVNTSTPINVNDDGYRPPFKVIRTAARPRNGSDTLEFSWTPDDPSWKFYVYLYFAEVEQLEKTQLRKFNIAWNGSPLFDDSLIPRHLFATTLSNSKSLVANEHKISIHKTKDSTLPPILNAVEIYVARQLDALATFEEDGSVPTILLERSRAGLLTLRVDDQNLGDTGGNNKTKKIVIPVVVSVSVLVILIAFTLFWKLRRNERSDEEISMLNKGGKTVTTKNWQYTYSEVLDITNNFEMAIGKGGFGTVYCGEMKDGKQVAVKMLSPSSSQGPKEFRTEAELLMTVHHKNLVSFVGYCDDDNKMALIYEYMANGSLKDFLLLSDGNSHCLSWERRIQIAIDAAEGLDYLHHGCKPPIIHRDVKSANILLSQDFEAKIADFGLSREFRKDNQDQQFQVIHKDATYEKSAVMGTTGYLDPEYYKLGRLNEKSDIYSFGIVLLELLTGRPAILKGNRVMHILEWIRPELERGDLSKIIDPRLQGKFDASSGWKALGIAMSCSTSTSIQRPTMSIVIAELKQCLKLESPSDTKTFVAPPRQVYDEVYSSSEAFSYDNGLEMLEKKDYVFAKQKWGRGKSKELARGNNKRGRKIDAVDKTLDEINEQIENMRMIQEALSAPIGEAAYFDEDELEAELEELEAAEFHPATTAPAATLLVPARRPPSRPVPVEDELAALQAELAI

SEQ ID NO: 151107 - protein, 237 aa, Glycine max
  Coding DNA Sequence Number=SeqID_34329
  Gene Ontology: Mol. function=DNA binding; Cellular component=nucleus; Biological process=regulation of transcription
  Homolog annotation: Hit_ID=Q09GS3; Match level="QueryCoverage=99%, HitCoverage=100%, E-value=1e-122, Identity=82%"; Hit description =Transcription factor MYBJ6
  Pfam annotation: Domain name=Myb_DNA-binding; Domain location=14-62; Score=47.8; E_value=3.5e-11; Accession=PF00249.21; Description=Myb -like DNA-binding domain
MGRAPCCDKSNVKRGPWSPDEDATLKNYLEKHGTGGNWIALPKKAGLKRCGKSCRLRWLNYLRPHIKLGAAQLPGRTDNDVKNHWNTKLKKKFLAGNTSSTAATTSNNNVTFSNTSYSDQVKTLVLDHQKLNSADNWFDYSYNVLELEQTPIPVPFPMSQELEAFNYTAGSISCSAPPPSKEVSMLSNADNHTLWFGYDHASEDDPNLLEFVLDDDLLNHGFVSQDKSCSQVGPPSG

SEQ ID NO: 151108 - protein, 55 aa, Glycine max
  Coding DNA Sequence Number=SeqID_34330
MAAASAFWKRSGTYTTDRMRFLEIILNKLFGDELKIDSGEAYSDFAKDELDLLRR

SEQ ID NO: 151109 - protein, 150 aa, Glycine max
  Coding DNA Sequence Number=SeqID_34331
  Homolog annotation: Hit_ID=Q9AY32; Match level="QueryCoverage=20%, HitCoverage=46%, E-value=1e-09, Identity=96%"; Hit description=RRNA intron-encoded homing endonuclease
MPTRDQRMLLLGLRWHPYEKSKSLGSGGSMVARLKLKGIDGRAPPGLFLDSMGGGAWPFLVGGAICLVNSVNERDLSLLNSYVEIIAIVGLQRGIPSKRESSARVDYVPALCTHRPSLLPIEWSGEVFGLRRRERFAARDVVRSPLNLII

SEQ ID NO: 151110 - protein, 105 aa, Glycine max
  Coding DNA Sequence Number=SeqID_34332
MAKFDLEIVMEFYANAWPTGEGCEYSQRRSQASGFDEEAIAQLLCVSGQDFARTTTGRRVRIMHTNMTTLTQIWMTLQLSNILPNDHNSDLPLPKCQLVYAILTQ

SEQ ID NO: 151111 - protein, 83 aa, Glycine max
  Coding DNA Sequence Number=SeqID_34333
  Gene Ontology: Mol. function=sequence-specific DNA binding; Cellular component=nucleus; Biological process=regulation of transcription, DNA-dependent
  Homolog annotation: Hit_ID=Q533S5; Match level="QueryCoverage=75%, HitCoverage=30%, E-value=5e-28, Identity=100%"; Hit description=MADS box protein PIa
  Pfam annotation: Domain name=SRF-TF; Domain location=9-59; Score =107.1; E_value=5e-29; Accession=PF00319.9; Description=SRF-type transcription factor (DNA-binding and dimerisation domain)
MGRGKIEIKRIENSSNRQVTYSKRKNGILKKAKEITVLCDAQVSLIIFAASGKMHDYISPSTTFFLKIFILDQFTKGNFIKRV

SEQ ID NO: 151112 - protein, 114 aa, Glycine max
  Coding DNA Sequence Number=SeqID_34334
  Gene Ontology: Biological process=response to ionizing radiation
  Homolog annotation: Hit_ID=Q6H432; Match level="QueryCoverage=97%, HitCoverage=39%, E-value=1e-19, Identity=50%"; Hit description =Putative MND1 domain containing protein
  Pfam annotation: Domain name=Mnd1; Domain location=16-114; Score =29.1; E_value=1.7e-08; Accession=PF03962.6; Description=Mnd1 family
MSKKRGLSLEEKREKMLQIFYESQDFYLLKELEKMGPRKGVISQSVKDVVQSLVDDDLVSKDKIGTSVYSNFPNKVHSVMCYLKNRSDSAMYRRATTVYFWSLPSCAGNQVKFY

SEQ ID NO: 151113 - protein, 276 aa, Glycine max
  Coding DNA Sequence Number=SeqID_34335
  Gene Ontology: Mol. function=hydrolase activity; Cellular component =intracellular; Biological process=protein amino acid phosphorylation
  Homolog annotation: Hit_ID=Q1SZI6; Match level="QueryCoverage=99%, HitCoverage=53%, E-value=3e-43, Identity=28%"; Hit description =Tetratricopeptide-like helical
  Pfam annotation: Domain name=PPR; Domain location=163-197; Score =45.9; E_value=1.3e-10; Accession=PF01535.11; Description=PPR repeat
  Pfam annotation: Domain name=PPR; Domain location=198-232; Score =29.7; E_value=1e-05; Accession=PF01535.11; Description=PPR repeat
  Pfam annotation: Domain name=PPR; Domain location=78-112; Score=24.4; E_value=0.00041; Accession=PF01535.11; Description=PPR repeat
  Pfam module annotation: Pfam domain module=PPR::PPR::PPR; Domain location=163-197::198-232::78-112
MLSRCVKPGNFAFSIALKACSDSGNALVGRAIHAQIVKHDVEEADQVVNNALLGLYVEIGCFHEVLKVFEAMPQRNVVSWNTLIASFAGQGRMFETLAAFRVMQREGMGFSWITLTTVLPVCAQITAPLSGKEVHGQILKSRKNADVPLLNSLMDIMHSKDLTSWNTMLAGFSINGQIYEALGLFDEMIRYGIEPDGITFVALLSGCSHLGLTSEGKRLFNVMQDFGVQPSLEHYACLVDILGRLYGNVALAEIVAERLFEIEPSNPGNYVMLSNI

SEQ ID NO: 151114 - protein, 354 aa, Glycine max
  Coding DNA Sequence Number=SeqID_34336
  Pfam annotation: Domain name=Snf7; Domain location=153-325; Score =200.5; E_value=3.8e-57; Accession=PF03357.11; Description=Snf7
MGEPVSRIPNSHSYPHRFFWDVLIANSVLRTKQVQVEFSAMFQGPSGDARVEEERDAFFFFNGLCVFVVLGVEVAVMFVLTVMLVGREMAGSMMETETVRKERNHSDFKGDRLTNREDLIARKGLGFQSIASHITIMFSRMFGKPKQETNAVATLDKLNETLEMLEKKEKVLLKKVAAEVEKAKEFTRGKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVQVPAGQQPTRPVPAKRTPEEDELAALQAEMAL

SEQ ID NO: 151115 - protein, 91 aa, Glycine max
  Coding DNA Sequence Number=SeqID_34337
  Subcellular localization annotation: CTP_CleavageSite=77; ConfidenceScore=5.09e-01
MEVLRVQVFVMSIVALALAYVAPSINAQVLPPAPAPAPTSDDFSLLLSHSNSSNFSRITMTTPPPFPNSTPADHCNSAATTKEQTSSNAHF

SEQ ID NO: 151116 - protein, 134 aa, Glycine max
  Coding DNA Sequence Number=SeqID_34338
  Gene Ontology: Mol. function=protein binding; Biological process =response to ionizing radiation
  Homolog annotation: Hit_ID=Q6H432; Match level="QueryCoverage=90%, HitCoverage=57%, E-value=6e-30, Identity=54%"; Hit description =Putative MND1 domain containing protein
  Pfam annotation: Domain name=Mnd1; Domain location=1-121; Score=-0.4; E_value=3e-06; Accession=PF03962.6; Description=Mnd1 family
SDLESSKKRHAQLVDQCEELKKGREESDERVEAIADLKAIEQKHNELKVNLKNILQFRSWDTDVLVLTLAEEAIAVAHASANRWTDNIFTLRQWCSNNFPQAKEQLENLYKEVGITDDFDYLELAPVPLKTVAD

SEQ ID NO: 151117 - protein, 64 aa, Glycine max
  Coding DNA Sequence Number=SeqID_34339
MGRPVRVTLFCENAPTMWDQHRLKEEFKLGVFTPKAYTLKSPSRPLPLDLGPTPKTIFACKHCS

SEQ ID NO: 151118 - protein, 1276 aa, Glycine max
  Coding DNA Sequence Number=SeqID_34340
  Homolog annotation: Hit_ID=Q3LHL2; Match level="QueryCoverage=14%, HitCoverage=36%, E-value=6e-60, Identity=56%"; Hit description =Hypothetical protein PPS5
  Pfam annotation: Domain name=DUF292; Domain location=288-409; Score =256.5; E_value=5.4e-74; Accession=PF03398.5; Description=Eukaryotic protein of unknown function, DUF292
VVTTARRMSSFTLISSQTQHLLASMLSDKEFTENYIKTNRERLRKRNQMIIEGLRSAGIECLKGNAGLFCWMNLSPLLEKNKPKGREGELELWNAILHQVKLNISPGSSCHCSEPVVKLCLGDLLVMDSNLETASLHMQGASPGAAVKLCLGDLLVMGSNPETASLHLQGSTIDHPFLLILPTNMSRAAASFGILLCLFLAAAAVVNCSDQANCSTTCIAEQCDTVGIKYGKYCGVGYWGCAGEKPCDDLDASCMAHDDCVDKFVRVFAQNMLHRSFKPAKCKTTLKLAVSRIKLLKNKREAQIKQLKRELAQLLESGQDRTARIRVEHVVREEKTMAAYDLVEIYCELIAARLPMIESQKNCPIDLKEAVSSVIFASPRCSDLPELMDVKKQITSKYGKEFVSAAIELRPDCGLVEKLSAKAPDGPTKIKILAAIAEEHNIKWEPKSLGENDVKSSQDFLVGPSTSEKVAYAEPSQIHVPPAHDEKGPSNLHAPSQVKPVHHSSTNSYEQTASGAARKDQSTTSGVSNSEVGSSGTGSQETKFQDSYSGNNSSFPMNRQNWSMEFKDAASAAEAAAESAERASMAARAAAELSNRENMTRQYSSGSHSSSRSGLRDERSQEYTFHDDKNLSTSPVDASFHRSSSGMHNEQITATEQDNLVGPPNEYYRNSHENVVRHAQSASLMPGSVFNDDKPFTDGSQMADIYQHNNSFGQKSSDLPEMSIKTQAGRSEEDFVTDLYDDSDLNAENNYHFGDARTNRQSSKVSSSHFITPTDDHNDNLDLDDWNTRNKAVEDPFVTDEVNTQRNNMETSSYNDTTVVFDDSGSEDDDHKFDVDKKYNGEGSSLFVSSPASKSQVDPFENTNSLAYGQNIDEKVTSSGTQSHFSVVSERLTSAVSSEKEDLPSVTFDDSDDPGSDSDMNFVNKSKVSGLSDYGKFFLDPIASHGVPGSSSRNEKNVGTDRKSWLSPLSVDSDTVEEHFERRVDTTTVSEKNLGYDDLPASQPPTKERSSILGLDLEANNDTETLEEYHKESGKELSYGTLKGGLRNKGFKRPPYIKNTLDDVSSSLGDTSVQNEGSLPTARTSIGSDARVQDKYTREVSRGNRNVGLGAHKIPSDSDSYRVVANSQETLASTNEPRIQKEQREVKKKSSSRASVTYFGSDNSDSEDELTKQNSPSLARPISGISRRTSASSKAATGLSSRDAPLSKASVTSAATLGWKSSRTSYESNNQNASTIMKSSENGTGSKPGSAKNKASEPISEPNRSLDGEISKSSAR

SEQ ID NO: 151119 - protein, 177 aa, Glycine max
  Coding DNA Sequence Number=SeqID_34341
  Homolog annotation: Hit_ID=Q1S2V8; Match level="QueryCoverage=62%, HitCoverage=36%, E-value=2e-36, Identity=67%"; Hit description =Saposin B
MRNYLCKDLSKACSSKPPPVPKDRAPGEPFVAKSSKEAEMEKLLKSMEGMPGAPGMKMYSRDDLMNMKNFGGEDGDEEDEDDDDDEASFPSKLGNVLRAKESGKRDWKQMLNNSTTFPPRWVIDITTPKMDKNLEGNQMRTSQSPLGMICFPVQDLLSNDEYEGGCILGNLLEATLF

SEQ ID NO: 151120 - protein, 157 aa, Glycine max
  Coding DNA Sequence Number=SeqID_34342
  Gene Ontology: Mol. function=acyl-[acyl-carrier-protein]-UDP-N -acetylglucosamine O-acyltransferase activity; Biological process =lipid A biosynthetic process
  Homolog annotation: Hit_ID=Q5JMA6; Match level="QueryCoverage=56%, HitCoverage=27%, E-value=7e-26, Identity=60%"; Hit description=UDP -acetylglucosamine acyltransferase-like
  Pfam annotation: Domain name=Hexapep; Domain location=47-64; Score =1.7; E_value=89; Accession=PF00132.14; Description=Bacterial transferase hexapeptide (three rep
  Pfam annotation: Domain name=Hexapep; Domain location=71-88; Score =9.2; E_value=11; Accession=PF00132.14; Description=Bacterial transferase hexapeptide (three rep
  Pfam annotation: Domain name=Hexapep; Domain location=89-106; Score =8.9; E_value=12; Accession=PF00132.14; Description=Bacterial transferase hexapeptide (three rep
  Pfam module annotation: Pfam domain module=Hexapep::Hexapep::Hexapep; Domain location=47-64::71-88::89-106
MSVCVVLMVKSKARMWWLLLFNNTIGYHAVIGVKCQDMKYKPEDECYLEVGHNNDIREHSSIHRSSKSTDRTVIGNANFIMGSCHITHDCKIGNNNILANNTLLAGHVEVEVYLFYLHGLESICFVTREMIVMQLCKYATVHCTKSKAVGSQHSAEV

SEQ ID NO: 151121 - protein, 146 aa, Glycine max
  Coding DNA Sequence Number=SeqID_34343
  Homolog annotation: Hit_ID=Q1S2V8; Match level="QueryCoverage=95%, HitCoverage=46%, E-value=1e-55, Identity=75%"; Hit description =Saposin B
MKMKGVLWVVVVSVVVAAWIPLSHCSKKPVGVARKEDIPYIKCQVCEKLAKELYQQVQNKQAEIAPKKISEYQIIEIAENVCNLKKVEADWILRIDIVEKEDRLELVEQDSEGQCNSECKTIERACQEAQIYEWEMLCEHLESHCH

SEQ ID NO: 151122 - protein, 266 aa, Glycine max
  Coding DNA Sequence Number=SeqID_34344
  Gene Ontology: Mol. function=binding; Cellular component =mitochondrial inner membrane; Biological process=transport
  Homolog annotation: Hit_ID=Q1S2V6; Match level="QueryCoverage=90%, HitCoverage=94%, E-value=4e-83, Identity=64%"; Hit description =Mitochondrial carrier protein
  Pfam annotation: Domain name=Mito_carr; Domain location=107-178; Score=24.4; E_value=2e-05; Accession=PF00153.17; Description =Mitochondrial carrier protein
  Pfam annotation: Domain name=Mito_carr; Domain location=179-258; Score=39.0; E_value=1.6e-08; Accession=PF00153.17; Description =Mitochondrial carrier protein
  Pfam module annotation: Pfam domain module=Mito_carr::Mito_carr; Domain location=107-178::179-258
  Subcellular localization annotation: CTP_CleavageSite=45; ConfidenceScore=5.21e-01
MAKQRQEDGKNDVVDHMPLSPRNYLPAALPRPSSLLSNMSRFSFRAEFQSTGLIGSTVIIAKTEGLLGFYRKWRSVARIIPYAAIHYMSYEEYRRRIIQTFTHVWKGPTLDLVAGSLSGGTAIVSPTKLNASGMVNNEQVYRGILDCLAKTCREGGIRGLYRGVAPTLIGIFPYAGLLGQTITYPLEVVRRQMQVKKLLPSDYAELKGTLKSIVSISQKQGWKQLFSGLRINYIKVVPSVAIGFTVYDTMKSYLRVPSRDEAAVEN

SEQ ID NO: 151123 - protein, 101 aa, Glycine max
  Coding DNA Sequence Number=SeqID_34345
MAEEPKVPPPSNPTLSFDPSRTVGIIKRKALIKDLAAVYHAECLAYCQELLELQTKWEEVITEKCDHNCGCDCIAVKLKYLNIAVAIAVAECYLKPCTELL

SEQ ID NO: 151124 - protein, 461 aa, Glycine max
  Coding DNA Sequence Number=SeqID_34346
  Gene Ontology: Mol. function=binding; Cellular component =intracellular; Biological process=metabolic process
  Homolog annotation: Hit_ID=Q1S2U8; Match level="QueryCoverage=93%, HitCoverage=97%, E-value=1e-169, Identity=69%"; Hit description =Pentatricopeptide repeat
  Pfam annotation: Domain name=PPR; Domain location=164-198; Score =30.7; E_value=5.3e-06; Accession=PF01535.11; Description=PPR repeat
  Pfam annotation: Domain name=PPR; Domain location=199-233; Score =20.1; E_value=0.0081; Accession=PF01535.11; Description=PPR repeat
  Pfam annotation: Domain name=PPR; Domain location=98-132; Score=4.5; E_value=2.2; Accession=PF01535.11; Description=PPR repeat
  Pfam module annotation: Pfam domain module=PPR::PPR::PPR; Domain location=164-198::199-233::98-132
  Subcellular localization annotation: CTP_CleavageSite=25; ConfidenceScore=5.56e-01
MASIPRAVFTHSSSSIPFCAYAVPNASRRRNGTNNSRSTHKIPPLCKGNLPNEQKLQLDHQNQNAPLPLNVDLVSLCEEGNLDQVLELMGQGAVADYRVYLALLNLCEHTRSLESGKRVHEFLRRSTFRRDVELSNRLIGMYCKCGSVKDARRVFDQIPERNISSWHLMIGGYAANGLGCDGLLVFQQMKQAGVPPDGETFELVLAACAQAEAVEEGFLHFESMKEHGIVPSMEHYLEVINILGNTGQLNEAEEFIEKIPIELGVEAWESLRNFAQKHGDLDLEDHAEEVLTCLDPSKAVADKLPPPPRKKQSDMNMLEEKNRVTEYRYSIPYKEEAHEKLGGLSGQMREAGYVPDTRYVLHDIDEEEKEKALQYHSERLAIAYGLISTPPRTTLRIIKNLRICGDCHNAIKIMSKIVGRELIVRDNKRFHHFKDGKCSCGDYWFKSLVGQIKEIFVPSMN

SEQ ID NO: 151125 - protein, 104 aa, Glycine max
  Coding DNA Sequence Number=SeqID_34347
MDRGVSVLHNGRVDERLGEEVMQTKKGGSSSRYSEMDPDSLIDEVRNNMQEKRILITTRMQEVVVSCKGTPLDHVHEMKPLTSEKCLELLWKKTFQYGEKFGKF

SEQ ID NO: 151126 - protein, 193 aa, Glycine max
  Coding DNA Sequence Number=SeqID_34348
  Gene Ontology: Mol. function=methyltransferase activity; Biological process=metabolic process
  Homolog annotation: Hit_ID=Q8S0I2; Match level="QueryCoverage=66%, HitCoverage=42%, E-value=4e-59, Identity=83%"; Hit description =Methyltransferase-like
  Pfam annotation: Domain name=Methyltransf_11; Domain location=103 -193; Score=35.1; E_value=2.4e-07; Accession=PF08241.2; Description =Methyltransferase domain
  Subcellular localization annotation: CTP_CleavageSite=65; ConfidenceScore=5.12e-01
MTNFVGLRLHTRLSLPLPLPVLGGASHSCSATATTLSRAVIRKWNWGIKGPRRMVLGLGLGVSFLSMAAPRFVTHIDDPAIAALTKYYSKVFPPSNTPGVSILDMCSSWVSHFPSGYKQERVVGLGMNEEELKRNPVLTEYAVQDLNVNPKLPFEDNSFDLITNVVSVDYLTKPLDVFKEMCRILKPGGLAIM

SEQ ID NO: 151127 - protein, 114 aa, Glycine max
  Coding DNA Sequence Number=SeqID_34349
MGAGLKSTLMPQSSDKFLRTGMGMVAPDHEGNVLGAATCFEESVFEPRIAEPLCLRWAIQLSSDFCFANVEFESDCLQLVNEMWKRAESARSYFGGLVDDCIILINLMTGTAHT

SEQ ID NO: 151128 - protein, 170 aa, Glycine max
  Coding DNA Sequence Number=SeqID_34350
MEDDLERSMEARAIGCRGGRGTHGRDMEASEGGGGVEGRRSVEVGMVQVLMCGSNLGSMYPGMEILKMKDLKLTNYESLRVHGDWRLIWELEVPPIRVKQLIDELTFQVRIAQMLLCSLWRRRNDKLWENMVVSDSSVVQRGDDFLQAWVNAKMKSNSGQLQTDQHPVQR

SEQ ID NO: 151129 - protein, 461 aa, Glycine max
  Coding DNA Sequence Number=SeqID_34351
  Gene Ontology: Mol. function=nucleotide diphosphatase activity; Cellular component=integral to plasma membrane; Biological process =nucleotide metabolic process
  Homolog annotation: Hit_ID=Q9SU83; Match level="QueryCoverage=84%, HitCoverage=79%, E-value=0.0, Identity=75%"; Hit description =Nucleotide pyrophosphatase-like protein
  Pfam annotation: Domain name=Phosphodiest; Domain location=72-400; Score=432.2; E_value=6.9e-127; Accession=PF01663.12; Description =Type I phosphodiesterase  nucleotide pyrophosphatase
  Pfam annotation: Domain name=Sulfatase; Domain location=70-443; Score= -57.2; E_value=0.035; Accession=PF00884.13; Description=Sulfatase
  Pfam module annotation: Pfam domain module=Phosphodiest::Sulfatase; Domain location=72-400::70-443
  Subcellular localization annotation: CTP_CleavageSite=48; ConfidenceScore=5.85e-01
MAKESSSTSTSTSTSTPLLSSTNPSSTTFTSRILLLVASMFLLAAFVLALYFSSPTSSSPSLPPPRAKLPHPVVILISSDGFRFGYQFKTPAPNIQRLIKNGTEAETGLIPVFPTLTFPNHYSIVTGLYPPHHGIVNNVFFDPLTGEKFTMQSHQPKWWLAQPLWETVLLHNLSAATYFWPGSEVPKGPWTCPKAFCQPYNESVPFQDRVDTVLSYFDLPSHQVPSFITLYFEDPDHQGHQVGPDDSQITQAVAEIDAIVGRLIQGLEQRGVFQDVHLIMVGDHGMVGTCDKKLVFLDDLAPWIQIPRDWVQYLTPILSIRPPPSVDPAHVVAKMNEGLNSGKVENGAKLRVYLKEDLPRRLHYSASDRIPPIIGLADEGFKVEQNRTGEKECGGAHGYDNAFFSMRTIFIGHGPRFARGKKIPSFENVEIYNLVTSILDIKGAPNNGSTSFPDSVLLPVA

SEQ ID NO: 151130 - protein, 101 aa, Glycine max
  Coding DNA Sequence Number=SeqID_34352
  Gene Ontology: Mol. function=phospholipase A2 activity; Cellular component=vacuole; Biological process=lipid catabolic process
  Homolog annotation: Hit_ID=Q8S8N6; Match level="QueryCoverage=93%, HitCoverage=68%, E-value=7e-41, Identity=75%"; Hit description =Expressed protein
MAWGLMTVPPLLRYGKYCGLLYSGCPGERPCDGLDACCMKHDQYDYLSQECSQTFINCMNNFKNSRAPTFKGNTCDADDVIEVIHVVMEAALLAGRVLHKP

SEQ ID NO: 151131 - protein, 81 aa, Glycine max
  Coding DNA Sequence Number=SeqID_34353
  Homolog annotation: Hit_ID=Q1SW19; Match level="QueryCoverage=89%, HitCoverage=7%, E-value=1e-12, Identity=49%"; Hit description =Disease resistance protein
MADMAVSIAREKLLPLIRDEANLIWDMPKEFADLKDELEYIQAFLKDADKRAAGKGDNMKEGIRNWVKQSRESIISHRRFY

SEQ ID NO: 151132 - protein, 178 aa, Glycine max
  Coding DNA Sequence Number=SeqID_34354
MDIWDLKWRRPWFKWEIPFVDCFLLDLEWIGLNQGVDGGQTLWKRTSTGLKIPSNVAAFIWRLSKGVVFHIVYGAIVIIGWVCLRYNIGIGGIIFFQHNYHWLGKGKTRVWRFVWCAEVWALWRHSNNIIFRQHILDFDSVIEHIEFLTWSCLTAKLKCFKFSHNEWHANLAFCITAL

SEQ ID NO: 151133 - protein, 86 aa, Glycine max
  Coding DNA Sequence Number=SeqID_34355
MDYYRGWCTGKAECLELVQDLKCFITLLKRFVGSLKVVRLDRLLATDEEHTLLEVSKAYFGVTFASIIGSLKEMPLSYSYIPCALY

SEQ ID NO: 151134 - protein, 1060 aa, Glycine max
  Coding DNA Sequence Number=SeqID_34356
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=99%, HitCoverage=93%, E-value=0.0, Identity=60%"; Hit description =Transcriptional factor B3; Auxin response factor; Aux/IAA_ARF _dimerisation
  Pfam annotation: Domain name=Auxin_resp; Domain location=240-323; Score=195.5; E_value=1.3e-55; Accession=PF06507.4; Description=Auxin response factor
  Pfam annotation: Domain name=B3; Domain location=113-218; Score =107.3; E_value=4.4e-29; Accession=PF02362.12; Description=B3 DNA binding domain
  Pfam module annotation: Pfam domain module=Auxin_resp::B3; Domain location=240-323::113-218
MKKKSSIKAELWHACAGPLVKLPPSGTHVIYFPQGHSEQVSASLNRDVHSQIPNYPNLPSKLLCLLHTLTLHADPQTDQVYAQITLQPLPSFDKDALLRSDLALESTKPPPDFFCKQLTASDTSTHGGFSVPRRAAEKIFPPLDYSMQPPAQELVARDLHDTVWKFRHIYRGQPKRHLLTTGWSLFVSGKRLFAGDSVLFIRDEKQQLLLGIRRANRQPTNISSSVLSSDSMHIGILAAAAHAAANNSPFTVFYNPRASPSEFVIPLAKYYKSVYSHQPSLGMRFRMMFETEDSGTRRHMGTVTGISDLDPVQWKNSQWRNLQVGWDESTAGEKRSRVSIWEIEPVTAPFFICPPPFFRSKRPRQPGMPDDELSDFDNIFKQTMPWPGDDMCVKDPQGLPGLNLAQWMNMQQNPALASSLQPNYAPSLSGSILQNIPGPDISHQLGFSAPQISQSNNVALNTQRLLQTAPQLDHLQKLPSTSSTLGTVLPPQQQLGDITQQSRQNLANQTIPQGQVQAQLVHPQNIVQTNNILQQQQPSSQNHQLHRSLSQNPSQQQQQTIIGQNQHQNLIQSPMPDHVQQLQMSDDQIQLQLLQKLQQQKQTLLAQQTALQHSTQLTQIQDRQRQLLDKTHNLSRALTPGQVREIPPIFQNSLPKANSISNPITKANCQSNIQFYQQPKLQQQQPGLLSEMPGHTALHPTTTTNQLSAAGSSILTGAGGAGGAGQSVITDEVLSCSTSPSANNCTNALPQLINSRFQRSTLVGDDMAQSAATILSSSALETTSSNANMLKDLQPKSEVKPSLNISKIQNQGHFAPQTYLNGNAAHTDCLDTSSSTTSVCLSQSDAHMHQNNNPLSYNPQSLLFRDNNQDGEVQADARSNIPYANNIDSQMGMPLNPDSLSTKGTLRLGKDLSNNFSSEGMLGNYEINRDAQQEPSSSMVSQTFGVPDMAFNSIDSTIDDSNFLNSGPWAPPPAPPLPPLPPLPPAQFQRMRTYTKVYKRGAVGRSIDITRYSGYEELKQDLARRFGIEGQLEDRQRIGWKLVYVDHESDVLLLGDDPWE

SEQ ID NO: 151135 - protein, 234 aa, Glycine max
  Coding DNA Sequence Number=SeqID_34357
  Gene Ontology: Mol. function=carboxypeptidase A activity; Biological process=proteolysis
  Homolog annotation: Hit_ID=Q9FGZ7; Match level="QueryCoverage=77%, HitCoverage=40%, E-value=3e-75, Identity=73%"; Hit description =Arabidopsis thaliana genomic DNA, chromosome 5, TAC clone:K5J14
  Pfam annotation: Domain name=Peptidase_M14; Domain location=56-232; Score=-42.6; E_value=4.7e-05; Accession=PF00246.14; Description=Zinc carboxypeptidase
  Subcellular localization annotation: CTP_CleavageSite=61; ConfidenceScore=5.19e-01
MALSIFQFLLFSISNFFLASSFQDLLLLSVNAQSHNLTQPSVTPINFDLYHSSGNLMEEIRALVHRHPDKLTMETIKAGNKGYGAEVSVVTYCKEKKDNDERSKLRILLSFGQHGRELITTELALRILSILSEEKFLPSMDQASLNSALDKLVIKVVPMENLNGRKVVEAGDLCRGVDLNRNWSVDWGKKEKDYDPYEENPGIAPFSEPESQIMRKLAISFEPNLWVNVHSGME

SEQ ID NO: 151136 - protein, 166 aa, Glycine max
  Coding DNA Sequence Number=SeqID_34358
  Gene Ontology: Mol. function=methylcrotonoyl-CoA carboxylase activity; Cellular component=mitochondrion; Biological process =metabolic process
  Homolog annotation: Hit_ID=Q42777; Match level="QueryCoverage=65%, HitCoverage=12%, E-value=5e-29, Identity=66%"; Hit description =Methylcrotonoyl-CoA carboxylase subunit alpha, mitochondrial precursor
  Pfam annotation: Domain name=CPSase_L_chain; Domain location=1-88; Score=10.5; E_value=0.00023; Accession=PF00289.12; Description =Carbamoyl-phosphate synthase L chain, N-terminal domain
MTIVEKIGDPLRDSLHVASADEAIRIRPPPARLSYLNRASIVDTAIRSNTQAIHRGYGYLSESADFAKLCEGSSLTFIGPPASLLFEIWVTRGIVQIINLFFGMDCGTASKRIMGAAANGYSVIITNDLQVIKEGCAKSFAPFPTGPSHKFEKHDVEGGPVLRSKE

SEQ ID NO: 151137 - protein, 680 aa, Glycine max
  Coding DNA Sequence Number=SeqID_34359
  Gene Ontology: Mol. function=transferase activity; Cellular component= mitochondrion; Biological process=positive regulation of transcription, DNA-dependent
  Homolog annotation: Hit_ID=Q8L844; Match level="QueryCoverage=87%, HitCoverage=83%, E-value=0.0, Identity=75%"; Hit description=Crp1 protein-like
  Pfam annotation: Domain name=PPR; Domain location=170-204; Score =47.5; E_value=4.4e-11; Accession=PF01535.11; Description=PPR repeat
  Pfam annotation: Domain name=PPR; Domain location=242-276; Score =13.1; E_value=0.21; Accession=PF01535.11; Description=PPR repeat
  Pfam annotation: Domain name=PPR; Domain location=277-311; Score =26.8; E_value=7.6e-05; Accession=PF01535.11; Description=PPR repeat
  Pfam annotation: Domain name=PPR; Domain location=312-346; Score =41.1; E_value=3.8e-09; Accession=PF01535.11; Description=PPR repeat
  Pfam annotation: Domain name=PPR; Domain location=347-381; Score =37.4; E_value=4.9e-08; Accession=PF01535.11; Description=PPR repeat
  Pfam annotation: Domain name=PPR; Domain location=382-416; Score =23.1; E_value=0.001; Accession=PF01535.11; Description=PPR repeat
  Pfam annotation: Domain name=PPR; Domain location=417-451; Score =34.8; E_value=3.1e-07; Accession=PF01535.11; Description=PPR repeat
  Pfam annotation: Domain name=PPR; Domain location=452-486; Score =54.2; E_value=4.2e-13; Accession=PF01535.11; Description=PPR repeat
  Pfam annotation: Domain name=PPR; Domain location=487-521; Score =29.9; E_value=8.9e-06; Accession=PF01535.11; Description=PPR repeat
  Pfam annotation: Domain name=PPR; Domain location=522-556; Score =36.4; E_value=9.9e-08; Accession=PF01535.11; Description=PPR repeat
  Pfam annotation: Domain name=PPR; Domain location=557-591; Score =33.8; E_value=5.9e-07; Accession=PF01535.11; Description=PPR repeat
  Pfam annotation: Domain name=PPR; Domain location=592-626; Score =29.1; E_value=1.5e-05; Accession=PF01535.11; Description=PPR repeat
  Pfam annotation: Domain name=PPR; Domain location=627-661; Score =38.1; E_value=3e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=170-204::242 -276::277-311::312-346::347-381::382-416::417-451::452-486::487 -521::522-556::557-591::592-626::627-661
  Subcellular localization annotation: CTP_CleavageSite=33; ConfidenceScore=5.05e-01
MNLLPPQLTTTPFPSPSTHRHSHHNNIHFLPPPQSSASPITAKPTILEEGPDDILSLHNRRYDFTPLLSFLSTTSNSSPPTSLDSTEFQLAESYRAVPAPLWHAFLKSLCASSSSSSSIALAYAVVSWLQKHNLCFSYELLYSILINALGRSEKLYEAFLLSQRQVLTPLTYNALIGACARNGDVEKALNLMSKMRRDGYQPDFVNYSSIIQYLTRSNKIDSPILQKLYAEIETDKIEIDGHLMNDIIVGFSKAGDPTRAMRFLAMAQSNGLNPKPSTLVAVILALGNSGRTHEAEALFEEIRENGLEPRTRAYNALLKGYVRTGSLKDAEFVVSEMEKAGVKPDEQTYSLLIDVYAHAGRWESARIVLKEMEASNVQPNSYVFSRILANYRDKGEWQKSFQVLKDMKSSGVQPDRHFYNVMIDTFGKYNCLDHAMATFERMLSEGIPPDIVTWNTLIDCHCKSGRHDMAEELFSEMQQRGYSPCITTYNIMINSMGEQQRWEQVTAFLSKMQSQGLQPNSITYTTLVDVYGKSGRFSDAIECLEVLKSTGFKPTSTMYNALINAYAQRGLSELAVNAFRLMTTEGLTPSLLALNSLINAFGEDRRDAEAFAVLQYMKENNIEPDVVTYTTLMKALIRVEKFQKVPAVYEEMVASGCTPDRKARAMLRSALRYMKQTLKS

SEQ ID NO: 151138 - protein, 241 aa, Glycine max
  Coding DNA Sequence Number=SeqID_34360
  Gene Ontology: Mol. function=carboxypeptidase A activity; Biological process=proteolysis
  Homolog annotation: Hit_ID=Q9FGZ7; Match level="QueryCoverage=95%, HitCoverage=39%, E-value=7e-52, Identity=48%"; Hit description =Arabidopsis thaliana genomic DNA, chromosome 5, TAC clone:K5J14
MPYDHKNTTPDGLPLQRMKSLLEEVKHLHCQERCMIGSGGGSVGVSLISGRSGMSNGCKHVSQLYSNDTCCLELSFKGLKYSTTFDNLKSYFAHGTATDFMYDIVGVPMAFTFEIYGDGTASSRDCFKMFNPTDLATYNRVLSDWSATFFTIFKLVPQKLGDSNASILKPDKLVSIDEYLDGYLMERRNRYGKKLEVLELGMQEIRTYFRLFLLSSVLLLFMFCSRISKSKCRPIVSAIPL

SEQ ID NO: 151139 - protein, 176 aa, Glycine max
  Coding DNA Sequence Number=SeqID_34361
  Gene Ontology: Mol. function=protein binding; Cellular component =membrane; Biological process=defense response
  Homolog annotation: Hit_ID=Q7G752; Match level="QueryCoverage=78%, HitCoverage=17%, E-value=1e-12, Identity=34%"; Hit description =Putative NBS-LRR type resistance protein
  Pfam annotation: Domain name=LRR_1; Domain location=116-138; Score =12.0; E_value=1.6; Accession=PF00560.23; Description=Leucine Rich Repeat
  Pfam annotation: Domain name=LRR_1; Domain location=140-162; Score =9.0; E_value=5.8; Accession=PF00560.23; Description=Leucine Rich Repeat
  Pfam annotation: Domain name=LRR_1; Domain location=15-37; Score=1.2; E_value=1.7e+02; Accession=PF00560.23; Description=Leucine Rich Repeat
  Pfam annotation: Domain name=LRR_1; Domain location=38-60; Score=8.3; E_value=8; Accession=PF00560.23; Description=Leucine Rich Repeat
  Pfam module annotation: Pfam domain module=LRR_1::LRR_1::LRR_1::LRR _1; Domain location=116-138::140-162::15-37::38-60
MQAVLPYSEITNLISLALLSIQSCHNMESIFGGVRFSALKTLRVADCHSLKCLPLDVTNFPELEFQVVENCVNLDLELWKDHHEEQNPKLKLKCVGFWGLPQLVALPRWLQETTNSLQTLIIKNCDNLEMLPEWLSTLTNLKSLLISDCPKLISLLDNIHHLTALESMYIDLLCWT

SEQ ID NO: 151140 - protein, 476 aa, Glycine max
  Coding DNA Sequence Number=SeqID_34362
  Gene Ontology: Mol. function=translation elongation factor activity
  Homolog annotation: Hit_ID=Q00WW9; Match level="QueryCoverage=59%, HitCoverage=78%, E-value=5e-57, Identity=42%"; Hit description =Homology to unknown gene
MAASSRGFSTTQFDFKLRVMRLNAALLPKSHVLEFGPRKRRKLCFDSDRVRLGDGAMRCCCSDSVTPIRRTSGPGNGSDKNEEWRFDTKKPPHIHRVRVQASPAAMPFASPPSFLKQEKFFPRCTPRNSGPQSRDTPPKRDTGIANEKDWGISLLNENVNESGTNEDGSAWYRESGEELGENGYRCRWTRMGGQSHDGSSEWKETWWEKSDWTGYKELEFLSVHLGPVQNCFWAEVWRNLVEILRGILGGKHGRKIFIKMNGGLYISLLVVNSNIARIERSAQKQAKSGTENAGWYEKWWEKYDAKGWTEKGAHKYGRLNEQSWWEKWGEHYDGRGSVLKWTDKWAETELGTKWGDKWEERFFKGIGSRHGETWHVSPSSERWSRTWGEEHFGNGKVHKYGNSTTGESWDIVVDEETYYEAEPHYGWADVVGDSTQLLSIEPRERPPGVFPNLDFGSPPSPEAHDDSPDEDFPSSQ

SEQ ID NO: 151141 - protein, 137 aa, Glycine max
  Coding DNA Sequence Number=SeqID_34363
  Gene Ontology: Mol. function=protein binding
  Homolog annotation: Hit_ID=Q6Z3F8; Match level="QueryCoverage=86%, HitCoverage=32%, E-value=5e-34, Identity=56%"; Hit description =Transducin / WD-40 repeat protein-like
  Pfam annotation: Domain name=WD40; Domain location=39-78; Score=31.7; E_value=2.5e-06; Accession=PF00400.22; Description=WD domain, G-beta repeat
MSIECSHVCSVDYHPQKQHILVTAEHESGIHIWDLRKPKVPIQELPGHTHWTWTVKCNPEYDGMILSAGTDSTVNLWLASTNHDELTTERQVDSSARWVDPLLNTYSDYEDSIYGKEGSHGVLVNHGSLHHYPMMAG

SEQ ID NO: 151142 - protein, 504 aa, Glycine max
  Coding DNA Sequence Number=SeqID_34364
  Gene Ontology: Mol. function=nucleotide binding
  Homolog annotation: Hit_ID=Q40474; Match level="QueryCoverage=73%, HitCoverage=76%, E-value=1e-153, Identity=64%"; Hit description=Axi 1 protein
  Pfam annotation: Domain name=DUF246; Domain location=116-388; Score =529.5; E_value=3.6e-156; Accession=PF03138.5; Description=Plant protein family
MAHQRRRHHYYQRFRHMIPVFSAVAAALFFLFALLSFLAPSPVETDRIHRRRQHTSVNVQKDDAIDNPAFRVPGDGGKLGRDIWSSLNSEHFFGCSNSSNKFQKAQVITQPNRYLMIATSGGLNQQRTGITDAVVAARILNATLVVPKLDQRSFWKDSSNFSEIFDVDWFISFLSKDVKIIKQLPTKGRKALSAYNMRAVQLSKFDYRLANRFEPDMLAFSGCDYGGGEKEQKELGAIRRRWKTLHRSNPDRARRQGRCPLTPEEVGLMLRALGYGSDIHIYVASGEVYGGERTLAPLKALFPNFHSKETIATKEELEPFSSFSSRMAALDFIVCDESDVFVTNNNGNMAKILAGRRRYFGHKPTIRPNAKKLYRLFLNRSNSTWEAFASSVRTFQKGFMGEPKEVRPGRGGFHENPSSCICEDSAAAKVDKNSQSRKYGKDNTTKKNVANDELDVDNVSEWPDMDDDDDDQNDLAEKGTFNETISDYDALNFEDPELEEIISD

SEQ ID NO: 151143 - protein, 446 aa, Glycine max
  Coding DNA Sequence Number=SeqID_34365
MKKMTIHVLDRNTAIQLGVCVNGKTLKFVTPFTKWVSDLNWRLGLTGLIIPLVLFITFFSLHYSSTSNGFSAFYPVQQFLFNIPFKFICEDDPVISKDELLRSKIAVCLVGGARRFELTGPSIIEMVLKEYPNSDLFLHSPLDKDTFKFSILKFAPNVAAVRIFHPQPLPENEPYVRVLTAHNSPNGIQGLLQYFNLVEGCLTMIKSHQQKHNFTYDWIIRTRVDGYWNAPLGPENFVPGKYLVPPGSSYGGLNDRLGIGDLRTSTVALSRLSLVPNLDSAGFNNLNSEAAFKAQLTTLNVSHVAKRLPFCVVSDRRYDFPPGRFGVPVAALSSPGPLSGAKCRPCRPACEGLCVETVMDNVEKEWSWTHWENGALQLCDAHDAWESGWEKIFDRFSGNKFAAARKRIHSMRMGECVKDFVQLRKRSAHWSAPPVDEICTLGLSPP

SEQ ID NO: 151144 - protein, 662 aa, Glycine max
  Coding DNA Sequence Number=SeqID_34366
  Gene Ontology: Mol. function=DNA topoisomerase (ATP-hydrolyzing) activity; Cellular component=chromosome; Biological process=DNA topological change
  Homolog annotation: Hit_ID=Q6Z3H8; Match level="QueryCoverage=63%, HitCoverage=44%, E-value=1e-69, Identity=35%"; Hit description =Putative bzip-related transcription factor
  Pfam annotation: Domain name=DUF630; Domain location=1-59; Score =79.4; E_value=1.1e-20; Accession=PF04783.3; Description=Protein of unknown function (DUF630)
  Pfam annotation: Domain name=DUF632; Domain location=215-549; Score =352.2; E_value=8.4e-103; Accession=PF04782.3; Description=Protein of unknown function (DUF632)
  Pfam module annotation: Pfam domain module=DUF630::DUF632; Domain location=1-59::215-549
MGCNTSRLDRLPAVALCRDRCKFLDDALRQSYALADAHVAHMEALKTLGHALLCFFDGFEDSDETNVPNKETKVPVATKSPPPHSPSSFSSDSDDAHVLLHSESETEDAEKEEFQLFTHARYDYAHSARYPPFSPPRGYSGSKPPSPPPPSGSAWDFLNFFEPYEKYHVPYFPGGGDADVAENEKGKVEKRDGSKSKEENGEAKKKKGDSKEKKVVSEKAEVVLVSEQCSDSAKGFSEAVKEIQILFEKASESGNPVLEMLDAGKLRYHRKFDLNPVSCKMMHVFTPSSPLGVRCMKSSVGRRMGSGYEGDKDLTYANLCSTLKKLCMWEKKLYHEVKAEEKLRMLHQKKCKQLRRMKQKDADAQKIDSVQTFIGILSTKMKISIQVVDKISITISKLREEELWPLIYRFILTFLGMWKDMQECYKCQYQQIVEAKTLDALSLNTKPGNAHIDATIKLKSEVQKWNLSFLDWIHAQRSHVKALNGWLVRCLLYEPEEVPDDSTPFSPSKIGAPPVFVICHKWSRAVDNLSEKNVIEAVNGFMLRVNELLEKHILDLQQKLTLDKEFERKVKMLEREEQKMHKVMRAHERKMVTVGREESDALLRGDAVHHADIVDSTNLQSSLKQIFGAMEKFTDSTVRLYEELCQQIKQEDHVLGETNKIS

SEQ ID NO: 151145 - protein, 798 aa, Glycine max
  Coding DNA Sequence Number=SeqID_34367
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=99%, HitCoverage=100%, E-value=0.0, Identity=59%"; Hit description =Protein kinase; UspA
  Pfam annotation: Domain name=Pkinase; Domain location=461-731; Score =109.3; E_value=1.1e-29; Accession=PF00069.15; Description=Protein kinase domain
  Pfam annotation: Domain name=Pkinase_Tyr; Domain location=461-725; Score=70.0; E_value=7.4e-18; Accession=PF07714.7; Description =Protein tyrosine kinase
  Pfam annotation: Domain name=Usp; Domain location=13-152; Score=48.3; E_value=2.7e-11; Accession=PF00582.16; Description=Universal stress protein family
  Pfam module annotation: Pfam domain module=Pkinase::Pkinase_Tyr::Usp; Domain location=461-731::461-725::13-152
MSRVNSEKKLGAGRVVAVAIENNKTSQHAAKWAVDNLLPKDQCLLLIHVRQRPSSVPSSDHLSEAVGDNESKELFESFRVFCNRKSIQCKEVLLEDTDISKALIDTISTNTIELLVLGAPSRGGLVRRFRTTDVPSTVSKGAPQFCTVYIISKGKISSVRSATAPLAPNKAAIAAAAAAATTPRNQLQPQQQPHPQIMRSPERFSDSQPPRNYPPRPTSERPTAFGSHGAHHPMMDEDDIISPFTRAGKTYEPSKFQDSDISFVSSGRPSVERMFPTLYEDQDSASGIALGRFSDYDGRNSFASSYSSQSQGIDDHSFSSQSRLSDCTDDVEFEMRRLKLELKQTMEMYSSVCKEAMTAKQKAMELQRWKVEEQKKLEDSSMSSSPGEAVTSSSSMALMEMEQEKIREEALQKIAALEAQKRMSLQMERKKPEEKTLSSFGHTARYRRYTIEEIEEATNMFSESLKIGEGGYGPVYRCELDCTQVAIKVLKPDAAQGREQFQQEVEVLSCIRHPNMVLLLGACPEYGCLVYEYMANGSLDDCLFPRGKSRPPLPWQLRFQIAAEIATGLLFLHQTKPEPLVHRDLKPGNILLDRNYVSKISDVGLARLVPPSVADTVTQYRMTSTAGTFCYIDPEYQQTGMLGIKSDIYSLGIMLLQLVTAKPPMGLTHHVGRSIEKGTFAEMLDPAIPDWPLEQTLHFAKLSLGCAEMRRKDRPDLGKVVLPELNKLRAFAEQCMSPMMMFALRSTGGAGGGAGGGAGYVPRNSNSSGLSSSTQDMSEVSGFSGYESRSSTSSLGRI

SEQ ID NO: 151146 - protein, 598 aa, Glycine max
  Coding DNA Sequence Number=SeqID_34368
  Gene Ontology: Mol. function=protein kinase activity; Cellular component=integral to membrane; Biological process=protein amino acid phosphorylation
  Homolog annotation: Hit_ID=Q1S3M0; Match level="QueryCoverage=97%, HitCoverage=95%, E-value=0.0, Identity=60%"; Hit description=Protein kinase
  Pfam annotation: Domain name=LRRNT_2; Domain location=4-47; Score =32.8; E_value=1.2e-06; Accession=PF08263.3; Description=Leucine rich repeat N-terminal domain
  Pfam annotation: Domain name=LRR_1; Domain location=123-145; Score =8.1; E_value=8.7; Accession=PF00560.23; Description=Leucine Rich Repeat
  Pfam annotation: Domain name=LRR_1; Domain location=147-166; Score =6.9; E_value=15; Accession=PF00560.23; Description=Leucine Rich Repeat
  Pfam annotation: Domain name=LRR_1; Domain location=168-190; Score =8.2; E_value=8.5; Accession=PF00560.23; Description=Leucine Rich Repeat
  Pfam annotation: Domain name=LRR_1; Domain location=50-73; Score=0.2; E_value=2.6e+02; Accession=PF00560.23; Description=Leucine Rich Repeat
  Pfam annotation: Domain name=LRR_1; Domain location=98-121; Score =18.2; E_value=0.029; Accession=PF00560.23; Description=Leucine Rich Repeat
  Pfam annotation: Domain name=Pkinase; Domain location=310-580; Score =21.2; E_value=8e-10; Accession=PF00069.15; Description=Protein kinase domain
  Pfam annotation: Domain name=Pkinase_Tyr; Domain location=309-580; Score=-42.3; E_value=7.1e-10; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=4-47::123 -145::147-166::168-190::50-73::98-121::310-580::309-580
MITSASDTGSLLKFRDSLENNNALLSSWNASIPPCSGSSHWPRVQCYKGHVSGLKLENMRLKGVIDVQSLLELPYLRTISLMNNDFDTEWPDINKIVGLKTLFLSNNNFSGEIPAQAFQGMQWLKKIHLSNNQFTGPIPTSLASMPRLMELRLEGNQFTGPIPNFQHAFKSFSVANNQLEGEIPASLHNMPPSSFSGNEGVCGAPLSACSSPKKKSTASIVAAAVLVIVALIVIGAVILLVLHQRRKQAGPEVSAENPSSIMFQSQQKEASSSDEGSRGSPTSSSHRSRSLRLLFVRDDREKFDYNELFRASAKMLGSGCFSSSYKVALLDGPEMVVKRFKQMNNVGREEFDEHMRRIGRLNHPNLLPLVAYYYRKVEKLLVTDFVHNGSLAVRLHGYQALGQESLDWASRLKIVKGIAKGLEHLYKEMPSLIAAHGHLKSSNVLLSESLEPILTDYGLGPVINQDLAPEIMVIYKSPEYVQHGRITKKTDVWSLGILILEILTGKFPANLLQGKGSELSLANWVHSVVPQEWTREVFDKDMEGTNNSEGEMVKLLKIALACCEGDVDKRWDLKEAVERIHEVNEEEVKSSLSPWMVN

SEQ ID NO: 151147 - protein, 159 aa, Glycine max
  Coding DNA Sequence Number=SeqID_34369
  Gene Ontology: Mol. function=transcription factor activity; Cellular component=nucleus; Biological process=regulation of transcription, DNA-dependent
  Homolog annotation: Hit_ID=Q9FK12; Match level="QueryCoverage=84%, HitCoverage=43%, E-value=1e-16, Identity=36%"; Hit description =Similarity to pathogenesis-related genes transcriptional activator
  Pfam annotation: Domain name=AP2; Domain location=90-141; Score=53.5; E_value=7e-13; Accession=PF00847.10; Description=AP2 domain
MASSQRQSATKQGSPSSQKGNEKATSFGECSWKTLRITYTDPDATDSSSDEENDKVSNGGPKRRFIDITNPNWKDPNCKLSIRKGKRICSSKYLGVRRRPWGKYAAEIRDPRQKNCRKRLWLGSYDTEIEAAMTFNVKRQEFEREMALERGDNASVHSE

SEQ ID NO: 151148 - protein, 310 aa, Glycine max
  Coding DNA Sequence Number=SeqID_34370
  Gene Ontology: Mol. function=protein kinase activity; Biological process=protein amino acid phosphorylation
  Homolog annotation: Hit_ID=Q9LPP1; Match level="QueryCoverage=91%, HitCoverage=64%, E-value=5e-36, Identity=35%"; Hit description=3 -phosphoinositide-dependent protein kinase-1, putative
MDSDAAAAIAIWKEIEASESYLVCSMYEEAAELASSVLERLRHGHHDIDRDMLESSAMVLLQAFNQLPTKTPDILNQLKLHFVSLKAIPTLVLLTGACFQIAQGSESALASVQQFLHDFLNGWSLEHSQYSSVITEAASRDQSPRFILPVDEYLQVVELYALTLLATVQKDVDLAISWVENASLPEENRQGLLRSLHSMHSSKSTILSQSSFQQSPTNSNEAYPLKEQSVSEGLPKALKSNEKYRSKEAVTKLSERIEACFWCFRGINLKIGTTKFVITSGKIMLGCLILFIYYVFRKKQATLNRDRKGS

SEQ ID NO: 151149 - protein, 59 aa, Glycine max
  Coding DNA Sequence Number=SeqID_34371
MAEGNSITLRRSGLIAGDELEGILGSNVEVVDELTDLELVDVGVEEVAQKGDVTPRPQP

SEQ ID NO: 151150 - protein, 298 aa, Glycine max
  Coding DNA Sequence Number=SeqID_34372
  Gene Ontology: Mol. function=catalytic activity; Cellular component =cellular_component; Biological process=metabolic process
  Homolog annotation: Hit_ID=Q1ERD4; Match level="QueryCoverage=86%, HitCoverage=34%, E-value=1e-126, Identity=83%"; Hit description =Oxidosqualene cyclase
  Pfam annotation: Domain name=Prenyltrans; Domain location=186-228; Score=34.3; E_value=4.2e-07; Accession=PF00432.11; Description =Prenyltransferase and squalene oxidase re
  Pfam annotation: Domain name=Prenyltrans; Domain location=235-294; Score=2.6; E_value=2.2; Accession=PF00432.11; Description =Prenyltransferase and squalene oxidase re
  Pfam module annotation: Pfam domain module=Prenyltrans::Prenyltrans; Domain location=186-228::235-294
MQVVQCQGYNGSQFWDVTFSIQAILAINLEDEYGSILKKANNFIKYSQITANSSGNLSHWYRHISKGGWPFSTADNGWPVSDCTAEGLKAAILLSNLPFETVGKPMETEQLWDAVNLILSLQNRNGGFASYELTRSYAWLEKINPTETFEDIMIDYQCVECTSSAIQGLVLFTQRYPRHRWKEIKTCIAKAANYIESIQLANGSWYGSWGICYIYGTWFGIKGLIDAGKSYQDSQSIRRGCEFLLSKQQLCGGWGESYIACQQKFVFGYNTIDFEAKNHGVTVNFEKQLCVVVAPPWG

SEQ ID NO: 151151 - protein, 853 aa, Glycine max
  Coding DNA Sequence Number=SeqID_34373
  Gene Ontology: Mol. function=protein binding; Cellular component =small nucleolar ribonucleoprotein complex; Biological process=rRNA processing
  Homolog annotation: Hit_ID=Q67WP2; Match level="QueryCoverage=98%, HitCoverage=97%, E-value=0.0, Identity=59%"; Hit description =Putative beta transducin
  Pfam annotation: Domain name=Utp21; Domain location=664-851; Score =186.6; E_value=6e-53; Accession=PF04192.3; Description=Utp21 specific WD40 associated putative domain
  Pfam annotation: Domain name=WD40; Domain location=171-209; Score =21.5; E_value=0.0031; Accession=PF00400.22; Description=WD domain, G- beta repeat
  Pfam annotation: Domain name=WD40; Domain location=214-253; Score =26.4; E_value=0.0001; Accession=PF00400.22; Description=WD domain, G- beta repeat
  Pfam annotation: Domain name=WD40; Domain location=258-296; Score =24.8; E_value=0.00031; Accession=PF00400.22; Description=WD domain, G-beta repeat
  Pfam annotation: Domain name=WD40; Domain location=304-342; Score =20.4; E_value=0.0067; Accession=PF00400.22; Description=WD domain, G- beta repeat
  Pfam annotation: Domain name=WD40; Domain location=463-501; Score =18.9; E_value=0.018; Accession=PF00400.22; Description=WD domain, G -beta repeat
  Pfam annotation: Domain name=WD40; Domain location=505-542; Score =9.6; E_value=2.7; Accession=PF00400.22; Description=WD domain, G -beta repeat
  Pfam annotation: Domain name=WD40; Domain location=546-584; Score =48.2; E_value=2.7e-11; Accession=PF00400.22; Description=WD domain, G-beta repeat
  Pfam module annotation: Pfam domain module=Utp21::WD40::WD40::WD40::WD 40::WD40::WD40::WD40; Domain location=664-851::171-209::214-253::258 -296::304-342::463-501::505-542::546-584
MGIFEPYRAIGCITSSVPFSVQRLGTETFLTVSVGKAFQIFNCAKLNLVLVGPQLPKKISALASYREYTFAAYGNNIAVFKRAHQFATWSSHNAKVKLLLLFGDHIVSVDARGNMFLWPFKGIDENHVPFGHIMLDEKFSPSCIMHPDTYLNKVLIGSEQGPMQLWNISTKKKIFEFKGWNSPISCCVSSPALDVVAIGCTDGRIHVHNIRYDEELVTFTHSTRGSVTSLSFSTDGQPLLASGGSSGVISIWNLEKKRLQSVVREAHDSVITSLHFFANEPVLMSSSADNSVKMWIFDTSDGDPRLLRFRSGHSAPPFCLKFYANGRHILSAGQDRAFRLFSVVQDQQSRELSQWHVSKRARKLKLKEEEIKLKPMIAFDCAEIRERDWCNVVTCHMDTAQAYLWRLQNFVLGEHILNPCPENPTPVKGCVITDYCFHTVTGLCHQCLWKFCLSRDSRGAYIDISESRSCAHDGEVVGVACDSTNTLMISAGYEGDIKVWDFKERDLKTKWDVGCSVVKIVYHRYNGLLATVADDLTIRLFDVVALRLVRKFEGHTDRITDLCFSEDGKWLLSSSMDGSLRIWDVILARQIDAIQVDASITALSLSPNMDILATTHVDQNGIYLWVNQAMFSSTSNVDSCASGKEVVSVTLPSISSAEHSRDEHYDEPVNASQPKDALHFPTQDKQIPELVTLSLLPKSQWQNLINLDIIKVRNKPTEPPKKPEKAPFFLPSVPSLSGEILFESDAAFTDYIKGLSPSSLDMELRMFQIIDDDDQQEAEKRPELVSIGWLLDYFIHELSSRNNFEFLQAVMRLFLKIHGETIRQQSCLQEKARKLLDIQCMKSRVANLLKAGG

SEQ ID NO: 151152 - protein, 315 aa, Glycine max
  Coding DNA Sequence Number=SeqID_34374
  Gene Ontology: Mol. function=GPI anchor binding; Cellular component =membrane; Biological process=cell wall catabolic process
  Homolog annotation: Hit_ID=Q93ZH0; Match level="QueryCoverage=90%, HitCoverage=69%, E-value=4e-59, Identity=42%"; Hit description=LysM domain GPI-anchored protein 1 precursor
  Pfam annotation: Domain name=LysM; Domain location=113-158; Score =16.4; E_value=0.01; Accession=PF01476.10; Description=LysM domain
  Pfam annotation: Domain name=LysM; Domain location=178-220; Score =43.5; E_value=7.1e-10; Accession=PF01476.10; Description=LysM domain
  Pfam module annotation: Pfam domain module=LysM::LysM; Domain location=113-158::178-220
MRNYMQFLNPQILCFLFFSALLLCLVETKSTIEPCNSSNSCPSLLSYLLPWDSKLSEIATRFNVNFFDILASNSLFPITPSSAHQILSAKSQVKIPISCSCVDGIRRSMSTIYTVHAADTLASISEGYGGLVSAEQIKIVNAINATNPLTYRGTLVIPLPCTCFDNVNNGGNAIYMSYVVQRRESLGSIATKFGTTVSDLETVNGFGEATVDPGDILSIPIAACSSATLNWYDESMIVPNGSYTLTATNCIKCTCEPTDITLQCVPSGLDVPCYNLRCKGSNLIIGDQCVDLSQTACNVSQCVYRGHRGGKILSR

SEQ ID NO: 151153 - protein, 58 aa, Glycine max
  Coding DNA Sequence Number=SeqID_34375
MEERKEYGYGDTFLALSGTFPLSGFNTQSGPSGAKRESLGLNLYSNSSAVFLQNKRPP

SEQ ID NO: 151154 - protein, 607 aa, Glycine max
  Coding DNA Sequence Number=SeqID_34376
  Gene Ontology: Mol. function=structural constituent of ribosome; Cellular component=intracellular; Biological process=translation
  Pfam annotation: Domain name=DUF1666; Domain location=368-606; Score =405.4; E_value=7.9e-119; Accession=PF07891.2; Description=Protein of unknown function (DUF1666)
VCPWCLGLITDMHEPVGDDIRDFDISVQTMFSHFGATTKKMLLCPKEEALVKLFYNVVSSPFQLLFLILFSSSVFLVTFLTFTGRFPLIQRDQEYEYVYTEDEEEEEEEENQEGYSCVDSNERLQVTCGKETHVFLQNDEGHQRTHSYSEEFISHEESLNEEESEEKHYSEMLSLHNSPQVSDLENEEVETIQVDFPERDPDSVPNSAQVERRTTSPISLSAYKRNKNRDDDHVSIEIIKNKKVQETNLARDERFFVFASTQLQSKKLMIEEKDDESSKWKSSIIGRDSDTEDEFSCSSRSCPKWESYTLFQKYDEEMAILDRISAQKLHETESLRSIQMSPRSMSERIVYKFQNMNKKPAEAGHNPYHELEAAYVAQICLTWEALSWNYKNFRSKHASHQDHDTGCSATVVQQFQQFQVLLQRYIENEPYENGRRPEIFARMRLLAPKLLLVPEYQDLEEDQKDGGFQCKISSASFLKIMEDGIKTFMNFLKNDKEKPCQILAAYFRRKQRGTVDPTLLRLMKKKRVKVKDLNHAGKCLRKRKLKVEKDMDILMALIDLKVVSRVLRMNDLSEEQLHWCEEKMSKVRIMEGKLQRDYSTPLFFPSH

SEQ ID NO: 151155 - protein, 1268 aa, Glycine max
  Coding DNA Sequence Number=SeqID_34377
  Gene Ontology: Mol. function=microtubule motor activity; Cellular component=microtubule associated complex; Biological process =microtubule-based movement
  Homolog annotation: Hit_ID=Q5FAM3; Match level="QueryCoverage=85%, HitCoverage=99%, E-value=0.0, Identity=43%"; Hit description =Putative Kinesin motor protein-related
  Pfam annotation: Domain name=CH; Domain location=64-170; Score=30.0; E_value=8.3e-06; Accession=PF00307.21; Description=Calponin homology (CH) domain
  Pfam annotation: Domain name=Kinesin; Domain location=780-1072; Score= 406.6; E_value=3.6e-119; Accession=PF00225.13; Description=Kinesin motor domain
  Pfam annotation: Domain name=Tropomyosin; Domain location=551-750; Score=-115.9; E_value=0.054; Accession=PF00261.10; Description =Tropomyosin
  Pfam module annotation: Pfam domain module=CH::Kinesin::Tropomyosin; Domain location=64-170::780-1072::551-750
MAHKKVVLFDSNLLGTIFSSSVRNIVMNSPPDDNSSEPTELGSPDASSNENGNFLSCYGEVEAKHRLLLVQWLTCLVPSLNLPINVTDGELRACLSNGTVLCQILNKIRHGTVIVVSEPDNFLPSQSENVKTFLKALDGMGLPRFEISDLEKGSMKAVVDCLLTLREKSLQNALGDNISVTNSNIVSPHGNTPLSFHCSPTFGGEQRKIAAGSMLQRVKSSPVMAESSASLIHHVGHNFHEVFQMKPGSYADLPAAKIAEMMKSNSIDNAPTQSLLSVVNGILEESVERRNGEIPHRVACLLKKVTQEIERRMSTQAEHLRTQNNLFKAREEKYQSRIRVLEALASGTIDESEICPSQFQQLKGEKIKEKVKKVDENEVVRLIKEQEDKNLEISALKVELETAKRTYEVQFSQMEEEANSFKAALTRKVQEYEHQLEELRNEAEKINEEVKTTDEEESIKFMKEQEDKKLEISSLKQELKTKKKTYEVQCSQLEEDAKDAKAELTQKAQEYENQLEALGNKVEKIKEEVKTADEKEIVRLMKEQEDKNLEISALKQELETTKRTYEVQCSQLETQAKDAKAELTQKSQEYEQRLEELRNKVEEIREEEKKADEKEIIRLMKEQEDKNLEISSLKQDLEATKKTNEVQCSQLEGEAKGAKAELEQKSQEYEHQLEELRNKVKELEVSSDSKDQKWNMKMNQMQTVIKFQFSSLQKLKLSWESIKHNVMKEQTVYAEDCDRLGVYLKPLLHAAENYHAVLAENRKMFNEIQELKGNIRVFCRIRPFLSGKKDKQSIVELIGENDLVVANPSKEGKDALRSFKFNKVFGSATTQAEVYSDIQSFIRSVLDGYNVCIFAYGQTGSGKTYTMTGPNGATSETIGVNYRALNDLFKIATSRESFIDYEIGVQMGLAVPDASLFPVKSPSDVIKLMDIGLKNRAIGATAMNERSSRSHSVLSIHICGKDLKIGSTMVGNLHLVDLAGSERVDRSEVIGDRLKEAQHINKSLSALGDVIFALSQKSPHVPYRNSKLTQLLQTSLGGQAKTLMFVQINSDISSYSETLSTLKFAERVSGVELGAARSSKESKEVRELMEQVSSLKNAISAKEEEIQRLQLLKGSVGSIVWRNQIPRSRSIKHYEADNQQPMDDHIHQSESLHQSELNGGNIGKKVAANAETSGFTDSDFDGKSSDLSDSSVAPGTETDGSENSSLTEGKKSSDKRSKAIRKTVQVMRKLSRTSSTATTPVKDDPVKKSPGIKKSVSIGNLKPPKLWK

SEQ ID NO: 151156 - protein, 368 aa, Glycine max
  Coding DNA Sequence Number=SeqID_34378
  Gene Ontology: Mol. function=metal ion binding; Cellular component =intracellular; Biological process=regulation of transcription
  Homolog annotation: Hit_ID=Q8RWD0; Match level="QueryCoverage=97%, HitCoverage=96%, E-value=5e-62, Identity=39%"; Hit description=Zinc finger protein CONSTANS-LIKE 16
  Pfam annotation: Domain name=CCT; Domain location=319-357; Score =69.1; E_value=1.5e-17; Accession=PF06203.4; Description=CCT motif
  Pfam annotation: Domain name=zf-B_box; Domain location=10-57; Score =46.1; E_value=1.2e-10; Accession=PF00643.14; Description=B-box zinc finger
  Pfam module annotation: Pfam domain module=CCT::zf-B_box; Domain location=319-357::10-57
MKDAGALGGKTARACDSCVSRRARWFCAADDAFLCHACDTLVHSANQLASRHERVRLQTASSKATTTTTHAWHSGFTRKARTPRHNNSKHFALQQRLKHEVLFNNTSVLPLVPELGGEEQEPVVVDNDETEEQMLCRVPVFDPFDVRTDDLDSFSDMDFSEFAADVEGRLDKEDDEISAYVGGGEGVQGVLAKVKGEEEIDGDVACYLESVFDMISDDAFHWNNIESVVSDAREEKGCVVPCDGGVSEQGGIKRDIFLRLNYDEVITAWSSQGSSPWTTSNPPKFNSDYDFSLGLSGVDGEGRSLRGHLDGGREARVSRYREKRRTRLFAKKIRYEVRKLNAEKRPRMKGRFVKRTCFVGANAFPAYH

SEQ ID NO: 151157 - protein, 134 aa, Glycine max
  Coding DNA Sequence Number=SeqID_34379
  Gene Ontology: Mol. function=catalytic activity; Cellular component =cellular_component; Biological process=metabolic process
  Homolog annotation: Hit_ID=Q1ERD4; Match level="QueryCoverage=97%, HitCoverage=17%, E-value=3e-50, Identity=70%"; Hit description =Oxidosqualene cyclase
MWKLKFSKSNEDEWIMQSVNNHIGRQFWEFDPHLGTKEERAQVEQVHKEFNKNRFKYKHSSDLLMRLQFEREKGLKTKLSKIEIQSEQDINEEVVRNTLKRALRSYSALQADDGFWPADYGGPLFLLPGLVHSF

SEQ ID NO: 151158 - protein, 51 aa, Glycine max
  Coding DNA Sequence Number=SeqID_34380
  Gene Ontology: Mol. function=DNA binding; Cellular component=nucleus; Biological process=regulation of transcription
  Homolog annotation: Hit_ID=Q9LS50; Match level="QueryCoverage=99%, HitCoverage=16%, E-value=1e-18, Identity=82%"; Hit description =Similarity to NAM
  Pfam annotation: Domain name=NAM; Domain location=5-51; Score=-33.5; E_value=0.00022; Accession=PF02365.6; Description=No apical meristem (NAM) protein
MEEKLPPGFKFHPTDEELITYYLLRKVSDVGFTSKAVAVVDLNKSEPWDLP

SEQ ID NO: 151159 - protein, 278 aa, Glycine max
  Coding DNA Sequence Number=SeqID_34381
  Gene Ontology: Mol. function=DNA binding; Cellular component=nucleus; Biological process=regulation of transcription
  Homolog annotation: Hit_ID=Q9LS50; Match level="QueryCoverage=93%, HitCoverage=83%, E-value=9e-50, Identity=45%"; Hit description =Similarity to NAM
  Pfam annotation: Domain name=NAM; Domain location=9-96; Score=137.5; E_value=3.7e-38; Accession=PF02365.6; Description=No apical meristem (NAM) protein
MAYNIIFWTLTVDKLIRKASMGEKEWYFFSLKDRKYPTGLRTNRATESGYWKTTGKDKEIFGGGVLIGMKKTLVFYMGRAPRGEKSNWVMHEYRLANKQPYRSSKEERVICRVFQKSSAPKKPQQTSSSQPSQESPTSMVNEFGDVDLPNLNSIANSSSSFTNNIAYNINGDPSNAVNTNMNLTMNWPSGFLNPNLSVNSLLLKASQLRNTYQQREAATSSDHHFATYVPQGFSHNNTIGTEHHLMTPNLSATSSSSKALEYSCVPQQEQPFNMDSIW

SEQ ID NO: 151160 - protein, 739 aa, Glycine max
  Coding DNA Sequence Number=SeqID_34382
  Gene Ontology: Mol. function=RNA binding; Cellular component =ribonucleoprotein complex; Biological process=regulation of translation
  Homolog annotation: Hit_ID=Q6K4E4; Match level="QueryCoverage=89%, HitCoverage=71%, E-value=1e-118, Identity=37%"; Hit description =Putative CRS1
  Pfam annotation: Domain name=CRS1_YhbY; Domain location=148-231; Score=84.2; E_value=4.1e-22; Accession=PF01985.11; Description=CRS1 YhbY domain
  Pfam annotation: Domain name=CRS1_YhbY; Domain location=315-399; Score=44.1; E_value=4.9e-10; Accession=PF01985.11; Description=CRS1 YhbY domain
  Pfam annotation: Domain name=CRS1_YhbY; Domain location=526-613; Score=114.8; E_value=2.5e-31; Accession=PF01985.11; Description=CRS1 YhbY domain
  Pfam module annotation: Pfam domain module=CRS1_YhbY::CRS1_YhbY::CRS1_ YhbY; Domain location=148-231::315-399::526-613
  Subcellular localization annotation: CTP_CleavageSite=39; ConfidenceScore=5.52e-01
MRLSMKSALLSTLPPSSSVLLFSSYSKFKLKSPLGIPIRALTSSSLPTTRDHDDLFDPLSLPAPQHLHKATNAIERIALRLRNLGLASTTDLADAEDDFLRREWLRPDQALFPWDKGQEEDAEEPGEQQKEMLKKKNVNASTLAEQTLVEEELRRLRTLGMSLKEKITIPKAGLTRAVLDRIHRHWSNCELVRLKFHEFLAQNMKLAHQIVEHRTRGLVIWRSGSYMWVYRGKNYQGPVESDATSMEKSEAVWWKGENMTPEEAEFNRMLDGFGPRFVEWWGTGILPVDADSLPPMVPGYKTPLRLLPAGMRPQLTNDELTNMRKLAKSLPCHFALGRNRNLQGLASAILRLWEKSLVAKIGVKRGIVNTNNELMAQELKALTGGTLLLRNKYYIVIYRGKDFVPTSVAAVIAERQELTKQVQDVEEKVRCKALDSTPSGEDESTAQAGSLAEFYVAQACWGRDISTEERERMMQEVAKAKNAKLVKKIECKLAVAQAKRLRAEKLLAKIEASLLPVGPDYDKETITDEERVMFRSVGLRMKAYLPLGIRGVFDGVIENMHLHWKHRELVKLITKQKTLAFVEDTARLLEYESGGILVAIDKVPKGFSLIYYRGKNYRRPMTLRPRNLLTKAKALQRSVVMQRHEALSQHHLNVSRISVCSPAHVYAIIIPTVDIPTRQHQGLSQDLGTKDRWNVEDHNQIDHISEFTQSEEEYSDGDDTDGNFNDDEYSECNDNDSEF

SEQ ID NO: 151161 - protein, 188 aa, Glycine max
  Coding DNA Sequence Number=SeqID_34383
  Gene Ontology: Mol. function=catalytic activity; Cellular component =cellular_component; Biological process=metabolic process
  Homolog annotation: Hit_ID=Q2WGL6; Match level="QueryCoverage=83%, HitCoverage=20%, E-value=5e-77, Identity=83%"; Hit description =Cycloartenol synthase
MVAAAPPPCGAGLTEVRWRHGMWKLKFAEGGNPWLRTLNNHVGRQVWEFDPKLGSPQDLLEIEKARQNFHDNRFTHKHSADLLMRMQFARENPTREVLPKVGVKDIEDVTQEIVTKTLRRAVSFHSTLQCHDGHWPGDYGGPMFLMPGLVITLSITGALNTVLTEEHRKEICRYLYNHQVRTSCHFAP

SEQ ID NO: 151162 - protein, 323 aa, Glycine max
  Coding DNA Sequence Number=SeqID_34384
  Gene Ontology: Mol. function=protein binding; Cellular component =nucleus
  Homolog annotation: Hit_ID=Q69JZ7; Match level="QueryCoverage=99%, HitCoverage=100%, E-value=1e-116, Identity=68%"; Hit description =Putative XAP-5 protein
  Pfam annotation: Domain name=XAP5; Domain location=109-321; Score =348.7; E_value=9.9e-102; Accession=PF04921.5; Description=XAP5 protein
MSGMGDGYVGTAQDAVRIRRLEKQREAERRKIQELKTKSASAKDQPGLLQFGSSTSEILETAFKKETVGLVTREQYVEKRVNIQSKIEEEEKEKLQKQQQEEEELQLQKRKKRKIRGNSRLSFAEDIDNEPQEDEPHHNNLEANRLRCGKLGKDPTVETSFLPDRSAEDSCSVSERLRSKLSVKGCANSGFVSRSKFEVRKGDSIGEFLRAVQQQLAPEFREIRTTSVENLLYVKEDLIIPHQHSFYELIVNKARGKSGPLFHFDVHEDVRTIADATIEKDESHAGKVVERHWYEKNKHIFPASRWEIYDPTKKWERYTIHGD

SEQ ID NO: 151163 - protein, 252 aa, Glycine max
  Coding DNA Sequence Number=SeqID_34385
  Gene Ontology: Mol. function=transcription regulator activity; Cellular component=nucleus; Biological process=regulation of transcription
  Homolog annotation: Hit_ID=Q5FAM4; Match level="QueryCoverage=66%, HitCoverage=63%, E-value=3e-51, Identity=61%"; Hit description =Putative bZIPtranscription factor protein
  Pfam annotation: Domain name=HLH; Domain location=140-190; Score =20.2; E_value=0.001; Accession=PF00010.16; Description=Helix-loop -helix DNA-binding domain
MAEFTADLQSLRFPFLDIDNMEIQNFMMPFSCESFLGSPEAEFPGNLLEENFPALVQCVDHNEVPVLVPIGSVKNEIHEGQKRKATDICEPSSANSTPAVSESGSKTKNSSGRGKRVKRNSIEDKKPNEVVHVRAKRGQATDSHSLAERVRRGKINEKLRCLQNIVPGCYKTMGMAIMLDEIINYVQSLQHQVEFLSMKLTAASTYYDLNSESDALETMQRARASEVKELGKCVREGSEEVSCFEPTWPWPL

SEQ ID NO: 151164 - protein, 78 aa, Glycine max
  Coding DNA Sequence Number=SeqID_34386
MKSKRGKENDLRRGARIWRLWHWKGRWFSGVAHSDDEDEVPAMTVVVLDAARDGGCSMVRRYLVFSFGEGFHRGSRLA

SEQ ID NO: 151165 - protein, 228 aa, Glycine max
  Coding DNA Sequence Number=SeqID_34387
  Homolog annotation: Hit_ID=P93422; Match level="QueryCoverage=33%, HitCoverage=10%, E-value=4e-10, Identity=45%"; Hit description =Histidyl-tRNA synthetase
  Subcellular localization annotation: CTP_CleavageSite=42; ConfidenceScore=5.33e-01
MAEASVTVGGKASSISSSSVFAVATGRAHVRIDSSALDRLPKTETTSASPQLRISVPDFLTLEESRAFLLVLLNNLVLSNAPSRVPLLLSQTLNSNPPTFHFHDGADVTQQDLLTSSTLLAVSAIVDHQSAALSAFADVAAAFSCEALKADATPFNLMDSGDGHTSKDEVAVAANIRVLLNGSKSVGKEKIRSVARVPKVHGSVREQAKALHSRMRVELNSGVKGVVG

SEQ ID NO: 151166 - protein, 320 aa, Glycine max
  Coding DNA Sequence Number=SeqID_34388
  Gene Ontology: Mol. function=catalytic activity; Cellular component =cellular_component; Biological process=metabolic process
  Homolog annotation: Hit_ID=Q2WGL6; Match level="QueryCoverage=84%, HitCoverage=35%, E-value=1e-152, Identity=90%"; Hit description =Cycloartenol synthase
MWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQVARLLAIGARLSEYYEKIYHGDHFMLLLVNVIIGSFNTYDANINKMTVFH

SEQ ID NO: 151167 - protein, 530 aa, Glycine max
  Coding DNA Sequence Number=SeqID_34389
  Gene Ontology: Mol. function=transferase activity, transferring hexosyl groups; Cellular component=mitochondrion; Biological process= metabolic process
  Homolog annotation: Hit_ID=Q6YS36; Match level="QueryCoverage=82%, HitCoverage=78%, E-value=8e-47, Identity=25%"; Hit description =Putative fertility restorer homologue
  Pfam annotation: Domain name=PPR; Domain location=158-192; Score =19.5; E_value=0.012; Accession=PF01535.11; Description=PPR repeat
  Pfam annotation: Domain name=PPR; Domain location=193-227; Score =28.1; E_value=3.1e-05; Accession=PF01535.11; Description=PPR repeat
  Pfam annotation: Domain name=PPR; Domain location=229-263; Score =44.2; E_value=4.6e-10; Accession=PF01535.11; Description=PPR repeat
  Pfam annotation: Domain name=PPR; Domain location=264-298; Score =46.3; E_value=1.1e-10; Accession=PF01535.11; Description=PPR repeat
  Pfam annotation: Domain name=PPR; Domain location=299-333; Score =33.0; E_value=1.1e-06; Accession=PF01535.11; Description=PPR repeat
  Pfam annotation: Domain name=PPR; Domain location=334-368; Score =25.9; E_value=0.00014; Accession=PF01535.11; Description=PPR repeat
  Pfam annotation: Domain name=PPR; Domain location=369-403; Score =44.4; E_value=3.9e-10; Accession=PF01535.11; Description=PPR repeat
  Pfam annotation: Domain name=PPR; Domain location=404-438; Score =39.2; E_value=1.4e-08; Accession=PF01535.11; Description=PPR repeat
  Pfam annotation: Domain name=PPR; Domain location=72-106; Score=17.5; E_value=0.049; Accession=PF01535.11; Description=PPR repeat
  Pfam module annotation: Pfam domain module=PPR::PPR::PPR::PPR::PPR::PP R::PPR::PPR::PPR; Domain location=158-192::193-227::229-263::264 -298::299-333::334-368::369-403::404-438::72-106
MGSIRRAEAWFVKIACTVFVRSNSLDPFVGYFSKHLTPSLVYEVVNRLHIPNLGFKFVEFCRHKLHMSHSYLTYSLLLRSLCRSNLHHTAKVVYDWMRCDGQIPDNRLLGFLVWSYAIVGRLDVSRELLADVQCNNVGVNAVVYNDLFNVLIRQNKVVDAVVLFRELIRAGEIDEAFRLLNDLRSFGCLPDVITYNTLIHGLCRINEVDRARSLLKEVCLNGEFAPDVVSYTTIISGYCKFSKMEEGNLLFGEMIRSGTAPNTFTFNALIGGFGKLGDMASALALYEKMLVQGCVPDVATFTSLINGYFRLGQVHQAMDMWHKMNDKNIGATLYTFSVLVSGLCNNNRLHKARDILRLLNESDIVPQPFIYNPVIDGYCKSGNVDEANKIVAEMEVNRCKPDKLTFTILIIGHCMKGRMPEAIGIFHKMLAVGCAPDEITVNNLRSCLLKAGMPGEAARVKKVLAQNLTLVLWQSANQWIDTAFHHYALSTWCRCLQLVDQRHAIIGQVDFSLFMVSFFTFHGLMAGLKS

SEQ ID NO: 151168 - protein, 182 aa, Glycine max
  Coding DNA Sequence Number=SeqID_34390
  Gene Ontology: Cellular component=plastid; Biological process =peroxisome organization and biogenesis
  Homolog annotation: Hit_ID=Q2QQS3; Match level="QueryCoverage=99%, HitCoverage=35%, E-value=2e-61, Identity=60%"; Hit description =LILLIM08, putative, expressed
MPSDAKQPSRLAMWKGVMFAYTVIALCLFPLAIGGYWAYGNLIPTNGGMLGALQKYHEHDTSKFIIALTSLLVVINSLSSFQIYAMPVFDDLEFRYTSKMNRPCPRWLRIAFRGLFGCLAFFIAVALPFLRSLAGLIGGAALPITLAYPCFMWIQIKKPQRCSTNWYLNWTLGVVGMILSVL

SEQ ID NO: 151169 - protein, 133 aa, Glycine max
  Coding DNA Sequence Number=SeqID_34391
  Gene Ontology: Cellular component=integral to peroxisomal membrane; Biological process=peroxisome organization and biogenesis
  Homolog annotation: Hit_ID=Q9SXF7; Match level="QueryCoverage=99%, HitCoverage=26%, E-value=4e-38, Identity=58%"; Hit description=Amino acid transporter-like protein 1
MGKLLALFPIMYLSGGTCVTLIMIGADTMKIFFQMVFGTASPLTTIEWYLVFTCTAILLAQLPNLNSIAGVSLIGAITAVSYCALICIVSVVQGRLDHVSYEPPRGQSEASMIFSAWNALGIIAFAFRGHNLV

SEQ ID NO: 151170 - protein, 60 aa, Glycine max
  Coding DNA Sequence Number=SeqID_34392
MTGPLSRSSPPLLQTSPLPGVGEDCCLGSMVKFQVLTQLVRMTGSPDTQYDMDMRLQGIS

SEQ ID NO: 151171 - protein, 39 aa, Glycine max
  Coding DNA Sequence Number=SeqID_34393
MERHRNRKVHKLSQKESFHTDPPFKLNWRDGTTTRNGVE

SEQ ID NO: 151172 - protein, 89 aa, Glycine max
  Coding DNA Sequence Number=SeqID_34394
MKMKANKTRNELKVSDSNTYRLKNEERTKNDEERRKIFTDLLTEVSQKRYGSTSTQFFFTETNFTEAKEAPKTIFQQNVEELAAQLLPP

SEQ ID NO: 151173 - protein, 451 aa, Glycine max
  Coding DNA Sequence Number=SeqID_34395
  Gene Ontology: Mol. function=serine-type endopeptidase activity; Cellular component=cytoplasm; Biological process=proteolysis
  Homolog annotation: Hit_ID=Q658B2; Match level="QueryCoverage=99%, HitCoverage=65%, E-value=0.0, Identity=65%"; Hit description =Putative prolyl endopeptidase
  Pfam annotation: Domain name=Peptidase_S9; Domain location=208-448; Score=272.0; E_value=1.2e-78; Accession=PF00326.11; Description =Prolyl oligopeptidase family
YILLHIAEGCDPVNKLYYCDLSKLPNALEGFRNGNSLLPFAKLIDNFDAQYEAIANDDTSRVDLKEPTAWADVLQESEKDVLESACAVNGNQLIDPCCINYQLRLAVFLKFLHDVKIVWFSFGFTSFLTPGIIYQCNLGTEIPDMKIFREIVVPGFDRSEFHVKQDFVTSKDGTKIPMFIVAKKDITLDGSHPCLLYGYGGFNINITPYFSVSRIVLTRHLGVVFSIANIRGGGEYGEEWHKAGSLARKQNCFDDFISAAEYLVSTGYTQPKKLCIEGGSNGGLLVGACINQRPDLFGCALAHVGVMDMLRFHKFTIGFFRSVMSSHAWTSDYGCSDKEEEFHWLIKYSPLHNVRRPWEQHHDQSFQYPSTMLLTADHDDRVVPLHTLKLLATMQYVLCTSLEKSPQTNAIIGRIDCKSGHGAGRPTQKMIDEAADRYGFMAKVLEVHWIE

SEQ ID NO: 151174 - protein, 307 aa, Glycine max
  Coding DNA Sequence Number=SeqID_34396
  Gene Ontology: Mol. function=fatty-acid synthase activity; Cellular component=fatty acid synthase complex; Biological process=fatty acid biosynthetic process
  Homolog annotation: Hit_ID=O42484; Match level="QueryCoverage=95%, HitCoverage=35%, E-value=8e-44, Identity=38%"; Hit description=17 -beta-hydroxysteroid dehydrogenase type IV
  Pfam annotation: Domain name=MaoC_dehydratas; Domain location=165 -298; Score=40.8; E_value=4.7e-09; Accession=PF01575.9; Description =MaoC like domain
MNRDAALYALGVGVCLSDAVDGVELKYVYHENGQGSIKVLPTFATLLVLRSGASGYNLPGLEYDPRLLLHGQQYIELYKPLPSSCHIHNIVSLAGLHDKGKAAILEIETKSYEKESGDLLCMNRTTVFLRGAGGFSKSSKPFSYTNYPMNQNPAVKIPESKPFSVFEDRTQPSQACYNYAILALLYRLSGDYNPLHSDPMVAKVAGLYLSLFRGRSWGVLRFSQPILHGLCTLGWAVRAIIKCICRGDPDLIKSVAGRFLLHVYPGETLVTEMWLEGSRVIYRTKVKERKRTVLSGYVGLRGLTSSL

SEQ ID NO: 151175 - protein, 259 aa, Glycine max
  Coding DNA Sequence Number=SeqID_34397
  Gene Ontology: Mol. function=serine-type endopeptidase activity; Cellular component=cytoplasm; Biological process=proteolysis
  Homolog annotation: Hit_ID=Q658B2; Match level="QueryCoverage=95%, HitCoverage=33%, E-value=1e-103, Identity=69%"; Hit description =Putative prolyl endopeptidase
  Pfam annotation: Domain name=Peptidase_S9_N; Domain location=10-259; Score=148.9; E_value=1.3e-41; Accession=PF02897.5; Description =Prolyl oligopeptidase, N-terminal beta-propeller domain
MASLCALNYPPARRDDSVVEDYHGVKIADPYRWLEDPDAEEVKEFVAKQVQLTDSVLQKCETRGKLRETITKLFDHPRYDAPFRRANKYFYFHNTGLQPQNILYVQESLEGEAEALLDPNTFSEDGTVSLSTLSVSEDAKYLAYALSSSGSDWTTIKVMRIEDRNVEPDTLSWVKFSSISWTHDGKGFFYSRYPAPKDGEVVDAGTETNANLHHQLYYHFLGTDQSEDILCWRDPENPKYTFGGSVTDDGKVLNVLSLF

SEQ ID NO: 151176 - protein, 76 aa, Glycine max
  Coding DNA Sequence Number=SeqID_34398
MSVFNHEPPLTFREGSCSVVNVYVYSAIWKVKTSNICYTGRTKETRKCPNSKGNIGFTKNGGIEIIGFLTPDASGN

SEQ ID NO: 151177 - protein, 734 aa, Glycine max
  Coding DNA Sequence Number=SeqID_34399
  Gene Ontology: Mol. function=binding
  Homolog annotation: Hit_ID=Q9T041; Match level="QueryCoverage=37%, HitCoverage=32%, E-value=2e-46, Identity=36%"; Hit description =Microtubule-associated protein TORTIFOLIA1
  Pfam annotation: Domain name=HEAT; Domain location=129-164; Score =10.8; E_value=2.1; Accession=PF02985.12; Description=HEAT repeat
  Pfam annotation: Domain name=HEAT; Domain location=210-246; Score =20.2; E_value=0.0076; Accession=PF02985.12; Description=HEAT repeat
  Pfam annotation: Domain name=HEAT; Domain location=86-122; Score =22.8; E_value=0.0013; Accession=PF02985.12; Description=HEAT repeat
  Pfam module annotation: Pfam domain module=HEAT::HEAT::HEAT; Domain location=129-164::210-246::86-122
MKRAQGNGGLEMKQRIVGALNKVGDRDTQQIGMEELDRMAQGLRAEGIWSFLSCILDSDWEQKASIRKECVRLMGTLATYYDGLVLPHLPKMVASIVKRLRDPDSVVRDVCVNTVALLASKLGRDGEDKVFVVLVRPIFEALGEQNKHVQSSSALCLARIIDNTPHPPLSLLHKMLSRTLKLLKNPHFIAKPALLDFTRSIILAGGAPTHNILSAAISSIQDSLKHSDWSTRKAASLALADIALSAASFLGFFRASCLQSLESCRFDKVKPVRDAVMQALKYWTILPAPPDTPDPSETGSSLKENICRGDSSDLSSTTTESRHIQKVNMKSTMGRIPFSVKNYARNNHQKPDDWDVQVAVPRPHSLVEFQNKESESCSVTKQPLETMSADVTSMQDVGYEYVPMDDKQECSSVSNPPTDNFETKFLSASHDCFIQKMPIARSQRFSEEITSDERVKMQHPTSSDSTVTEPTHQTAHECCMQMANEMICIQNQLSDIEIKQANMMHQLQMFTTGIMDALSTIQSRITGLENVFDRLSQESLQRGRHSYSENSKLGRQSENVASPRFSICTPTPRPSVEINNKQSDSMSVKNSESWEKKAFSRSQPRIHSGDSLDMWKSNKVKATRKFTEKDVLNSSSKDTLQMGSVKNDGIFSATRITNARNDCSESNNNYWKHIVEMSTIHGPNCIAISIEAKKHLLSAVQEAMNLHFFSHAERRRVAELAMKLHHIWGKITES

SEQ ID NO: 151178 - protein, 47 aa, Glycine max
  Coding DNA Sequence Number=SeqID_34400
MCDKIANGGTLTCGLVSTVTGELRYSDALRLLNTLEDASKRLGTILQ

SEQ ID NO: 151179 - protein, 193 aa, Glycine max
  Coding DNA Sequence Number=SeqID_34401
  Homolog annotation: Hit_ID=Q9FGT3; Match level="QueryCoverage=79%, HitCoverage=76%, E-value=5e-49, Identity=61%"; Hit description =Arabidopsis thaliana genomic DNA, chromosome 5, TAC clone:K21L19
  Pfam annotation: Domain name=Aha1_N; Domain location=70-179; Score= -18.7; E_value=0.00075; Accession=PF09229.1; Description=Activator of Hsp90 ATPase, N-terminal
MESGALVSSEKEGQQGASYTYWVRKITEDAAPLPVPRKLNPEDVPPCHSQSQSRSATLGSAWNRAGTWEEKSLNNWATPRIKELLISLGSIQFSFGRAEVEDVTKCVGDAFMVIVRNKKRVGYTYELSLKVKGEWIIQGEKKFVGGHIDVPEFSFGELDELQLFKRYIRIPRIKAGDVRPSSTRVPQMPVRTG

SEQ ID NO: 151180 - protein, 83 aa, Glycine max
  Coding DNA Sequence Number=SeqID_34402
MDSLLVALLLTRKVVSIYKRHFALVSGCPKWKEYPIYYLVEVRLSEARDILHQDKTQICNDLKLFLQPVREKLLQFEQELKDR

SEQ ID NO: 151181 - protein, 116 aa, Glycine max
  Coding DNA Sequence Number=SeqID_34403
  Gene Ontology: Mol. function=hydrogen ion transporter activity; Cellular component=integral to membrane; Biological process=proton transport
  Homolog annotation: Hit_ID=Q7F1V0; Match level="QueryCoverage=86%, HitCoverage=21%, E-value=9e-39, Identity=69%"; Hit description =Putative heme binding protein cemA
  Pfam annotation: Domain name=CemA; Domain location=1-115; Score= -94.2; E_value=1.3e-05; Accession=PF03040.5; Description=CemA family
MGGHTFVTLNDTLYKKVALLKFTGYKIINNISDTGKAFLIILITDIFLGYHSESGWQTLLEIIVEHYGLEVDQSAITIFICLIPVVIDACVKLWLFKFLPRLSPRVTNIFREMKRH

SEQ ID NO: 151182 - protein, 74 aa, Glycine max
  Coding DNA Sequence Number=SeqID_34404
  Subcellular localization annotation: CTP_CleavageSite=39; ConfidenceScore=5.13e-01
MASASTSAPPPPPPLPRNDGSLLGSSTVITAKEFLYSISQKLNNSNYLLWCQQVKLVLKGRRLFHLLTEPQIPP

SEQ ID NO: 151183 - protein, 333 aa, Glycine max
  Coding DNA Sequence Number=SeqID_34405
  Gene Ontology: Mol. function=RNA-directed DNA polymerase activity; Cellular component=chromatin; Biological process=chromatin assembly or disassembly
MAFMHQGQNIRIQGDPSLVKSTISAKTLMRLVENKVEAMSILWIVEKEQRHVEILTEQDEELYSLLEEFTQGVTTAQGKSTTIRHDGSIRPAIASSCSGAIADTTIATSIHPATEDGSWRFRVDNRTLNKATIPDKFPILVIEELLDELNGIATSPRQILGTMRQHHLFANRKKCSFGKTEMSYLVHIVSKARVSMDPQKIEAILQWPLPKSIKEALRDINIIGTLYAKAVTTTLVLVTPHFGKPFSIECDVSRKGIGVLAIQHWTPYLLGQRFTDQKIFRPLLELRERRVDPALAKIMEELKKDPNSHPNTPWNMKGSIIRDDCCWQHRQPV

SEQ ID NO: 151184 - protein, 261 aa, Glycine max
  Coding DNA Sequence Number=SeqID_34406
  Gene Ontology: Mol. function=nucleic acid binding; Biological process= DNA integration
  Homolog annotation: Hit_ID=Q1T010; Match level="QueryCoverage=65%, HitCoverage=12%, E-value=2e-35, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLITNGGNVPAQLLVLDGKNWERWHIQMKALFEFQDVMEVVKNGVAAESAEPATEAVRNAYKDSKKKDAKAIFFLHQSVDDANFNLISKATSAKQAWDKLEKCYAGGDRIKKVKLQVLQRQFDSMMMEENEKIADFFARVKVVTNQMATQGETLTDGKICEKITRSLLEKYDYIVCVIEESKEVSEMSLEELQSSLEARELRLLERNKKKIAKQALLAQSSNKNSDDSNRGRSGFRGRGHGRNNRGRGGYVSSSGRGQNN

SEQ ID NO: 151185 - protein, 311 aa, Glycine max
  Coding DNA Sequence Number=SeqID_34407
  Homolog annotation: Hit_ID=Q9FGT4; Match level="QueryCoverage=86%, HitCoverage=27%, E-value=1e-106, Identity=72%"; Hit description =Arabidopsis thaliana genomic DNA, chromosome 5, TAC clone:K21L19
MSKPSPEISEEEAEDRLQDAIQEKFAVFGDKEHQAIDILLAEIDIYELFAFKHCKGRKVKLALCEELDERMRDLRNELQSFEGEEYDESHKKKAIEALKRMESWNLFSDTYETWTSVLASFMDLPVQEFQNYTVARDSFLAHLGATLWGSMRHIVSPSVADGAFHYYEKISFQLFFMTQEKVRHIKQLPVDMKAIMDGFSSLMVPSQKPMFSPHVLPLSEDPALAMAFAVARRAAAVPLLLINGTYRKTVRTYLDSSILQYQLQRLNKHGSLKGLSYILKSSCFRRPIVCTWKNKNMLGNPFEIEKRKGGN

SEQ ID NO: 151186 - protein, 137 aa, Glycine max
  Coding DNA Sequence Number=SeqID_34408
  Homolog annotation: Hit_ID=Q9FGT4; Match level="QueryCoverage=79%, HitCoverage=10%, E-value=3e-26, Identity=53%"; Hit description =Arabidopsis thaliana genomic DNA, chromosome 5, TAC clone:K21L19
MQIEWYNIWLDALDNFGRLYQGRDTAEIIEVKALQLLKGKDQDLKLHLEKVLKSGDYSGFQAECLTDTWIGKDRWAFIDLSAGPFSWGPAVGGEGVRTEASLPSVEKTIGSASGSNDVLDCVHVMYPAVNHTSHTHS

SEQ ID NO: 151187 - protein, 1419 aa, Glycine max
  Coding DNA Sequence Number=SeqID_34409
  Gene Ontology: Mol. function=nucleoside-triphosphatase activity; Cellular component=integral to membrane; Biological process=transport
  Homolog annotation: Hit_ID=Q5W274; Match level="QueryCoverage=98%, HitCoverage=96%, E-value=0.0, Identity=58%"; Hit description =Pleiotropic drug resistance protein 3
  Pfam annotation: Domain name=AAA; Domain location=210-355; Score= -34.5; E_value=0.087; Accession=PF00004.19; Description=ATPase family associated with various cellular activities (AAA)
  Pfam annotation: Domain name=ABC2_membrane; Domain location=1144 -1358; Score=238.2; E_value=1.8e-68; Accession=PF01061.14; Description=ABC-2 type transporter
  Pfam annotation: Domain name=ABC2_membrane; Domain location=533-704; Score=64.6; E_value=3.3e-16; Accession=PF01061.14; Description=ABC-2 type transporter
  Pfam annotation: Domain name=ABC_tran; Domain location=208-431; Score= 65.7; E_value=1.5e-16; Accession=PF00005.17; Description=ABC transporter
  Pfam annotation: Domain name=ABC_tran; Domain location=857-1047; Score=82.0; E_value=1.8e-21; Accession=PF00005.17; Description=ABC transporter
  Pfam annotation: Domain name=PDR_assoc; Domain location=709-772; Score=101.1; E_value=3.3e-27; Accession=PF08370.2; Description=Plant PDR ABC transporter associated
  Pfam module annotation: Pfam domain module=AAA::ABC2_membrane::ABC2 _membrane::ABC_tran::ABC_tran::PDR_assoc; Domain location=210 -355::1144-1358::533-704::208-431::857-1047::709-772
MELTPRGRTQGHVLTFERDADSFVEEDKELQSKWAAIEKLPTFKRIKTSFVDVSQEEGASSSSSSTVITLRSGSKRVADVSKLGAVEKRLFIDKLIKHIENDNLQLLQKLRERMDRDINGVPVDVGTLFQEIDKLVVFRVNVKLPTVEVKYKNLNVRAECEVVQGKALPTLWNSFSSSLSGFMKNISCTSQGAEISILNDVSGIIKPSRLTLLLGPPGCGKTTLLKALAGKLEQSLKFSGEISYNGYKLDEFVPQKTSAYISQYDLHVPEMTVRETIDFSARCQGVGGRADLVAEISRREIEEGIIPDPDIDTYMKAISVEGQSENLQTEYVLKILGLDICADILVGDALDRGISGGQKKRLTTGEMIVGPIKALFMDEISTGLDSSTTFQIVTCLQQLVHITDATAVLSLLQPAPETYELFDDLILMAEGKIVYHGPRSQALQFFKDCGFWCPERKGVADFLQEVISKKDQRQYWYRTDIPYKYVSVDEFSQIFKSSYWGRMLNDELSRPDDKSESHKNALSFSKYSLGKLDLFKACMKREILLMKRNSFIYVFKTAQLTITAIITMTVFIRTQRAVDLIGANYLLGSLYYTLVRLMTNGVAELIMTITRLPVVDKQKEFYLYPAWAYCLPSAILKIPFSVLDSIVWTSVTYYVIGYSPEITRQLLMSHGVIFTAASLPRWLRWGFWLSPMSYGEIGITLNEFLAPRWQKIQEGNITVGREVLRSHGLDFDSHFYWLSVGALLGFTILFDFGFVLALSYIKQPKMSRALVSKKRLSQLRERETSNSVELKSVTVDIGHTPRENQSTGKMVLPFEPLSIAFKDVQYFVDIPPEMKKHGSDEKRLQLLCDITGAFRPGILTALMGVSGAGKTTLMDVLSGRKTGGIIEGDIRIGGYPKVQKTFERVSGYCEQNDIHSPYITVEESVTYSAWLRLPTEIDSVTKGKFVEEVLETIELDYIKDCLVGIPGQSGLSTEQRKRLTIAVELVSNPSIIFMDEPTSGLDARAAAVVMRAVKNVVATGRTTVCTIHQPSIDIFETFDELILMKSGGRIIYSGMLGHHSSRLIEYFQNIPGVPKIKDNYNPATWMLEATSASVEAELKIDFAQIYKESHLCRDTLELVRELSEPLPGSKDLHFSTRFPQNSLGQFMACLWKQHLSYWRSPEYNLTRFIFMIVCAIIFGAVFWQKGKKINNQQDLFNVLGSMYIAVIFLGLNYCSTILPYVATERAVLYREKFAGMYSSTAYSFAQVVIEIPYILVQSILYVAITYPMIGFHWSVQKVFWYFYTTFCTFLYFVYLGMMVMSMSSNLDIASVLSTAVYTIFNLFSGFLMPGPKIPKWWIWCYWICPTAWSLNGLLTSQYGDIEKEVLVFGERKSVGSFLRDYYGFRHDRLSLVAVVLIVYPIVYASLFAYFIKKMNYQKR

SEQ ID NO: 151188 - protein, 251 aa, Glycine max
  Coding DNA Sequence Number=SeqID_34410
  Gene Ontology: Mol. function=nucleic acid binding; Biological process= DNA integration
  Homolog annotation: Hit_ID=Q1S7C5; Match level="QueryCoverage=59%, HitCoverage=15%, E-value=8e-25, Identity=37%"; Hit description =Integrase, catalytic region
MANSNSLPFAPQSFPNFIAEKLDDSNYLHWKQQIEPVINSRLDATYLASIDAFESILSHVLGSIHSYQVWDKIHKHFFTQMKACACQLQTDLHTTSLEGKTMCKFLSQIKNIADELASAGSPIQHEEYVDSIWEGLPQDYAIVFSVIESKFETPPVTEVKVLLLAHESAYMCGIAGHSSYSDHDGGHHGGDLTPPISLMNLWCCMILLHCNLCSIVAHSQANSKPNTWVNPANTKSQNQPASTQATPSAIC

SEQ ID NO: 151189 - protein, 210 aa, Glycine max
  Coding DNA Sequence Number=SeqID_34411
  Gene Ontology: Mol. function=nucleoside-triphosphatase activity; Cellular component=integral to membrane; Biological process=transport
  Homolog annotation: Hit_ID=Q5W274; Match level="QueryCoverage=94%, HitCoverage=56%, E-value=2e-79, Identity=55%"; Hit description =Pleiotropic drug resistance protein 3
  Pfam annotation: Domain name=ABC_tran; Domain location=1-118; Score= -53.1; E_value=0.0086; Accession=PF00005.17; Description=ABC transporter
MFLVQATSIKALKSSLQTDYILKILGLDICANTSVDIRRGISGGQKKRLTTGEMIVGPTKALFMDEISNGLDSSTTFQIISCLQHLVHITNATALISLLQPAPETFDLFDDIVLMAEGKIVYHGPHDYILEFFEDCGFKCPQRKGTADFLQEVTSTKDQARYWNSSEKPYSYVSIDQFIEKFKDFPFGLKLKEELSKPFDESQPQECPCI

SEQ ID NO: 151190 - protein, 529 aa, Glycine max
  Coding DNA Sequence Number=SeqID_34412
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=94%, HitCoverage=45%, E-value=2e-79, Identity=37%"; Hit description=SBP
  Pfam annotation: Domain name=SBP; Domain location=1-31; Score=2.2; E _value=0.0092; Accession=PF03110.5; Description=SBP domain
FHVLQEFDEGKRSCRRRLAGHNRRRRKTHPDVSVVNEGSLNDQRDSNYLLMSLLRILTNLHSNGSDHTRNQDILSHLLKNLASLAGPNNGGRLAPLLEESKGLVNAGTHGADHDKPNLNSNAPEASRPSSSIKTDNGIIAQDPPMSVVQYETPANGMTQKCIASGDGVGNLKPPSGPLLSNVCEPRDSVPSQLTTAETKVGRGNLNNIDLNNVYNDIQNTVENHKKPYPPVASGMGFIDHASWLQCDSLKSSPPQTSRNSDSTSTQSPSSSSGEAQISLLIKILFCQGHHLKSPFQSRTDRIVFKLFGKDPSDFPLLLRSQILNWLSRSPTEIESYIRPGCIILTIYLRLEKSAWEELYCNLGSSLRKLLAASNDSFWRTGWVYARVQHAVAFLYNGQVVLDVPLRLKSPQHCMISCINPLAVPASASAQFIVKGFNLSQSSTSPDVDLLLMISRLHCALEGKYLVHASCHDLIGGADAPIQHLSFSCQIPSVTGRGFIEVVSIHHTPKIVCCKIPETNRRTQSSGACF

SEQ ID NO: 151191 - protein, 133 aa, Glycine max
  Coding DNA Sequence Number=SeqID_34413
  Gene Ontology: Mol. function=helicase activity
  Homolog annotation: Hit_ID=Q1SRJ5; Match level="QueryCoverage=88%, HitCoverage=17%, E-value=2e-19, Identity=38%"; Hit description =Probable helicase [imported]-Arabidopsis thaliana-related
PTYREACFAKGFLQDDREFVEAIKEAKDWGVITKPEELWSQTWNWLAEDIAYHYKKTTLNTELLIDDEQLKNLTLLEIEKLLHANQKSLRDYPTMPYPEGGNPASCLENSLILSELNYNNDEARSEFEIFFYG

SEQ ID NO: 151192 - protein, 91 aa, Glycine max
  Coding DNA Sequence Number=SeqID_34414
  Gene Ontology: Mol. function=protein kinase activity; Biological process=protein amino acid phosphorylation
  Homolog annotation: Hit_ID=Q9LTU4; Match level="QueryCoverage=97%, HitCoverage=6%, E-value=4e-13, Identity=45%"; Hit description =Helicase-like protein
  Pfam annotation: Domain name=DUF889; Domain location=1-91; Score= -125.6; E_value=0.0057; Accession=PF05970.5; Description=Eukaryotic protein of unknown function (DUF889)
MRLLGNAQLIDDQETTKFAKWILDIGDGVIGNQNDGYATIEIPEYLLITEYNDPIDAIVKSTFPDLYQHHSNPEFFKSRAILASTNEIVEE

SEQ ID NO: 151193 - protein, 232 aa, Glycine max
  Coding DNA Sequence Number=SeqID_34415
  Gene Ontology: Mol. function=metalloendopeptidase activity; Biological process=proteolysis
  Homolog annotation: Hit_ID=UPI00005F97BC; Match level="QueryCoverage =48%, HitCoverage=25%, E-value=1e-51, Identity=87%"; Hit description =COG4942: Membrane-bound metallopeptidase
  Pfam annotation: Domain name=Peptidase_M23; Domain location=20-115; Score=130.6; E_value=4.3e-36; Accession=PF01551.12; Description =Peptidase family M23
  Pfam annotation: Domain name=Polysacc_deac_2; Domain location=123 -232; Score=36.3; E_value=2.2e-10; Accession=PF04748.3; Description =Divergent polysaccharide deacetylase
  Pfam module annotation: Pfam domain module=Peptidase_M23::Polysacc _deac_2; Domain location=20-115::123-232
MWPVRGRTLHGFGEQQQGELRWKGMVIEAREGSEVKAVADGRVLLADWLQGYGLMVVVEHGKGDMSVYGYNQSALVNVGAQVRAGQPIALVGTSGGQGTPSLYFEIRRQGQAVYAAQAGKLSIVIDDVGYRPHEENAVLQMPTAISVAVLPNAPHARLMATRAHSQGREVLIHMPMAPLSKQPLERDTLQPSMSSDEIQRIIRNAVNNVPYAVGMNNHMGSAMTSSLPGMQK

SEQ ID NO: 151194 - protein, 542 aa, Glycine max
  Coding DNA Sequence Number=SeqID_34416
  Gene Ontology: Mol. function=nucleic acid binding
  Homolog annotation: Hit_ID=Q1RVN3; Match level="QueryCoverage=61%, HitCoverage=57%, E-value=1e-11, Identity=21%"; Hit description =Nucleotide-binding, alpha-beta plait
  Pfam annotation: Domain name=RRM_1; Domain location=92-162; Score =31.1; E_value=3.9e-06; Accession=PF00076.12; Description=RNA recognition motif. (a.k.a. RRM, R
MRLGEDVQHSRGAAGKVLLFKSRVWLLAGWWAAGREPIPESVHEEVKESEWTTVSHRKPRNFPPRRHGRSGKREEDHPQRRNWRDRTDITSFYFTRFHDEVTETELWTHFRKWGDVKEIFIPKRRNREGRRYGFVRYKGISDKRRIEKELDSSIVKGLKLHVNAPKYGRGQTMLEQYKIVPAKKGKGVDVYGQKEEAPLRTTGNKVLRKTYAEAVAVSSDRNTPGTTADVKLVSYGGPQPQITLKISEGDIRRYENTWVGRMKQLEIFERLEDEVLWKLGPAEIMAEEIEQGSSLFYSLTKWKSQLHTGNRLIWLRCWGIPLVAWSIDNIRKMVAVVGDLVEVDDDVEHMQRLDRARVLVRTPRPPLIQQVVEVHAGGETYRVHLVEENGGDGLSNRRRERSTWESSEEILSDADDIVSVRSWRDTAAPSSPDGNREGDRRELHSTLLPTGLDIAVDPVGKDHHARALCPVQMLKRTPDLKRKGFESISSQHIPYLPVDEEEEIPSTEIWVNLDEKRELEASSAVGASENVHFEHVLKLGRN

SEQ ID NO: 151195 - protein, 210 aa, Glycine max
  Coding DNA Sequence Number=SeqID_34417
  Gene Ontology: Mol. function=nucleic acid binding; Biological process= DNA integration
  Subcellular localization annotation: CTP_CleavageSite=66; ConfidenceScore=5.24e-01
MAEAGVVSTMEVVAVVGAQSSVNGGNNSNYGNSNNGNYGNNNNHNNCSQQSQNQNHNSQNSNSSPAQAMVANSDCNASSSWFPDSGASFHVTNNSQNIQQTSPFEGPDQISIGNGQGLNISAAGHSNFVSPFSPNVKRILKNMLLVPQITKNLISVSKLAKDNHVFFEFHANCYFVKSQDSNKIILQGDVGSDGLYQFPNLQFCSVVQLV

SEQ ID NO: 151196 - protein, 493 aa, Glycine max
  Coding DNA Sequence Number=SeqID_34418
  Homolog annotation: Hit_ID=Q1SDS1; Match level="QueryCoverage=44%, HitCoverage=59%, E-value=3e-11, Identity=23%"; Hit description=IMP dehydrogenase/GMP reductase
MERIEKVVKISEQELDRVKQNRNEVAGIPRKHLEEKVEALASQGEWATFIDVLALLVFGTVLFPNVDGLVDLAAIDAFLAYHPNKASPVIAVLADAHDTFDLRCKKSSARIVCCTPVLYVWLASHVAYHEGMTGASISWFPRWKEGGAGVLYSCFIEANAKILQRIRKAWNTMERKDKELRGSSNGVIGDYHKWLKSRMQGITWLPKLTGLSGKEAEIPEESEEVQALKAELEKTRLVKEKLKVVVTRVRKECDKLKDINMTTVEALEQETKKARKEEWSRNTFRGALWGSSNKLKLRKAERDKSRMESMKEKVNLAASHGQMLQDEQAKVLALQIEREAREGVIELLHKEAMKWMNRFALTLNESQERPKLLARAKAVADTYSAPDEVHSLLDYCQHMARIMSEIEEVQEQMKADMEAMKYQMTTMMEAMMSMRKMMEVNAAAAATISATTESKHPFRSYGLPPNYAPPNVVHVPNENVNHSAPIPLENQQP

SEQ ID NO: 151197 - protein, 501 aa, Glycine max
  Coding DNA Sequence Number=SeqID_34419
  Gene Ontology: Mol. function=zinc ion binding; Cellular component =nucleus; Biological process=transcription
  Homolog annotation: Hit_ID=Q9ZVC9; Match level="QueryCoverage=96%, HitCoverage=56%, E-value=1e-141, Identity=50%"; Hit description =Mutator-like transposase
  Pfam annotation: Domain name=SWIM; Domain location=343-379; Score =44.5; E_value=3.5e-10; Accession=PF04434.8; Description=SWIM zinc finger
MSITRQCPLGGGGHHVLDYLKHMQAENPAFFYAVQDVNNLACGNIFWADATSRTNYSYFGDAVILDTTYKTNRCRVPFTSFNGLNHHGQPVLFGCALIFNESESSFIWLFRTWLHAMSGRHPVSITTDLDPFIQVTVAQVLPSTRHRFCEWSIFRETRGKLAHLCQSYPAFETEFKKCVHESETIDEFESYWHSLLERFYVMDNEWLQSIYNSRQHWVPVYLRETFFGEISLNEGNEYLISFFDGYVNSSTTLQVLVRQYEKAVSSWHEKELKADYDTTNSSPVLKTPSPMEKQAASLYTRKIFMKFQEELVETLANPAIKIDDSGTITTYRVAKFGENQKSHVVTFNSFEMKASCSCQMFEFSGIICRHILSVFRAKNVLTLPSQYVLTCWTRNAKTGTLLDEHASELPSTSRESVPVCYNNLRQEAIKYVEEGAKSIQIYHVAMRALKEAAKKVCTIKNQSSGTAEGATATNGSRGELLVADEDVPSNQSVMIKPLGSH

SEQ ID NO: 151198 - protein, 87 aa, Glycine max
  Coding DNA Sequence Number=SeqID_34420
MAGLITLLSGKGAYIKEGRGGGQPDPTTIRQQGWKNPMCLNPKTSQKRWKPPRRVARLHEWWHTSSAPLVQGQRCKAAIGMAEAMKT

SEQ ID NO: 151199 - protein, 103 aa, Glycine max
  Coding DNA Sequence Number=SeqID_34421
MLSPLKHKGKDAESYETKKQGTLSPVKHKGKDFESYETKKERMLSPVKHKDEDVESYESKKQRRLNLVNHKGEDIESYEIKMQRTLSPAKHKGEKVESYETCQ

SEQ ID NO: 151200 - protein, 63 aa, Glycine max
  Coding DNA Sequence Number=SeqID_34422
MRDREQHDMQICKRTKDRPRAIQHSHQSKHLIMVLHTTHLTNIAKKATNKALNITMQSAHSPR

SEQ ID NO: 151201 - protein, 166 aa, Glycine max
  Coding DNA Sequence Number=SeqID_34423
  Subcellular localization annotation: CTP_CleavageSite=41; ConfidenceScore=5.23e-01
MGKGWGPGAAGAVYIDRSYRSTAPGSYGLLSVGQPNAACMRASGAPSSACELRWTLGTVADVEAMVVRLLSVVVTGLAPAVVPASACELAEACDQCWKSQCPIGLLWDSVDQLAFRKREIRIMVTGKDVAEQKRHTDLSESGHASAHDPYPPPCYALCTIMSRGAQ

SEQ ID NO: 151202 - protein, 375 aa, Glycine max
  Coding DNA Sequence Number=SeqID_34424
  Gene Ontology: Mol. function=2-oxoglutarate decarboxylase activity; Biological process=menaquinone biosynthetic process
  Homolog annotation: Hit_ID=Q15KJ0; Match level="QueryCoverage=50%, HitCoverage=72%, E-value=8e-16, Identity=30%"; Hit description =Truncated PHYLLO protein
  Pfam annotation: Domain name=Auxin_resp; Domain location=176-231; Score=-24.7; E_value=0.056; Accession=PF06507.4; Description=Auxin response factor
MNLAVSALGGWRVCNGAMFLLEGGGNGLGMGSGRVCSRSRSEVSGVRVGVRLDGPVPLKDDVLEKEVVFEQCVTRTLSPALTLEEGLEKLKEALQILNSPSPSSPTGFLRFQVALPPSPKTFTLFCSQPHSSSVFPLIYVSKNDADSKSLYVNLDDNVSHQKESRSQIELDELESVSILSMTLAWDEFSFSTFQEAHYSLQVSLDQVPGTIIGNEDINSIRWPGSAWRRLKDTLYLENIEERETGGTPPIIQTVRAWDLILMWQGQGIYLWTFELEVIQIDKLRYQDVLSKGFRSAADKVDTADSDCWEFRSQLKSMKGYIILGEHRGKGNWGHASNNPDSESMGPVVQLKSTPKEKQKMQERDDGVIAARSDTD

SEQ ID NO: 151203 - protein, 130 aa, Glycine max
  Coding DNA Sequence Number=SeqID_34425
MALHEMDAVAEETPMSATRLWTTRLLVALLVLAVLAGIGYGIKKLFSGGATQKKQITTVKLLPDTPPPPPPPPPKEPPKETPKEQPKEAPKEPEPKPVEAPPAENLKMEGAAGDGPSPFQSGAVNNEYKG

SEQ ID NO: 151204 - protein, 196 aa, Glycine max
  Coding DNA Sequence Number=SeqID_34426
  Subcellular localization annotation: CTP_CleavageSite=52; ConfidenceScore=5.66e-01
MTTPPNSHPPPPPPPDATSHFPSTLKRTRKATRLRSLATRLVGTERPLAHVDPATGKADSPYRKKLRTYLGIVTRDKVDVTYENWKQVSATQKDLIWKNIQAEFDIPEAFDLWTKKKILQTSTRTMSMTLFAKSTTLARKNGPNFVTVAETLCGRMCKKKGTGHSKTKRCPSLTCYLMGDPLEEQASQGSFVAYGR

SEQ ID NO: 151205 - protein, 117 aa, Glycine max
  Coding DNA Sequence Number=SeqID_34427
  Homolog annotation: Hit_ID=Q5Z5A8; Match level="QueryCoverage=35%, HitCoverage=10%, E-value=2e-13, Identity=85%"; Hit description =Photosystem II stability/assembly factor HCF136, chloroplast precursor
YIILGEHRGKGNWGHASNNPDSESMGPAVQVKSTRKEKQKKQERDDGMNNGCGIVSTGISGASYCTGTFNTVDCSPDGRYVLVSSRGNFYLTWESGCGGKSRFCATYFEASQNVQWL

SEQ ID NO: 151206 - protein, 583 aa, Glycine max
  Coding DNA Sequence Number=SeqID_34428
  Pfam annotation: Domain name=RRM_1; Domain location=18-83; Score =11.1; E_value=0.013; Accession=PF00076.12; Description=RNA recognition motif. (a.k.a. RRM, R
RDTVRAGERIPTRIMPELGMEATVKDLWHHFKKFGDVREVFISKNRNKNGRRYGFARFKGVEDVHSLEKKLDDIVYGGLKMGEEAIRLRQLQPKSNKGSYVEVVSGNKSGTGSRRPVGSEIRSYEGSWSSVYLDVPETEFTRVKEAWVGRLKNLAMFDKVEDDLYWDDGEDVVPKYMGDDMILLLGLTDERAKQMTEEEHPKLCTGYRLTWVNCWGIPLLAWDTKQISKIMAAIGDLVDVDDDVKVVRRLDRTRVLLKTSRRPLKQHIVNVHIHGEMHSVHIVEEGRSNPERGHCRRWCEYGSSEEIQTIDSDKDDECDFTMALRNAEVQPLSNEALPEGGSSYVPGQLPNRREMMLAAEQEASPTMDAAVNSTEQDSTVYEAKEEELAAAAKEEEGRQTCLIDTVETHTHRQLDAQTESEPRQQEKNMEGGSGLAIHTPLTSLHQHLFSSHSPNLQVYSRKKKFQKKLHLGCSTEGPISATNPKLKTTIHSPNHHQLGVEDKAGLDQVGISSNIDKSPIQIDYEEEEGATKQKQEAAALWEMAKELGVTCGPQQNNYVSKLMEMEKRDKIEAQSVGSRRGIQ

SEQ ID NO: 151207 - protein, 192 aa, Glycine max
  Coding DNA Sequence Number=SeqID_34429
  Pfam annotation: Domain name=RRM_1; Domain location=22-88; Score =25.9; E_value=0.00014; Accession=PF00076.12; Description=RNA recognition motif. (a.k.a. RRM, R
MGMCVKLLIPQPQPMKENGLKFPSWVNEKDLWQKFQRWGKVREVFIPKYKNREGQRFGFVRYKDVEDAAGLERKLDNSIFFDGRKMFVNQPRFERNKGAIRKQNGNSLPHNVNLQGVDRRRQGGLETCVNGGRLCSYAEVVKVAQLGTSVLCHQNEKPQLVEDVSTAVILQTKAMQLIQEERQNGSTPIMDL

SEQ ID NO: 151208 - protein, 147 aa, Glycine max
  Coding DNA Sequence Number=SeqID_34430
MPAYAKFMKKVLTKKKNIEKDNIEVLVKFVPHYSNCCNYSAIKQSSLPRYVYMSAFSNLMFVKGWSSDRQGFGLGTATEQHCLGAGAVVGCANEFFAGDKGSFVKVMTEEADPKLDEAIAKEQLNTTKRSQTAKKDHWRNRSTPECR

SEQ ID NO: 151209 - protein, 46 aa, Glycine max
  Coding DNA Sequence Number=SeqID_34431
MGVDHPSQVDGGVAASAHRHCRGESRMDAALDAMEPYDFPNRLERN

SEQ ID NO: 151210 - protein, 66 aa, Glycine max
  Coding DNA Sequence Number=SeqID_34432
MGSSRQLGETWQQLLKFRKTKMSQLGMFGEERCGSKTHFMVERRGNRDYETRIQCQSSLPSFDPTR

SEQ ID NO: 151211 - protein, 983 aa, Glycine max
  Coding DNA Sequence Number=SeqID_34433
  Gene Ontology: Mol. function=protein serine/threonine kinase activity; Cellular component=integral to membrane; Biological process=protein amino acid phosphorylation
  Homolog annotation: Hit_ID=Q9LJM4; Match level="QueryCoverage=95%, HitCoverage=95%, E-value=0.0, Identity=51%"; Hit description =Receptor-like protein kinase HAIKU2 precursor
  Pfam annotation: Domain name=LRRNT_2; Domain location=22-62; Score =40.8; E_value=4.6e-09; Accession=PF08263.3; Description=Leucine rich repeat N-terminal domain
  Pfam annotation: Domain name=LRR_1; Domain location=115-136; Score =14.5; E_value=0.39; Accession=PF00560.23; Description=Leucine Rich Repeat
  Pfam annotation: Domain name=LRR_1; Domain location=138-161; Score =5.9; E_value=23; Accession=PF00560.23; Description=Leucine Rich Repeat
  Pfam annotation: Domain name=LRR_1; Domain location=163-186; Score =1.1; E_value=1.8e+02; Accession=PF00560.23; Description=Leucine Rich Repeat
  Pfam annotation: Domain name=LRR_1; Domain location=188-210; Score =8.6; E_value=7.1; Accession=PF00560.23; Description=Leucine Rich Repeat
  Pfam annotation: Domain name=LRR_1; Domain location=212-234; Score =14.7; E_value=0.33; Accession=PF00560.23; Description=Leucine Rich Repeat
  Pfam annotation: Domain name=LRR_1; Domain location=236-258; Score =9.6; E_value=4.6; Accession=PF00560.23; Description=Leucine Rich Repeat
  Pfam annotation: Domain name=LRR_1; Domain location=283-305; Score =7.7; E_value=10; Accession=PF00560.23; Description=Leucine Rich Repeat
  Pfam annotation: Domain name=LRR_1; Domain location=307-329; Score =7.5; E_value=11; Accession=PF00560.23; Description=Leucine Rich Repeat
  Pfam annotation: Domain name=LRR_1; Domain location=331-350; Score =7.2; E_value=13; Accession=PF00560.23; Description=Leucine Rich Repeat
  Pfam annotation: Domain name=LRR_1; Domain location=379-401; Score =10.8; E_value=2.7; Accession=PF00560.23; Description=Leucine Rich Repeat
  Pfam annotation: Domain name=LRR_1; Domain location=403-425; Score =5.3; E_value=30; Accession=PF00560.23; Description=Leucine Rich Repeat
  Pfam annotation: Domain name=LRR_1; Domain location=451-473; Score =11.9; E_value=1.7; Accession=PF00560.23; Description=Leucine Rich Repeat
  Pfam annotation: Domain name=LRR_1; Domain location=475-497; Score =10.4; E_value=3.2; Accession=PF00560.23; Description=Leucine Rich Repeat
  Pfam annotation: Domain name=LRR_1; Domain location=499-521; Score =13.3; E_value=0.87; Accession=PF00560.23; Description=Leucine Rich Repeat
  Pfam annotation: Domain name=LRR_1; Domain location=523-545; Score =14.9; E_value=0.29; Accession=PF00560.23; Description=Leucine Rich Repeat
  Pfam annotation: Domain name=LRR_1; Domain location=546-565; Score =10.7; E_value=2.8; Accession=PF00560.23; Description=Leucine Rich Repeat
  Pfam annotation: Domain name=LRR_1; Domain location=66-89; Score =11.1; E_value=2.4; Accession=PF00560.23; Description=Leucine Rich Repeat
  Pfam annotation: Domain name=LRR_1; Domain location=91-113; Score =7.7; E_value=10; Accession=PF00560.23; Description=Leucine Rich Repeat
  Pfam annotation: Domain name=Pkinase; Domain location=665-956; Score =139.5; E_value=9.3e-39; Accession=PF00069.15; Description=Protein kinase domain
  Pfam annotation: Domain name=Pkinase_Tyr; Domain location=665-956; Score=66.6; E_value=8.1e-17; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=22-62::115-136::138-161::163 -186::188-210::212-234::236-258::283-305::307-329::331-350::379 -401::403-425::451-473::475-497::499-521::523-545::546-565::66-89::91- 113::665-956::665-956
  Subcellular localization annotation: CTP_CleavageSite=60; ConfidenceScore=5.18e-01
MFATFRLLLLLSFLSLLTSAQSEDQRQILLNLKSTLHNSNSKLFHSWNATNSVCTFLGVTCNSLNSVTEINLSNQTLSGVLPFDSLCKLPSLQKLVFGYNYLNGKVSEDIRNCVKLQYLDLGNNLFSGPFPDISPLKQMQYLFLNKSGFSGTFPWQSLLNMTGLLQLSVGDNPFDLTPFPKEVVSLKNLNWLYLSNCTLGWKLPVGLGNLTELTELEFSDNFLTGDFPAEIVNLRKLWQLEFFNNSFTGKIPTGLRNLTKLELLDGSMNKLEGDLSELKYLTNLVSLQFFENDLSGEIPVEIGEFKRLEALSLYRNRLIGPIPQKVGSWAKFDYIDVSENFLTGTIPPDMCKKGTMSALLVLQNKLSGEIPATYGDCLSLKRFRVSNNSLSGAVPLSIWGLPNVEIIDIEMNQLSGSISSDIKTAKALGSIFARQNRLSGEIPEEISMATSLVIVDLSENQIFGNIPEGIGELKQLGSLHLQSNKLSGSIPESLGSCNSLNDVDLSRNSFSGEIPSSLGSFPALNSLNLSENKLSGEIPKSLAFLRLSLFDLSYNRLTGPIPQALTLEAYNGSLSGNPGLCSVDAINSFPRCPASSGMSKDMRALIICFAVASILLLSCLGVYLQLKRRKEDAEKYGERSLKEETWDVKSFHVLSFSEGEILDSIKQENLIGKGGSGNVYRVTLSNGKELAVKHIWNTDVPARRKNSWSSTPMLGNKHGGGGKSKEFDAEVQALSSIRHVNVVKLFCSITSEDSSLLVYEYLPNGSLWDRLHTSRKMELDWETRYEIAVGAAKGLEYLHHGCEKPVIHRDVKSSNILLDEFLKPRIADFGLAKVIQANVVKDSSTHVIAGTHGYIAPEYGYTYKVNEKSDVYSFGVVLMELVTGKRPTEPEFGENKDIVSWVHNKARSKEGLRSAVDSRIPEMYTEEACKVLRTAVLCTGTLPALRPTMRAVVQKLEDAEPCKLVGIVITKDDSEKKIGVNDK

SEQ ID NO: 151212 - protein, 50 aa, Glycine max
  Coding DNA Sequence Number=SeqID_34434
MATSQTAKAETQLPGQWHCSPKGKASTLTGPWWNCYKSSYLKHWEIQSLT

SEQ ID NO: 151213 - protein, 212 aa, Glycine max
  Coding DNA Sequence Number=SeqID_34435
  Homolog annotation: Hit_ID=Q40538; Match level="QueryCoverage=21%, HitCoverage=80%, E-value=3e-08, Identity=73%"; Hit description =Nicotiana tabacum (clone 5) activating factor DNA sequence
MASGYHIGQCRCRTFPALQKVLLDSPAPDLRTSYREFEEERNVNQYPEEGVSQIQNVRKSMEQEMQILQLNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151214 - protein, 170 aa, Glycine max
  Coding DNA Sequence Number=SeqID_34436
MAQSNSSRLGFPALITALCRTRGVASDSLFFEHLSQIINLAYIRKNCWNPDDPIIIIRGARRPRARPTEAPSTSVAPHLAATSAAPPLAHIAAAPSTLPLVDFQSFEAMLQSIHQGQIILLQSLHLVAPLDFIPTVEQFNEWVAWPGTQPPPHRDDEDPAAQVPHHPADE

SEQ ID NO: 151215 - protein, 96 aa, Glycine max
  Coding DNA Sequence Number=SeqID_34437
  Subcellular localization annotation: CTP_CleavageSite=44; ConfidenceScore=5.74e-01
MAFSSWQNKLNRQMATPPNSLPPIGAASSSPSTLKRTRNVTRLRALATRPVGAERSLVHVDPMTEKADCPHSKKLRTYLGIVARDKVDVTYENWKQ

SEQ ID NO: 151216 - protein, 172 aa, Glycine max
  Coding DNA Sequence Number=SeqID_34438
  Gene Ontology: Mol. function=cob(I)yrinic acid a,c-diamide adenosyltransferase activity; Cellular component=mitochondrion; Biological process=cobalamin biosynthetic process
  Homolog annotation: Hit_ID=Q4J6D0; Match level="QueryCoverage=98%, HitCoverage=84%, E-value=2e-58, Identity=61%"; Hit description =Conserved protein
  Pfam annotation: Domain name=Cob_adeno_trans; Domain location=4-161; Score=259.0; E_value=9.7e-75; Accession=PF01923.8; Description =Cobalamin adenosyltransferase
MTVWYTGTGDKGKTKLPSVGEIWKDDDIVNAIGDLDELNASLGVISSLYPQLREIIVRVQSDIFSLSSEIAGFNLNFEEDKVEWIEEEINNFSKGLPELRNFILPGGHIASSFLHLARTVCRRSERSVVKLLKRNRAKDVHVKYLNRLSSLLFVLALYVNKQENVQEIIWKR

SEQ ID NO: 151217 - protein, 141 aa, Glycine max
  Coding DNA Sequence Number=SeqID_34439
MGEVEEVQEQMKADMEAMKEQKATMMEAMMSKKKIMEANAIAITATSTVAKVNLTLPSGLNQMNHPTSVMVGKDLGTGKNPHAMAEMGKLDHLEERLRAIEGRKDYAFAILEELFLVPNIITPPKFKVLDFDKGTTCPRTI

SEQ ID NO: 151218 - protein, 286 aa, Glycine max
  Coding DNA Sequence Number=SeqID_34440
MLSLSNLVPTSHTSDITLDKAKLIYGIVHRMDMNVGYLISHQISMIAQHDSSRLGFLALIIVLCKARGVTSDSRMLESLSPAINLAYVKKNCWNLDDLIVTFRGPRKAKEKKSKTLPSSEVPPTTSAPSTLAPVSSTPATSAPSAAQLPVLAPFTSGPSDFSFTPEMLHAMMQSLHQGYIIIKQSFQSLGLPSIMSMEDFHTQVAWPGFRPSLSGGGGTSATQELEPTEVHKPAVEDELTSLEPFSFAYDSVMAQEEVPSLELIPELSPAPISEDTLPSTPALEQE

SEQ ID NO: 151219 - protein, 134 aa, Glycine max
  Coding DNA Sequence Number=SeqID_34441
MSGRNYSYHEFESHANEAFLIPIVEGDIASQRCSCARKYTNFRRDDMLGMEDVAKKFEQEKDIQLKVNGKKNCSCGANTLTSMSMSCIFSIAGNECMQDQDLQNNRIPLTRVDSGPSESSAHQGWKINKRRRVQ

SEQ ID NO: 151220 - protein, 216 aa, Glycine max
  Coding DNA Sequence Number=SeqID_34442
  Gene Ontology: Mol. function=aminoacyl-tRNA hydrolase activity; Cellular component=mitochondrion; Biological process=apoptosis
  Homolog annotation: Hit_ID=UPI0000583F78; Match level="QueryCoverage =64%, HitCoverage=72%, E-value=3e-22, Identity=43%"; Hit description =PREDICTED: similar to peptidyl-tRNA hydrolase 2
  Pfam annotation: Domain name=PTH2; Domain location=86-208; Score =44.2; E_value=4.5e-10; Accession=PF01981.7; Description=Peptidyl -tRNA hydrolase PTH2
MDLTWLSAILVGAGYLALGYFIGSQYPPRFLFSHKLSTKHKEDASLLNDNDNKKRNTKSKLKDPLEIEQLAEILDDFKMILVVRNDLKMGKGKIAAQCSHATLGLYKKILRRAPKALNRYFHNLGCPCRWEMSAQPKVVVKIESEEDMLALQGEEVRDFIQQKSLMYKNAKLKRKNPERAKSLKLPTHITIDAGRTQIAPRPVEVVDEVTGGLKLL

SEQ ID NO: 151221 - protein, 899 aa, Glycine max
  Coding DNA Sequence Number=SeqID_34443
  Gene Ontology: Mol. function=structural constituent of ribosome; Cellular component=intracellular; Biological process=translation
  Homolog annotation: Hit_ID=Q1S8S2; Match level="QueryCoverage=97%, HitCoverage=99%, E-value=0.0, Identity=58%"; Hit description =Tetratricopeptide-like helical
  Pfam annotation: Domain name=PPR; Domain location=187-221; Score =22.1; E_value=0.002; Accession=PF01535.11; Description=PPR repeat
  Pfam annotation: Domain name=PPR; Domain location=222-256; Score=8.6; E_value=0.72; Accession=PF01535.11; Description=PPR repeat
  Pfam annotation: Domain name=PPR; Domain location=257-291; Score =35.6; E_value=1.7e-07; Accession=PF01535.11; Description=PPR repeat
  Pfam annotation: Domain name=PPR; Domain location=292-326; Score =33.4; E_value=8.1e-07; Accession=PF01535.11; Description=PPR repeat
  Pfam annotation: Domain name=PPR; Domain location=327-361; Score =16.0; E_value=0.094; Accession=PF01535.11; Description=PPR repeat
  Pfam annotation: Domain name=PPR; Domain location=362-396; Score =45.1; E_value=2.4e-10; Accession=PF01535.11; Description=PPR repeat
  Pfam annotation: Domain name=PPR; Domain location=397-431; Score =39.1; E_value=1.5e-08; Accession=PF01535.11; Description=PPR repeat
  Pfam annotation: Domain name=PPR; Domain location=432-466; Score =39.1; E_value=1.5e-08; Accession=PF01535.11; Description=PPR repeat
  Pfam annotation: Domain name=PPR; Domain location=467-501; Score =49.0; E_value=1.5e-11; Accession=PF01535.11; Description=PPR repeat
  Pfam annotation: Domain name=PPR; Domain location=502-536; Score =43.3; E_value=8.5e-10; Accession=PF01535.11; Description=PPR repeat
  Pfam annotation: Domain name=PPR; Domain location=537-571; Score =56.5; E_value=9e-14; Accession=PF01535.11; Description=PPR repeat
  Pfam annotation: Domain name=PPR; Domain location=572-606; Score =22.0; E_value=0.0021; Accession=PF01535.11; Description=PPR repeat
  Pfam annotation: Domain name=PPR; Domain location=607-641; Score =33.8; E_value=6.1e-07; Accession=PF01535.11; Description=PPR repeat
  Pfam annotation: Domain name=PPR; Domain location=642-676; Score=8.9; E_value=0.65; Accession=PF01535.11; Description=PPR repeat
  Pfam annotation: Domain name=PPR; Domain location=677-711; Score =42.6; E_value=1.3e-09; Accession=PF01535.11; Description=PPR repeat
  Pfam annotation: Domain name=PPR; Domain location=712-746; Score =46.9; E_value=7e-11; Accession=PF01535.11; Description=PPR repeat
  Pfam annotation: Domain name=PPR; Domain location=747-780; Score=9.1; E_value=0.62; Accession=PF01535.11; Description=PPR repeat
  Pfam annotation: Domain name=PPR; Domain location=781-815; Score =50.1; E_value=7.3e-12; Accession=PF01535.11; Description=PPR repeat
  Pfam annotation: Domain name=PPR; Domain location=816-850; Score =41.8; E_value=2.4e-09; Accession=PF01535.11; Description=PPR repeat
  Pfam annotation: Domain name=PPR; Domain location=851-885; Score =42.7; E_value=1.3e-09; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R; Domain location=187-221::222-256::257-291::292-326::327-361::362 -396::...
  Pfam module annotation: Domain location=397-431::432-466::467 -501::502-536::537-571::572-606::607-641::642-676::677-711::712 -746::747-780::781-815::816-850::851-885
MKRRTQFQSGACACSVAVANEAPICSHGGPRLSRHHPYSPQTLLRIQTGRPKRWSFCVTPLRHRPRKAELEGGFQRRFNFIDIETPSRGASVDEHPRRCQASFEVLQLSRSAQKHEPLHNLLRHHGPRARSLQALLAREFPLAHPSPSWVPPKMRFFPLSTLSQAIVFDAVVTVKLLFANNLLPEVRTLSALLNGLLKVRKFITVWELFDESVNAGVRPDPYTCSAVVRSMCELKDFFRAKEKIRWMEANGFDLNIVTYNVLIHGLCKGDRVWEAVEVKRSLGGKGLKADVVTYCTLVLGFCRVQQFEAGIQLMDEMVELGLAPSEAAVSGLVDGLRKKGKIDEAYELVVKVGRFGFVLNLFVYNALINSLCKDGDLEKAESLYNNMRSMNLCPNGITYSILIDSFCRRGRLDVAISYFDRMIRDGIGETVYAYNSLINGQCKFGDLSAAESLFTEMSNKKVEPTAITFTSLISGYCKDLQVQKAFKLYNNMIEKGITPNVYTFTALISGLCSTNKMAEASELFDELVERNIKPTEVTYNVLIEGYCRDGKIDKAFELLEDMHQKGLIPDTYTYRPLISGLCSTGRISKAKDFIDGLHKQNAKLNEMCYSALLHGYCREGRLMEALSASCEMIQRGINMDLVCLSVLIDGALKQPDRKTFFDLLKDMHDQGLRPDNIIYTSMIDAYSKEGSFKKAFECWDLMVTEECFPNVVTYTALMNGLCKAGEMDRAGLLFKKMQAANVPPNSITYGCFLDNLTKEGNMKEAIGLHHAMLKGLLANTVTYNIIIRGFCKLGRFHEATKVLFEMTENGIFPDCVTYSTLIYDYCRSGNVGAAVKLWDTMLNKGLEPDLVAYNLLIYGCCVNGELNKAFELRDDMLRRGVKPRQNLQALLKGEYNSTG

SEQ ID NO: 151222 - protein, 136 aa, Glycine max
  Coding DNA Sequence Number=SeqID_34444
MGGLGPFRRCHLSRFGYIQSIPPPPISARSSHDQIDDRWMQFAEHLLPASQLCLVPGQPRDAPATDPEDYIQPPSPQVPVAFDPPPHVRLERVLNLRIVTAGTELYDIMQDSLTIARGGPSADGTVRARQRRRTDH

SEQ ID NO: 151223 - protein, 53 aa, Glycine max
  Coding DNA Sequence Number=SeqID_34445
MDGILISSVVLLADSRFTRPDMGFHPTKLNFVPSDADEAPLDVSICLHAFGIV

SEQ ID NO: 151224 - protein, 172 aa, Glycine max
  Coding DNA Sequence Number=SeqID_34446
  Gene Ontology: Mol. function=electron carrier activity; Cellular component=nucleus; Biological process=electron transport
  Homolog annotation: Hit_ID=Q6K882; Match level="QueryCoverage=95%, HitCoverage=53%, E-value=5e-49, Identity=58%"; Hit description =Putative nucleolar essential protein
  Pfam annotation: Domain name=Nep1; Domain location=1-167; Score =176.3; E_value=7.8e-50; Accession=PF03587.5; Description=Nep1 ribosome biogenesis protein
PSINLDSPLNKAGRLRSVYIRTEKGVLIEVKPFVRIPRTFKRFAGVMLELLQKLSISAVGKREKLLRTIKNPVTQYLPINSRKIGLSYSSEKLVDMDDYVSTVTSNMDLVFVVVLLVQLLISLPIVSVGAMAHGKIETDYTEDYVAISGYPLSAAYCITRITGALERKWKIL

SEQ ID NO: 151225 - protein, 295 aa, Glycine max
  Coding DNA Sequence Number=SeqID_34447
  Gene Ontology: Mol. function=small conjugating protein ligase activity; Cellular component=protein complex; Biological process =protein modification process
  Homolog annotation: Hit_ID=Q1S8S1; Match level="QueryCoverage=94%, HitCoverage=66%, E-value=4e-73, Identity=84%"; Hit description =Ubiquitin-conjugating enzyme, E2
  Pfam annotation: Domain name=UEV; Domain location=27-148; Score =218.9; E_value=1.1e-62; Accession=PF05743.3; Description=UEV domain
MTQFLNSVLSQRGPSAVPYSEDTKWLIRQHLVALTTAFPSLEPKTASFTHNDGRSVNLLQADGTIPMTFQGVTYNIPVVIWLMESYPRHPPCVYVNPTRDMIIKRPHPHVNPSGLVSVPYLQNWTYPSSNLVDLILNLSLHFGRDPPLYSQRRPNPNTNPNPNPNPNPNPNPTPHPHPPPNYGNSSPSNLSSSSSGYPHAHAHPPPRTYPPSPYPAPSSRVQSTEDPSEVFKRNAINKLVEMVHGDVAALRKTREDEMEGLFSLQGVLKQREESLNRGVKEMQQEMEALEQQLQM

SEQ ID NO: 151226 - protein, 94 aa, Glycine max
  Coding DNA Sequence Number=SeqID_34448
VVAPPGSIPSIKQFLEKVAWTRAQPSLHREDEGPTAQEPRQLAADPFTPVVDMLEDQTTPVLTLNTSPPATPVLHLTDEKDVQTQDTQDLSQGF

SEQ ID NO: 151227 - protein, 320 aa, Glycine max
  Coding DNA Sequence Number=SeqID_34449
  Gene Ontology: Mol. function=methyltransferase activity; Biological process=intracellular signaling cascade
  Homolog annotation: Hit_ID=Q5ZC77; Match level="QueryCoverage=84%, HitCoverage=57%, E-value=1e-110, Identity=66%"; Hit description=ATP synthase beta subunit/transcription termination factor rho-like
  Pfam annotation: Domain name=DUF185; Domain location=127-319; Score= -16.7; E_value=1.3e-05; Accession=PF02636.7; Description =Uncharacterized ACR, COG1565
  Subcellular localization annotation: CTP_CleavageSite=34; ConfidenceScore=5.03e-01
MAREEDNGIPAYNSNLNSLNVYAVPRFYRRRLCSSSSSSESTAATISIDRSSLYNPPEHSHHPTSDSELVKHLKGIIKFRGGPISLGEYMSEVLTNPKAGYYINRDVFGAEGDFITSPEVSQMFGEMVGVWVMCLWEQMGQPQGVNLVELGPGRGTLMADLLRGASKFKNFIESLHVHLVECSPALQKLQHQNLKCTDEENASQDTDTRTARSLFGTPVSWHATLEQKASRGWCEKMVDVAEDSSFHFVLSPQPTPATLYLLKRCKWAAPEEIADLNQIEVSPQAMELTQTIVDRISSDGGGALIIDYGLNGVISDSLQV

SEQ ID NO: 151228 - protein, 132 aa, Glycine max
  Coding DNA Sequence Number=SeqID_34450
  Gene Ontology: Mol. function=RNA splicing factor activity, transesterification mechanism; Cellular component=spliceosome; Biological process=mitosis
  Homolog annotation: Hit_ID=Q1SM40; Match level="QueryCoverage=99%, HitCoverage=100%, E-value=1e-66, Identity=85%"; Hit description =Thioredoxin domain 2
  Pfam annotation: Domain name=DIM1; Domain location=4-126; Score =291.6; E_value=1.5e-84; Accession=PF02966.7; Description=Mitosis protein DIM1
MSYLLPHLHSEEERVVVIRFGHDWDDTCMQMDEVLASVAEKIKNFAVIYLVDITEVPDFNTMYELYEPCTVMFFFRNKHIMIDLGTGNNNKINWALKDKQEFIDIVETVYRGARKGRGLVISPKDYSTKYRY

SEQ ID NO: 151229 - protein, 59 aa, Glycine max
  Coding DNA Sequence Number=SeqID_34451
  Subcellular localization annotation: CTP_CleavageSite=42; ConfidenceScore=5.16e-01
IRSTTVPSSALSSASELSLRTFTTTTVRVDAKDTIFESSSPRSGHKSGQDNCTSSAVSE

SEQ ID NO: 151230 - protein, 142 aa, Glycine max
  Coding DNA Sequence Number=SeqID_34452
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=8e-18, Identity=35%"; Hit description= UPI00006A17C9 related cluster
MTDPLNDSIFCFLIGVDPSVLEPIAFRGLHILAFRGLHTLTFKGLHVLSFKGLHVLAFRGLHVLTFRGLHALAFRGLHVLTFRGLHVLTFKGLHVLTFRGLHILTFRGLHALTIRGLHVLAFRGLDVLPFKGLHILPFRGLH

SEQ ID NO: 151231 - protein, 146 aa, Glycine max
  Coding DNA Sequence Number=SeqID_34453
GEACRPARPGEQAFEGVTETHGLRKNTFFRFPPHYGISRIAQAYFRLIFETSRDFIYCMSSSNNPRMKLGYDTHILLKLSDAGIHSLKASINGIDTTIQGIKAFTNICAEASSHLIEAEEREYVLLAEVVHPSSTIAHPCPYGSRR

SEQ ID NO: 151232 - protein, 54 aa, Glycine max
  Coding DNA Sequence Number=SeqID_34454
MVAKEKKQRLVTMLECDEHDAQMQTGTFKVNIDFLEKTDVNISNVNIGFLKIRC

SEQ ID NO: 151233 - protein, 113 aa, Glycine max
  Coding DNA Sequence Number=SeqID_34455
MGSASPMVGTVPHDTSWEDWDQLRQDHHLENKVILQGPKEDDSTAEPIPEREIGITTTNTGANGKEGPGPRRQSLSIAVVSHCYGSFLLYNNYVKTEANLKMNWVADGILCSL

SEQ ID NO: 151234 - protein, 266 aa, Glycine max
  Coding DNA Sequence Number=SeqID_34456
  Gene Ontology: Mol. function=protein kinase activity; Biological process=protein amino acid phosphorylation
  Homolog annotation: Hit_ID=Q2QZ78; Match level="QueryCoverage=98%, HitCoverage=47%, E-value=8e-60, Identity=46%"; Hit description=AT hook motif-containing protein, putative
  Pfam annotation: Domain name=DUF889; Domain location=123-266; Score =79.9; E_value=8.2e-21; Accession=PF05970.5; Description=Eukaryotic protein of unknown function (DUF889)
MFFLYGFGGTGKTFIWRTLASSLRAKNQIVIIVASSGIASLLLPGCRTAYSRFKIPIPIFEDSTCNIHQGIKLAELLNQTSLIIWDEAPMAQKFYFEVFDQSLRDIITDKSKSNQIFGGKVIVFGGDFCQILPVIPRGTRSNIVNAAINSSYLWDSCEILTLTKNMRLHSNLESVDEQETATFAKWILDIGDGIIDDENDGYATIQIPAHLLITQYDDSISAIVKSTFPDLDQHHNNPEFFKSKAILALTNETVEQINDYVLSFIP

SEQ ID NO: 151235 - protein, 51 aa, Glycine max
  Coding DNA Sequence Number=SeqID_34457
MASIKFGTVAGEQWAKAFCFAFQSHPLEHLVWQYLRETKILGTSFSKLKTP

SEQ ID NO: 151236 - protein, 71 aa, Glycine max
  Coding DNA Sequence Number=SeqID_34458
MLGKLGRIGGDPVLRETRIWATWEYVSSVGGGQQGMSGTWRYVAGVRRPWGRQVGCYCPQPSLTNPDPTRA

SEQ ID NO: 151237 - protein, 100 aa, Glycine max
  Coding DNA Sequence Number=SeqID_34459
MTLIVDTLPVFYYGKWWATHLQSFEDLVFASERIDVGPKRGKVDHPTRTTEKTGANEESEKEGETHAVTVIPIRPSFPPTQQCHYSANNKPPPYPPTSYP

SEQ ID NO: 151238 - protein, 99 aa, Glycine max
  Coding DNA Sequence Number=SeqID_34460
MVFRWGILALSAFAFSFCFCLVRGEKVASTQDFVGNQRERTIVGRGQGLTFSPWVKVYDKLGFWLKACRTGGHDICQGLASGSGIKGMSYIISMIHMQQ

SEQ ID NO: 151239 - protein, 150 aa, Glycine max
  Coding DNA Sequence Number=SeqID_34461
MVIPKFKVPDFDKYKGTTCPKNHLKMCCRKMGAFAKDEELLIHFFQESLTGVAATWYTNLEPSRVHSWKDLMVAFVRQYQYNFDMWHKSFKEYAQRWRDLAAQVAPPMRGKEIITIIIDTLPVFYYEKWWDTHLQALRIWSSLGKGSKRI

SEQ ID NO: 151240 - protein, 49 aa, Glycine max
  Coding DNA Sequence Number=SeqID_34462
MGSGNAMWLDSHVDLNESSFPRRCNSSYFGNGKIFGARTQEEGLIPYHP

SEQ ID NO: 151241 - protein, 129 aa, Glycine max
  Coding DNA Sequence Number=SeqID_34463
MGDKLHRREGNSPDHQLRPLNDRSVIKEVGVQRQPGGERSALEGRTRASSAGRSGSENVGLSNANVGENPMPRKPKGSSARVIRGRENASSQSSSTRRYSAEVIHAILPGKARTTFNKWVPVPETDTGG

SEQ ID NO: 151242 - protein, 393 aa, Glycine max
  Coding DNA Sequence Number=SeqID_34464
  Gene Ontology: Biological process=pollen maturation
  Homolog annotation: Hit_ID=Q5Z6I4; Match level="QueryCoverage=85%, HitCoverage=43%, E-value=3e-74, Identity=47%"; Hit description =Putative Osnop
  Pfam annotation: Domain name=C2; Domain location=280-357; Score=16.1; E_value=0.0089; Accession=PF00168.20; Description=C2 domain
MDEKSSTQKTITGRIAQIFSKSSDMSSTASRRSIDLYQSEISKVEVSEMKAEDQSSNETFEEAMRKLQSADQGSEIPSNLPAGVFIDQQYVIAPEDLNELLFSSDSNFLKSLAEVQSNTELEIGPWKFENDGKIFKRLVTYVKAPSKPADLYATLLSQTIKPADLKDLSSNKEQALASLHAEPESDWRLAVQYFGNFTVFATVFMGLYVLVHIWLAAPSTIQGLEFGGLDLPDSIGEFVVCAVLVLQGECMLGIISRFIKARAQKGSDHGIKAQGDGWLLTVALIEGSSLASVDSSGLSDPYVVFTCNGKTRTSSIKFQKSNLTWNAASLGHAEINFLKANIADLADIWVPLEGKLALACQSKLHLRIFLDNTRGGNVAKDYLSRMEKEVRKK

SEQ ID NO: 151243 - protein, 92 aa, Glycine max
  Coding DNA Sequence Number=SeqID_34465
MRLPGKESLLMKSPITINEILDVSISFLNDHLEETLGSTKIEEIHSKCINLAQGKVYGESGFWLKACRMARHDTCQGLVWFKDKKGCPTLFP

SEQ ID NO: 151244 - protein, 323 aa, Glycine max
  Coding DNA Sequence Number=SeqID_34466
  Gene Ontology: Mol. function=oxidoreductase activity, acting on the CH-OH group of donors, NAD or NADP as acceptor; Cellular component =chloroplast; Biological process=metabolic process
  Homolog annotation: Hit_ID=Q97ZK1; Match level="QueryCoverage=99%, HitCoverage=99%, E-value=1e-168, Identity=93%"; Hit description=D-3 -phosphoglycerate dehydrogenase
  Pfam annotation: Domain name=2-Hacid_dh; Domain location=17-323; Score=119.6; E_value=8.7e-33; Accession=PF00389.20; Description=D -isomer specific 2-hydroxyacid dehydr
  Pfam annotation: Domain name=2-Hacid_dh_C; Domain location=119-294; Score=213.4; E_value=5.1e-61; Accession=PF02826.9; Description=D -isomer specific 2-hydroxyacid dehyd
  Pfam annotation: Domain name=AdoHcyase_NAD; Domain location=128-298; Score=-31.9; E_value=0.026; Accession=PF00670.12; Description=S -adenosyl-L-homocysteine hydrolase, NAD binding domain
  Pfam annotation: Domain name=NAD_binding_2; Domain location=151-295; Score=-81.1; E_value=0.041; Accession=PF03446.5; Description=NAD binding domain of 6-phosphogluconate dehydrogenase
  Pfam module annotation: Pfam domain module=2-Hacid_dh::2-Hacid_dh _C::AdoHcyase_NAD::NAD_binding_2; Domain location=17-323::119 -294::128-298::151-295
METIQGINSINKLDFKVLITDPVDHYMIKTLQNNGLIVDYKPEISREELLKIIDQYQVLVVRSRTKVDKEIIRYGTNLKIIARAGIGLDNIDTEEASKRNIKIVYAAGASTDSAAELTIGLLLTAARKLYDSMNMAKGGIFKKIEGIELAGKTIGVIGFGRIGTKVAKVCKALDMNVIAYDVIDIKEKANMLGVKVAESLDELLKNSDVITFHVTVGKDAKPILNKDTFNYVKDNTIIINTSRAVVIDGKALLEYIDKKQLTYATDVLWNEPPKEDWEIKLLRHERVIVTTHIGAQTKEAQYRVAVVTTDNLITSLKEIGVLK

SEQ ID NO: 151245 - protein, 99 aa, Glycine max
  Coding DNA Sequence Number=SeqID_34467
  Subcellular localization annotation: CTP_CleavageSite=41; ConfidenceScore=5.06e-01
MATIALLSRYGSKLAYDAGIGVNSTGFFSRKFLHWLASDVQQAGQGSSSSMDSFASWKMNGSGIEKEEREETPLQGEDESRIRKGEEDKSTKFCALKEL

SEQ ID NO: 151246 - protein, 107 aa, Glycine max
  Coding DNA Sequence Number=SeqID_34468
MTHQDFQVQAIGQFAQATCAPEFGLPRPFNQRLLVLHVGGVAVKQRTFMWPHFIIPESLSSSRSELSRIGCWTYGLSYLKKGGVELRCKDYSPIKLSLSLFGLTMHP

SEQ ID NO: 151247 - protein, 126 aa, Glycine max
  Coding DNA Sequence Number=SeqID_34469
MGSSRMPSLKKRFYQVKVKSLGITSLKELGQLMGQLQRQAFHKAYGKIWDLAMVEVSTEAIASLAQYYDHPLRKQVENGVVGIPRKYLEAKARILAAIDAFLTYHNHKESPVVAMLADLYDTFNRR

SEQ ID NO: 151248 - protein, 231 aa, Glycine max
  Coding DNA Sequence Number=SeqID_34470
  Homolog annotation: Hit_ID=Q1T493; Match level="QueryCoverage=76%, HitCoverage=44%, E-value=1e-13, Identity=24%"; Hit description =Nucleic acid-binding, OB-fold, subgroup
GQVLSCTLWENYCLQFLSYLNDIEDERPIVILLTHARIKEAQGSYPASVSNSFKASKLMINDLVLEIQEFRESLLDLGIEVRSILAPIGQGSSQFQGHLNYHQKMCFCQRLKYRVEVMVNHKGEQTKFLIWDRECAQLIGQSTDEVNRLIIEDGDADLNASPQALDRLLGCFLAFKVKVQPRFRNSVVLKYSNELDLINVVLDMIPDSEPCCKIENSILDSTDPTVLESVS

SEQ ID NO: 151249 - protein, 174 aa, Glycine max
  Coding DNA Sequence Number=SeqID_34471
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=4e-20, Identity=36%"; Hit description= UPI00006A17C9 related cluster
LHVLTMRGLHALTSRGLQVLALRGLHALTLEGYTPSPWVLVTLTVRGLHTLTLRGLHVLTIRGLHALTSRGLHVLALRGLHALTLGLPVLTLRGLHALTLRGLHTLTIRGLHALTSRGLHVLALRGLHALTLGLHALTSRGLHVLALRGLHVLTLGTSYPHRERATHPRLERTT

SEQ ID NO: 151250 - protein, 128 aa, Glycine max
  Coding DNA Sequence Number=SeqID_34472
MAEPSKKRKGVATFIRSHWNTKPRNIQEQRIRYNSLFSSRSIIDPKFVDLAFFDDEVFDCFQAFQNSGLIQFISMKLPFYPELVKVFYSNLEIQKDSLISEVYGIKMVIDQSLFFDLTQLSSDGVPFE

SEQ ID NO: 151251 - protein, 176 aa, Glycine max
  Coding DNA Sequence Number=SeqID_34473
  Homolog annotation: Hit_ID=Q5CEG7; Match level="QueryCoverage=59%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAQPVPLAVVSLDSRQGQWESR

SEQ ID NO: 151252 - protein, 48 aa, Glycine max
  Coding DNA Sequence Number=SeqID_34474
  Subcellular localization annotation: CTP_CleavageSite=35; ConfidenceScore=5.06e-01
MCSLSVQPARPARSLFLLKLSAPSLPKPKFTYSCLASQSRKASLRKLK

SEQ ID NO: 151253 - protein, 117 aa, Glycine max
  Coding DNA Sequence Number=SeqID_34475
  Gene Ontology: Mol. function=binding; Cellular component =intracellular; Biological process=protein kinase C activation
  Homolog annotation: Hit_ID=Q1SV65; Match level="QueryCoverage=98%, HitCoverage=13%, E-value=2e-40, Identity=69%"; Hit description =Asp/Glu racemase; Tetratricopeptide-like helical
MIDGYLRMNHFIGALALFREMQMSNVKPDEFTMVSILIACALLGALELGEWVKTCIDKNSNKNDSFVGNALVDMYFKCGNVRKAKKVFKEMYQKDKFTWTTMIVGLAINGHGEEALA

SEQ ID NO: 151254 - protein, 661 aa, Glycine max
  Coding DNA Sequence Number=SeqID_34476
  Gene Ontology: Mol. function=protein dimerization activity; Cellular component=nucleus; Biological process=regulation of transcription, DNA-dependent
  Homolog annotation: Hit_ID=Q1S6D5; Match level="QueryCoverage=99%, HitCoverage=97%, E-value=0.0, Identity=68%"; Hit description=Zinc finger, BED-type predicted; HAT dimerisation
  Pfam annotation: Domain name=hATC; Domain location=576-658; Score =120.3; E_value=5.4e-33; Accession=PF05699.5; Description=hAT family dimerisation domain
  Pfam annotation: Domain name=zf-BED; Domain location=30-81; Score =48.3; E_value=2.6e-11; Accession=PF02892.5; Description=BED zinc finger
  Pfam module annotation: Pfam domain module=hATC::zf-BED; Domain location=576-658::30-81
MEFVARATPDNNDEISDSGTQPNKQMRKKSMVWDYFTVETVGAGCTRAYCKQCKKSFSYITDSKLSGTSHLKRHISLGICRVLWEKNQQRSYPKTGGSLDTANPPKKQPRATPGFAGNGISFDQERCNHDVAKMIILHDYPLHIVKQQGFIDFVRILQPQFNPLCLNSVEGDCVAIYLRKKQNLLNVINGIPGQVNLTLDLWTSNQAMGYVFVRGHFIDSDWKLHRPILNVVTVPFPVSDDSLNQTLVTCLSDWHLEGRLFTLALDKSFSSEAVMGNLRGLLFVKNPAILNGQLLNQNCYARVLSRLAADALWTMRETICKVRESVKHVKSSESHKRKFIELKQHLQVPSMMDLSIDDQCKWDTTYHMLVAACELKEVFTCLDTIDPDYRMTLTMGDWKQVDTLCTYLKYLYDAAIILTVQPCPTSNLFFAEVSKVQVELTHAAFSQDPFLSSLFLPLHKNFDQYWRESCLILAIAVAMDPRHKMKLVEFTFAKIFGENAEEWIKIVEDGLRELFIEYSMQMFLTTTNGDEGDDIMIKKTFLEGSIDCSLFVDGDEFSDYEFYISDFTGNPQFKSELDEYLDEPLLTRVEEFDILSWWRVNGLKYPTLSRIASDILSLPVSTLSADSIFDMQIRKMDSYRSSLSSLTLEALICAKDWFQSE

SEQ ID NO: 151255 - protein, 192 aa, Glycine max
  Coding DNA Sequence Number=SeqID_34477
  Gene Ontology: Mol. function=methyltransferase activity; Cellular component=intracellular; Biological process=mRNA editing
  Homolog annotation: Hit_ID=Q1S6D3; Match level="QueryCoverage=97%, HitCoverage=32%, E-value=2e-62, Identity=52%"; Hit description =Asp/Glu racemase; Tetratricopeptide-like helical
  Pfam annotation: Domain name=PPR; Domain location=73-107; Score=34.3; E_value=4.4e-07; Accession=PF01535.11; Description=PPR repeat
MISHCFGESPISLLEKCKSMYQLKQIHSHTIKMGLSSDPLFRNRVIAFCCAHESGNMNYAHQVFDTIPHPSMFIWNTMIKGYSKISHPENGVSMYLLMLTSNIKPDRFTFPFSLKGFTRDMALQHGKELLNHAVKHGFDSNLFVQKAFIHMFSLCGIVDLAHKVFDMGDASCGEMDEAQGVFDNMKTRDVIS

SEQ ID NO: 151256 - protein, 178 aa, Glycine max
  Coding DNA Sequence Number=SeqID_34478
DFAKVKKNAMHLLVVERAVQNEFWMFASRYQRVFCLCSVFLAVIVCAEYMSSVGRWATGDGGFMRDLWMWKNLLCTIARPPPSTTCDGVVPGDMSRGSGDLGDIRRAPGSQQIKGTKTTKQGGLWWLASCESCVIYGLWPLVIDYQGLENEVVEASGNRLPVCVIDYTEEWVTGNRLP

SEQ ID NO: 151257 - protein, 105 aa, Glycine max
  Coding DNA Sequence Number=SeqID_34479
  Homolog annotation: Hit_ID=Q1S6C9; Match level="QueryCoverage=95%, HitCoverage=6%, E-value=1e-35, Identity=78%"; Hit description=TPR repeat
MPPRSGKGKSNKAKAEKKKKEEKAAAAPSLVDITVVTPYDTQIVLKGISTDKILDVRKLLAVKVETCHFTNYSLSHETKGQRLNDRVEVVTLKPCLLRMVEGRCT

SEQ ID NO: 151258 - protein, 1606 aa, Glycine max
  Coding DNA Sequence Number=SeqID_34480
  Gene Ontology: Mol. function=binding; Cellular component=thylakoid; Biological process=photosynthesis
  Homolog annotation: Hit_ID=Q1S6C9; Match level="QueryCoverage=99%, HitCoverage=93%, E-value=0.0, Identity=69%"; Hit description=TPR repeat
  Pfam annotation: Domain name=PAM2; Domain location=1330-1347; Score =10.4; E_value=0.35; Accession=PF07145.5; Description=Ataxin-2 C -terminal region
  Pfam annotation: Domain name=PAM2; Domain location=1419-1436; Score =14.0; E_value=0.1; Accession=PF07145.5; Description=Ataxin-2 C -terminal region
  Pfam annotation: Domain name=TPR_1; Domain location=828-861; Score =19.7; E_value=0.01; Accession=PF00515.18; Description=Tetratricopepti de repeat
  Pfam annotation: Domain name=TPR_1; Domain location=912-945; Score =8.3; E_value=0.55; Accession=PF00515.18; Description=Tetratricopeptid e repeat
  Pfam annotation: Domain name=TPR_2; Domain location=786-819; Score =4.2; E_value=11; Accession=PF07719.7; Description=Tetratricopeptide repeat
  Pfam annotation: Domain name=TPR_2; Domain location=828-861; Score =24.6; E_value=0.00035; Accession=PF07719.7; Description =Tetratricopeptide repeat
  Pfam annotation: Domain name=TPR_2; Domain location=870-903; Score =3.9; E_value=12; Accession=PF07719.7; Description=Tetratricopeptide repeat
  Pfam annotation: Domain name=TPR_2; Domain location=912-945; Score =16.5; E_value=0.1; Accession=PF07719.7; Description=Tetratricopeptide repeat
  Pfam module annotation: Pfam domain module=PAM2::PAM2::TPR_1::TPR _1::TPR_2::TPR_2::TPR_2::TPR_2; Domain location=1330-1347::1419 -1436::828-861::912-945::786-819::828-861::870-903::912-945
  Subcellular localization annotation: CTP_CleavageSite=69; ConfidenceScore=5.01e-01
DYTDEAQAIAHVRRVLDIVACTTRFGRPKRSVASSESRPKKNGKAQHQNQTSLSPPGTPNGESRVGSPSSEAPPSAILDNVGMKAIHPTPKLSDFYEFFSFSHLSPPILHLKRCEVKDEEDRRKGDYFQLQVKICNGKVIEVVGSEKGFYTVGKQSLHSHTLVDLLQQLSRAFATAYESLMKAFLERNKFGNLPYGFRANTWLVPPSVAESPSIFPALPAEDENWGGNGGGQGRNGEFELRPWATDFAILASLPCKTEEERVVRDRKAFLLHSQFVDTSIFKGVAAIQHAMESKLNTKNELNSYPDSVLHEDHVGDLSIIVKRDIQDGNAKYNSLLDESSMHKVDAQKNLLKGLTADESVIVHDMSSLAVVVVHHCGYTATVKVVGNVNTRKPKVRDIEIDDQPDGGANALNINSLRVLLHKSGAESLEGTLSSLSNSNDLDASKVLVRKVVQECMEKIKEEPSASERSIRWELGSCWIQHLQKQETSTDNSSKNKEDGNDLEQAVKGLGKQFKFLKRREKKSNNLDGADSREQNDSRLANMNDVADKVEPNNDDLSNSNELEKLLSEEAFLRLKESGTGLHTKSVDELISMAHKFYDEVALPKLAMDFGSLELSPVDGRTLTDFMHLRGLQMRSLGKVVKLAENLPHIQSLCIHEMITRAFKHLLKAVTASVDNVADLSAAIASTLNFLLGGSRTEDGADQILIDDHNLRIQWLHLFLSKRFGWTLNDEFQHLRKLSILRGLCHKVGLELFPRDYDMESSKPFGKNDIISLVPVCKHVGCSSLDGRNLLESSKIALDKGKLEDAVNYGTKALAKMMAVCGPFHQNTASAYSLLAVVLYHTGDFNQATIYQQKALDINERELGLDHPDTMKSYGDLSVFYYRLQHIELALKYVNRALFLLHFTCGLSHPNTAATYINVAMMEEAMGNVHVALRYLHEALKCNKRLLGADHIQTAASYHAIAIALSLMDAFSLSMQHEQTTLKILQAKLGSEDLRTQDAAAWLEYFESKAIEQQEATKNGTPKPDASIASKGHLSVSDLLDFISPNPKGNDARRKQRRTKILSTSDNNSQEHDEAIADETILFDNSKDALSMIQGKIEETNGKLDSQVQKQNGDFTGYRPVTSEPVYEASSDEGWQEANSKGRSGNAANRKFGHKKRHHLSKLSINGSNNYIYREGSSRNEITSPPQRGVPKVMLDMSSPSRQSKSRNLTLNEDSVNHSTKASVSKISSPASLSSLASKSISYKEVALAPPGTVLKPLLEKADMERVNAGDEICCNPAVTSISEGSCQSSITNTVCQHDETEETHENEPQQESSGSELEKVSDQAKSTAETNGSKLSAAAKPFNPGMLSMSHHLNSASFTSMYDTDVSQGMHVETVLPPAVARVPCGPRSPLYYRTNYTFRMKHGSTKGQTSIRERSGFGSPRIMNPHAPEFVPRNASQIEANDANSNVSNEHNSLSDIGMSEENKLDENFVEINGSSNKNSISESEKSEIARQILLSFLVKSVKENIDSVDESKDGEGKIEILESCSDEIAKDSAVINIMYGNEEKNKTVPHSSDSDEQEKLGVTEKKNGDGEGFIVVSKRRKNRQKITNGVTELYNQQSICASVR

SEQ ID NO: 151259 - protein, 99 aa, Glycine max
  Coding DNA Sequence Number=SeqID_34481
  Subcellular localization annotation: CTP_CleavageSite=21; ConfidenceScore=5.07e-01
MPHRSQAWALSHVLIARAPVHTMGVAERVRFRGTFRGMVFKIGRDGFEGERERGVRVRAQLSFRKRARFSFNWKGLQACMSHAREEQRRTYQRTVVVLH

SEQ ID NO: 151260 - protein, 140 aa, Glycine max
  Coding DNA Sequence Number=SeqID_34482
MGEVEEIQEKRKADMEAIKEKMATMMEAMMSVKKIMEANAVAIAATSVVAKYKGTTCPKNHLKMYCQKMGEYAKDEELLIHSFQEKSYWGSCYLNICKKGDRSFKEHAQKVEGSGGPGGTPNDGKGDDDRDGRHIIDTLL

SEQ ID NO: 151261 - protein, 151 aa, Glycine max
  Coding DNA Sequence Number=SeqID_34483
MGETHEMPYHNLVNFEPCLRYATEGQAVGGVPRQNTLEGPQYHPQPHPLHSTPGKNPHAMAEMGELDHLEERLRDIEGGEDSAFANLEELFLVPNIVTPPKFKVSDFDKYKGTTCPKNHLKMYCQKMGAYAKDGKLLIHFFQESLTGAAVT

SEQ ID NO: 151262 - protein, 553 aa, Glycine max
  Coding DNA Sequence Number=SeqID_34484
  Gene Ontology: Mol. function=protein binding; Biological process=two -component signal transduction system (phosphorelay)
  Homolog annotation: Hit_ID=Q1SH09; Match level="QueryCoverage=99%, HitCoverage=98%, E-value=1e-142, Identity=51%"; Hit description =Leucine-rich repeat; Leucine-rich repeat, ribonuclease inhibitor subtype; Leucine-rich ...
  Homolog annotation: Hit description=repeat, cysteine-containing subtype
  Pfam annotation: Domain name=LRR_1; Domain location=132-154; Score =4.4; E_value=43; Accession=PF00560.23; Description=Leucine Rich Repeat
  Pfam annotation: Domain name=LRR_1; Domain location=156-179; Score =8.0; E_value=8.9; Accession=PF00560.23; Description=Leucine Rich Repeat
  Pfam annotation: Domain name=LRR_1; Domain location=181-204; Score =5.9; E_value=22; Accession=PF00560.23; Description=Leucine Rich Repeat
  Pfam annotation: Domain name=LRR_1; Domain location=206-228; Score =8.7; E_value=6.8; Accession=PF00560.23; Description=Leucine Rich Repeat
  Pfam annotation: Domain name=LRR_1; Domain location=230-253; Score =8.1; E_value=8.6; Accession=PF00560.23; Description=Leucine Rich Repeat
  Pfam annotation: Domain name=LRR_1; Domain location=255-277; Score =5.2; E_value=30; Accession=PF00560.23; Description=Leucine Rich Repeat
  Pfam annotation: Domain name=LRR_1; Domain location=307-329; Score =4.3; E_value=44; Accession=PF00560.23; Description=Leucine Rich Repeat
  Pfam annotation: Domain name=LRR_1; Domain location=331-353; Score =8.7; E_value=6.6; Accession=PF00560.23; Description=Leucine Rich Repeat
  Pfam annotation: Domain name=LRR_1; Domain location=355-377; Score =5.4; E_value=27; Accession=PF00560.23; Description=Leucine Rich Repeat
  Pfam annotation: Domain name=LRR_1; Domain location=379-401; Score =8.5; E_value=7.2; Accession=PF00560.23; Description=Leucine Rich Repeat
  Pfam annotation: Domain name=LRR_1; Domain location=403-425; Score =2.5; E_value=96; Accession=PF00560.23; Description=Leucine Rich Repeat
  Pfam annotation: Domain name=LRR_1; Domain location=427-449; Score =5.0; E_value=34; Accession=PF00560.23; Description=Leucine Rich Repeat
  Pfam annotation: Domain name=LRR_1; Domain location=451-473; Score =3.2; E_value=72; Accession=PF00560.23; Description=Leucine Rich Repeat
  Pfam annotation: Domain name=LRR_1; Domain location=475-498; Score =6.2; E_value=20; Accession=PF00560.23; Description=Leucine Rich Repeat
  Pfam annotation: Domain name=LRR_1; Domain location=500-522; Score =7.4; E_value=12; Accession=PF00560.23; Description=Leucine Rich Repeat
  Pfam annotation: Domain name=LRR_1; Domain location=524-551; Score =5.7; E_value=25; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=132-154::156-179::181 -204::206-228::230-253::...
  Pfam module annotation: Domain location=255-277::307-329::331 -353::355-377::379-401::403-425::427-449::451-473::475-498::500 -522::524-551
MGGACSRKQERDNKDSPTRGLSRRYCKSGTLKWWTSSFSYPSVDFHLRKGECPPLLDLCIQKINEDIDKYNTFSMLPRDISQLIFNNLVYSRRLTSASLEAFRDCALQDLYLGEYDGVNDNWMGVISSQGSSLLSVDLSGSDVTDFGLTYLKDCESLISLNLNYCDQISDRGLECISGLSNLTSLSFRRNDSISAQGMSAFSGLVNLVKLDLERCPGIHGGLVHLRGLTKLESLNLKWCNCITDYDMKPLSGLQKLALLNLEGCLVTAACLDSLAGLLELCQLQFCTLQMLGCIYNSTACTNFNLPALSNLNLNRCNLSDNGCKKISRLTKLESLNLDSCKIGDEGLVNLAGLEQLNCLELSDTEVGSNGLHHLSGLSSLQKINLSFTMISDSSLRKLSGLSSLKSLNLDAYQITDAGLANLTSLTGLTDLDLFGARITDFGTNYLKKFKNLRSLEICGGVLTDAGVKNIKELSSLVCLNLSQNSNLTDKTLELISGLTGLVSLNVSNSRITNAGLQHLKTLKNLRSLTLESCKVTANDIKKLKSIYLPNLWY

SEQ ID NO: 151263 - protein, 236 aa, Glycine max
  Coding DNA Sequence Number=SeqID_34485
  Gene Ontology: Mol. function=methyltransferase activity; Cellular component=mitochondrion; Biological process=ubiquinone biosynthetic process
  Homolog annotation: Hit_ID=Q1S360; Match level="QueryCoverage=91%, HitCoverage=67%, E-value=6e-77, Identity=68%"; Hit description=SAM (And some other nucleotide) binding motif
  Pfam annotation: Domain name=Methyltransf_11; Domain location=34-132; Score=58.9; E_value=1.6e-14; Accession=PF08241.2; Description =Methyltransferase domain
  Pfam annotation: Domain name=Methyltransf_12; Domain location=38-130; Score=13.0; E_value=0.031; Accession=PF08242.2; Description =Methyltransferase domain
  Pfam annotation: Domain name=Ubie_methyltran; Domain location=11-235; Score=106.6; E_value=7.1e-29; Accession=PF01209.9; Description =ubiECOQ5 methyltransferase family
  Pfam module annotation: Pfam domain module=Methyltransf _11::Methyltransf_12::Ubie_methyltran; Domain location=34-132::38 -130::11-235
MGCCLKFKGFSIKLKVFYFTGDVAFRILESIHKVKLRGLRGAFQDTLEAETQIYVCDINPKMLNVGKRRASEKGFGEDGSLVWVEGNAESLSFQNDSMDGYTIAFGIRNVTHIEKVLSEAHRVLKPGGRFLCLELSHVGIPVFKDLYDYYSFSVIPYMGELLSIFSYFSIAQRKGPVGLAFLNGPIDASQDGWLLLIITSLKYEKFASMIADAGFQKVEYENLVAGVVAIHSGLKI

SEQ ID NO: 151264 - protein, 464 aa, Glycine max
  Coding DNA Sequence Number=SeqID_34486
  Gene Ontology: Mol. function=protein binding; Biological process =primary shoot apical meristem specification
  Homolog annotation: Hit_ID=Q1S365; Match level="QueryCoverage=90%, HitCoverage=34%, E-value=0.0, Identity=80%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=WD40; Domain location=161-198; Score =6.3; E_value=6.8; Accession=PF00400.22; Description=WD domain, G -beta repeat
  Pfam annotation: Domain name=WD40; Domain location=202-241; Score =9.7; E_value=2.7; Accession=PF00400.22; Description=WD domain, G -beta repeat
  Pfam annotation: Domain name=WD40; Domain location=245-283; Score =35.3; E_value=2.1e-07; Accession=PF00400.22; Description=WD domain, G-beta repeat
  Pfam annotation: Domain name=WD40; Domain location=338-376; Score =8.0; E_value=4.2; Accession=PF00400.22; Description=WD domain, G -beta repeat
  Pfam annotation: Domain name=WD40; Domain location=389-428; Score =0.4; E_value=33; Accession=PF00400.22; Description=WD domain, G-beta repeat
  Pfam module annotation: Pfam domain module=WD40::WD40::WD40::WD40::WD4 0; Domain location=161-198::202-241::245-283::338-376::389-428
PIINPISAAAAAATSAALAERASSVVAIAGMNGDTRNLGDVKPRISEESNDKSKIWKLTEINEQSQCRSLKLPENVRVTKCYWILITRWLDTSLLAYFEAAFSYYLISRLIYTNSGNAILALASNAIHLLWKWQRNERNSSGKATATLQPQLWQPSSGILMTNDIADSNPEDAVPCFALSKNDSYVMSASGGKISLFNMMTFKTMTTFMPPPPAATFLAFHPQDNNIIAIGMDDSSIQIYNVRVDEVKSKLKGHNKRITGLAFSHVLNVLVSSGADAQICVWNTDGWEKQKSRFLQLPSGRTPPAQSDTRVQFHQDQIQFLVVHETQLAIYEATKLEGLKQWFPRDSSAPISYATFSCDSQLVYASFLDATICVFSASNLRLRCRINPSSYLPASVSSNTQPLVIAAHPQEPNQFAVGLSDGGVHVFEPLESEGKWGVPPPIENGSASNVAAASVGPSPDQAQR

SEQ ID NO: 151265 - protein, 74 aa, Glycine max
  Coding DNA Sequence Number=SeqID_34487
MEEIQALLPRDVAPCRACRSWIFFINAMLCFLKINGSGMEKEESESQLWFKPLIQDHVQDSPLSVLRYHKACKA

SEQ ID NO: 151266 - protein, 390 aa, Glycine max
  Coding DNA Sequence Number=SeqID_34488
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=Q949X0; Match level="QueryCoverage=75%, HitCoverage=80%, E-value=1e-134, Identity=71%"; Hit description =Palmitoyl-monogalactosyldiacylglycerol delta-7 desaturase, chloroplast precursor
  Pfam annotation: Domain name=FA_desaturase; Domain location=139-355; Score=183.8; E_value=4.2e-52; Accession=PF00487.14; Description =Fatty acid desaturase
  Subcellular localization annotation: CTP_CleavageSite=41; ConfidenceScore=5.31e-01
MALLTSQPKKPILHRFTTLHRPLPRLDRTVLGLGSFSHNTLSIKKFNFNPKQTKISLKNNPFTYNLAVTAKANANAAFGEGLEAGEVTLKHRKILLSEVEVKRQRRVFFGRKWNSLDVGTAGIVLAMHLLCLFAPFHFNWPAFRVAVALYIVTGLFGITLSFHRNLSHRSFKLPKWLEYFFAYCGVLALQGNPIDWVSTHRYHHQFCDSERDPHSPTEGFWFSHMSWLFDTSSVIERCGEANNVGDLEKQSFYRFLRSSYLVHPFALGALLYAAGGFPFLVWGMGVRIVWVYHITWFVNSACHVWGNQAWNTRELSRNNWWVALLAFGEGWHNNHHAFEYSARHGLEWWQLDMTWYVVRFLEAIGLATDVKLPTESHKQKMALNSDPIDT

SEQ ID NO: 151267 - protein, 148 aa, Glycine max
  Coding DNA Sequence Number=SeqID_34489
  Pfam annotation: Domain name=zf-CCHC; Domain location=92-109; Score =19.2; E_value=0.00068; Accession=PF00098.13; Description=Zinc knuckle
MTTIFVGRQGMDIFMKSQKRKSLEAYLDWEIRVEQQLKRKSTSKCYGSHSYPEKDEGRGILGATPSKPKDDKGKTIENQPPKASMKEKTSSIKCFKCLGRGHITSQCSTKKIMIMRSQDIYSSQDEATTSLSSSESEEAKGEESREEI

SEQ ID NO: 151268 - protein, 74 aa, Glycine max
  Coding DNA Sequence Number=SeqID_34490
MEDRRLLRKRLLLGGDPTGNDKVSGKGVPLCLTLEFGEYYGACHREMRALSPWDTGLIATRDGLVCLIDAECAR

SEQ ID NO: 151269 - protein, 192 aa, Glycine max
  Coding DNA Sequence Number=SeqID_34491
  Homolog annotation: Hit_ID=Q9AVH2; Match level="QueryCoverage=21%, HitCoverage=14%, E-value=6e-17, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQ

SEQ ID NO: 151270 - protein, 200 aa, Glycine max
  Coding DNA Sequence Number=SeqID_34492
  Homolog annotation: Hit_ID=Q1S372; Match level="QueryCoverage=99%, HitCoverage=100%, E-value=5e-72, Identity=67%"; Hit description =Peptidase S26A, signal peptidase I; Sterile alpha motif homology
MDWFSWLSKTGLEPTLVYEYGLTFAHNELEEEDIIYFNHEFLMSMGLSIAKHRLEILKLARKVKGKRAPARPVARLMVAIKRTKRCLANYIRTFISCEEESSALVVVPSSSRTRPYYGTRWKSHVMKRNKKMVVAKQERLLLTNGSPNTVVHGLDAFTSPMVYHFQKDEKMEGYDDDGYWSSAATEEIRWDTMFQDLKPN

SEQ ID NO: 151271 - protein, 91 aa, Glycine max
  Coding DNA Sequence Number=SeqID_34493
  Homolog annotation: Hit_ID=Q8H6Q7; Match level="QueryCoverage=95%, HitCoverage=6%, E-value=5e-28, Identity=72%"; Hit description=CTV.22
MEVILINHQLIDTVVDISNEDVDPTAAVAAAEGAEGIIVKCSFIAVALSPSLKSQYASAQMSPIQPLRLLVPANYPNCSPILLDKFPVESR

SEQ ID NO: 151272 - protein, 68 aa, Glycine max
  Coding DNA Sequence Number=SeqID_34494
MNPAQRKCVRAHRSMLGSGASRSGPKMLSRSSSGDFDLIRATLEAKSGSYVQLNYWEKKRQIFNIDRI

SEQ ID NO: 151273 - protein, 482 aa, Glycine max
  Coding DNA Sequence Number=SeqID_34495
  Homolog annotation: Hit_ID=Q1S375; Match level="QueryCoverage=97%, HitCoverage=35%, E-value=1e-149, Identity=62%"; Hit description =Globin-like
MKESYLPEMNEMYQKIANKLQQHDSLPQQPKSDQIDKLRAYKTMLERMMALLQIPKNNILPNFKEKLGSYEKQIINLINSNRPRKGMNSVQAGQLPPTHMSSMQQPQSQVTQVHSHENQMNPQLQSTNLQGSVPTMQQNNIASLQHNALAGVSTGQQNMMNSMQPVTNLDSGHGNSMNSLQQVPMSSLQQNPVSTPQQTNINSLPSQGGANMIQPNALQSGSSALQHQLKHQQEQQMLQSQQFKQQYQQRQQLMQRQQLLQQQQLHHPAKPQLSSQLQTHQMPQLHQMNDINDIKMRQGMGVKSGVFQQHLTSGQHSTYSHQQLKQGSAFPVSSPQLLQAASPQIQQHSSPQVDQQNHLPSKAKVTTPLQSSNSPFVGPTPSPPLAPSPMPGESEKPIPCVSSISNAANIGHQQTGGAIAPAQSLAIGTPGISASPLLAEFSAPDGAHGNALAATSGKSTVTEQPLERLINAVSIEVYLMLA

SEQ ID NO: 151274 - protein, 445 aa, Glycine max
  Coding DNA Sequence Number=SeqID_34496
  Homolog annotation: Hit_ID=Q1S375; Match level="QueryCoverage=99%, HitCoverage=35%, E-value=1e-65, Identity=39%"; Hit description =Globin-like
METLKKHLPVSGPDGLHELRKIAQRFEDKIFTAATSQPDYLRKISLKMLTMETKSQNTLANNMPPNQVGPSNKPPDQVHNLGQQHSIPLPGQLQPHQQLLSQNVQNNVASQPNLPPVSSLAQTPSQNIVQNSNIQNITGPNSVGTTISQNSNLQNMFPGSQRQMPGRQQIVPPQNSQQYLYQQQFKQKLQLQSQMQQQQQNLLQPNQLQSSQQSIMQTSSVMQPSMMQTSSLSSIPQNQQSTNVQQPMQSMPQQHSQVIRHQQQTAVTHQPSLPSQQQQQLMGHQPNTTNMQHAQMLGQQNNVGDIQQPQRMLSQQSNLTNLQQRQQLINQQNNPANIHQQQFGNNGPGLQQQHLLGHESGNADMQTSHHSTHMLQQPKVPMQQQSQQNTSNLLLPHSQQPQPLGSQQQLMPQIHTQSAQLQQQLGLQQQPNPSQRDMQQRIQAS

SEQ ID NO: 151275 - protein, 319 aa, Glycine max
  Coding DNA Sequence Number=SeqID_34497
  Homolog annotation: Hit_ID=Q1S375; Match level="QueryCoverage=74%, HitCoverage=18%, E-value=1e-28, Identity=38%"; Hit description =Globin-like
  Subcellular localization annotation: CTP_CleavageSite=15; ConfidenceScore=5.21e-01
MFSPRQINFFIGLVLQSQVHNLGQQHSIPLSSQLQPHQQLLSQNVQNNVASQPNLPPVSSLAQTTSQNIVQNSNMQNITGPNSVGSTISQNSNLQNMFPGSQRQMPGRQQIVPPQNSPQYLYQQQRLKQKQLQSQMQQQQQNLLQPNQLQSSQQSIMQTSSVMQPSMMQTSSLSSIPQNQQSTNVQQPMQSMPQQHSQVIRHQQQTAVTHQPSLPSQQQQQLMGHQPNTTNMQHAQMLGQQNNVGDIQQRKLPMNEKHEQSKYKYFIRKATYNNWDLRMWIGACNRSLHSRFALLGFFSNIHAAARAVILRCLNNVMYV

SEQ ID NO: 151276 - protein, 102 aa, Glycine max
  Coding DNA Sequence Number=SeqID_34498
MTRGNPGDLQPFDPKIDRTFHRLVRHRVHLDHPEHFVPFEHPEHSVIGEDLYKHLKEFHIFYSTMKPPDVQEDHIFLKAFPHSLEGVAKDWLYYLAPRSVTS

SEQ ID NO: 151277 - protein, 215 aa, Glycine max
  Coding DNA Sequence Number=SeqID_34499
  Homolog annotation: Hit_ID=Q8H612; Match level="QueryCoverage=99%, HitCoverage=41%, E-value=1e-34, Identity=37%"; Hit description =Pentatricopeptide (PPR) repeat-containing protein-like
  Pfam annotation: Domain name=DUF247; Domain location=2-215; Score= -181.8; E_value=0.046; Accession=PF03140.6; Description=Plant protein of unknown function
MEEYPTIQVSKSAHLLDFLYHMIVPNILEGQDTIEVEFKQGEEEEEGNEESNADFSQVKQLYSELWKRLSKLNKGPVKLIIVSRRFKVLKQPLEYLFSQNGGESENSSSNSSLKNKPPSVEEITVPSVTELLNSGVRFLPTNGSILNITFDAKTCTFYLPTIGLDANTEVFLKNLVAYEASVASGPLVVTRYTELMNGIIDSDEDAKILREKGIF

SEQ ID NO: 151278 - protein, 160 aa, Glycine max
  Coding DNA Sequence Number=SeqID_34500
  Homolog annotation: Hit_ID=Q8H612; Match level="QueryCoverage=95%, HitCoverage=29%, E-value=5e-37, Identity=50%"; Hit description =Pentatricopeptide (PPR) repeat-containing protein-like
MVNSPYPSSASQSSLGLVIPLLIFLNKLHLALNYHYWRPELYEMQRYKLAAAKRFQKQLQSLKLDNLVDQLTKLEQRVRACYHKFLDFNGETLVWMMAIDASFLLEFLEVCTIQDVTKVPEGKSYQNAILRDIVMLENQIPMFVLRKMMEFNFSSLEASD

SEQ ID NO: 151279 - protein, 55 aa, Glycine max
  Coding DNA Sequence Number=SeqID_34501
MLKAQVTTSVLARNDVESTCYYIETMLKAQAITSVLERNDVESTGYYIGTNKKRC

SEQ ID NO: 151280 - protein, 74 aa, Glycine max
  Coding DNA Sequence Number=SeqID_34502
  Subcellular localization annotation: CTP_CleavageSite=40; ConfidenceScore=5.21e-01
MQYPLTSLLARLSTGTGRGFLVASFHTALVLSLTLPLSPVGRQAQSKGWGERMHFRNLNVAPPKDENQMPIADL

SEQ ID NO: 151281 - protein, 41 aa, Glycine max
  Coding DNA Sequence Number=SeqID_34503
MTLRLADMHNSSFFQILPHAQPRSVALSGWLAKPEDWLSER

SEQ ID NO: 151282 - protein, 56 aa, Glycine max
  Coding DNA Sequence Number=SeqID_34504
MALFERGVVPYGSAMVARKRQPVAFALGTAADPKESRRYKPWDPGGPWWTRNTLRT

SEQ ID NO: 151283 - protein, 152 aa, Glycine max
  Coding DNA Sequence Number=SeqID_34505
  Homolog annotation: Hit_ID=Q1QTZ6; Match level="QueryCoverage=69%, HitCoverage=50%, E-value=2e-16, Identity=38%"; Hit description =Hypothetical protein precursor
MLNQLALPFLVVGVCTALMIAKDLLRHPHPLAVMNIIWPLTGLYMPFFGWLAWWYLGRKPSRQRKLALLLPSGLTGYASWQTIFISTSLSAAACIFGDIITLPIVTLLKHFAISPALCSIPCSAPSGLCYSWRCSPDLFSPGRQIISSSNAD

SEQ ID NO: 151284 - protein, 272 aa, Glycine max
  Coding DNA Sequence Number=SeqID_34506
  Gene Ontology: Mol. function=amino acid-polyamine transporter activity; Cellular component=integral to membrane; Biological process=amino acid transport
  Homolog annotation: Hit_ID=P0AAE0; Match level="QueryCoverage=41%, HitCoverage=25%, E-value=2e-47, Identity=80%"; Hit description=D -serine/D-alanine/glycine transporter
MFRARKTNTHSSADRHHVGDAGHHPAEPVSPAGEITGPRTEQIGGKVAEGFVLKVGEQQLTHGAHHKEQHKTDDHIDEDDRRTRQADGFTGAHEQTGANGTADSDKLDVTVMQLCWLLNNVLLHRARGHKIEERRPLSVMVFKPLCPFACFTVSVNIYMARRAVILRKCSANEPLAPRSAAQGSTLVISMNPEKVRQRARIARDSAAGPVRLVEFTLAENASAATVESVYTAPGYRSAGLDDALQAAAAEQRSGRVSGGDACGQRAGQSQFP

SEQ ID NO: 151285 - protein, 123 aa, Glycine max
  Coding DNA Sequence Number=SeqID_34507
  Homolog annotation: Hit_ID=Q6D4C6; Match level="QueryCoverage=99%, HitCoverage=52%, E-value=3e-32, Identity=52%"; Hit description =Putative exported protein
  Pfam annotation: Domain name=Extensin-like_C; Domain location=12-123; Score=130.7; E_value=3.9e-36; Accession=PF06904.3; Description =Extensin-like protein C-terminus
MAVASTLYVTRSNAALQQAGITSPLRRIAHVGSYACRNIYHRQEGRRSEHATAEAWDITGFQLADGRWLQVGKNWQQPPQAAAGLHALWRNGCASFGNALGPDYNAAHASHFHLGMRGAGFCR

SEQ ID NO: 151286 - protein, 367 aa, Glycine max
  Coding DNA Sequence Number=SeqID_34508
  Gene Ontology: Mol. function=hydrolase activity; Biological process =aromatic compound metabolic process
  Homolog annotation: Hit_ID=P75895; Match level="QueryCoverage=69%, HitCoverage=96%, E-value=8e-66, Identity=51%"; Hit description =Protein rutD
  Pfam annotation: Domain name=Abhydrolase_1; Domain location=141-354; Score=96.8; E_value=6.3e-26; Accession=PF00561.10; Description =alphabeta hydrolase fold
  Pfam annotation: Domain name=Abhydrolase_2; Domain location=102-284; Score=-74.3; E_value=0.029; Accession=PF02230.7; Description =PhospholipaseCarboxylesterase
  Pfam annotation: Domain name=Ribonuc_L-PSP; Domain location=10-107; Score=63.6; E_value=6.2e-16; Accession=PF01042.11; Description =Endoribonuclease L-PSP
  Pfam annotation: Domain name=Thioesterase; Domain location=115-356; Score=-18.0; E_value=0.0007; Accession=PF00975.10; Description =Thioesterase domain
  Pfam module annotation: Pfam domain module=Abhydrolase_1::Abhydrolase_ 2::Ribonuc_L-PSP::Thioesterase; Domain location=141-354::102-284::10 -107::115-356
MPKTVIIPPGTTTPIAPFVPGTLADGVVYVSGTLPFDADNNVVHVGDAAAQTRHVLETIKKVIETAGGSLQDVTFNSIFITDWSNYAAVNQRGTHWPAGGVMHLDIQGLSAPDAPTLVLSSGLGGVAAFWQPQLAALTPHYRVVTYDQRGTGRSPDTLPEGYSMAMMAAELADALAEHGIEQYDIVGHALGGLIGLQLALDYPQRVGRVVVINGWLALDAHTERCFQVRQDLLLNVGVEAFVRAQPLFLYPAEWLARHQSRISAEDVHHVAHFQGMENLLRRLHALKSADFRPHASRITQPVLAICSQDDLLVPWSCSPQLAQALPNGSLIEMPWGGHAMSVTDADNFNALLLRWLADTATPARRAS

SEQ ID NO: 151287 - protein, 316 aa, Glycine max
  Coding DNA Sequence Number=SeqID_34509
  Homolog annotation: Hit_ID=Q8XWN3; Match level="QueryCoverage=29%, HitCoverage=30%, E-value=5e-42, Identity=91%"; Hit description =Putative amino-acid transmembrane abc transporter protein
LPGINRDTQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIARPDHHRQRLQHDRHADRRDQRRQARRVAQRPVGDTFDGVRHDGADRHRKQQGEHQREPIRQIGEIFLEEVDGSQGRHCTDHQNIAVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMLRKILNRE

SEQ ID NO: 151288 - protein, 272 aa, Glycine max
  Coding DNA Sequence Number=SeqID_34510
  Homolog annotation: Hit_ID=Q8H612; Match level="QueryCoverage=91%, HitCoverage=47%, E-value=7e-68, Identity=47%"; Hit description =Pentatricopeptide (PPR) repeat-containing protein-like
  Pfam annotation: Domain name=DUF247; Domain location=33-271; Score= -100.7; E_value=1.3e-05; Accession=PF03140.6; Description=Plant protein of unknown function
MSSLKSVVSLDSKYNFDELQWVIQIRRTLEEELGEDDEFPVSIFSVPKLLRACDPASYIPQQVALGPYHYWRPELYEMQRYKLAAAKRFQKQLQSLKFDNIIDQLTKLEQRIRACHHKFLDFNGETLVWMMAVDASFLLEFLQVFDCAIQDGTKVPKGKSYHNAILRDIVMLENQIPMFVLRKMMEFKFSSLEASDQMLKLKFIGLFKEISPFKMMEEYPTIQVSKSAHLLDFLYHIIVPNILERQDTIEVETQQGDEEKEGNEESNADSSQ

SEQ ID NO: 151289 - protein, 199 aa, Glycine max
  Coding DNA Sequence Number=SeqID_34511
TAKKNVYTDNHSGISARQRDSNVSMTDLVSAEDNVFRLTDNKKEVYTDNHSGISACQRDSNVSMTDLVSAEDDVNLGVSTGLSAAIDEERIRRPKKNVYTDNHSGISARQRDSNVSMTDLVSADDGVNLRVLMGLSAAIDEGRRRRPKKNVYTDNHSGISARQRDSNVSMTDLVSAEDNANLLVSTGLSAAIDEGRRRR

SEQ ID NO: 151290 - protein, 105 aa, Glycine max
  Coding DNA Sequence Number=SeqID_34512
  Homolog annotation: Hit_ID=Q2XIB6; Match level="QueryCoverage=98%, HitCoverage=31%, E-value=3e-42, Identity=84%"; Hit description =Tn4652, cointegrate resolution protein T, putative
  Subcellular localization annotation: CTP_CleavageSite=45; ConfidenceScore=5.35e-01
PGPVAPCTVPVLHHVPSTAHQGAAVAAPFRRTGRGAAPGSALEPPAADASPRWRPAPGPGSCAGPGSAHHAAPAVAPAPCRRRRPGGVPPATARYRGAGGSVSPA

SEQ ID NO: 151291 - protein, 1012 aa, Glycine max
  Coding DNA Sequence Number=SeqID_34513
  Gene Ontology: Mol. function=protein phosphatase 2A binding; Cellular component=cytoplasm; Biological process=mRNA catabolic process, nonsense-mediated decay
  Homolog annotation: Hit_ID=Q8W417; Match level="QueryCoverage=82%, HitCoverage=98%, E-value=0.0, Identity=47%"; Hit description=Cig3
MDKMSAPSSRERAQRLYEKNLELESKRRRSAQVRVPSDPNAWQQMRENYEAIILEDQAFSEQHNIEYALWQLHYKQIEEFRAYFSAALSSTNANSSQGVKGPARPDRISKIRLQFKTFLSEATGFYHDLITKIRAKYGLPLGYFDDSENRIVMEKDGKKSAAMKKGLVACHRCLIYLGDLARYKGMYGEGDSINREFTAASSYYLQAASLWPSSGNPHHQLALLASYSGDELVAIYRYFRSLAVDSPFTTARENLIVAFEKNRQSFSQLSGDAKTLAVKESSGRSTGKGRGKGEAKLATRGIGVDASPRTGASSIQETYKYFCTRFVRLNGILFTRTSLETFAEVLAVVSSGLRELLSSGQDEELNFGTDTPENALVIVRIVCILVFTVYNVNKESEGQTYAEIVQRAVLLQNAFTAAFELMGYIIERCAQLCDPSSSYLLPGILVFVEWLAFYPDHAAGNDVDENQANLRSEFWNRCVSFLNKLLSVGPMSIDDDEEETCFNNMSRYEEGETENRHALWEDSELRGFIPLLPAQTILDFSRKHSIGSDGDKERKARVKRILAAGKALVNVVKVDKQMIYFDSKAKKFVIGIEPQTTDDFGLTTDSGMPNAKQLGQENPADQSKMEIIQSNQHQHMEGDDDDEVIVFKPIVPETRGDVIASSWAPHVGLEPVSKASGGDLKFHVNSTSNPLSNLSHQTSSVSGSGMVPQHLQPVQPHTSSWLEEEISLAYNLKGLGLFENGHVMKPGLQEAAGFSNHVSLPFPIQQSIGADTNAMFYGFSKALESVVPSKVDVIASSGVVTDNLAVNTPTLPVGSRKAPVSRPTRHLGPPPGFSHVPPKQGIESTVSDAISGNPIMDDYSWLDGYHLHASTKGLGSNGPLNYSQSNAQQVSNNGLNPTVSFPFPGKQVPSVPLQVEKQNGWQDYQTYDLLKSHHDQQLQPQQLTTGNQQFSPLPEQFQGQHIANVLHPFATQTNSNIAVSSLNVVGVSLALACCRHLLLQKIMMSSSPDEGR

SEQ ID NO: 151292 - protein, 403 aa, Glycine max
  Coding DNA Sequence Number=SeqID_34514
  Gene Ontology: Mol. function=ATPase activity, coupled to transmembrane movement of substances; Cellular component=integral to membrane; Biological process=transport
  Homolog annotation: Hit_ID=P23886; Match level="QueryCoverage=99%, HitCoverage=87%, E-value=2e-78, Identity=41%"; Hit description =Transport ATP-binding protein cydC
  Pfam annotation: Domain name=ABC_tran; Domain location=267-403; Score= 32.0; E_value=2.5e-10; Accession=PF00005.17; Description=ABC transporter
SWRGAGDCHAARQHRLADAVRLVSCCLLAGWRRRPPRRHFPRAATSARLYLQPADGAGTGAAGALSSRRTAEPLCQRCRYSRPSLFTRYFSTAGCGGGDCGGDLWPGATRYATGAAARGDHVADAAANAAAILAARRAHRRAYCPLPGSLAPATDALAQRTGRAADLWRGDAVATAAGSGRTCVATGAAAATPAAGAGAEPAYVDRRQYRYAAAVAGRQRRDARGAARAGDHRSTASDSLPDTTGRDAARPQPDAGTDRFQLSAAARSGAAQLLSDRGTIRLNGIDLAAWDEASLRQRISVVTQRVHLFSQTLRANLLLAAPQASDAQLIDVLQRVGLAHLTQHSEGLNAWMGEGGRPLSGGELRRLAIARALLHDGDLWLLDEPTEGLDAATEQQILTLLQQ

SEQ ID NO: 151293 - protein, 117 aa, Glycine max
  Coding DNA Sequence Number=SeqID_34515
  Gene Ontology: Mol. function=monooxygenase activity
  Homolog annotation: Hit_ID=Q8U9K2; Match level="QueryCoverage=99%, HitCoverage=35%, E-value=2e-58, Identity=94%"; Hit description =Flavin dependant oxidoreductase
MVGVMGVGADTDEEAQHLFTSSQQQFVNLRRNVRTQFPKPVHSMEGYWNEMERFSVEHTLRFAAVGAPETIQRHLDGFLAETQADELIVSMPIHDIEKRLRSVEIFADVRTSIKKAA

SEQ ID NO: 151294 - protein, 71 aa, Glycine max
  Coding DNA Sequence Number=SeqID_34516
MDARGALSGMSSLLARNSEFRLSTRLLAQWMDSSGALSRMIHRSANMHSSSFFHILPRAQPKEWCAQWMAR

SEQ ID NO: 151295 - protein, 139 aa, Glycine max
  Coding DNA Sequence Number=SeqID_34517
  Homolog annotation: Hit_ID=Q8TGM5; Match level="QueryCoverage=36%, HitCoverage=68%, E-value=1e-08, Identity=62%"; Hit description =Uncharacterized protein ART3
MCDSQAACPRPNGFSAQLAFKDSMVHGILQFTPSIAFRYVLHRCKSRDIRCRESLFEFLGARSAGVCVCREDEEAGRTGRRGHPLPPDGSVDFSQRRGQRTAHVAAIRTLHRTIQSVGATGGVYKGQGRSQRKLMTRAY

SEQ ID NO: 151296 - protein, 139 aa, Glycine max
  Coding DNA Sequence Number=SeqID_34518
MWAFHKGLQIDWAHLVRYRMHKALRLNAPLPYPHLITLFLQHFNIPLDSEPYVPIKRSFLIGVVVIASFGYQKEHDGSWVKKGARPVDEEGHLHGGEDSSLLQKILDRFDGLQSFVGERVVIIKKGEIVEASFMMLNQD

SEQ ID NO: 151297 - protein, 114 aa, Glycine max
  Coding DNA Sequence Number=SeqID_34519
  Homolog annotation: Hit_ID=Q1SN43; Match level="QueryCoverage=97%, HitCoverage=21%, E-value=2e-17, Identity=40%"; Hit description =Nucleic acid-binding, OB-fold, subgroup
MTNKFNSMTEINAKKESWRIMVRVVHLWMISNVSTTKQTFSSKIPLSMETVLVDSKTLIYKFDKTLQEGKVYSIQFFGVVDNGGIYRIILHKYKIMFQYSTKVALVDNASVPDS

SEQ ID NO: 151298 - protein, 370 aa, Glycine max
  Coding DNA Sequence Number=SeqID_34520
MASRRFHSLDAWNRYTNNILGRNILPERNVQIYHTEYDEFKVELERRNLHKCLANLQDGSIDVAMVKEFYANLYTIEEQAPKQARVRGHLIKIDADGLNEFLQMPMVLEEGESLPTYSRFCRLRTNPQDIEARLCIPCKGFVLNAEGQPWKLLRKDLMTLAQTWSVFSYSNLAPTSHTSDLNMDRARLVYGLVTNMDMNIGALILGEFSSIAQSNSSRLGFPALITTLYRATGVTSDSLTYESLSLAINLAYIKKNYWNVDDLIVNFRGARKARVRPAYVPSSSTLPAPSTSATPTPAPPGSSTQDSQRFEAMLQKQFIEKVSWPGTLPSVVRKGEGPSAQVRQEAATPERSPQISPDPPFPVVDQSFLQ

SEQ ID NO: 151299 - protein, 90 aa, Glycine max
  Coding DNA Sequence Number=SeqID_34521
DRARKTPVDPKKSNRVLELSALITGLYQFYRVPLAPSKVIKIPTNRAFIKKYCAPRQAQGETPQQPGDGRQWATDACSHFSKKKKTPRLF

SEQ ID NO: 151300 - protein, 68 aa, Glycine max
  Coding DNA Sequence Number=SeqID_34522
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=81%, HitCoverage=25%, E-value=2e-12, Identity=54%"; Hit description =Protein ULTRAPETALA2
MYNLSVQILGLLITCDDEEGSGLKASRGCSRSSTCQDCSTCYCEGCIKCHFEDCNCQECRDFMLYAKP

SEQ ID NO: 151301 - protein, 222 aa, Glycine max
  Coding DNA Sequence Number=SeqID_34523
  Gene Ontology: Mol. function=nucleoside-triphosphatase activity; Cellular component=chloroplast
  Homolog annotation: Hit_ID=Q2PMM5; Match level="QueryCoverage=69%, HitCoverage=6%, E-value=1e-86, Identity=99%"; Hit description =Protein ycf2
MQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLIPYIDNTHSSLGTSGAKVIEWHILLGEGAGRTISKQITHSFDREDHQDFVIRCRTYSNSIRDLNIMP

SEQ ID NO: 151302 - protein, 61 aa, Glycine max
  Coding DNA Sequence Number=SeqID_34524
MDTIVVPSSYHQQCAPKYPDFVHFRYDGITYQIRLRQHQQKPGGSTSSRAAATAVELQFAL

SEQ ID NO: 151303 - protein, 82 aa, Glycine max
  Coding DNA Sequence Number=SeqID_34525
MFFKGRLRRSLNCLLFLGLLLLLLLNWWRNVWIRPSKVGMIPPPGIVPIAGVIVLLWLILLLRLRRLLHKRAKVCVVVGRGA

SEQ ID NO: 151304 - protein, 57 aa, Glycine max
  Coding DNA Sequence Number=SeqID_34526
MVQNREEEKDFWYFEMSRKGVLWKINDKKRYNSLKTILVKEISVKEKTMREGEANGR

SEQ ID NO: 151305 - protein, 261 aa, Glycine max
  Coding DNA Sequence Number=SeqID_34527
  Gene Ontology: Mol. function=O-methyltransferase activity; Biological process=lignin biosynthetic process
  Homolog annotation: Hit_ID=Q1T3W1; Match level="QueryCoverage=86%, HitCoverage=66%, E-value=2e-88, Identity=65%"; Hit description=O -methyltransferase, family 2
  Pfam annotation: Domain name=Methyltransf_2; Domain location=13-240; Score=251.3; E_value=2e-72; Accession=PF00891.8; Description=O -methyltransferase
MESLDEDHAAKLLRAQTHIWNHIFSFISSMSLNVCVTPFLHSILDPILTNPWNQFSNWFKNGDPTPFETAHGMMFWDYAGADSKLNNLFNDAMASDARLVTSLVIEKCKGVFMGLGSLVDVGGGTGTMAKAIAKSFPQLDCIVFDLPHVVSGLQGSENLKFVGGDMFEAIPPADAILLKKCKEAITRKGKEGKVIIIDMVVENEKRDDEPIGTQLFFDMLMMVLVTGKERSKKEWVKLNSSADYNNYKITPVLGLRSLIEI

SEQ ID NO: 151306 - protein, 51 aa, Glycine max
  Coding DNA Sequence Number=SeqID_34528
MVSNERESINPQEEPTICTMHPDSRVGDGSGMLKNTTSAKSSLSGISMSTL

SEQ ID NO: 151307 - protein, 115 aa, Glycine max
  Coding DNA Sequence Number=SeqID_34529
  Subcellular localization annotation: CTP_CleavageSite=55; ConfidenceScore=5.03e-01
MPNSTGFVSLLPIRHGHLCVTLLSPPLRPSLFFYLRLSIDTITPHSSVSPFLEVLEKEKWGKGLGGAQDNQKKGRKGEGNEWGRRGVDVDGLKLPMQFFWVEAGRTSTWEGRGAN

SEQ ID NO: 151308 - protein, 182 aa, Glycine max
  Coding DNA Sequence Number=SeqID_34530
  Gene Ontology: Mol. function=nucleic acid binding
  Homolog annotation: Hit_ID=Q1RXW3; Match level="QueryCoverage=72%, HitCoverage=20%, E-value=4e-09, Identity=30%"; Hit description=Zinc finger, CCHC-type
  Pfam annotation: Domain name=zf-CCHC; Domain location=79-96; Score =22.8; E_value=0.00017; Accession=PF00098.13; Description=Zinc knuckle
MFKQGMTTKENDKKKKGISLKASSSIQEESDKEDLNEIEEDDDFSLFIKRFNKFLRNKGNQGKTNFNPNKRGEDLSSIPKCYECNQPGHLRVDCLGFKRRMEKSGRKTFKDKKAKKADITWEDNNMDSSRDSENEVMNLSFMAKNYESEEEVTSSNNNLSISFDDFKMHSMTCKKNQSNLPN

SEQ ID NO: 151309 - protein, 37 aa, Glycine max
  Coding DNA Sequence Number=SeqID_34531
MSNLARDGLKGRFNKVRTFTLLINYEASFEEASAYED

SEQ ID NO: 151310 - protein, 406 aa, Glycine max
  Coding DNA Sequence Number=SeqID_34532
  Gene Ontology: Mol. function=ATP binding; Cellular component=nucleus; Biological process=electron transport
  Homolog annotation: Hit_ID=Q1S771; Match level="QueryCoverage=99%, HitCoverage=100%, E-value=1e-143, Identity=63%"; Hit description =WD40-like
  Pfam annotation: Domain name=WD40; Domain location=100-136; Score =19.8; E_value=0.0097; Accession=PF00400.22; Description=WD domain, G- beta repeat
  Pfam annotation: Domain name=WD40; Domain location=174-212; Score =40.4; E_value=6.3e-09; Accession=PF00400.22; Description=WD domain, G-beta repeat
  Pfam annotation: Domain name=WD40; Domain location=217-254; Score =33.1; E_value=9.5e-07; Accession=PF00400.22; Description=WD domain, G-beta repeat
  Pfam annotation: Domain name=WD40; Domain location=262-300; Score =20.6; E_value=0.0057; Accession=PF00400.22; Description=WD domain, G- beta repeat
  Pfam annotation: Domain name=WD40; Domain location=307-343; Score =37.1; E_value=6.2e-08; Accession=PF00400.22; Description=WD domain, G-beta repeat
  Pfam annotation: Domain name=WD40; Domain location=350-398; Score =28.4; E_value=2.5e-05; Accession=PF00400.22; Description=WD domain, G-beta repeat
  Pfam annotation: Domain name=WD40; Domain location=43-79; Score=10.8; E_value=2; Accession=PF00400.22; Description=WD domain, G-beta repeat
  Pfam module annotation: Pfam domain module=WD40::WD40::WD40::WD40::WD4 0::WD40::WD40; Domain location=100-136::174-212::217-254::262 -300::307-343::350-398::43-79
  Subcellular localization annotation: CTP_CleavageSite=57; ConfidenceScore=5.68e-01
MEHSTSFNDSNNSLSSQRSLVSVPSLNSHSQFLTPSTTSHTCLTTLKFLTSSSVYISSLTLAGKFLYAGSSDREIRSWNHTHFIQNQKPTTTTTTTTTNNNNNSVVIAGKGAVKSIVVHSDKLFTAHQDNKIRVWKVTNLSHDHQKYTRVATLPTLADRVTKLLVPKNHVRIRRHKKCTWVHHVDTVSSIALSQDGNFLYSVSWDRTIKVWRTKDLACLESVRNAHDDAINAVAVSYDGHVYTGSADKRIRVWKKLEGEKKLSLVDTLEKHNSGINALALKSDGSVLYSGACDRSILVSEKGENGKLLVVGALRGHAKSILCLAVVSDLVCSGSEDKTVRIWRGVQKDEYSCLAVLEGHRSPIKSITAALDLSQDPSSQATSFLLYSASLDSHVKLWQLFLPLLST

SEQ ID NO: 151311 - protein, 154 aa, Glycine max
  Coding DNA Sequence Number=SeqID_34533
  Gene Ontology: Mol. function=methyltransferase activity; Biological process=cell cycle
  Homolog annotation: Hit_ID=Q1S762; Match level="QueryCoverage=63%, HitCoverage=30%, E-value=5e-44, Identity=86%"; Hit description =Glucose inhibited division protein
  Pfam annotation: Domain name=GidB; Domain location=2-111; Score= -27.9; E_value=0.00023; Accession=PF02527.6; Description=Glucose inhibited division protein
MESMNKRCVFLEHVVGVIGSSNIQIVRGRAESLGQDPCFREQFDVAVARAVAEMRILAEYCLPLVRVGGLFIAAKGHDPEDEIKKAESAIQKVGASLLQWTDREVEAGNTTQGAANNINKAQATENINREGQRVPIANKPKRRVTRPSYMKDYA

SEQ ID NO: 151312 - protein, 96 aa, Glycine max
  Coding DNA Sequence Number=SeqID_34534
  Subcellular localization annotation: CTP_CleavageSite=48; ConfidenceScore=5.46e-01
MDRTETLDSPRRSSSNFGSSLAVFFVVFFLGLCCSVVFVMVKVMIIIRSSSMRSKRLVDDDDDVSDKGIRDGSLEGVEEKSKVVRVIPLRKEKEAT

SEQ ID NO: 151313 - protein, 293 aa, Glycine max
  Coding DNA Sequence Number=SeqID_34535
  Gene Ontology: Mol. function=mannosyl-oligosaccharide 1,2-alpha -mannosidase activity; Cellular component=membrane; Biological process=ER-associated protein catabolic process
  Homolog annotation: Hit_ID=Q1S755; Match level="QueryCoverage=65%, HitCoverage=33%, E-value=8e-86, Identity=80%"; Hit description =Glycoside hydrolase, family 47
  Pfam annotation: Domain name=Glyco_hydro_47; Domain location=113-291; Score=-197.6; E_value=4e-05; Accession=PF01532.11; Description =Glycosyl hydrolase family 47
MIINYTCDVTSVVFWKRRHAEYGSTEKKLRSIDQSQILSGPRSLREHSSIIHSFSFLSNQSPQNIENPMFPPRCHYTTCLLLFLLVLSDFTISESQSPWAAKKKRMRDKVRNMFYHAYDNYMTHAFPHDELKPISKTFTNSLSELGNLKLEHLPQDYNGSALTLIESLSSLVIMGNNTEFERAVLWLSENLTFDVDARINLFECNIRVLGGLVSAHLLASDSSKKLFQGAYKNQLLALAEDLGKRFLPAFDTPTGLPYAWINLKVHQPIHACHPSPLASTMFWHETVTSPPFQ

SEQ ID NO: 151314 - protein, 84 aa, Glycine max
  Coding DNA Sequence Number=SeqID_34536
  Gene Ontology: Biological process=base-excision repair
  Homolog annotation: Hit_ID=Q1S757; Match level="QueryCoverage=72%, HitCoverage=22%, E-value=5e-09, Identity=53%"; Hit description=HhH -GPD
MAFQHAITGLLISIPPDKQNVQTSIGCLAPTKASCIKNVLRCLRERRGELCLEYLRDLSVDEVKAELSLFKGIGPKTVLFFCFP

SEQ ID NO: 151315 - protein, 68 aa, Glycine max
  Coding DNA Sequence Number=SeqID_34537
MAKTIPGRPAPVPTSTRLSLLHEAPQCERSLPQEFQRIDESGLSGGRLGFRSGREWQGICADRAVVLI

SEQ ID NO: 151316 - protein, 88 aa, Glycine max
  Coding DNA Sequence Number=SeqID_34538
MNANRRKDMHSVNDARHDSNPSRWRALHCVIGNDDCSLDWQRMQFYVSPYIRTRSTLHELRLCFLKERIIEYEGRVASSRTGFSKTFK

SEQ ID NO: 151317 - protein, 137 aa, Glycine max
  Coding DNA Sequence Number=SeqID_34539
  Subcellular localization annotation: CTP_CleavageSite=26; ConfidenceScore=5.61e-01
MGRQKGESARSKSRPSSSSLAASLLSSGSGAAAVGFGGFVGSSRLDPLPSSSEDSLPFVDVDSEIAVHLKRLGRKDPTTKNTKLVSLLEAKCHYSAIAMLNSLDPQFQLRQLLRPLWVLGLWHTSYILVISSESLAN

SEQ ID NO: 151318 - protein, 72 aa, Glycine max
  Coding DNA Sequence Number=SeqID_34540
MECKTSLIQTAEANFLSPHTNIQNKGTQNWEYIRQRGESLRMKEEDQARASGKTTESDGGDCETAGKKIRQD

SEQ ID NO: 151319 - protein, 1492 aa, Glycine max
  Coding DNA Sequence Number=SeqID_34541
  Gene Ontology: Mol. function=oxygen transporter activity; Biological process=oxygen transport
  Homolog annotation: Hit_ID=Q9FGI1; Match level="QueryCoverage=100%, HitCoverage=78%, E-value=0.0, Identity=43%"; Hit description =Arabidopsis thaliana genomic DNA, chromosome 5, P1 clone:MQJ2
MKTVAGAILGAFNEKDPTCHPSMWDLIILFSRKFPDGWSSLNIQKSILNPFWNFLRNGCFGSQQVSYPALVLFLDNVPPKSVGGDKFFLEFFKNLWSGRRISLSADRLAFLQALKECFLWSLKNASRYNDGDSIRHFQVTLIDNVLVKLLWKDFLTAGIPKANDIINSGKATDTSEENVSHNKKVDMVDTKYPMPYLQELGKCFVEILLGIYVLDSDVLSVFIEELEDNCMGALQQAANVDIVERIILFMLLLEKHAVLKGAVWPLTYIVGPMLAKSFSVIRSSDSPDAVRLLSVAVSIFGPRMIIQEVLIKNRENYASQLSYDGDNVGEAEDFMQIFKNVFVPWCLQSNSCSTSARLDLLLALLDDEYFSEQWSFIINYVIGQSHSELQPGLLDADHASTLATLLEKARDDRMKRKVKDDSSHRMGCNAKDWHHEYLESSAIAVSRSLPPFSTSHVQFICSLLGGLTEGRSSFLSRNALILIYEEIFRKLVSFVQVSPFFWVQNAASMLSNDAKICVEFDSSLNIVEIAQFALKILDGSFFSLKTLDGESGLVSGILSAIFVIEWEYNLSKALDDSLDDNSMTKTKARLTFGEHVCAFRNKINVQFLKSLSLDSRKRLSNILIQSIRFSIFAEDRLINDEIASLCCTWVLEVLECFCVDENEEQSLLHYLLSKDELWPVFVVLNFSLTKASGHQKFVALIDKLISKIGIDRVIAACGMPNLSLLEKSQEVASSAWLAAEILCTWRWPGSSAVSSFLPSLSAYAKGSNSPQESLLDETLSILLDGSLVYGGSGTKSSVSMWPVPADEVDGVEEPFLRALVSFLSALFKEKIWRPEKALNLIELLVNKLFLGEAVNTNCLKILPLLINVLLEPLYGYAEPGTGVHHCSLEERFVQNTMIDWLERAVSLPPLVTWKTGEDMEDWLQLVIACYPFSTIGGPQALKPARSTSSDERKLLYKLFLKQRHVSGGSAMFNQLTVVPMLLSKLMIVSVGYCWNEFSEEDWDFLLSNLRCWIQSAVVMMEDVAENINGLVDSSSDNLNMMCQKIEKIILISDPFPIKIAENALLSFLLLLKHCKLQQDEERDNLNTFKSEKLDSVKDRILEGVLRLLFCTGVSEAIASACYKEAASVIASSRVEYTHFWDLVASGVVNSSSQARDKAVKSVEFWGLRKGSISSLYAILFTSKPIPSLQFAAYFVLSNEPVLSIAVLEDNACNSNIYAASEEDISRLDLPIEEKVHLKEEISFMVERAPYEVLDMDLLADQRVNLFLAWSLLISHLQSLPSSSSQRERLIQYIQDSATPVILDCLFQHIPVEISTVQSLKKKDAELSGGLSEASSAATRATTTGSLLFSVESLWPVELGKISSLAGAIYGLMLQVLPAYVRGWFSDLRDRNTSAVIESFTRTCCSPPLIANELSQIKKSDFRDENFSVSVSKSANEIVATYTKDETGMDLVIRLPASYPLRPVDVDCTRSLGISETKQRKWLMSMMLFVRNQ

SEQ ID NO: 151320 - protein, 119 aa, Glycine max
  Coding DNA Sequence Number=SeqID_34542
  Gene Ontology: Mol. function=nucleic acid binding; Cellular component= ribonucleoprotein complex; Biological process=nuclear mRNA splicing, via spliceosome
  Homolog annotation: Hit_ID=Q41499; Match level="QueryCoverage=84%, HitCoverage=43%, E-value=1e-47, Identity=88%"; Hit description =Spliceosomal protein
  Pfam annotation: Domain name=RRM_1; Domain location=12-84; Score =30.3; E_value=7e-06; Accession=PF00076.12; Description=RNA recognition motif. (a.k.a. RRM, R
MLSGDIPPNQTIYIKNLNEKVKKDELKRSLYCLFSQYGRILDVIALKTPKLRGQAWVCFSEVTAASNAVRQMQNFPFYDKPMRIHYAKTKSDCIAKEEGSFVPREKKKKQEEKGYYTMV

SEQ ID NO: 151321 - protein, 402 aa, Glycine max
  Coding DNA Sequence Number=SeqID_34543
  Gene Ontology: Mol. function=protein binding; Cellular component =cytoplasm; Biological process=ubiquitin cycle
  Homolog annotation: Hit_ID=Q8RWU5; Match level="QueryCoverage=98%, HitCoverage=88%, E-value=2e-94, Identity=32%"; Hit description =Putative F-box protein family, AtFBL3
  Pfam annotation: Domain name=LRR_1; Domain location=117-140; Score =6.3; E_value=19; Accession=PF00560.23; Description=Leucine Rich Repeat
  Pfam annotation: Domain name=LRR_1; Domain location=143-166; Score =8.2; E_value=8.2; Accession=PF00560.23; Description=Leucine Rich Repeat
  Pfam annotation: Domain name=LRR_1; Domain location=15-38; Score=4.9; E_value=34; Accession=PF00560.23; Description=Leucine Rich Repeat
  Pfam annotation: Domain name=LRR_1; Domain location=169-192; Score =1.8; E_value=1.3e+02; Accession=PF00560.23; Description=Leucine Rich Repeat
  Pfam annotation: Domain name=LRR_1; Domain location=220-245; Score =4.1; E_value=49; Accession=PF00560.23; Description=Leucine Rich Repeat
  Pfam annotation: Domain name=LRR_1; Domain location=246-269; Score =9.0; E_value=6; Accession=PF00560.23; Description=Leucine Rich Repeat
  Pfam annotation: Domain name=LRR_1; Domain location=41-61; Score=2.8; E_value=87; Accession=PF00560.23; Description=Leucine Rich Repeat
  Pfam annotation: Domain name=LRR_1; Domain location=67-93; Score=4.4; E_value=42; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=117-140::143-166::15 -38::169-192::220-245::246-269::41-61::67-93
MITEKCLHHILQLEHLEDLVLEHCLGIEDHGLATLQASCKSMKMLNLSKCQNIGHIGIASLTSGAHNLEKLILSSSLSVTTDLAKCLQSFPRLRSVKLDSCLGTKSGLKAIGNLGASLKELNLSKCVGVTDENLPFLVQTHKDLEKLDITCCHTITHASISSLTNSCLRITSLRMESCSLVSREGLQSISRCTKLSCLKLGICLMITDDGLKHIASSCSKLKHLDLYRSSRITDEGIVAAALGCPSLEVVNIAYNNNITDTSLESFSKCQKLELLKSEGALVFHQRVSQILLPSIKLSYCSVTDVGLIALASISCLQHVSIFHVEGLTSNGLAAFLLACQNLTKVKLHACFESLIPQQILNYMEARGCTLVWRDKTFEASGYVLLDISDLYFKLVMQELNHL

SEQ ID NO: 151322 - protein, 506 aa, Glycine max
  Coding DNA Sequence Number=SeqID_34544
  Gene Ontology: Mol. function=calmodulin binding
  Homolog annotation: Hit_ID=Q9FJI9; Match level="QueryCoverage=100%, HitCoverage=88%, E-value=1e-109, Identity=45%"; Hit description =Similarity to calmodulin-binding protein
  Pfam annotation: Domain name=Calmodulin_bind; Domain location=31-335; Score=504.3; E_value=1.4e-148; Accession=PF07887.2; Description =Calmodulin binding protein-like
MVKEEVEAALKRHLTSMKQTCGKEFHTTELRNLQLQFENSICLPVFTGARIEGEDGSNLRIGLVDALTGKVVSTGPESSAKVEIVVLEGDFEEESETWMPEEFKSNIVREREGKKPLLTGDVILYLKDGIGMVSEISYTDNSSWTRSRRFRLGARVVDNFDGVRIREAKTESFIVRDHRGELYKKHHPPGLSDEVWRLEKIGKDGAFHKRLSREKIVTVREFLTLLNLDPAKLRSILGTGMSAKMWEVTVEHARTCVLDTTRHVYFPSNSQEPGVVFNAVGQVTGLLSECDYVTVDKLTETEKAFIPHPLLLSLLFPSFSYFSLIISNMIFHHQADAQNAVTAALRQGEKYATFEDEDSLMDGSSHLTNVLYSPSSPKTEGSSANKILAPQKTGGFNYPPANASSPDIMSSIYSVGGTSSLDDYCLPNFDSMGLRYDQTLSFPVQVSNSLICDTDSMAHAFSDEDHLQFFDTDLQSHVQADLQSAIDSFMLARPTANGGAQRRWRK

SEQ ID NO: 151323 - protein, 167 aa, Glycine max
  Coding DNA Sequence Number=SeqID_34545
  Gene Ontology: Mol. function=zinc ion binding; Cellular component =intracellular
  Homolog annotation: Hit_ID=Q53J16; Match level="QueryCoverage=81%, HitCoverage=75%, E-value=1e-51, Identity=72%"; Hit description =Pollen-specific protein SF3, putative
  Pfam annotation: Domain name=LIM; Domain location=66-125; Score=32.6; E_value=8.2e-07; Accession=PF00412.12; Description=LIM domain
MQLSNYCSFEGVLYCKPHFDQLFKMTGSLDKSFEGIPRSARVERSADQVQSNNKVSRLFSGTQEKCVGCKKTVYPIEKFFANFAYDLVISDRLRCTHGGCVISPSNYVAHEHRLYCRHHHTQLFKQKGNFSQLDKHDSVQVVITENTTQHPDPSNGNTDTTPAEESS

SEQ ID NO: 151324 - protein, 81 aa, Glycine max
  Coding DNA Sequence Number=SeqID_34546
MMIDDGDNDGCDAISVGDNGGDNENNGDGDVTMMMTMTIINNSDNDDANNNRDSYDHTHKDDINNDYFDDNDDDDEKEEKR

SEQ ID NO: 151325 - protein, 151 aa, Glycine max
  Coding DNA Sequence Number=SeqID_34547
  Gene Ontology: Mol. function=nucleic acid binding; Biological process= transport
  Homolog annotation: Hit_ID=Q8H6Q8; Match level="QueryCoverage=51%, HitCoverage=2%, E-value=7e-09, Identity=38%"; Hit description=CTV.20
  Pfam annotation: Domain name=MP; Domain location=6-151; Score=-35.0; E_value=0.023; Accession=PF01107.9; Description=Viral movement protein (MP)
MDDWNIPEIPQDQLYVPETIKNKHNFDYIIKTVENNIPLGQDIGEEFHLLSKNSIYEHSRKYKYLHIGCVQVAIKPLIDMGIDAAVLMCLRDIWHNQFEDSLIGTVKTSLGQVSLMDRNILDSLFLNIHFHGLDMKEGSIRAALIYRIQYK

SEQ ID NO: 151326 - protein, 112 aa, Glycine max
  Coding DNA Sequence Number=SeqID_34548
  Homolog annotation: Hit_ID=Q84VH5; Match level="QueryCoverage=78%, HitCoverage=17%, E-value=4e-38, Identity=72%"; Hit description =Envelope-like protein
KLSVKYAILHRIGAANWVPTNHTSTVATESFAVKLPIAFPTVLCGIMLSQHPNILNNIDSVMKRESALSLHYKLFEGTHVPDIVSTSGKAAEEEEDAAEDTESDDDDSEATP

SEQ ID NO: 151327 - protein, 254 aa, Glycine max
  Coding DNA Sequence Number=SeqID_34549
  Homolog annotation: Hit_ID=Q4UVM0; Match level="QueryCoverage=54%, HitCoverage=44%, E-value=9e-43, Identity=65%"; Hit description =Phosphate-binding protein
MAPQILYALDRAVAAHEEHRLVITHAVALGQQQWAGATALAQRHRRTRGFGDPVDPAPPQIAGHLLRVACHQDPPLLDANVVHARHHVVQQGLQLFVMRLGIIADPAQHQYRIRCCTHRPGQQDHGQAQQSPLHCLSQTRHRLHPPWVSRQTTRKNENVVSCPCCPLVPVAPCAGCRRGCRATGALPARWVRCAGTGGAACASPIPGRGPCGNRSHPACRQAGRRSSPSARGWPPVRGSPARRRLQAAHPAAAC

SEQ ID NO: 151328 - protein, 208 aa, Glycine max
  Coding DNA Sequence Number=SeqID_34550
MTGRLLAGSLTFDCRIMHYIIVRILLPRSSNLAQASEEDLILMWDFLIGRPIDWAHLIRYRMHKALRSNAPLPYPQLVTLFLHHFQTPLDNEPFVKVKRSFAIGAGVVTSFSYRKDMDGQWLKKDAQPPQDERTHSPPPQRDDYSALMNEVLSELRGLCTYVGERFDSLDGRINAIDARFAGMDTRITQLEEDISYVRQCFDLPSPSS

SEQ ID NO: 151329 - protein, 49 aa, Glycine max
  Coding DNA Sequence Number=SeqID_34551
MVNKPSEFNIDRKIERNSKRGLVPSIEEFQSRSEGPTTLRDIGLRSTPN

SEQ ID NO: 151330 - protein, 125 aa, Glycine max
  Coding DNA Sequence Number=SeqID_34552
MVHQVKLNHGGDHLAKIGAKDESSYIAACLLPNTFRIVDVLVTFSFTLTKMSWTIKEQALRRPYRTRARARVMGKVEEVQEKMKVDMEAMKEKMATMMEAMMSMRKIMEDNAIAVAATSTVGGIL

SEQ ID NO: 151331 - protein, 51 aa, Glycine max
  Coding DNA Sequence Number=SeqID_34553
MSFPAFRLARLGEHPCTWKHKNEGGGVFLHPKLSSLIQKMQTPTEFADFHP

SEQ ID NO: 151332 - protein, 1306 aa, Glycine max
  Coding DNA Sequence Number=SeqID_34554
  Gene Ontology: Mol. function=nucleic acid binding; Cellular component= intracellular; Biological process=DNA integration
  Homolog annotation: Hit_ID=Q1T010; Match level="QueryCoverage=98%, HitCoverage=98%, E-value=0.0, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=490-641; Score =73.0; E_value=9.4e-19; Accession=PF00665.16; Description=Integrase core domain
  Pfam annotation: Domain name=zf-CCHC; Domain location=276-293; Score =24.2; E_value=9.9e-05; Accession=PF00098.13; Description=Zinc knuckle
  Pfam module annotation: Pfam domain module=RVT_1::RVT_2::rve::zf -CCHC; Domain location=835-1042::813-1070::490-641::276-293
MAMQKSNDQIPAKLPIFDGNNYERWTAQMKVVFRYQGVLDIISTGVTPLAENPTEALRATHREQLKKDDKAIFLIHQCVDANVLEKIIEYETAKEAWDVLAATYAGDKQTKKVKLMAMRRQLGLLQMESNESVANFVNRLVVLTNQMRSCGEIVSESMKVEKVLTGLTPNFDVVVSAIEQAKDLDTLKLEQLLGALEAHELKLKNRESIKKDDKEHEKALFAQSQKKGGGSESWKNKRGKGKWKNNKQDGNNPKGENQKKEGDNNGKGKKKSKEDIQCYNCQRYGHYADECNNPKVPRKRNEEAQFAQDSDNQETVLLMAIINTETGCEEWWYLDTGCSNHMTGHKDWFCELDETVRRSIKFGDGRTVMAKGIGRVSIRRVDGSKVVISDVLYVPNMESNLLSLGQLMEKGLSMHMQGEHMEVADTNGKCVLKVPVSKNRTFKVGVSSFEQKCLAAQVNENVWKWHKRLGHLNFNSMRKLQMKGMVAGLPEIEAPKGVCGKCCEGKQPRKSYKTTVPTRAKTKLEVVHSDVCGPFEAKSHGAGNSIKLLRTDGGGEFTSTEFENYCKEEGLIHEVMAPYTPQHNGTAERRNRTVLNMVRCMLKEKHLPKEFWAEAVLTATHILNRSPTKRLEELTPEEAWSGVKPSVKHFKVFGSLCYRHVPEQNRRKLDSRAQAMILVGYHSTGAYKLFDPLNKRIVISNDVTVDEANEWDWNNSVAVQTSDTVEVELDDSQIEEEDMQANNEPQEIVEGNIAAPLRRSLRQTTMPARYQDYDVFPDSAINIDGDLQNLVLLAEAEPVSLEEALAHPHWKDAMDEELRSIHKNKTWEMVNLPRNKKAIEVKWVFKTKIKPSGEIAKYKARLVAKGFLQKPGLDFNEVYAPVARIETVRMIVAIASRKKWTLSQLDVKSAFLNGPLEEEVYTKQPPGFVKKGMEDKVMKLNKALYGLKQAPRAWNRRIDGFLQKLQFVKCTTEHGVYIKHCGTAGVIILCLYVDDLLVTGDSEQEIKSFKMKMMEEFEMSDIGRLGYFLGMEFVTFEIGIFLHQKKYATDILKRFNMLNCNPAATPCEPGIKLTAGTDTEFVDSTLYRQLIGSLRYLCNSRPDITFSVGLVSRFMEKPCKDHLLAAKRVLRYVKGTLECGILFPTATENSEIEVTGYTDADWSGDIVDRKSTSGYIFMLGDAPISWCSKKQEVVALSSCEAEYISAAFGASQALWLSMLLKELNVKCCEIMKLRVDNRSAIDLAKHPIAHGRSKHIEVKYHFLRDQVNKGNLALEYCRSEDQFADILTKAVKLRRLEEMKNKTGML

SEQ ID NO: 151333 - protein, 47 aa, Glycine max
  Coding DNA Sequence Number=SeqID_34555
MGWYNGPCGSHHAQQCKFPDLFRLTSVVETNVVERAKTLSYAHTRRG

SEQ ID NO: 151334 - protein, 66 aa, Glycine max
  Coding DNA Sequence Number=SeqID_34556
MVTRTFRQPGVNEPIGAKRLTSSSAPFVIQGQQVGWQAEIPYGHPRLSSTEENEFDGIMLDQVASE

SEQ ID NO: 151335 - protein, 106 aa, Glycine max
  Coding DNA Sequence Number=SeqID_34557
  Gene Ontology: Mol. function=DNA binding; Biological process=DNA integration
VREERKLQLSELDKIRLEAYENSKFYKEKTKKFHGSLIAKKDFVVGQKVLLYNSRLGLMSVEIKSESANKSFKVNGHRLKPFLTNPSLVDVVVEETSLLNPTSLMP

SEQ ID NO: 151336 - protein, 239 aa, Glycine max
  Coding DNA Sequence Number=SeqID_34558
MKKLITYLGVVACDKVDITYENWPEVPTAQTDLIWEDIQAEFEIPEASDSRTKKKLLQTVGERCRQFKSDLTRKWALAADQDDVDDTVCDKYGISKEKWAQFCQTHRDPSWEKLLAEKTKKKLEEAAQSGSVDGIIDPLSPVRRHVKWKMARTKKTGEMTTEIVKEITEKIESFEEQAGREDGPHGRQDVLTAAIVRPEHPGRVHATGVGVTIKQYFGSAPRTSHSSSSLPPEELQQLT

SEQ ID NO: 151337 - protein, 160 aa, Glycine max
  Coding DNA Sequence Number=SeqID_34559
  Gene Ontology: Mol. function=oxidoreductase activity; Cellular component=endoplasmic reticulum; Biological process=metabolic process
  Homolog annotation: Hit_ID=Q8H1Z0; Match level="QueryCoverage=92%, HitCoverage=23%, E-value=8e-71, Identity=81%"; Hit description =Cuticle protein
TNVLRATLQMLTLSTDRFQRIQKEAPPEYQSYLVQVTKYQAAQNCKTWIVGKWITPREQYWAPRGTHFHQFVVPPILPFRKDCTYGDLAAMRLPEDVEGLGCCEYTMDRGMVHACHAGGVVHSLEGWPHHEVGAIDVNRIDLVWEAALKHGLRPVSSFTQ

SEQ ID NO: 151338 - protein, 218 aa, Glycine max
  Coding DNA Sequence Number=SeqID_34560
  Homolog annotation: Hit_ID=Q9FJN5; Match level="QueryCoverage=80%, HitCoverage=75%, E-value=4e-09, Identity=28%"; Hit description =Arabidopsis thaliana genomic DNA, chromosome 5, P1 clone:MTI20
MENRARLKVQKKRPIKRSGRKVLLKNVLDYLKADTYMYAPLLSPPTSDFPSPNAFPSSAKGVEYKKPVTEKQWFGKQVGKYLKYDGYMYDPLLRLPHSSLGVAAKILYVGNWSIQGAPNYLFRLNWKDGKLIICIDFVFICQIEEPLQDCGMMRMDDSARTLRMKVNQRTNHLGNANQSSESHLPQTDLSDQHIGGHTETVKHTVYQSCRSTSATIVE

SEQ ID NO: 151339 - protein, 69 aa, Glycine max
  Coding DNA Sequence Number=SeqID_34561
MSKRLAEDAKAYFDECVSLSTFDSSDFSSPEDPPLNFVGPPTPSGSPVCLTEASSNASVSNFIGSFLND

SEQ ID NO: 151340 - protein, 357 aa, Glycine max
  Coding DNA Sequence Number=SeqID_34562
MELHHYSSIFLTTKLIADLKERVNLTYHNNFNWAIVDYCLDSESVYLNADKGHPNFTYVCEDTFKALSITLPFSNFKCAILAKINVALIQLHPKMTEDGKVGWVSMTSAKGCDVVKAWGKIVQPQEKHPKVIYVVVLESEVKRFAEKEKSPEKGKSSELQTVKASVAIENETTPTPEVDAPITNPPPSPSDQNQERAKLIFSLKEKKALVDEKVRIIFNLQKKITNHEQIVSAKAIENGKLCQDIKSLNKKWNVVIKELANSNKMISVLNDQLIEKEDKIKTLVLEKEELKKEKKSAEDFMPRLEKQVADLTTDKEKTSAPLAQQAPCGACRAWIFFNNGVLSFLKFNGSGMEEEEI

SEQ ID NO: 151341 - protein, 131 aa, Glycine max
  Coding DNA Sequence Number=SeqID_34563
  Gene Ontology: Mol. function=DNA binding; Biological process=DNA integration
MVQPKNPRSTPRFSTHGPKINPKAHEIPRAFCCISGSIFLESSIQCPCEVGLHHPPILIRPTLGAEFLHYLFVSNTTFSSLLMQEDDKRQPLIYFTSRVLQGAEQRYQMIEKLALSLFNLVRRMHPYIHSH

SEQ ID NO: 151342 - protein, 72 aa, Glycine max
  Coding DNA Sequence Number=SeqID_34564
MAENSLRTDMSSSFNSSRRAQFQEVLNDENLTMELNLIDEVRDLPKYKKKLAKEVMEAFLRSFYGGWIFKLQ

SEQ ID NO: 151343 - protein, 51 aa, Glycine max
  Coding DNA Sequence Number=SeqID_34565
MEKEQVLWWYMKEVSELLTFLALLCVSSTFTLHGWPIITSSDDPRHHSSSS

SEQ ID NO: 151344 - protein, 224 aa, Glycine max
  Coding DNA Sequence Number=SeqID_34566
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=8e-24, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTACPRLQRTTRLRHQRTTCPCLQRTTLPCFRGLHVLAFRGLLALPSEDYTSSPSEGYSPCLQRTTRSCHQRTTHPRLQWTTLSRLQRIAHPCLQRATHPHLQRATRLQLAFRGLHVLSIRGLHVLAFRGLRVLAFRGLHVLAFRGLHVLTFRGLHALTFRGLHALAFTRLHVLAFKGLHAFTFKGQHVLDFRGLHTLTFRGLRVLTFSGLHIHTLREFKVLYP

SEQ ID NO: 151345 - protein, 150 aa, Glycine max
  Coding DNA Sequence Number=SeqID_34567
  Gene Ontology: Mol. function=RNA-directed DNA polymerase activity; Biological process=RNA-dependent DNA replication
MAGWNDCAIADALQALAQALGNQNKGEAVGAAEYQGLNHFQQNNPPGFNGGYNPDSAQNWIREIEKIFQVEGQVVTWEVFKRVFLEKYFLEDVRNKKEMEFLELKQGNMTVAKYVAKFEELVSKEQNEWTLTLGKTVLDPPKQYGNHPNN

SEQ ID NO: 151346 - protein, 118 aa, Glycine max
  Coding DNA Sequence Number=SeqID_34568
MVFDKTVVLSFKPKIVLQKPTHRKIIFYKKVSGLSQQRRWKDRLDEEEVIVGVLDLEGERKRGRRTTCHRGCHGGERRGQGQEGFGVETETAKGREREGREARIIGFERERERKGKKK

SEQ ID NO: 151347 - protein, 167 aa, Glycine max
  Coding DNA Sequence Number=SeqID_34569
MTLLLSNILPSDHNSDLPLPKCQLVYAILTRMSVHVAQLIADAIYLFASMPPTRHPLDPDKSNRALGFPALITGLCQSFGVPVTPSKVIRPPITQAFIEKYCTPRQAQGDASQAADAPPPPHQADPVGSFDTERYLRHLVRQQAANHRAHVQTHDCLYQLSLSLQSQ

SEQ ID NO: 151348 - protein, 115 aa, Glycine max
  Coding DNA Sequence Number=SeqID_34570
MDSSKDNSIISCIELLGAPEPGARRAGARPAELPSTSAAPTPTSTLVAPSVPVVEPSGSIPSMEQFTEMARLTSALSKGGKMHGVATNEGISTSHVDKSGALAPTYPPSKRKSDL

SEQ ID NO: 151349 - protein, 72 aa, Glycine max
  Coding DNA Sequence Number=SeqID_34571
  Subcellular localization annotation: CTP_CleavageSite=12; ConfidenceScore=5.13e-01
MDNQVHGPPTPRGVKTTNQSSPYELSQLPTRHPTQLSSTCISTFHYDVILARSGSLDTGYRVLDDATFGEGR

SEQ ID NO: 151350 - protein, 62 aa, Glycine max
  Coding DNA Sequence Number=SeqID_34572
  Subcellular localization annotation: CTP_CleavageSite=43; ConfidenceScore=5.04e-01
MSYQAGLSGEGFAKRQHHSILKSLSALSACSGAKPESLTKALSAAAALSPKCLLEVTTSSWA

SEQ ID NO: 151351 - protein, 152 aa, Glycine max
  Coding DNA Sequence Number=SeqID_34573
  Homolog annotation: Hit_ID=Q9AVH2; Match level="QueryCoverage=30%, HitCoverage=16%, E-value=3e-20, Identity=97%"; Hit description =Putative senescence-associated protein
MARHKVARTHAHTHTHSRRHRGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 151352 - protein, 197 aa, Glycine max
  Coding DNA Sequence Number=SeqID_34574
MNPDFNQPRGGCSREVSIHPAQQHCYMFALGKRCVTPRQACPRPNGFGRNLRFKDSMVHGILQFHTKYRISLRSSSMQEPRYPLPRVIVCKMLCRDDSPRDTVSGPPGVALNRFEFLGARSAGVCVCREDEEAGRTGRRGHPLPPDGSVDFSQRRGQRTAHVAAIRTLHRTIQSVGATGGVYKGQGRSQRELMTRAY

SEQ ID NO: 151353 - protein, 142 aa, Glycine max
  Coding DNA Sequence Number=SeqID_34575
MERGAYRGRGRNSYGGGRGSYGGDRDGNGDHNSYGGGRGGYGGGRSNIGSSKISEKKMDTITPVRRPDNGEQWQFENAISAKAPPPKNNRPPKKISKGNIYCGRVQRRGRKTCFVSGPSDIGEQARASEVEGLPQWKRTFDP

SEQ ID NO: 151354 - protein, 181 aa, Glycine max
  Coding DNA Sequence Number=SeqID_34576
MNTKMDSLLEHLVALTLIPTSPKYPPTPTPVSCFRPHMKLEIPHFDGNDPMGWIFKATQFFDYQNIHDQEKLIAAKFYMEDPALSWYQWMHRNGFLTTWPTLLQAIKSRFTPSFYDDLHNTLFKLQQHGTTIFKYLTEFERLANHIIGLSPLSSLVVLSPVYYQNFAERSELSNQSLSHRP

SEQ ID NO: 151355 - protein, 133 aa, Glycine max
  Coding DNA Sequence Number=SeqID_34577
  Homolog annotation: Hit_ID=O63067; Match level="QueryCoverage=48%, HitCoverage=7%, E-value=7e-28, Identity=96%"; Hit description =Aspartokinase-homoserine dehydrogenase
MSVHKFGGTCVGTSQRIKNVADIILKDDSERKLVVVSAMSKVTDMMYDLIHKAQSRDESYIAALDASGRHRGGAPIRPIVSRITIHWPSFYNVVTGKTLALPNLIALQHIPLSPAGVIAKRPAPIALPNSCAA

SEQ ID NO: 151356 - protein, 106 aa, Glycine max
  Coding DNA Sequence Number=SeqID_34578
MQDEMSNEELKLQDSRCRIQCPDILPENTGVAAQCISQDKMSNEELKLQNPRCRTRCPDIWPENTGHINLFSGRMIDLLQHKPLQPRNAHCYIIMEAARVLYQVRD

SEQ ID NO: 151357 - protein, 105 aa, Glycine max
  Coding DNA Sequence Number=SeqID_34579
MGKGWGLGFVDVGSPSSAGGQRWTIEMVTAVEVVAVHLQLAAAGPPPAVVVPDPAAVPALAYQLGHMNTHLGQDDMDQLALRQGKVGIMIVREDVAEQQCHPDMC

SEQ ID NO: 151358 - protein, 151 aa, Glycine max
  Coding DNA Sequence Number=SeqID_34580
  Gene Ontology: Mol. function=chitin binding; Cellular component =extracellular region; Biological process=chitin metabolic process
  Homolog annotation: Hit_ID=UPI000044A8F0; Match level="QueryCoverage =72%, HitCoverage=99%, E-value=1e-15, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=7; ConfidenceScore=5.06e-01
MQMTTLVSAYYRTLESDGRNKTFSRSRPKDANISGTCSPLKARTCSPLKAKACSPLKVRTCSPLKARTCSLLKPLKARTCSPMKARTCNPLKARVCSPFKGRTCSPLKVRACSPMKARVCSPLKARVCSPLKVRACSPLKARVLVPKGPPL

SEQ ID NO: 151359 - protein, 70 aa, Glycine max
  Coding DNA Sequence Number=SeqID_34581
MQAKEHKWRLGAARNESSHKLLVVLNVGCRNLHFGERVTRGSWVHLPREEGTRSRHQRLFEENVGKTGKV

SEQ ID NO: 151360 - protein, 117 aa, Glycine max
  Coding DNA Sequence Number=SeqID_34582
  Gene Ontology: Mol. function=oxidoreductase activity
  Homolog annotation: Hit_ID=Q9M9M7; Match level="QueryCoverage=45%, HitCoverage=15%, E-value=8e-11, Identity=62%"; Hit description =Putative NADP-dependent oxidoreductase
MGLLATFAKENQEIVISLLCQHPPSRYLLCHPANVSNYESQPIERGCVYTLEMAEKEVRNKQLVLRDYVTGFPKESELYVTSNGTIKLKLEGDSKRVLVKNLFLAADPHLRPFDEES

SEQ ID NO: 151361 - protein, 200 aa, Glycine max
  Coding DNA Sequence Number=SeqID_34583
  Gene Ontology: Mol. function=sequence-specific DNA binding; Cellular component=intracellular; Biological process=regulation of transcription, DNA-dependent
  Homolog annotation: Hit_ID=Q2KUM0; Match level="QueryCoverage=73%, HitCoverage=53%, E-value=2e-46, Identity=60%"; Hit description=AraC -family transcriptional regulator
  Pfam annotation: Domain name=AraC_binding; Domain location=36-174; Score=31.8; E_value=2.5e-06; Accession=PF02311.9; Description=AraC -like ligand binding domain
METGMLIPCTSPSGCDCDNDSAATRTEFWRDPSLDFVESRRACHSRACYRPHSHPTFSIGAVDAGGSLFTGASGGPCSLQPGMMVFIPAGAVHSCNPLPHKHWSYQMLHIDAAWLNALLAEMDDVSGSFISQGEVRVTNNQERYHRFCELNNLLFSTASTEDKNTALIEFIGDSKYGTGPVKAFPVMASDISRALHNVIE

SEQ ID NO: 151362 - protein, 136 aa, Glycine max
  Coding DNA Sequence Number=SeqID_34584
ARGVVSDNLTFERLSPIINLAYIKKNCWNPEDLTVSIRGARRARARPIEAPSTSAAPPPAHTLVAPSTLSSTDFQHLEAMLQSIHQGQIVLLQSLQLVAPPDSIPSVEQFNEWVAWPETQPPLHREDEGLTAQVPQ

SEQ ID NO: 151363 - protein, 79 aa, Glycine max
  Coding DNA Sequence Number=SeqID_34585
EVKTTVIDIETLKIVLHNFITGFPRPGILSGVQAGFIAQFGLGSGQEWFAVVVVLIPLYYSAIDIIRHQTRPYVMSSKM

SEQ ID NO: 151364 - protein, 93 aa, Glycine max
  Coding DNA Sequence Number=SeqID_34586
  Homolog annotation: Hit_ID=Q1T099; Match level="QueryCoverage=59%, HitCoverage=8%, E-value=1e-14, Identity=69%"; Hit description=AAA ATPase; DEAD/DEAH box helicase, N-terminal
AEVTITKLNEERRRTTQEKDLLLRQEELDNLLFSHLSFLDVLDDCMTGGKEARKQNRTLTKLFPNKITIHMPQDEALLASWKQQLEREVETQN

SEQ ID NO: 151365 - protein, 113 aa, Glycine max
  Coding DNA Sequence Number=SeqID_34587
MGDPISRLSFPGRRIVCHSNHMLSWNICLFAKACLHFSGENTETFSSLTSYPELRRSEFLIGGYVGARASLLSTTPPFVAMTQELIRGDTLRLSAPLCYLDTVVVRWHAEAKS

SEQ ID NO: 151366 - protein, 63 aa, Glycine max
  Coding DNA Sequence Number=SeqID_34588
MPPQNKFVGCAFTGKNLKKFQIPSTCTIDELKNLIKQVAPKGIPPLGIHESQTVLFDGTGERQ

SEQ ID NO: 151367 - protein, 60 aa, Glycine max
  Coding DNA Sequence Number=SeqID_34589
MTKGLGGRLEGKKSENGCSWWPLMVVGGGGGGGVRAWISLSELILLIGSPLLALSATFRS

SEQ ID NO: 151368 - protein, 83 aa, Glycine max
  Coding DNA Sequence Number=SeqID_34590
MGNQNKGEAVGATEYQGLDRFQRNNPPAFNKGYNPNEEAKYWWENTHQCLEAEGQAVTWETFKMVFLEKYFLKMLEARRRWSS

SEQ ID NO: 151369 - protein, 94 aa, Glycine max
  Coding DNA Sequence Number=SeqID_34591
MENWRTTLLNNFAGLQSRRWRMHEQRQAMTFMGLRKKVENGELWRMENWRRALRNNFAGLQTRWWRMHEERQAMTFMGLRKKVENGELANSATQ

SEQ ID NO: 151370 - protein, 59 aa, Glycine max
  Coding DNA Sequence Number=SeqID_34592
AKRREGQAAGVSLSEAYVLSECHPLSKALSSLSVMRNPRRGSARDVLAHQPPRESRLEG

SEQ ID NO: 151371 - protein, 224 aa, Glycine max
  Coding DNA Sequence Number=SeqID_34593
RHRSHLRPHSHRREDERKPQEANINLSYFNGKDNVEAYLDWEIRVEQKQKRKSTLKSYGSHSYPKKDQGLGILGAAPSKPKDNKGKTIEKQPPKKTMIMRSPDIGRGHITSQCPTKKTMIMRSPDIYSSQDEATTSPSSSESEEAKGEESSEEIYLQEEGQPLMVKEECKEVSVSSKRLAKKERHFEIKTNIKEISPLRQPPHFLLCIKTLVNIAKPLGLEFIP

SEQ ID NO: 151372 - protein, 204 aa, Glycine max
  Coding DNA Sequence Number=SeqID_34594
MGETEKMQKQIKANLEAMKDQMATMIVAMMSMKKIMEVNTAVVAATSVVAKVDLTPTFGLNQINHVISDMVGQRGIELGSTGGPHFVHVQNKHSFPPYGLAPNHTPPNVAHTPNEDVDNSTPIPIESQQPQVDHAHVSQSTGETHEISHHNLTDFEPRLGYATKGQAVGGVPLPNTLEGPQFLLQPHHTLAFYDGRILLAMAEK

SEQ ID NO: 151373 - protein, 174 aa, Glycine max
  Coding DNA Sequence Number=SeqID_34595
  Homolog annotation: Hit_ID=Q39LL0; Match level="QueryCoverage=72%, HitCoverage=12%, E-value=2e-21, Identity=43%"; Hit description=Rhs element Vgr protein
MEPQQEGITRALTPGEVNLARSVFGSTIFYQNVLVHCDSYLPFGLQNQYTAMSPNGELYFRRALYKKDYAIQDPEAQHLFIHEMAHVWQYQRGMWVRTRGLLSWAVSYQYRLDKPSLHHYSMEQQASIIADYFILKRYGVNAFFRLPNRKLIGIVDRRTLSQFHPIIRSAGLPL

SEQ ID NO: 151374 - protein, 260 aa, Glycine max
  Coding DNA Sequence Number=SeqID_34596
  Homolog annotation: Hit_ID=Q8TGM6; Match level="QueryCoverage=29%, HitCoverage=62%, E-value=7e-09, Identity=66%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADPALTVPHPTGTHRRPPSASLPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPVRSPLLRESLLVSFPPLIDMLKLSG

SEQ ID NO: 151375 - protein, 148 aa, Glycine max
  Coding DNA Sequence Number=SeqID_34597
  Gene Ontology: Mol. function=transcription factor activity; Biological process=regulation of transcription, DNA-dependent
  Homolog annotation: Hit_ID=Q710C2; Match level="QueryCoverage=97%, HitCoverage=43%, E-value=3e-13, Identity=53%"; Hit description=Sigma factor
MPFREVSTVCTKIESFRAQHFRMLMENLCVLEETFVDSEALSLENPIILQLGKVGALELFNVCLSRSVGTSLVSNYAVKVDDYKDKDTKPVANLSTWAEASRVDEKVLQQLLHRGYYCRDELIQSSRSLVVYPARKYRGMGIALDDLL

SEQ ID NO: 151376 - protein, 166 aa, Glycine max
  Coding DNA Sequence Number=SeqID_34598
  Homolog annotation: Hit_ID=Q47522; Match level="QueryCoverage=25%, HitCoverage=53%, E-value=3e-19, Identity=100%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDHVLHVSVARALMLVPISPRWHTVALAAANPAELHAPVLHPSSRTPLRALGGTES

SEQ ID NO: 151377 - protein, 115 aa, Glycine max
  Coding DNA Sequence Number=SeqID_34599
  Homolog annotation: Hit_ID=Q1T3K5; Match level="QueryCoverage=43%, HitCoverage=18%, E-value=2e-08, Identity=57%"; Hit description=Zinc finger, CCHC-type
MKMRALLVQQGLEKALEGEKILPANLSEKEKKDFLDKAHSALILSLGDKVTNTSNNIKACVFLPQNPHPTPPNLLLHHPQIPVTSTSRCCLPLDHCMEKNTLIREKSSKTNSRIR

SEQ ID NO: 151378 - protein, 167 aa, Glycine max
  Coding DNA Sequence Number=SeqID_34600
  Subcellular localization annotation: CTP_CleavageSite=38; ConfidenceScore=5.47e-01
MSPISDSARLPPLEDAPVSPASPSRRRVAFTFCKLPTRKNHNFGTNMSHHSSSVNGEGTSHKNPLSTILDELSSLKLWKEKLERKEKGNERVEINQDEKEQIREEERKKILKELRKKNASYSSHDSCKSPSEELGDYYEGRHRSHFRPHSHRREKERKPQEANINLP

SEQ ID NO: 151379 - protein, 80 aa, Glycine max
  Coding DNA Sequence Number=SeqID_34601
MSHHSSSVNGEDTSHKDPLSRILDELSSLKLWKEKVQRKEKGKEREGIGHILDLTPIENERKESLKRLTLTSHTFMGRTM

SEQ ID NO: 151380 - protein, 221 aa, Glycine max
  Coding DNA Sequence Number=SeqID_34602
  Gene Ontology: Mol. function=metal ion binding; Cellular component =cytoplasm; Biological process=L-arabinose catabolic process
  Homolog annotation: Hit_ID=Q1XUQ6; Match level="QueryCoverage=97%, HitCoverage=93%, E-value=1e-105, Identity=82%"; Hit description =Class II aldolase/adducin-like
  Pfam annotation: Domain name=Aldolase_II; Domain location=1-204; Score=212.6; E_value=8.9e-61; Accession=PF00596.11; Description =Class II Aldolase and Adducin N-terminal domain
MQLDALKLVVYTFGNVSAVDRDKGVFAIKPSGVPYDILKPEDMVILDFDANVIEGSLRPSSDTKTHAYLYKNWENIGGISHTHAIYSVAWAQAQMDIPVFGTTHADHLTTDIPCAPPMRDELIEGNYEYNTGIQILECFKQKQLSPEEVEMVLIGNHGPFTWGKNAEKAVYNSKVLETIAEMAYLTRQINPDAERLKDSLIKKHYERKHGKNAYYGQEFKH

SEQ ID NO: 151381 - protein, 389 aa, Glycine max
  Coding DNA Sequence Number=SeqID_34603
  Gene Ontology: Mol. function=ribulokinase activity; Biological process=carbohydrate metabolic process
  Homolog annotation: Hit_ID=Q1XUQ5; Match level="QueryCoverage=98%, HitCoverage=68%, E-value=1e-137, Identity=62%"; Hit description=L -ribulokinase
  Pfam annotation: Domain name=FGGY_C; Domain location=106-360; Score =17.0; E_value=4e-08; Accession=PF02782.6; Description=FGGY family of carbohydrate kinases, C-terminal domain
MEHCDYLTFLLSDHKDLATFKRSRCAAGHKAMWHETWDGLPSEEFLNRLDPSLGTLRARLYRETYTSDEVAGYLNEEWAAKTGLTTQTIITVGTFDAHSGAVGARVEENTLIRIMGTSTCDIMVASQEAIGNTTVKGICGQVDGSVIPGLIGLEAGQSAFGDMLAWYKDILMWPVHQIMMHSENISDEQKIKLADEMEAVLIRKLTLEAEKIPLSDSVPIALDWVNGRRTPDADQELKAAISQLSLGTKAPHIFKALVNAICFGAKKIVDRFEEEGVKINKVIGIGGVARKSPFIMQTLANVLDMPIVVAASDQTPALGAAVYAAVSAGIYPTVQEASMKMGSAFEAEYHPKAEEVQHYRELMQQYQKLADFVEYNTKLKNNRKELQNS

SEQ ID NO: 151382 - protein, 35 aa, Glycine max
  Coding DNA Sequence Number=SeqID_34604
MYGLAPSLSPTIADGTEHHANDAQVDRPYDMGNNH

SEQ ID NO: 151383 - protein, 498 aa, Glycine max
  Coding DNA Sequence Number=SeqID_34605
  Gene Ontology: Mol. function=calcium ion binding; Cellular component =extracellular region; Biological process=pathogenesis
  Homolog annotation: Hit_ID=Q6F8M1; Match level="QueryCoverage=99%, HitCoverage=57%, E-value=1e-104, Identity=35%"; Hit description =Putative hemagglutinin/hemolysin-related protein
DKQGALNPGEVTDDAQPTVRGEAEPGSLVNLYDNGQLVGSAVTNAEGQWEFTPTRPLLNGAHSLTVEAVDAAGNISEPSDSFDFMLEAGGAPTAPAITGVVDNVGDVQGTIEKGGVTDDVRPTINGTAQPDSVVTVYADGKVLGTVLTDAAGKWSFTPDSDLAEGLRNLSATATNAAGNISPSTGLYPIVIDTTAPDASSDNQLTDDVGDIQGPINSGDTTDDAQPTFSGVTEPGATIIIRDNGQPIGSAVAGKDGNWRFTPDQPLADGDHSFTAQPVDKAGNKGAESQPVDFIVDTSAVLVTINSVYDDAGSVTGNLTSGAVSDDTTPTLNGSATPDALIHIYNNGTLIGSAKANYKGEWSFTPDVALAEGEHHFTATATNAAGTSAESSPFDLTIDLTPPVVGGIDSVLDDVGTVQGPVDNGGITDDTTPTLVGEGVPGDVVTIIDNGETIGSAVIGENGKWTFTPETPLNDGEHKFETVITDPAGNSSQPSDPYI

SEQ ID NO: 151384 - protein, 354 aa, Glycine max
  Coding DNA Sequence Number=SeqID_34606
  Gene Ontology: Mol. function=helicase activity; Biological process =viral genome replication
  Homolog annotation: Hit_ID=Q2R1R7; Match level="QueryCoverage=81%, HitCoverage=18%, E-value=2e-57, Identity=40%"; Hit description=AT hook motif-containing protein, putative
MALADITNTQPNSQHVSTRQRKTINNIFSLRKIDDIVLDYENELSDCVDDTIDDISIGFIDRYVDLGDHSQICAYCQAAMWYQEKMRKNRNQVNPKYSLCCSMGKIQLPFLKNPPMLLQQLLCDEESRESRNYQQNIRACNLIFAFSYPGAKIDTSLLKGKGPSICKIHGKSCHLIGSMLPMLGKPPKFAQLYIYDIENEIENKIGAIRQNLLDSKLALKLKDMLDEYNVFAKSLRMEKDRYDNYQTENLNLRLIADRKKDGRIYNLPTVLEVAAVIVGDASQPINRDIILEKQSGRLQRINELHPSYLGLQYPLLFSYGEDGYHSDMKHRDMDDSHERKRNKLTIREFLCFRL

SEQ ID NO: 151385 - protein, 215 aa, Glycine max
  Coding DNA Sequence Number=SeqID_34607
  Gene Ontology: Mol. function=helicase activity; Biological process =viral genome replication
  Homolog annotation: Hit_ID=Q1SM20; Match level="QueryCoverage=91%, HitCoverage=64%, E-value=3e-43, Identity=42%"; Hit description =Nucleic acid-binding, OB-fold
  Pfam annotation: Domain name=DUF889; Domain location=1-131; Score= -5.7; E_value=4.1e-11; Accession=PF05970.5; Description=Eukaryotic protein of unknown function (DUF889)
MGNDVGDGKLSKGDDGCYEIETPPDILITSFTDPIEAIVNHTYPDIQKKYKDEEFLNSRVILAATNEVVDQINDYILNIIPDQAEGLFNGTRLIISRMTNHVIEERIIFGKNVGSLVDIPRMTLSPSQSPWSFKMTRRQIPLIVSYAMTINKSQGQSLQCVGLYLPQPVLSHGQLYVTFSRVQSKTRLKILIHDKEGKPLNTTTNVVFKEVLQNM

SEQ ID NO: 151386 - protein, 55 aa, Glycine max
  Coding DNA Sequence Number=SeqID_34608
MANIMLKITRTLEEILNTINAKDKTYDEVNRSFAMRWKNVLEHCWHLVDKNGNLH

SEQ ID NO: 151387 - protein, 62 aa, Glycine max
  Coding DNA Sequence Number=SeqID_34609
MKIEPGLEEEASPSNAQAQHFAPPSSLFGTLNQPPVTRGATAPVIALCIKGLSSCHKIIISD

SEQ ID NO: 151388 - protein, 55 aa, Glycine max
  Coding DNA Sequence Number=SeqID_34610
MTLIIPSSAKFFHFQRASQSVQNYLQQHAKFVKGPNWVQKDHNYDDDEIGKVQQV

SEQ ID NO: 151389 - protein, 172 aa, Glycine max
  Coding DNA Sequence Number=SeqID_34611
  Gene Ontology: Mol. function=protein-tyrosine kinase activity; Cellular component=integral to membrane; Biological process=protein amino acid phosphorylation
  Homolog annotation: Hit_ID=Q2HVC0; Match level="QueryCoverage=99%, HitCoverage=40%, E-value=4e-20, Identity=38%"; Hit description =Protein kinase
  Pfam annotation: Domain name=LRR_1; Domain location=24-45; Score =20.9; E_value=0.0046; Accession=PF00560.23; Description=Leucine Rich Repeat
  Pfam annotation: Domain name=LRR_1; Domain location=47-66; Score=6.9; E_value=15; Accession=PF00560.23; Description=Leucine Rich Repeat
  Pfam annotation: Domain name=LRR_1; Domain location=68-90; Score=8.6; E_value=6.9; Accession=PF00560.23; Description=Leucine Rich Repeat
  Pfam module annotation: Pfam domain module=LRR_1::LRR_1::LRR_1; Domain location=24-45::47-66::68-90
MMIISLGLMSTTHDLPTSLNALHTLRVLDLSNNQLSGELPRLKNLANLQVLNLENNTFGPHFPSLPTKLVSLVLRNNSFRLSVPSNLSSFYLLQRLDLSLNSKRVVRASTRSIIEHVSSANTSKLLTDARYILETMKMGANLPAYRTLALDEPKEATKNFDESSFTSEGPHG

SEQ ID NO: 151390 - protein, 70 aa, Glycine max
  Coding DNA Sequence Number=SeqID_34612
  Gene Ontology: Mol. function=protein kinase activity; Cellular component=chloroplast; Biological process=protein amino acid phosphorylation
  Homolog annotation: Hit_ID=Q1RVG1; Match level="QueryCoverage=73%, HitCoverage=48%, E-value=2e-16, Identity=80%"; Hit description =Protein kinase
MSKVEALAFKAANMVSNLKAATKSFKSDALLGEGGFGKVYKGWLDEKALAPTKAGFGIMVAIKKLNPKSM

SEQ ID NO: 151391 - protein, 114 aa, Glycine max
  Coding DNA Sequence Number=SeqID_34613
  Subcellular localization annotation: CTP_CleavageSite=34; ConfidenceScore=5.01e-01
MTKPMHLMQGMQKIPKKRGKRVFSLSFLDPISLRLASDSPGPPNYFKVKEPARLGEPITSRVGLRKVPGSVLKGIERIKREEETRGNKAKALSNHDCDQSLRHFSFGVLRMIVD

SEQ ID NO: 151392 - protein, 61 aa, Glycine max
  Coding DNA Sequence Number=SeqID_34614
MTTLASAHQSHLGSLNDEVRITIRGNPGFDKIEENHSKCINLAQCGARKKGSLAHGILVGN

SEQ ID NO: 151393 - protein, 287 aa, Glycine max
  Coding DNA Sequence Number=SeqID_34615
  Gene Ontology: Mol. function=RNA methyltransferase activity; Biological process=RNA processing
  Homolog annotation: Hit_ID=Q5PID6; Match level="QueryCoverage=95%, HitCoverage=75%, E-value=7e-85, Identity=59%"; Hit description =Putative RNA methyltransferase
  Pfam annotation: Domain name=SpoU_methylase; Domain location=205-287; Score=-27.4; E_value=0.00045; Accession=PF00588.9; Description=SpoU rRNA Methylase family
  Pfam annotation: Domain name=SpoU_sub_bind; Domain location=117-192; Score=56.6; E_value=8.1e-14; Accession=PF08032.2; Description=RNA 2'- O ribose methyltransferase subs
  Pfam module annotation: Pfam domain module=SpoU_methylase::SpoU_sub _bind; Domain location=205-287::117-192
PYRQGGRPAARQEENRRSGPRSTRNNEESGRPRTARGDDAGRSRGPRDDAGRSRGPRDDSARGRRSDRDDRGFSDSPWRTVSRPPVAAEADAGDEAASSKPVIDPELIRRQRQEETRVYGENACQALFQSRPESIVRAWFVQSVTPRFRETLRWLAANRKAYHVVDDAELAKASGTEHHGGVCFIIKKRMGMPVAEWLQQAQSKDCVLALEDVSNPHNLGGIMRSCAHFGVKGLLVNDASLLESGAAVRTAEGGAEHVQAISGESFAAGLEAFRKAGYTIVTTSSHA

SEQ ID NO: 151394 - protein, 188 aa, Glycine max
  Coding DNA Sequence Number=SeqID_34616
  Subcellular localization annotation: CTP_CleavageSite=73; ConfidenceScore=5.36e-01
MTLAQVWSVLSYSNLAPTSHTSNLTVDRARLIFGLVSRMDMNIGALISGQMTSIAQSNSSRLGFLALITTLCRARGVISDNLTFERLSLIINLAYIRKNYWNPDDLTVAIRGARRARARPADLPSTSVAPTPASTSASPSVPAQMDSQRFEAMLQSIHQGQIILLQSLQVVAPPRSIPSIEQFLERVA

SEQ ID NO: 151395 - protein, 84 aa, Glycine max
  Coding DNA Sequence Number=SeqID_34617
MSEKPKLEKVEGLCILKMRVRESFMHEEGCFPRSYVSSGAMRKSDLRSSLRTEGERVVMVLDLETIFSSLKGVESLRCWTLKRP

SEQ ID NO: 151396 - protein, 170 aa, Glycine max
  Coding DNA Sequence Number=SeqID_34618
MEDIPSSSTLAPPSVTVGQDVQGSQTLVPMLQSLFRGQFIIMHSLEELAHNRPIITMEHFLEQVAWLEAQLALVRPSEAAPPEPTPMQVDPKLAYPQSPVVNPLSFPEHEVVPPSLPLIIISDASLDEAATPPHSPAGKTADLPTSLVGGISDLSDSSSGEAVALTNSPV

SEQ ID NO: 151397 - protein, 240 aa, Glycine max
  Coding DNA Sequence Number=SeqID_34619
  Homolog annotation: Hit_ID=Q3KHQ5; Match level="QueryCoverage=27%, HitCoverage=17%, E-value=6e-24, Identity=82%"; Hit description =Alginate biosynthesis protein Alg44
DLPSQWLLFLSAVPPVQLLTGWCVTAKAPPDISAGKCSGRVPFAIQAAQLLGRAIGAGLFAITPAGERGMCCKAIKLGNARVFPVTTLNSMCLVHITDFQRLLGGIEGQAAGGEVDDPHFHGRAVGAEKAQLGRDFDPGVLALGFGFVDNVGVYLAVHSVLIPRLIQAWQGQTIKLIDTVDLEGGPVGKPVVPAALMNRPTRGERRFAYWALAECILAYYVGTDEGVSEVLHVAGEKRLH

SEQ ID NO: 151398 - protein, 146 aa, Glycine max
  Coding DNA Sequence Number=SeqID_34620
  Homolog annotation: Hit_ID=Q47522; Match level="QueryCoverage=34%, HitCoverage=62%, E-value=2e-21, Identity=92%"; Hit description=LacZ protein
RVPFGIQAAQLLGRTIGAGLFAITPAGERGMCCKAIKLGNARVFPVTTLANWSSTAVAAALELVDPPGCRNSMEALNELLTKEFRERFVGHGLGPVWSILTPGGQGSSQVSGSSHQAYRYRRPRGGARYQLLFPLVRVNFELGVIM

SEQ ID NO: 151399 - protein, 162 aa, Glycine max
  Coding DNA Sequence Number=SeqID_34621
MQWYIRQTRRYISREGTLCTEVYYPGHHQHQSYVEPSVPLVHVSGYMPPTSSITSTISINKLLWIHASRMSTKFDTTFNTLSSAYNLPLSNSCYRSLLSTQMHDMSHEDEEEDDDNNNTKNNDDDDDNGNNHLQIQCNKMRDFNAYLEELVVGHHLIIIIFC

SEQ ID NO: 151400 - protein, 743 aa, Glycine max
  Coding DNA Sequence Number=SeqID_34622
  Gene Ontology: Mol. function=protein kinase activity; Cellular component=integral to membrane; Biological process=protein amino acid phosphorylation
  Homolog annotation: Hit_ID=Q1S7R4; Match level="QueryCoverage=98%, HitCoverage=99%, E-value=0.0, Identity=56%"; Hit description=Protein kinase
  Pfam annotation: Domain name=LRR_1; Domain location=108-130; Score =2.0; E_value=1.2e+02; Accession=PF00560.23; Description=Leucine Rich Repeat
  Pfam annotation: Domain name=LRR_1; Domain location=132-154; Score =7.6; E_value=11; Accession=PF00560.23; Description=Leucine Rich Repeat
  Pfam annotation: Domain name=LRR_1; Domain location=156-177; Score =13.2; E_value=0.94; Accession=PF00560.23; Description=Leucine Rich Repeat
  Pfam annotation: Domain name=LRR_1; Domain location=179-198; Score =10.3; E_value=3.4; Accession=PF00560.23; Description=Leucine Rich Repeat
  Pfam annotation: Domain name=LRR_1; Domain location=200-222; Score =6.9; E_value=15; Accession=PF00560.23; Description=Leucine Rich Repeat
  Pfam annotation: Domain name=LRR_1; Domain location=224-246; Score =7.9; E_value=9.6; Accession=PF00560.23; Description=Leucine Rich Repeat
  Pfam annotation: Domain name=LRR_1; Domain location=248-270; Score =9.5; E_value=4.7; Accession=PF00560.23; Description=Leucine Rich Repeat
  Pfam annotation: Domain name=LRR_1; Domain location=272-293; Score =10.1; E_value=3.8; Accession=PF00560.23; Description=Leucine Rich Repeat
  Pfam annotation: Domain name=Pkinase; Domain location=437-723; Score=- 42.3; E_value=4.8e-06; Accession=PF00069.15; Description=Protein kinase domain
  Pfam annotation: Domain name=Pkinase_Tyr; Domain location=437-723; Score=-105.7; E_value=5.5e-06; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::Pkinase::Pkinase_Tyr; Domain location= 108-130::132-154::156-177::179-198::200-222::224-246::248-270::272 -293::437-723::437-723
MKNFLVSLYYLFPAIIAIILVLLTPIPSAQLTTSENRILLQVQKLLEYPQALQGWTNLTNFCSLPPPLSIVCFNGHVTELTVVGNSSWTLSERFSIESFFTVLTKLSNMKVLSLVSLGLWGPLPSKIDRFWSLEVMNFSSNFIYGEISPSVSSLKNLKSLVLANNLFNGSVPDLGKLASLEELNLSGNKLGPEFPSLSKNLVRVILRNNSLRCRIPPQLIHVYKLELFDISSNVIFGNIPSFIFSLPSLKYLNLASNQLSGYLSLNVSCSSSLTFVDISHNLLVGTLPSCIGSNASNRTTLYYGNCLVTRSLLSDQYPSSYCQKVESLAAVKPSIKSQKREPEMELGQIIGIVGGVVGIAGLMVLLIWCIFRKSKLEKADSNYSIGISAPNNFSIRAYSRPNINARRPPLPMRQPVLGFPPYCIFSIEEIEDATNNFDPSNLIAEGSQEQLYKGWLIDGSMVMVNRNKLKQKSLHKNSIQSLKVLPYLRHRHLVSVLGHCVITHHDHPQMISTIFIVFEHVSNVSLRDYLADRRKREMLKWPQRMAISIGIARGIQFLHTRVHPGIFGNNIKIENILLDDCLNAKVSGYSIPWPSKKGHDSKLYDQRALNQIGSINDAEKEDIYQFGVILLEVITGKLITSSSEVEELKNDLERGLAEASSPSLKGATPSLKGTSPILKGMSDSSLRDTCVHESLKTTVQITISCLSKVSSNRPSIEDILWNLQYSMQVQEPRTSGVHFFTDM

SEQ ID NO: 151401 - protein, 358 aa, Glycine max
  Coding DNA Sequence Number=SeqID_34623
  Gene Ontology: Mol. function=binding; Cellular component =mitochondrial inner membrane; Biological process=protein amino acid phosphorylation
  Homolog annotation: Hit_ID=Q1S7R2; Match level="QueryCoverage=99%, HitCoverage=80%, E-value=1e-127, Identity=40%"; Hit description =Tetratricopeptide-like helical
  Pfam annotation: Domain name=PPR; Domain location=106-140; Score =19.5; E_value=0.012; Accession=PF01535.11; Description=PPR repeat
  Pfam annotation: Domain name=PPR; Domain location=213-247; Score =38.3; E_value=2.7e-08; Accession=PF01535.11; Description=PPR repeat
  Pfam annotation: Domain name=PPR; Domain location=248-282; Score =41.1; E_value=3.7e-09; Accession=PF01535.11; Description=PPR repeat
  Pfam annotation: Domain name=PPR; Domain location=283-317; Score=0.5; E_value=6.6; Accession=PF01535.11; Description=PPR repeat
  Pfam annotation: Domain name=PPR; Domain location=7-41; Score=13.7; E_ value=0.18; Accession=PF01535.11; Description=PPR repeat
  Pfam module annotation: Pfam domain module=PPR::PPR::PPR::PPR::PPR; Domain location=106-140::213-247::248-282::283-317::7-41
  Subcellular localization annotation: CTP_CleavageSite=45; ConfidenceScore=5.35e-01
MPQPNVASLNAALSGFSRNGRRGEALRVFRRAGLGPLRPNSVTIACMLGVPRVGANHVEMMHCCAVKLGVEFDAYVATSLVTAYCKCGEVVSASKVFEELPVKSVVSYNAFVSGLLQNGVPRLVLDVFKEMMRGEECVECKLNSVTLVSVLSACGSLQSIRFGRQVHGVVVKLEAGDGVMVMTALVDMYSKCGFWRSAFEVFTGVEGNRRNLITWNSMIAGMMLNKESERAVDMFQRLESEGLKPDSATWNSMISGFAQLGECGEAFKYFGQMQSVGVAPCLKIVTSLLSACADSSMLQHGKEIHGLSLRTDINRDDFLVTALVDMYMKCGLASWARGVFDQYDAKPDDPALWNAMIG

SEQ ID NO: 151402 - protein, 53 aa, Glycine max
  Coding DNA Sequence Number=SeqID_34624
MTVPKQSLNPHSPETPWLMSEMRRGEVSTKQSLVPLVLIEIKKDNQEKVKKVS

SEQ ID NO: 151403 - protein, 61 aa, Glycine max
  Coding DNA Sequence Number=SeqID_34625
MDLMFGYRRFWCLFCSLGRSKCPRKSLVRIEIVMGGFKVVIMAADENGSRSPGVGAVMMYI

SEQ ID NO: 151404 - protein, 60 aa, Glycine max
  Coding DNA Sequence Number=SeqID_34626
MARVGGVGGSEGGGSIRVGMETGFEEMGMEGLGVGRGTEGVGRTRMEVGEEGECFSVEAI

SEQ ID NO: 151405 - protein, 615 aa, Glycine max
  Coding DNA Sequence Number=SeqID_34627
  Homolog annotation: Hit_ID=Q1S7R7; Match level="QueryCoverage=93%, HitCoverage=100%, E-value=1e-122, Identity=47%"; Hit description=IQ calmodulin-binding region
  Pfam annotation: Domain name=IQ; Domain location=116-136; Score=26.3; E_value=0.00011; Accession=PF00612.17; Description=IQ calmodulin -binding motif
  Pfam annotation: Domain name=IQ; Domain location=138-158; Score=23.3; E_value=0.00087; Accession=PF00612.17; Description=IQ calmodulin -binding motif
  Pfam annotation: Domain name=IQ; Domain location=164-184; Score=10.0; E_value=3.6; Accession=PF00612.17; Description=IQ calmodulin-binding motif
  Pfam module annotation: Pfam domain module=IQ::IQ::IQ; Domain location=116-136::138-158::164-184
  Subcellular localization annotation: CTP_CleavageSite=43; ConfidenceScore=5.06e-01
MGKGRSPGKWFKNLLLGKKSSSKSTSSKKNDIFKPSIDKDLLVSSEVPVPDPTMDSLQISTPISGANDYKGVFSEKEVVSRSSHDRDVLSTRVKEAKVQDVANFGSQENLEKLQLTEATIKVQAACRSYLARRTLQKLKGVIQLQAFIRGHLVRRHAVSALYCVKGIVKFQALARGYNVRCSDIGLAVQKIRKDTHCSNSVRVVSSTQAEKLSENVFVCKLLASSPYAVPLSLNSDPGEPNMGQKWLDYWTRSHFWASLPEFKKKLESVSDEKNGTSQTVQKGQVKKITRKSPTVKADNVSNLGSNKSKQHLKKDSSHPLPSAQENPPKETEKSSFGKTHAHNASNGSEVVNEKRKSGNKKILDHAVIDVSEQGPNASSAKEKDSTVPKSKESDPEKGHGQQTKDKNDNEPHNDPIAVSKTSVKKGGNEGIQVVSENLNGGDNCISNNSQRRASLPANINEQENELYNTPVTPRLPSYMAPTESAKARLRGQGSPRFTTDLVDKNSATRRHSLSSSLNGKSGSFSPRAEKLIGVSSRGGIRSDRSLSSSRDGTGMLLEYNTVNMHRDKEVDPTSVEKVILPYFSRQGYLKKMILKNCSINITLTKSTCGGIHAAR

SEQ ID NO: 151406 - protein, 131 aa, Glycine max
  Coding DNA Sequence Number=SeqID_34628
  Gene Ontology: Mol. function=RNA-directed DNA polymerase activity; Biological process=RNA-dependent DNA replication
  Homolog annotation: Hit_ID=Q2HS45; Match level="QueryCoverage=50%, HitCoverage=10%, E-value=4e-09, Identity=51%"; Hit description=RNA -directed DNA polymerase
MLKRRLRDDEREVVVVRKILYDYAEASGQYINQQKFEVTFSRNVNQGLKNDVRMTEGNGGGKYLGFLSFVGMSKKAIFNFIKNKDLKVGVLMDKEALCWNYTLLTQIFEVQDVEAILRTPLLNVDQQDTKI

SEQ ID NO: 151407 - protein, 120 aa, Glycine max
  Coding DNA Sequence Number=SeqID_34629
  Gene Ontology: Mol. function=transferase activity; Cellular component= mitochondrial inner membrane; Biological process=protein amino acid phosphorylation
  Homolog annotation: Hit_ID=Q1S7R2; Match level="QueryCoverage=95%, HitCoverage=18%, E-value=4e-51, Identity=82%"; Hit description =Tetratricopeptide-like helical
MMRIEYGLQPKPEHFGCIVDLLGRSGRLSEAQDLMEELAEPPASVFASLLGACRCYLDSNLGEEMAKKLLDVEPENPAPLVVLSNIYAGLGRWKEVERIRGVITDKGLDKLSGFSMIELA

SEQ ID NO: 151408 - protein, 480 aa, Glycine max
  Coding DNA Sequence Number=SeqID_34630
  Gene Ontology: Mol. function=sequence-specific DNA binding; Cellular component=nucleus; Biological process=regulation of transcription
  Homolog annotation: Hit_ID=Q1T4J9; Match level="QueryCoverage=92%, HitCoverage=74%, E-value=1e-60, Identity=34%"; Hit description=DNA -binding WRKY
  Pfam annotation: Domain name=WRKY; Domain location=163-223; Score =141.6; E_value=2.2e-39; Accession=PF03106.6; Description=WRKY DNA -binding domain
MGEAREENKMLEFFEILQQDKPEDATNAKGVFSHDEENEESELVSLSLGISISKGKPTKDEKILKNKNGIEKTEDEDVHNKRLVLGLDINLDPVDQDELTANNSTTESSFVGERGKEEEPTEMWPPSKVLKTMKSVDKSEVSQHDQPKKTRVSIRARCDTQTMNDGCHWRKYGQKMAKGNPCPRAYYRCTASPSCPVRKQVQRCAEDMSILITTYEGTHNHPLPMSATAMACTTSAAASMLQSPSLSSQHGLVDSAISSIINSSAPYYNPNNALNFSTHQVSRPQQFYFPNSSISTLNSHPTITLDLTTPPTSSSNSSFTCMPKYSSTNLNFSSGFSPLHSSMPQSPWNSYSGYFNSGTLSQNRHHGGNYMLNTGNQNQPHSLGHLHQPIYMSNNSTISQHSFPNPIVAATEAIITSNPKFQSALATALTAYVGNEASGGRLRENHVLENAELMNLKLLRSENSIGNSSIFPLPLPEQWK

SEQ ID NO: 151409 - protein, 447 aa, Glycine max
  Coding DNA Sequence Number=SeqID_34631
  Gene Ontology: Mol. function=nucleotide binding; Biological process =fatty acid biosynthetic process
  Homolog annotation: Hit_ID=Q1S7R1; Match level="QueryCoverage=99%, HitCoverage=98%, E-value=1e-180, Identity=72%"; Hit description=CBS
  Pfam annotation: Domain name=CBS; Domain location=292-426; Score =89.8; E_value=8.4e-24; Accession=PF00571.18; Description=CBS domain
  Pfam annotation: Domain name=CBS; Domain location=51-265; Score=38.3; E_value=2.7e-08; Accession=PF00571.18; Description=CBS domain
  Pfam module annotation: Pfam domain module=CBS::CBS; Domain location =292-426::51-265
MAQEQEYRTSTTLPKCDTYFETIQSRKKLPLSLQETLTDAFAKIPVSSFPAVPSGKVIEILADTPIGEAVKILSESNILSAPVKDPEAANSSDWRRRYLGIIDYSAIILWVLEGAELAHKALLVGTATAAGVGAGAAGAMGALALGVTGPAAIAGLTAAAAGAALAGGIAADRVVAKDAPQAADNLGEDFYKIILEEEPFKSTTVRSIIKSYRWAPFVPVARNSAMLTVLLLLSKYRLRNVPVIETGKPDIVNFITQSAVVQGLEGCKGRDWFDCIAEKRIADLGLPFMSTDEARIGVISIQSNELILEAFKQMRDNKIGGLPIVEGPKKRIVGNLSIRDIRHLLLRPELFTNFRKLTVMNFMNKIVSSSLQTGKVTQSITCKPDSTLQGVIHTLASQSIHRIYVVDGQDEVVGVITLRDVISCFVTEPPYNFDDYYGFAVKEMLNQ

SEQ ID NO: 151410 - protein, 303 aa, Glycine max
  Coding DNA Sequence Number=SeqID_34632
  Gene Ontology: Mol. function=protein phosphatase type 2C activity; Cellular component=protein serine/threonine phosphatase complex; Biological process=protein amino acid dephosphorylation
  Homolog annotation: Hit_ID=O82479; Match level="QueryCoverage=94%, HitCoverage=93%, E-value=1e-105, Identity=67%"; Hit description =Protein phosphatase-2c
  Pfam annotation: Domain name=PP2C; Domain location=1-250; Score=73.7; E_value=5.9e-19; Accession=PF00481.12; Description=Protein phosphatase 2C
MVHGVGVYDGHGGSEASQFVSDNLFCNLKRLAAEHQGVSEHVIKRAYSATEESFLSLVKKQWLSKPQIASTGTCCLVGVICNGMIYVANSGDSRVVLGRLERATRETEAIQLSTEHNVNQESVRDELRSKHPFDSQIVVLRQNVWRVKGLIQVSRSIGDAYLKKAEFNRDPLPAKYRLAETFFRPILSCEPSTSSHTLHPDDQFLIFASDGLWEHLTNQEAVNIVSNNPPNGIARRLVKAALREAAKKCEMRLSDLQKIEQGMRRHIHDDITVIVVFLNPKLTENTSLCGSPLSIKGGGSTNS

SEQ ID NO: 151411 - protein, 54 aa, Glycine max
  Coding DNA Sequence Number=SeqID_34633
MVRVRVSNVVVLGGQGGRGHHRDKEGELRGEGCGVGESQGLAMAEDAREGRGGA

SEQ ID NO: 151412 - protein, 71 aa, Glycine max
  Coding DNA Sequence Number=SeqID_34634
  Gene Ontology: Mol. function=DNA binding; Cellular component=plastid chromosome
DSNFRKQPLCICKGKAAYNIPPPYLRIAKSLWCIMPYLLGWNAFGNSIKPEVYSQVNSTNPRYGADNEWNR

SEQ ID NO: 151413 - protein, 623 aa, Glycine max
  Coding DNA Sequence Number=SeqID_34635
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=99%, HitCoverage=66%, E-value=1e-171, Identity=51%"; Hit description =Plastid alpha-amylase
  Subcellular localization annotation: CTP_CleavageSite=58; ConfidenceScore=5.01e-01
MSTVALETLFPLCRRKPSFHRHKPIPLRPFFVTCSSNLNDDASFIFHQQPRKTLSPVHAVSHTDTSVLHSLQCPHTITNTFLINTTETVEGKIFVRLDHGKGLRDRELTVGCNLPGKWILHWGVTYVDDVGREWDQPPRDMIPPGSILIKDYAIETPLKESSLSAEGDTLHEIRIDLKANNGIAAINFVLKDEETEAWYKNKRRDFKVSLVNNLKEDNSIIGPKWGFDLWPGNLGQISKMFLQSEEADQDDSSESRVPEQDNNQPESFCEEVPITKKVLVQNSISVSTTKCHESGAVKELLLLETDLPGDVVLHWGVCRDDSRKWEVPPRPHPPGTVAFKERALRTQFRPRDDGKGSLALITLEEEFSGFMFVLKQNENTWFKYNGHDFYIPLSSSSSFLNSGNKEGQSEGMQREVTQEASQKSSFFAFTDTITNEIRNLVTDNSSEKIQRTKSKMAQRSIFQEIERLAAEAYNIFRISIPTFSEETAAEPEVTIVEPETSIVEPQATTIVIPETSVESETQSLDPKICSGTGTGYEILCQAFNWESHKSGRWYIELKEMASELASLGFTVVWLPPPTESVSPEGYMPKDLYNLNSRYGNIDELKDLVKRFHEVGIKVLGDAV

SEQ ID NO: 151414 - protein, 55 aa, Glycine max
  Coding DNA Sequence Number=SeqID_34636
MSGSPLNCCTAMKKPSLPPPALMYWHKNGLHQILICELNQTGSTEYPNNFKMAGK

SEQ ID NO: 151415 - protein, 178 aa, Glycine max
  Coding DNA Sequence Number=SeqID_34637
MAYTILIVMFVAAAIVSSWTLYILLSSPSIIRHILNTFSLFPILPLHCGFRERSPSLRSQVPIPFFLHTSYSIPLLKPLIFNGSSNLTIPSFHFDDNPLCKTKIKNQRKLFWIIITDNDASDEEQNNPTKTPRVKREITHKKIVIVLCRWSGAFKVSKEGYVVLQFAPSVGADELIYD

SEQ ID NO: 151416 - protein, 84 aa, Glycine max
  Coding DNA Sequence Number=SeqID_34638
MLDQFHPCIQDSIENIIDVKADGNCGYRAIAALLGMSKESWSLVRNHLHKELTSLLEEYINLLGDIKRFEELKRSLLVDGLSMV

SEQ ID NO: 151417 - protein, 105 aa, Glycine max
  Coding DNA Sequence Number=SeqID_34639
  Subcellular localization annotation: CTP_CleavageSite=40; ConfidenceScore=5.13e-01
MYPPLELIHKRSTLSCSQSTTQVDVPSTCTTKDVPSNVLRQSSQAGKGRIKRILKLCHFEFFDKGEGRHKRIQAVSPSFFWKREKRDTKGIQAVSLWRILFGRRE

SEQ ID NO: 151418 - protein, 158 aa, Glycine max
  Coding DNA Sequence Number=SeqID_34640
MASFSQMQSQMQSQGLALPPEPMVGPSSPCVSIKESFVDPSGNDPETGDSDKCGLYIEANPPRLVALGRVYEGSIVHNVPLLSGQVKVGVEEAKDAQAPVPVPTDEAAVSPAKPPQRSDLEVDDPLYLMTLTIRELFLKPFQVNWDATMFGVFNPDFL

SEQ ID NO: 151419 - protein, 102 aa, Glycine max
  Coding DNA Sequence Number=SeqID_34641
MAEASPSRKSKPQMMESDMEVAQHLIQLSEDSSSDDIAGKRNTSCDGEEVHQRLSDDISVEKKIRELFGDDEVSQPKKKKRRRRYRSLVNIYMATASISMLQ

SEQ ID NO: 151420 - protein, 197 aa, Glycine max
  Coding DNA Sequence Number=SeqID_34642
  Gene Ontology: Mol. function=protein serine/threonine kinase activity; Biological process=protein amino acid phosphorylation
  Homolog annotation: Hit_ID=Q1SJB2; Match level="QueryCoverage=91%, HitCoverage=28%, E-value=1e-28, Identity=47%"; Hit description =Serine/threonine protein kinase, active site
MNLAKVFLKFFKCSPLACDPSALPVIPKDEDERLQTKRGKRQRVSKREQSSQTSRSDASQSEKNQIAEQPREDTESSKENNMEQHKQGQETGHSASSTSSGSRLFMMTEGSMNASMSPVFLSSGSVRKSPKTEGHPNALKNIMNYSALLQQASIIDMINRNEGKEFPQLRKSFSALDFRLDSDKLLSNLYALHNKHI

SEQ ID NO: 151421 - protein, 76 aa, Glycine max
  Coding DNA Sequence Number=SeqID_34643
  Gene Ontology: Mol. function=protein serine/threonine kinase activity; Biological process=protein amino acid phosphorylation
  Homolog annotation: Hit_ID=Q1SJB2; Match level="QueryCoverage=97%, HitCoverage=12%, E-value=9e-20, Identity=62%"; Hit description =Serine/threonine protein kinase, active site
  Subcellular localization annotation: CTP_CleavageSite=33; ConfidenceScore=5.04e-01
MNVEQIHMIFKLCGSPSPDYFKKLKLTTSYRPTQHYKPSFHENFQKFPSSSLGLLATFLDLNPAHRGNAASALQSD

SEQ ID NO: 151422 - protein, 333 aa, Glycine max
  Coding DNA Sequence Number=SeqID_34644
  Gene Ontology: Mol. function=protein serine/threonine kinase activity; Cellular component=transcription elongation factor complex b; Biological process=protein amino acid phosphorylation
  Homolog annotation: Hit_ID=Q1SJB2; Match level="QueryCoverage=97%, HitCoverage=57%, E-value=1e-111, Identity=61%"; Hit description =Serine/threonine protein kinase, active site
  Pfam annotation: Domain name=Pkinase; Domain location=122-333; Score =216.2; E_value=7.6e-62; Accession=PF00069.15; Description=Protein kinase domain
  Pfam annotation: Domain name=Pkinase_Tyr; Domain location=122-333; Score=35.8; E_value=1.2e-14; Accession=PF07714.7; Description =Protein tyrosine kinase
  Pfam module annotation: Pfam domain module=Pkinase::Pkinase_Tyr; Domain location=122-333::122-333
  Subcellular localization annotation: CTP_CleavageSite=23; ConfidenceScore=5.17e-01
MGCVCGTFSPPREERPRPQVKRVASNKSSRTTRSSKHVGEGVNSKKEKTQRQRVSVNVNDGGVAEGEKAKPIAKENKSYKDRDAREEKMARYEFVEGWPKWLLDNIPANVLANIVPKSADSYEKLAKIGRGTYSNVYKAREKGTRKIVALKKVRFDTSDSESIKFMAREIMMLQMLDHPNVIKLKGLATSRMQYSLYLVFDFMQSDLTRIISRPGEKLTEAQIKCYMQQLLSGLQHCHEKGIMHRDIKASNLLIDRNGVLKIADFGLATSIEAEGPLTNRVVTLWYRAPELLLGSTDYGYSIDLWSAGCLLAEMFVGRPIMPGRTEVTVSLSI

SEQ ID NO: 151423 - protein, 295 aa, Glycine max
  Coding DNA Sequence Number=SeqID_34645
  Gene Ontology: Cellular component=integral to membrane; Biological process=response to nematode
  Homolog annotation: Hit_ID=Q2QXJ5; Match level="QueryCoverage=94%, HitCoverage=75%, E-value=2e-81, Identity=59%"; Hit description =Transporter, putative, expressed
  Pfam annotation: Domain name=TPT; Domain location=190-289; Score= -9.5; E_value=0.002; Accession=PF03151.7; Description=Triose -phosphate Transporter family
MSSVSKGDKKASIDAASWLFNVVTSVGIILVNKALMATYGFSFDCTTLVSWIKSLKMWIDCADYKNDLIIDWIYDVASTTLTGLHFATTTLLTLILKSLGYIQTSHLPVSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLIFCTLIIMELGAKFYCLNSVSGCLVTLRKNLLVD

SEQ ID NO: 151424 - protein, 1203 aa, Glycine max
  Coding DNA Sequence Number=SeqID_34646
  Gene Ontology: Mol. function=RNA-directed DNA polymerase activity; Cellular component=chromatin; Biological process=chromatin assembly or disassembly
  Pfam annotation: Domain name=Chromo; Domain location=1104-1152; Score= 22.7; E_value=0.0013; Accession=PF00385.14; Description='chromo' (CHRromatin Organisation MOdifier
  Pfam annotation: Domain name=RVP_2; Domain location=72-162; Score= -47.9; E_value=0.0054; Accession=PF08284.2; Description=Retroviral aspartyl protease
  Pfam annotation: Domain name=RnaseH; Domain location=546-667; Score= -28.5; E_value=0.026; Accession=PF00075.14; Description=RNase H
  Pfam annotation: Domain name=rve; Domain location=801-957; Score =110.1; E_value=6.2e-30; Accession=PF00665.16; Description=Integrase core domain
  Pfam annotation: Domain name=zf-H2C2; Domain location=742-783; Score =13.9; E_value=0.0051; Accession=PF09337.1; Description=His(2)-Cys(2) zinc finger
  Pfam module annotation: Pfam domain module=Chromo::RVP_2::RVT _1::RnaseH::rve::zf-H2C2; Domain location=1104-1152::72-162::288 -457::546-667::801-957::742-783
MAFRKERGLCYNCDDKWSSGHRCKGRILLFVADDVTQDSGEPGITNNTIDFDDNLSNPDPTSDSSSPHISLHAMAGSPSPETFRVYGTIRSARITVLIDSGNCDKRCPDTPLTIQGHSFPVTFHLLHISGADAVLGVDWLRQFGPVTTNYDDFVMRFTHQGQEISLQADVATKPEPASANQVKRMLHTGSTSTLFHLCILDSNPTDSTTNLLSPIIKPIAELLLRYDQLFQPPKHLPPSREVNHRIPLLPSTAPVNVRPYRYPHFQKAEIERQVAELLSNGLIRPSTSPYSSPVLLVKKKDGTWRLCVDYRSLNSVTVRDRFPIPTIEELLDELGHASWFTKLDLRQGFHQILMNEADIEKTAFRTHHGHYEYMVMPFGLCNAPSTFQAAMNHLLAPFLRRFAAVFFDDILVYSESLSSHVQHLDLIFQALLRGEFYLKRTKCFFAQRELEYLGHVVSGKGVTPEPSKVRAITQWPIPATARDLRAFLGLTGFYRKFVRNYATITAPLTSLLCKDAFEWTIESQEAFNKLKSAMSNTPVLALPDFSKPFVVETDASGTAMGAVLTQAGHPLAFFSKNFAPKLLTASTYVRELHAITSAVRKWRQNLLGSTFTILTDHKSLRELMTQVIQTPEQHYYLSKLLGFNYTIQYKTGASNVVADALSRRPPEPSQLLVLSVPNLDFLCDIQQTLAINPDFQALMSNVQTNPSAYPHYRVHNGCLLFNNRIWINNTNPHIPSLLSEFHSTPLGGHFGVTKTLRRLEASFFWQGMKADVQRFIKECTVCQQNKSSTRRPAGLLQPLPPPTGVWEDISMDFVTHLPPSNGFTVIFVVVDRFSKGVHLGALPTGFSAFKVAMLFIEIVCKLHGFPKSIVSDRDPVFLSTFWRELFRLSGTQLRLSTAYHPQSDGQTEVVNRVLEQYLRCFVNSQPSSWYRYLSLAEWCYNTSLHSTSGMTPFEVVYGKPPPSIPQYLPGLTRNEAVESLVESRQLMHAKLQKRLKKAQTTMKKYADMKRDDITFSVNQWVYVKLRPSRQRSVTGHIHPKLSKRYFGPFRISAKVGNVAYRLELPPESRIHPVFHSSLLRLHHGPPPSSSEPWNLEIVGQKPLQRPLCILDSKLDTSTTPPTRLVLTQWVGQPPEDTTWEPWLELRDAYHLEDKVVSRDGSIVSTQDNEGTHSSTMTGNGPDNATTRPIRTVTKPIYLQDYVN

SEQ ID NO: 151425 - protein, 228 aa, Glycine max
  Coding DNA Sequence Number=SeqID_34647
  Gene Ontology: Mol. function=RNA-directed DNA polymerase activity; Cellular component=chromatin; Biological process=chromatin assembly or disassembly
MAEHGTRKATTDRLEDAIARLTSSQANLNERYTDLSGKVDSILDHLRLRDLQQHPPSVSNMSAHRNSVKLDIPRFDGRDPLGWIFKMNQLFQYQNTPEEERITVASLYLDGAALSWYQWMFTNGLISSWQSFLDALESRFAPTFYDDPRGALFKLVQRGSVNDYLTEFERLANRVTGLPPPFLLSCFISGLNPELRREVLALQPISLLLATALAKLQEDKLKDRRSLS

SEQ ID NO: 151426 - protein, 1187 aa, Glycine max
  Coding DNA Sequence Number=SeqID_34648
  Gene Ontology: Mol. function=protein serine/threonine kinase activity; Cellular component=integral to membrane; Biological process=protein amino acid phosphorylation
  Homolog annotation: Hit_ID=Q76FZ8; Match level="QueryCoverage=95%, HitCoverage=94%, E-value=0.0, Identity=73%"; Hit description =Brassinosteroid receptor
  Pfam annotation: Domain name=LRRNT_2; Domain location=25-63; Score =32.7; E_value=1.3e-06; Accession=PF08263.3; Description=Leucine rich repeat N-terminal domain
  Pfam annotation: Domain name=LRR_1; Domain location=121-142; Score =9.6; E_value=4.5; Accession=PF00560.23; Description=Leucine Rich Repeat
  Pfam annotation: Domain name=LRR_1; Domain location=147-171; Score =14.1; E_value=0.5; Accession=PF00560.23; Description=Leucine Rich Repeat
  Pfam annotation: Domain name=LRR_1; Domain location=216-237; Score =13.8; E_value=0.61; Accession=PF00560.23; Description=Leucine Rich Repeat
  Pfam annotation: Domain name=LRR_1; Domain location=239-261; Score =10.1; E_value=3.6; Accession=PF00560.23; Description=Leucine Rich Repeat
  Pfam annotation: Domain name=LRR_1; Domain location=263-284; Score =8.7; E_value=6.8; Accession=PF00560.23; Description=Leucine Rich Repeat
  Pfam annotation: Domain name=LRR_1; Domain location=285-307; Score =8.1; E_value=8.6; Accession=PF00560.23; Description=Leucine Rich Repeat
  Pfam annotation: Domain name=LRR_1; Domain location=310-332; Score =13.6; E_value=0.74; Accession=PF00560.23; Description=Leucine Rich Repeat
  Pfam annotation: Domain name=LRR_1; Domain location=334-357; Score =12.4; E_value=1.4; Accession=PF00560.23; Description=Leucine Rich Repeat
  Pfam annotation: Domain name=LRR_1; Domain location=359-381; Score =6.5; E_value=17; Accession=PF00560.23; Description=Leucine Rich Repeat
  Pfam annotation: Domain name=LRR_1; Domain location=383-402; Score =14.0; E_value=0.55; Accession=PF00560.23; Description=Leucine Rich Repeat
  Pfam annotation: Domain name=LRR_1; Domain location=413-435; Score =19.5; E_value=0.012; Accession=PF00560.23; Description=Leucine Rich Repeat
  Pfam annotation: Domain name=LRR_1; Domain location=437-459; Score =18.1; E_value=0.032; Accession=PF00560.23; Description=Leucine Rich Repeat
  Pfam annotation: Domain name=LRR_1; Domain location=461-483; Score =2.8; E_value=86; Accession=PF00560.23; Description=Leucine Rich Repeat
  Pfam annotation: Domain name=LRR_1; Domain location=485-507; Score =14.6; E_value=0.35; Accession=PF00560.23; Description=Leucine Rich Repeat
  Pfam annotation: Domain name=LRR_1; Domain location=509-531; Score =16.8; E_value=0.076; Accession=PF00560.23; Description=Leucine Rich Repeat
  Pfam annotation: Domain name=LRR_1; Domain location=533-555; Score =16.4; E_value=0.1; Accession=PF00560.23; Description=Leucine Rich Repeat
  Pfam annotation: Domain name=LRR_1; Domain location=557-580; Score =13.2; E_value=0.95; Accession=PF00560.23; Description=Leucine Rich Repeat
  Pfam annotation: Domain name=LRR_1; Domain location=649-671; Score =13.4; E_value=0.85; Accession=PF00560.23; Description=Leucine Rich Repeat
  Pfam annotation: Domain name=LRR_1; Domain location=66-91; Score=2.0; E_value=1.2e+02; Accession=PF00560.23; Description=Leucine Rich Repeat
  Pfam annotation: Domain name=LRR_1; Domain location=673-695; Score =13.5; E_value=0.75; Accession=PF00560.23; Description=Leucine Rich Repeat
  Pfam annotation: Domain name=LRR_1; Domain location=697-719; Score =19.3; E_value=0.014; Accession=PF00560.23; Description=Leucine Rich Repeat
  Pfam annotation: Domain name=LRR_1; Domain location=721-742; Score =10.9; E_value=2.6; Accession=PF00560.23; Description=Leucine Rich Repeat
  Pfam annotation: Domain name=LRR_1; Domain location=93-116; Score =7.5; E_value=11; Accession=PF00560.23; Description=Leucine Rich Repeat
  Pfam annotation: Domain name=Pkinase; Domain location=874-1146; Score= 159.7; E_value=7.8e-45; Accession=PF00069.15; Description=Protein kinase domain
  Pfam annotation: Domain name=Pkinase_Tyr; Domain location=874-1146; Score=131.5; E_value=2.4e-36; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=25-63::121-142::147-171::216-237::239-261::263 -284::285-307::310-332::334-357::359-381::383-402::413-435::437 -459::461-483::485-507::...
  Pfam module annotation: Domain location=509-531::533-555::557 -580::649-671::66-91::673-695::697-719::721-742::93-116::874 -1146::874-1146
  Subcellular localization annotation: CTP_CleavageSite=63; ConfidenceScore=5.48e-01
MKALYRSSLLLLLLLFISVCFASSSSPVTQQLLSFKNSLPNPSLLPNWLPNQSPCTFSGISCNDTELTSIDLSSVPLSTNLTVIASFLLSLDHLQSLSLKSTNLSGPAAMPPLSHSQCSSSLTSLDLSQNSLSASLNDMSFLASCSNLQSLNLSSNLLQFGPPPHWKLHHLRFADFSYNKISGPGVVSWLLNPVIELLSLKGNKVTGETDFSGSISLQYLDLSSNNFSVTLPTFGECSSLEYLDLSANKYLGDIARTLSPCKSLVYLNVSSNQFSGPVPSLPSGSLQFVYLAANHFHGQIPLSLADLCSTLLQLDLSSNNLTGALPGAFGACTSLQSLDISSNLFAGALPMSVLTQMTSLKELAVAFNGFLGALPESLSKLSALELLDLSSNNFSGSIPASLCGGGDAGINNNLKELYLQNNRFTGFIPPTLSNCSNLVALDLSFNFLTGTIPPSLGSLSNLKDFIIWLNQLHGEIPQELMYLKSLENLILDFNDLTGNIPSGLVNCTKLNWISLSNNRLSGEIPPWIGKLSNLAILKLSNNSFSGRIPPELGDCTSLIWLDLNTNMLTGPIPPELFKQSGKIAVNFISGKTYVYIKNDGSKECHGAGNLLEFAGISQQQLNRISTRNPCNFTRVYGGKLQPTFNHNGSMIFLDISHNMLSGSIPKEIGAMYYLYILNLGHNNVSGSIPQELGKMKNLNILDLSNNRLEGQIPQSLTGLSLLTEIDLSNNLLTGTIPESGQFDTFPAAKFQNNSGLCGVPLGPCGSEPANNGNAQHMKSHRRQASLAGSVAMGLLFSLFCVFGLIIIAIETRKRRKKKEAALEAYGDGNSHSGPANVSWKHTSTREALSINLATFEKPLRKLTFADLLDATNGFHNDSLIGSGGFGDVYKAQLKDGSVVAIKKLIHVSGQGDREFTAEMETIGKIKHRNLVPLLGYCKVGEERLLVYEYMKYGSLEDVLHDQKKAGIKLNWAIRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDIFDPELMKEDPNLEMELLQHLKIAVSCLDDRPWRRPTMIQVMAMFKEIQAGSGIDSQSTIANDEEGFNAVEMVEMSIKEAPELSKH

SEQ ID NO: 151427 - protein, 98 aa, Glycine max
  Coding DNA Sequence Number=SeqID_34649
MAAGPERLVDFKESDWRWSRLRRKLAMTVRLVLRGTELRSMDVSSVSLQLMPLNVHGLWLGSQLGSRDGFGREFLKLRTDMETDKIKGEFVVVSLRGS

SEQ ID NO: 151428 - protein, 144 aa, Glycine max
  Coding DNA Sequence Number=SeqID_34650
  Gene Ontology: Mol. function=nucleic acid binding
  Homolog annotation: Hit_ID=Q1SR99; Match level="QueryCoverage=80%, HitCoverage=45%, E-value=1e-10, Identity=38%"; Hit description=Alba, DNA binding
MITITLSKKELGYVIHRLFDDLYQPPLPVDQVKPLNEYDEEGEGSPRIRGRGRGRGRGRGRGFYNGGMEYGDGWDGGRGYGGRGRGRARGHAFRGRGRGRGYGVQPVGYYDYGEYDAPPPPRGRGRGRGRGRGRGRGRDQVPAA

SEQ ID NO: 151429 - protein, 176 aa, Glycine max
  Coding DNA Sequence Number=SeqID_34651
  Gene Ontology: Mol. function=nucleic acid binding; Biological process= proteolysis
  Homolog annotation: Hit_ID=Q1SR99; Match level="QueryCoverage=72%, HitCoverage=40%, E-value=1e-40, Identity=69%"; Hit description=Alba, DNA binding
  Pfam annotation: Domain name=Alba; Domain location=51-152; Score =75.5; E_value=1.7e-19; Accession=PF01918.11; Description=Alba
MKIYYSTQRVQKQTQQLRPLSLSHPYPQNLPLSSMDRYQRVEKPKAESPINENEIRVTSQGRTRNYITYATTLLQVQEMIPTVTTVEKEQQQKIKRELTPVVANGLEKGSSEIVLKAMGRAINKTVMIAELIKRRIVGLHQNTQIGSTDITDTWEPLEEGLLPYGFLFLLCNLIKY

SEQ ID NO: 151430 - protein, 139 aa, Glycine max
  Coding DNA Sequence Number=SeqID_34652
ETHVGRVKENREGGGVDLNLGTPEPVLSDKPPPPPCGGLLLSVGEARRSEKEVVMKGCVEKVKLVKEFALAEVSKLPEEDAMRGALVSIGGRYFWEGKKRKGEARGFDWMAARLALRFASMFVFLTAAAGCSLESAANG

SEQ ID NO: 151431 - protein, 47 aa, Glycine max
  Coding DNA Sequence Number=SeqID_34653
MVVVNSLLPLGESWAIIRRLHFQRGNSGKGEKNEEIRNEYGILGKKD

SEQ ID NO: 151432 - protein, 55 aa, Glycine max
  Coding DNA Sequence Number=SeqID_34654
METIIQNPQLNYAKFYAVTELIPQPQPSSPQPSCPQLQLPPPKQLPYNNIDLNNP

SEQ ID NO: 151433 - protein, 261 aa, Glycine max
  Coding DNA Sequence Number=SeqID_34655
  Gene Ontology: Mol. function=transporter activity; Cellular component= coated vesicle membrane; Biological process=intracellular protein transport
  Homolog annotation: Hit_ID=Q9SB50; Match level="QueryCoverage=90%, HitCoverage=41%, E-value=6e-73, Identity=63%"; Hit description =Clathrin coat assembly like protein
MVGTFTIRLSDYCYFIVLITDRGEVQKGSAEIFFRKVKFWEDGGLQEAPPVFVGIIFLNQAEHIIMCFKLERNVDGVNYFHVKVVGLLFVATTRVNTSPSFVLELLQRIARVIKDYLGILNEDSLRKNFVLVYELLDEVILILVAADRLNRYVYNIFRVVYKKKYKPPKVLDFGYVQTTSTELLKSYVFNEPLVIDAAHLSPLGPAAIFTQGTKRMPGIAVTKSVVATEPGGRKREEIFVDIIEKISITFSSSVSKYILKY

SEQ ID NO: 151434 - protein, 81 aa, Glycine max
  Coding DNA Sequence Number=SeqID_34656
  Gene Ontology: Mol. function=nucleic acid binding; Biological process= DNA integration
TLGSLMYAQVCTRLDIAFIVVVLGRYQSNPGSDHWITAKKVMRYLQKTKKYMLMYSRVDNLEVVGYTNLDLGGCPDDKIDF

SEQ ID NO: 151435 - protein, 260 aa, Glycine max
  Coding DNA Sequence Number=SeqID_34657
  Gene Ontology: Mol. function=protein binding; Cellular component =protein complex; Biological process=proteolysis
  Homolog annotation: Hit_ID=Q1SS00; Match level="QueryCoverage=84%, HitCoverage=48%, E-value=9e-94, Identity=81%"; Hit description=IMP dehydrogenase/GMP reductase
MVNVAGDGFGCQMIFLGEKNKKGDRNWAKNPNDKNRPSRENAGNLEAAIEQLLNAEKQARLAGDVAATRNAVTEILRMCFEARAWKTLNDQIVLLSKRRGQLKQAVTAMVQQAMQYIDETPDLETRIELIKILNSVSAGKIYVEIERARLIKKLAKIKEEQGLIAEAADLMQEIAVETFGAMAKTEKIAFILEQVRLCLDRQDYVRAQILSRKISTRVFDADVSKEKKKPKEGDNVVEEAPVDIPSLPELKRIYYELMIR

SEQ ID NO: 151436 - protein, 257 aa, Glycine max
  Coding DNA Sequence Number=SeqID_34658
  Gene Ontology: Mol. function=transcription factor activity; Cellular component=nucleus; Biological process=regulation of transcription, DNA-dependent
  Homolog annotation: Hit_ID=Q1SRZ9; Match level="QueryCoverage=66%, HitCoverage=67%, E-value=3e-14, Identity=31%"; Hit description =Pathogenesis-related transcriptional factor and ERF
  Pfam annotation: Domain name=AP2; Domain location=133-173; Score =37.1; E_value=3.7e-08; Accession=PF00847.10; Description=AP2 domain
MMNNPALLSRLFPGINREREMSAMVSALTHVVSGEVPTGDSSSVLHHQPHDDDAVTVKPNMPSTTPFSSTYVVATSSLKRSRQHDTYTPSFSHPPSSFPAMPTSAECSKSGMGNAVYEYRTRGTENVKKEEGRRKYRGETFETAEAAARAYDEAALRFRGSKAKLNFPENVTLRQPQFTVSTSTDPFQLSGTNLYDHRMFLTSNTMASHHLQSSLPLPPATSSSLTSPPQNITSLSSLYSAQLPPWSASGHSSSSSP

SEQ ID NO: 151437 - protein, 53 aa, Glycine max
  Coding DNA Sequence Number=SeqID_34659
MASSQNKRILFVAFVILCLFSSPTIAARTLKEKSNLTSGDVNTVQHNKEAIAK

SEQ ID NO: 151438 - protein, 111 aa, Glycine max
  Coding DNA Sequence Number=SeqID_34660
  Subcellular localization annotation: CTP_CleavageSite=66; ConfidenceScore=5.10e-01
MEKSESFSSYCSSSYHDFRAGLEDQFTSYSFNSGPRSSKRDVLAPNGNPELKRRKRVASYNMYTMEAKLKSSFRSFKWIKNKLCRRLIPLLCVEEACDNKRIVVLPKNNCA

SEQ ID NO: 151439 - protein, 38 aa, Glycine max
  Coding DNA Sequence Number=SeqID_34661
MAKIPLRHFTEHLVGALSGTNNKGMGAMWLAPSSQNTT

SEQ ID NO: 151440 - protein, 599 aa, Glycine max
  Coding DNA Sequence Number=SeqID_34662
  Gene Ontology: Mol. function=GTPase activator activity; Cellular component=intracellular; Biological process=regulation of small GTPase mediated signal transduction
  Homolog annotation: Hit_ID=Q2HUD0; Match level="QueryCoverage=97%, HitCoverage=56%, E-value=0.0, Identity=87%"; Hit description=WD40 -like
MYMAYGWPQVIPLEQGLCPSAQKIVYLKVINRTLLVVSPTHFELWSTSQHRVRLGKYKRDSDSLQREGENLQAVWSPDAKLIAILTSAFFLHIFKVQLSDKRIHTGGKQPSALCLATISLLLTEQVPFTAKDLSVSNIVSDNKHMLLGLSDGTLYSMSWKGEFYGAFQFYPQPTASFDNSQMPLTLENGLSPKSHPKVLMSNHIIPRKSEINQLELCLPLRFLFVLYSDGELVSCSVSKKGLKQVDCIKAEKRLACGDAVCASVALEQQILAVGTKRGIVELYDLAESVSLIRAVSLYDWGYSMDDTGPVSFIAWTPDNSAFAVGWKLRGLTVWSVSGCRLMSTIRQIGLSSVSSPISKPNHDCKYEPLMGGTSLMQWDEYGYRLYAIEVGSSERILSFSFGKCCLSRGVSGTTYIRQVIYGEDRLLIVQSEETDELKMLHLKLPVSYISQNWPVQHVAASQDGMYLAVAGLHGLILYDIRLKRWRVFGDVTQEQKIQCKAFCTAISFYIHGLLGLLVLSQLFGELTPSGNPDLQLSAVRELSIMTAKSHPAAMRFIPDQLPRESISNNLVLSDSLTREPARYSPCEQLHLLQFVLPFL

SEQ ID NO: 151441 - protein, 116 aa, Glycine max
  Coding DNA Sequence Number=SeqID_34663
  Homolog annotation: Hit_ID=Q2HUD0; Match level="QueryCoverage=83%, HitCoverage=8%, E-value=4e-39, Identity=81%"; Hit description=WD40 -like
  Pfam annotation: Domain name=RIC1; Domain location=1-116; Score= -69.3; E_value=3.5e-08; Accession=PF07064.4; Description=RIC1
MYMPHLGATNRDKIEEALRLAELSAEKPHFSHCLEWLLFTVFEADISRPNVNKNQISVVKHAKRSLLEKTCDLIRNFPEYLDVVVSVARKTDGRHWADLFTAAGRSTEYVLQASML

SEQ ID NO: 151442 - protein, 178 aa, Glycine max
  Coding DNA Sequence Number=SeqID_34664
  Homolog annotation: Hit_ID=Q2HUD0; Match level="QueryCoverage=93%, HitCoverage=15%, E-value=2e-81, Identity=93%"; Hit description=WD40 -like
ATLDESLYELAGELVRFLLRSGREYDQASNDSDKLSPRFLGYFLFRSSEQKQSLDKSTSFKEQSSHVTSVKNILENHASYLMSGKELSKLVAFVKGTQFDLVEYLQRERYGSARLENFASGLELISQKLQMGTLQSRLDADFLLSHMCSVKFKEWIVVLATLLRRSEVCLASVYMTEI

SEQ ID NO: 151443 - protein, 257 aa, Glycine max
  Coding DNA Sequence Number=SeqID_34665
  Gene Ontology: Mol. function=oxidoreductase activity; Cellular component=integral to membrane; Biological process=electron transport
  Homolog annotation: Hit_ID=Q5XMI8; Match level="QueryCoverage=95%, HitCoverage=34%, E-value=7e-72, Identity=54%"; Hit description=Iron reductase
  Pfam annotation: Domain name=Ferric_reduct; Domain location=177-257; Score=-1.0; E_value=0.0013; Accession=PF01794.9; Description=Ferric reductase like transmembrane component
MDVEAVKRSPSQEKYGRVQSAIRLLVLVVFLGWIFVWIVTPTNTYQQKWQPRLQAKTNSIFGAQGAMLLVYTFPILFIAVLGCVYVHIAKKGNGFGKESSYGKKREVSIWKRLVLVRGPLGIVSGTEMVFLLMFIVLLVWSFSIYLHNGFAKITHKSAAEHGLKVWEKKLDIASVRLALVGNICLAFLFFPVARGSSVLPLLGLTPESCIKYHIWLGNVAMTLFTAHGICFIIYWTVTDKLSKVLKNPYYYLSFGAL

SEQ ID NO: 151444 - protein, 311 aa, Glycine max
  Coding DNA Sequence Number=SeqID_34666
  Gene Ontology: Mol. function=oxidoreductase activity; Cellular component=integral to membrane; Biological process=electron transport
  Homolog annotation: Hit_ID=Q5XMI8; Match level="QueryCoverage=96%, HitCoverage=50%, E-value=2e-77, Identity=66%"; Hit description=Iron reductase
  Pfam annotation: Domain name=FAD_binding_8; Domain location=1-87; Score=72.6; E_value=1.2e-18; Accession=PF08022.2; Description=FAD -binding domain
  Pfam annotation: Domain name=NAD_binding_6; Domain location=93-295; Score=88.5; E_value=2.1e-23; Accession=PF08030.2; Description=Ferric reductase NAD binding domain
  Pfam module annotation: Pfam domain module=FAD_binding_8::NAD_binding_ 6; Domain location=1-87::93-295
MTNKRVFSLLDLTYNPTSIMFINVPSISKLQWHPFTITSNSNLEPKMMSIVIKGEGTWSQKLYQMLSTPSAIDHLNVSVEGPYGPASTNYLRYDTIVMVSGGSGITPFISIIRELLYLNTTFRYRTPKVILICAFKNSYYLSMLDLILPNSGTPYDMSNMQLQIKAYITRKEEHRLENQIHLQQIWFKPKATDAPISAILASAAVLWNKKYNDREAKQIQNLEGSSSAESPKLNTDEGDKELESLPQQSLVQATKVHYGARPDLRRLLLELEGSRVGVFVSGPKKMRQEVAAICSSDLGENLHFESFSFNW

SEQ ID NO: 151445 - protein, 69 aa, Glycine max
  Coding DNA Sequence Number=SeqID_34667
  Gene Ontology: Mol. function=oxidoreductase activity; Cellular component=integral to membrane; Biological process=electron transport
  Homolog annotation: Hit_ID=Q6T303; Match level="QueryCoverage=98%, HitCoverage=9%, E-value=6e-18, Identity=62%"; Hit description=Ferric reductase
MVPINQEEVETGENSACIENAHVKDEEDNEEGVEVVSVEEELKNFSPIARDGCNPHAQTSKQSNLSSYI

SEQ ID NO: 151446 - protein, 97 aa, Glycine max
  Coding DNA Sequence Number=SeqID_34668
  Homolog annotation: Hit_ID=Q1SI78; Match level="QueryCoverage=59%, HitCoverage=5%, E-value=4e-09, Identity=59%"; Hit description=Nop14 -like protein
MASIPAERARVERKTGIIYPAIPIKKGSGRKLSKKSKYHLSDGEENDFEGIDSLGRDDFEDEMLPDDIDAETDEKLDLVQRSMQIPGETSADDGEEN

SEQ ID NO: 151447 - protein, 270 aa, Glycine max
  Coding DNA Sequence Number=SeqID_34669
  Gene Ontology: Mol. function=protein binding; Cellular component =nucleolus; Biological process=ribosomal small subunit biogenesis and assembly
  Homolog annotation: Hit_ID=Q1SI78; Match level="QueryCoverage=93%, HitCoverage=26%, E-value=1e-113, Identity=80%"; Hit description =Nop14-like protein
MYLIYKIPEFRQSRKFCPEAIIFLRTSLLAATESKHVSDEDSQLYHLMELKAIKPLLCIQETVNEISPLNFFKIIDMPEDSSFFTSVSFRASVLVAVVETLQGYVNVYEGLSSFPEMFLPIFKLLNEIAEQKNMPNVLRDKIKDVAELIKLKVDEHHTLRRPLQMRKQKPVPIKLLNPKFEENYVKGRDYDPDREQAELRKLKKQLKCEAKGAARELRKDNYFLLEVKEKERSLQEKDRAEKYGRAKAFLQEQEHAFKSGQLGKGRKRRR

SEQ ID NO: 151448 - protein, 301 aa, Glycine max
  Coding DNA Sequence Number=SeqID_34670
  Homolog annotation: Hit_ID=Q1SI78; Match level="QueryCoverage=97%, HitCoverage=30%, E-value=9e-62, Identity=46%"; Hit description=Nop14- like protein
RHKSKKEVMEEIISKSKFYKVWDISVIKAMAQKAKDKEENENLVEELDKDFTSLVQSEALLSLTEPNKMNALKALVNKSISNDQSNKDQMSATRTMDNSVQEKPDDYDKLVKQMGLEMRARPSDRTKTPEEIAQEEKEGLEQLEEERQKRMVAAEDSSDEDNEDSEKPFEQKPRSISGDDLGDSFSVNEQIMTKKGWVDEILERRDEEDSSSEDDDGEDPDNLGSSEDADEGSDEDLDEHEKDLSLKDWEQSDDDDIGADLEDEDDSDENIETAAEDLDEVKGSDAAVHIKKQKEMLLLKV

SEQ ID NO: 151449 - protein, 170 aa, Glycine max
  Coding DNA Sequence Number=SeqID_34671
MESSIVDASAVSRKRRRDEEEEEELEQVFFIIVSVVTMLLGALTWYHDKYFVKKPVQNLELERHSFLNRFKVIPNWDDIVDLCVKDRATGLGAENALDADDIMSKETNEEEAIHSVSFDLEGSSSAMRKNIRPSKSEEKEGMISSMKEVAESLKEFVEVTKKMENKKRWR

SEQ ID NO: 151450 - protein, 173 aa, Glycine max
  Coding DNA Sequence Number=SeqID_34672
  Gene Ontology: Mol. function=oxidoreductase activity; Biological process=metabolic process
  Homolog annotation: Hit_ID=Q1SMR0; Match level="QueryCoverage=50%, HitCoverage=27%, E-value=4e-36, Identity=85%"; Hit description=Short- chain dehydrogenase/reductase SDR
  Pfam annotation: Domain name=adh_short; Domain location=9-150; Score=- 34.8; E_value=0.0011; Accession=PF00106.15; Description=short chain dehydrogenase
MHRWWSKETVAVVTGGNRGIGFEICRQLAGHGVTVVLTSRDESVGVESAKVLQEGGFTEVACHQLDILDPSSINQFAEWLKENYGGLDILFHVNWPFLKAKFQVLMIWMLLLGYLASMNPLDVIQTRDGGYLASMNPLDVAMARKEAPKLAMQMSRPFVLASYQSLTGFKLYL

SEQ ID NO: 151451 - protein, 93 aa, Glycine max
  Coding DNA Sequence Number=SeqID_34673
MVWIPRITPPQILPKTSALVQLSAVVSGDCIGKEEEKEGDCVRISIGSLSLLHSCKVSHSSLSLGTISPSALFRKRCRSQARSVLASTNALFK

SEQ ID NO: 151452 - protein, 46 aa, Glycine max
  Coding DNA Sequence Number=SeqID_34674
MDEYQQNWKEMFNTMKKINKKVEKMFNPVHVMDQPFSEVSRSFVVR
